United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 2

SEQ ID NO: 4173 - DNA, 2928 bp, Glycine max
  Peptide Sequence Number=SeqID_120951
gagctcgtcactcaattgcgccttccttgtcagcccactccttcaccactacgtgttatggtgggaaatggtctgaatcttcaatgcaccagcttttgcgaagccatcattctcgacattcaatccactcagttcactatggatttgcatgtcctgcccattgtcggagcaaatgtggttttgggagttcaatggttgaaatccttaggacccattctcactgattataactccctttgcatgcaattcatttatgagggtcgtatcatcacacttcagggagacaaggaattcactctaaacccgataacttcatctcaatttcgtggtatgtcgcagacaaaagagacaggcctgtattgccatatctcccttattgagactgactccatcacatctcagaacttccatccggatattcaaaagctcctcaccaagtttgcgagcttgtttcagcaaccaaacaccctacccccggaacgtgaaactgaccatcacattcatcttcttcctcacttagctcccgtcaatgtccggccatacagatatccccactttcagaagtgtgaaatcgaaacacaaattgacgcaatgctccaaaagggtctaattcaaccaagcaccagccctttctctttctcggtgttgctggtgaagaagcacgacggcacatggcggttctgtgtggattaccgcgccctgaatgcaattatgattcgtgatcgtttcccaatcccaacgattgatgaactcttggatgagcttggtggtgctcgctgcttctctaaactcgatttattgcagggatatcatcagatacgcatgcattacgatgacatcccgaagactgcctttcgcacccatcatggccactacgagttcaaagtgatgccatttgggttgtgtaacgcgccttcatccttccaggccacgatgaacgccattttctgcccttacttgcgtcaatttatcattgtactctctgctcaccactttgttctgaaactcaccaagtgcttctttgctcaagatcaggtggagtacttgggccatttggtgtcctaccgtggtgtggagcccctcgcatcaaaagtggcagccatccataactggcctatacctcagacaactcgagcaactgcattcgatcagctcaagcaagctctctctcacgcacatgttttggccttaccggacttcaccatgccgttcaccgtggaaacggatgcctcagggattggaatggggaaagtcttttcccagaacaatcaccccatagcattcttcagtaagtcttttcctccgaaactgctacgggcttcagcatatgtccgcgagctcttcgccatcacagctgccgtaaagaagtggcggcagtatctgctcggccatcgtttcaccatcattactgaccaccgaagccttaaggagctgctaactcaagtcatccaaacaccagagcaacacatttacttggctaggttaatgggatatgattatcaaatccaatatcggaccagtgcccacaaccaagctgctgatgctctctcgcgatgctttgaccaagattccactctgcttagcctttcagtgccttgccccttgtttctgactgaattgtacaaccaattggatgctcaccaggaatataatcaactacgacaggaaattctgaagaatcctgagaaacatgctggtctctccctcgctcagaaattgatccttcgcaaaggacgaatttggttacccagagacttggaaatcatccccatattgctggtcgagtatcacaccacaccaactggtggtcacatgggggttgcgaaaaccatagcccgcttaatggaaaattttgattgggaaggacttcgagcagatgtcactaagtttgtggctcaatgtcttgattgtcagtacattaaatatgaaacgaaaagagtagctggtctcctgtgtccattgccggtaccgcatagaccttgggaggacctttcactggacttcatcaccggacttcccccttatcacggcaacactgtgatactagtcgtggttgattggttttctaaaggaatacatttaggtatgcttccggcgtccctcacagctcaagttgtagctaccttattcatggagatcataggcaaaatccatggcctaccaagaagcttggtctctgaccgtgacccgctatttgtcagcaagttttggcaagaactattccgtcggagtggaacgcagcttcgaatgagctctgcctaccatccgcaaagtgatggtcagaccgaggtgctcaatagagtcattgaacaatacctgcgtgctttttgttcatcgccagccacgcgaatggggataatacttgctttgggtagaatgcttctgcgggctcaagaacggatgaggaaggtggcagacgctaaccggagagaagtgaattaccaaataggggattgggtaatgctgaaactacggccctaccgccaagtctcagccaaaggacctcaggcgacaatgggcaagttgaccaagagattctatgggccgttccaaatcttagatcgtattggcaaggcagcatatcgcttgaagttgccggaaggaactcgcatacatccggtcttccattgttccttactaaagccttttaaaggtaatcctgaacaaggatctgaaagcaagctccctgggaagttctggtgcaatgggaagggttattgccagaagaaacatcctgggaagactggaagcagctgtgagcagattatcaccttgaggacaagaccaagaacacgaaacaagggtgcagtcacaaaacacatgggtgcagtcagtaggaaagccctagagggtcatcacaagaccttcttacctcaacgactacatatgatgaggggacaacatgatcacaatagaattagccaatga

SEQ ID NO: 4174 - DNA, 1011 bp, Glycine max
  Peptide Sequence Number=SeqID_120952
atgagagaatgcattcttggcaacttcagaagaagattgcttggtgttctgaaaactgataatgatcttcaacggccaactgttctggaatcactgattaagagacatattagcattgtgcatcttgcagagcagcacatcagcatggacattactcagggaattcgggaagttttgctttcagaagcctttccaggaccagtttcttctctgcacttgtttgagaagccaacagatcaacatacaggattggctactgaatctgtatgcaattggtacattgaaaacataatcaaggatgtttcaggtgctgggattttgtttgttccaattcataaatgcttcaggagtacaaggccagttggtggatattttgcagaatcagtcactgatctcagggaattacaggcttttgtacgtatttttggtggctatggtgtggacaggttagaccgaatgctaaaagaacacacagatgctcttttaaattgcattgacacttcactacgctcaaaccgagatgtgatagaagcagttgctaccagtctgcatgctggtgatagaattgaaagagaagcttctgtgaagcaaatagttgatctggaaactgggattggtttttgtgttcaggctggccttgcactggcttttgatcagctactagctgaggcttctggtgctatactcgaagaaggtgctcccttgatacattcgttgctagatggggttgttaagcatctacccgatggagtaccagaaaaggaagaaatcaggagaatgagaacagtggcaaatactgtaggtgttaataatcatgattcagtttgggtaagatcaattttggaggaagttggtggtgcaagtgatggatcatggggcttgttaccatacttatttgccacattcatgacatctaatatttggtccaccacggcatttaacgttgacacagagggttttagtaacaatatccattgcttggcaaggtcagtatggttatattttggctga

SEQ ID NO: 4175 - DNA, 873 bp, Glycine max
  Peptide Sequence Number=SeqID_120953
accctcgatgttacgagcaaggacctctacagttctgaccctactgtcagtcccgttgatttctctgacccctctgccactgactccgacaacaacagggggattatcattgtgaagttgcggcgcggacaagagctgaagctgagagcgatagctaggaaggggattgggaaggatcatgctaaatggtcacctgctgcaactgtcactttcatgtatgaaccggagattcatataaatgaggatttgatggaaaccttgactctggaagagaaaagagaatgggttgacagtagtccaacccgtgtctttgaaattgatccagtgacacaacaggtgatggtggttgatgctgaggcatacacatatgatgatgaggtgcttaagaaagcagaagctatgggcaagcctgggcttgtagaaatcattgcgaggcaggatagcttcatattcactgtggagtctactggagcggttaaagcttctcaattggttctaaatgccatagaaattctcaagcagaagctggatgctgtgaggctatctgaagatacagtggaggctgatgatcagtttggcgagcttggtgcacatatgcgaggagtggactggggccagtgcttcctgaagttgagccttcaacagattttaccctactacggctggcactgtaatcctaaggcccagaacagcgaacgttcctttgcttgttgtccatgctcctcaagctgccaatatcagcttcatagaggtgctcctggctatgtgacgatgatccttcgaagtaccctgattcgtgcccataatactgtggtgagtctccaccacgaggatgccttaagacaggagaagcatgtgcgagcaacacggcag

SEQ ID NO: 4176 - DNA, 1368 bp, Glycine max
  Peptide Sequence Number=SeqID_120954
atggctaacctgcaaatggtcaactatgcagctgctgcttcttcttcttcttgtgtggcttctctcaaaagttatgatgtttttcttagctttcgaggcgaggacactcgcggcaacttcacaagccatctctacgatgctctcatccaagccaaacttgaaacctacatagactacaggcttcaaaagggtgaggaaatctcgcaagcactcatcgaagccattgaagagtcgcaggtatccgttgtgatcttctcagaaaagtatggtacctccaaatggtgcttggatgaaatcaccaagattatggaatgcaaggagggtcaaggacaagttgttatacccgtcttctataaaatagatccatctcatataaggaagcaacaaggttctttcaataaagcatttgaagaacataagcgagatccgaatatcacaaatgatagggtgcaaaaatggagaagtgctctcacaaaagcagccaatttggctgggtgggactcgataacttataggaccgaggccaaattcattaaggacattgtcaaagatgttttatacaaactgaatctcatatacccgattgaaacgaaaggactgattggaattgaaagaaactatgcggagattgaatcactgttggaaattggctcaagggaaattcgagtgattggaatatggggcatgggtggcataggtaagactaccctggcaatttctttacatgccaaactattctctcaatttgaaggccactgctttctgggaaatgtaagggtacaagcagagaagcatggtctcaatgccttacgcagaacacttttctctgagttgttcccaggagaaaatcttcatgtacatgtgcccaaagttgaatcccattttataacgagaagacttaaacgcaaaaaagtttttcttattttggatgacgtggcttcctcggaacagttagaagatctaatcggtgatttcaattgtttcggaccaggaagtagggtgatagtaacaactagagataaacacatatttagccatgttgatgagatatatgaggtaaaggaattgaaccaccatgactctcttcaacttttctgtttgaatgctttcagagaaaagcattccaagaatggatttgaagagctatcagaaagtgtacttgcctattgcaaaggcaatcctttggcgttaaaaattttgggtgcatgtcttcgttcaagaagtgaacaagcatggaacagtgaattgagaaagcttcaaaagattccaaatgtgaaaattcacaatgttttaaaattgagttttgatgatttagatcatactgagcaggacatatttctagacattgcatgctttctcaaaggataa

SEQ ID NO: 4177 - DNA, 240 bp, Glycine max
  Peptide Sequence Number=SeqID_120955
atgaggcagactagctgggagagccacgtagttcgttctctcactgtgggaatcacttccccctccgcgtcaacatcacggtttcaacttgaatcagtcacgcttcagaaggtcgtcgaacctcggcagcagcttcgccaaccttgccaagaagaggaggggactgatggttcgtcggaggaatcgttgcaacaggatcaggaaagagacgggcagagaagaaaaaaagaaaaagagtaa

SEQ ID NO: 4178 - DNA, 1299 bp, Glycine max
  Peptide Sequence Number=SeqID_120956
atgtataggggtcactctagaatccttcaaagcaatggtgctatcaccaacccccctattgtttctccttcttcttcttcttcttcttcttcaccctcagtgccttatgtgtctaactaccagaaacaaacagctccatccccaagttcttcatctgggaacagaataagccctgcaattcttttcatcatagtaattttagctgtgctgtttttcatcttgggtctccttcacttgcttgttagatttctcataaagcaaaggtcttcttccaataattcatcaattccccaatcaaatagataccctgacatgtctgattcagatgcttaccaaagacagttacagcaactcttccatcttcatgactcaggcctggatcaggctttcatagatgctctccctgtcttcttttacaaagagataattggcttgaaagagccttttgattgtgctgtttgcctctgtgagttcttggaacaagacaagctcagattgcttcccatgtgtaaccatgcttttcacattgaatgcatagacacatggttgctttccaattcaacttgccctctttgtagagggactctctattcaccctttgaaaactcagtttttgactttgaaagtcaacttgaggaagatgggatgtcaggaagtggtggaattggttctgttaacaaaactacagaaagtcacatagtgaatgggaaaagggtgttttctgttaggcttggaaaatttagaagcactaataataatcaagatgggatggtggtggagagaggtgaaggagagagtagtactagtagtgttaatttggatgtgaggagatgctattcaatggggtcttttcagtatgtggtggctgattcagatctgagagtggctttaggcactagcagtggcagcatgagacaactgaagggaagaacagccacaaatggaagttctttcattgatggagatgctgttgagggcaagaaaatcaacattgcaaggaaaggtgaaagcttttctgtttccaagatctggcaatggtctaggaaagataagttgacaggttcatcagatgctcatttccttaatagttctactgtcacttcaactttgccatggatgaataaagccagaggagtgatagaacttgtaaattgtgccataaacataatcaggcaacgagaattaaaaattaatcttgagtgtaatcaatcacctgttttgctcacagagagctcaatgttcatgaaaagctataagctagtagaggttgtaatgaaaaagagtatagttagtgcttga

SEQ ID NO: 4179 - DNA, 1002 bp, Glycine max
  Peptide Sequence Number=SeqID_120957
atgggttggaatattgttcaacaagaatctatcgaagatcctggtaggcgaagtcgattgtgggatcctgaagaggtgtatgatgtgctgaaatataacaggggaactgaagcagtagaaggtataattttggatctgtctaaaattgaggatctacatttgagctttaattcctttagaaagatgtctaacataagatttcttaaattctactttggaggggagtggagtagcagatgtaaaatataccttcctatgaatggtcttgagacattgtctgacaaattaaggtaccttcattggcatggatattgtttggagtctttgccatcaaccttttctgctaaatttcttgttgagcttgccatgccctacagcaaccttcaaaagctttgggatggagttcagaatcttgtgaatttaaaggacattaacctcggattctgcgaaaacctggttgaggttccagacttttctatggcgtcaaatctcaaagttctggatttagaaggctgcactgagatagaaagccttcaaacagacgttcacttaaaatctctccaaaacctccgtcttagcaactgctcatccctcaaggatttttcagtatcttcagtggaacttgagaggttgtggttagatggcacacatatccaagaattgccctcatcaatttggaattgtgcaaaactcggtcttatcagcgtacgaggttgtaacaatctcgacagttttggggacaagttatctcatgattcgagaatggcatctttaaataatctgatactttctggatgcaaacaactcaatgcatcgaatctgcattttatgattgatggtttgcggtctttaacattgctggagttggaaaattcttgcaacttaagaacactccctgagagcattggctcgttatcatcattgcagcatttaaaactaagcggaagtaatgttgagagcttgcctgcaagcattgttaagagtcccacatcgggtagttaa

SEQ ID NO: 4180 - DNA, 822 bp, Glycine max
  Peptide Sequence Number=SeqID_120958
atgtcaaaagaaaaagactcagatgacaatcaagtggatacattttctgattcagtcatgttggagagatttcatactcttgtggagattgacaatctgaatcttgaaccagattgggacccaattacggagcttgagagcatcttatctgatagttataatatgtcttccatgtccactcactcagcaactatttcacaaattgaagtccatggtacaaatgtggcagctatccttgaaaaattggaggtccttttggaaacctcccttgaaattctctcttctgatgatgaagtcaagcaacaattccatcatgttttggagcaacttaaccaatttaaagatcaaatccctgtcaggcttcatgctgtgatttacaagttaaaaagtttcattgaagatgttgatatcagatatgcaactgcccaaagaactatccaagactatgatcaactgctacagtcaaggtctcttctatcaaagaatttggaaagtgccaaagctcaacaggacaaaattaatttgaaagtctcggaaggtaaaatacaatttgaaaagattaattctgagattgatgaactagaacacaagttatgtactttggttatgactagagacaagctaaagagagccttggacaattgtgctgctgaaaacaacaagttaaagactcaggttgccaaatgggtgccagaatgcaagagtatcatcacagctttgaaggagtatgagacttcttacaaagtggccctaaccaataagaggaaaaccgaagatgaatgggctgatctgaagaagacctttgtagctaataagatttga

SEQ ID NO: 4181 - DNA, 336 bp, Glycine max
  Peptide Sequence Number=SeqID_120959
atggccggagaaggtgccaacgtgtggcagctccaatggcgccggagaaaggtgggcttgactgggcgacgaggacacaaatcaggtggtgctagcagtgacagcttctgcacagcagagtatggttcaccggataagaacactagccagaaaacatacacagtttgccagaagaagggcaacgagtggaatggtccaccggaaactggaaaaagaatgataaaagaaaggcagcgaccaaaagggctcagtggagacagtgggtccccggtgaggaacgatttttccttattccctcagcctagctctagatatcatgagatattgttcctataa

SEQ ID NO: 4182 - DNA, 1123 bp, Glycine max
  Peptide Sequence Number=SeqID_120960
tccttcgctaaccattaatcacttgctttttcagtcagttccaatctatgtgtctgaaatggccccttataaataccgtggagctctaaacatgtgcttccaattgtcaatcacaataggcatctttgtggccaatttgttcaactactacttttccaagatactgaatggtcagggatggcgcttaagcttggggctaggtgcagtccctgctttcttttttgtcataggctcattttgccttcctgactcaccaagctcccttgttgaacgtggccatcatgaagaagccaaaagggagcttgtgaaaattcgcggtacaactgaagttgatgcagaattcagggacatacttgctgctagtgaagcttcacagaatgtgaaacacccttggagaaccttgatggacagaaagtataggccacagcttgtttttgccatatgcattcccttcttccagcagttcactggcttgaatgtgattactttctatgctcctattttgttcagaacaattggttttggaagcagggcttctctcatgtctgcagtgatcattggcagctttaaacctgtttcaaccctggtttcaattcttgttgtggataaatttggaagacgcacccttttcttggagggtggtgctcaaatgttgatttgccagatcatcatgacagttgctattgcagttacatttggtaccaatggaaacccaggtacactgcctaagtggtatgcaattgttgttgtgggggtcatctgtgtatatgtttcaggttttgcttggtcttggggtcctttagcctggttggtacctagtgaaatctttccccttgagattagacctgctgctcagagcatcacagttggtgtcaacatgatcagcactttcttcatagctcaattcttcacatcaatgctctgtcacatgaagtttggtttgttcatcttctttgggtgctttgtggtgatcatgaccacattcatctacaagttattgcctgagacaaagggtatcccacttgaggaaatgagtatggtttggcagaaacaccccatctggggcaaatttttggagtcagacatcacaacccaaaatgacaaaatcaacggaaaatgttga

SEQ ID NO: 4183 - DNA, 954 bp, Glycine max
  Peptide Sequence Number=SeqID_120961
atgggatttaggaatcttcatggcttcaaccttgtcatgctagggaagcaaggattgaaattatccacaaatgaagatgctatggttactaaaattttcaaagttaaatatttccccaaagttgggttcttgtatgccaatttaggacacaatccaagctacatctggcgtaacatccacacttcgcaggttccggtcaaggaaggaatgcactggagattaagaaatggacataaaatcaatatttggtcccaaccgtggacgaacatcatttcacaaattcttaacaaagctgactcccaagctattcaagctactccgcttttgaacaccacctcggatgatgttttgagatggaaattcagcagcattgaaatatacacagtaagatcttcttaccaccatttgatggagaacatgatcaataatgatgattataaggttcctgctgattggattctcttatggcaactcaaagttccaccgaaaattaagtacttccgaggagggcactgcagcattttatgtgagtactgtcatctggaaaattcatggcatgtcatttttggatgtgagcatagtctttcccaggaactcccagtgaaatttgttatgttgctttggtgcatttggcgttgcatgaaggacaagatttggaacaatatcgacttgcagcaccatgtttcaataagtctcatgatgcaatcttacgttgagtggtgtcatgcacgaataggaaatagagaccacaaccgaaaccatcatcaaccagcttctctaacctggcataaaccaaacgaaggctacatcaaatgtaatattgatgcaacactcttcaaagaaaacaacacttttggagtgggtatttgtctacgtgggcatcaaggagattacatttgcccaagaacttttcactccaaaggggttccgaatccacgaacagcagaagcttga

SEQ ID NO: 4184 - DNA, 210 bp, Glycine max
  Peptide Sequence Number=SeqID_120962
atggatgaagatacaccaagagaagttggtgtctgtgatgataatggaggttggcggttaaatagattttctcaatacctgcctgatgatattaatttgaaggtaatgcgaatgacctctccggactccaattccgagggggagcaaaccagtgatgcaatggagaggcacagagagaataaggatgttcctatggaaaatctgccatga

SEQ ID NO: 4185 - DNA, 948 bp, Glycine max
  Peptide Sequence Number=SeqID_120963
atggagaagaaaacaagtgtccaagagtcacgtaaattcaaccaattatttttccccaagcaacacaacaaagtgtacccaattaggctacagagaagctcttcaacttcatccttgtcttcattatcatcatcattgtcacaaaagtcagatgactcttctctaacagattccttgaatctagcagatgagagttttcaatttgcactgaatttgatttcgccgcgttgtcaaagaagagaaccagaaattattaatgatgcacaccaacaacaaattccacagactgctgaggctggtgaattgaaaaggtgcaactggatcactaagaactgtgatgaggcttacattcaatttcacgatgagtgctggggagtcccagcttacgatgacaaaaaagtttttgctggatttgatcctaatactgtggccaaaatggaggagaaagaaatcatggaaatagcatcaaacaaagaagttttgttagccgattgcagagttaggtgcataattgtgagggaatgtggatcattcagctgctatatatggggctatgtgaatcacaaaccagtgattaacagatacagatacccaagagatgtccctctaaggactacaaaagcagataccatcagcaaggacttgataaagcgtggctttcaatttttgggtccagtgatagtttattcttttatgcaagctgcaggattggcaattgatcatcttgtggattgttataggcacaatgaatgtctattcagttttccatacatgcctattctagcaagagagggagagtcagccttgaggccttggttgtggaacactacatgtttggtatgctatatagtcatcctcaaaaactggtgtgaaaatggctggttgttaaggtactttttgaataatgaggatcctgatgctgaggattttcttctatttgttcattga

SEQ ID NO: 4186 - DNA, 524 bp, Glycine max
  Peptide Sequence Number=SeqID_120964
atggaaactccaatcaagtatccgggcaatctcacccttagggtggttctcacttgcatcatggcagccagtggggggttgatttttggttatgaccatggagtttcaggtggagtgacctctatggattccttcctgaagcaattctttccgtctgtgtatgaaaaggagtctaacatgaagccttcttcaaacaagtactgcaaattcaacagtcagatactgacactgtttacatcttccctctatctaagtgctctagttgcgggtcttggggcatccagcataacaagaatgttgggtaggcgtgcaactatgattataggtggaatatgttttgttggaggtgcattactcaatggatttgccgtaagcatctggatgcttattgttggcaggttgttgcttggttttggcattggttgtgccaatcagaaacaacctctttgcatatgcaagtgtgaggctacttgcaatgaccctccctcagacctttgcatagcaaggagccttcaggcactagg

SEQ ID NO: 4187 - DNA, 195 bp, Glycine max
  Peptide Sequence Number=SeqID_120965
atggggttgtgcaaattgggtttatgggtattgtgttgtttaacctcgaaaatttcctctctgcttccgatcaaaatagacgaaacaagggtatttaaccctccaagtagcaaaccctcaccgttgcttgaatttcagtgcatgctttctgcggaagtgttggctttgattggacttaggaactccaaggcctag

SEQ ID NO: 4188 - DNA, 540 bp, Glycine max
  Peptide Sequence Number=SeqID_120966
atgaagcaggtgaagtctccactaactagcatacaatatttcttatcacaaaggcaatcaggcaacctccattcacaatctgaaccaaatcttaagagggagaatgtcaatgttgtgatgactagaagtaagaggattcaagaagactctcaggagaaggaagttgaggttcctgcttatgggaatccagtgtcaaagaaggaaagggatgaaaagaaaaaaatactagcatttccgcagaagttgggcgtaagagaattagaacctactaacatcactcttcaccttgctgatcgctcacttgtttatcctagaggggcgattgaggatgtgttggttaggcttggtagactcacccttagattaggggatgagaaagtgtatgcaaatgtctgtcctctagaaagagttatcactagtaaggaccttgactgggagttgaaccttgaaggaattgttctaaagctaaatcctcctgatgaggaacctcctgtttccgcggcaaaaacttgttcgggaataatgatccgcgaatgctaa

SEQ ID NO: 4189 - DNA, 603 bp, Glycine max
  Peptide Sequence Number=SeqID_120967
atgtggttgcctcataggaggctaaactccaacatgatggaggttatgaagggaaatatgcttaagttattggatgcaaacatcatctaccctttctctgacaatgaatggttcatggtggatgagtgcattgttcttggacataaagtgtcatctactagcattgaggttgaccctgccaatgtggaggtgattgcacaattgcctctgctcaactgtgttaatgtggtgaggagtttcctaggccatgttggcttctataagaggtttgagtttgacttagagataaaggacaagaaggggccaaaaaattttgtggcaaaccacttgtcttgccttgagccctttgttaagcaagctactgatgaaggaacaatacatgagacattcctcgatgagcacttgctagttatggctactctaccagaagcaccttggtgttccctccagagtttgagttctaggaaaggaaaagactggtggcagaggctaaacaacatttttgactatatgtctaagtgggttaaggtagtagcattacccactaatgatgctcgtagtgctcaggatgttaaacaagcacttccaagaggcatgctgtga

SEQ ID NO: 4190 - DNA, 1113 bp, Glycine max
  Peptide Sequence Number=SeqID_120968
atggaccagtctttgttgagtaatgtcatggtgtggacaacttctaataatatcttgcaacctttctcgggtttcaagtacactttcttcctccctatgcacaaagtttccaatgtccttgatgtactgatccgccttcataggagcgaaatacctttggctgaaattcctgagtacgactccgagatggaaagagcttgtcgcaggaacaatgctggcataaggaagagaaagatggctaaagcaaatgctggaaatggcaataatggaggcaatgaaggtaataaggaaaggttgaagattgcctcggtgacttgcgagttggagcattactacttaggatcaatgctcactagcattcttgaagaaattcctccttgtagcaaaaatatttgtctgaagcttgagagcaattcaaaggattacatagcctactccatggctatcccccatagagtaaagatcattgaggctatggcttctaatgtttacaatggtgtgggagacagaaggattctcaagaggcccactgaagttcatttgatgatggcactccctcgtccacctcatgtttgtgatgagagcggggaaacaagacatgtggtggaagactgcccatatactcatgccttggaagaggtgaaatatgttggtggaaatggtgctaactatgatccgtactccaacactttcaaccaagctctgccttttcaaactgagcccaaccttaaggagaaattgaagttagtgagcactaggagtgggaaaccacatgcaaagtacaagaagaaggagaaagtagcttctccaaagaaggaaaatgaggctcacattgaagaaagtcaaacaaagcacatggaagctcctactgagaggagttcaatgacaaggaaagaaaaggaggaaacacaacccataaacatcaccttgcagcttgttgacaagtttattgcctatcctaaaggcgtagttgaggatgtgctagttaaggtgaacacattaatcttttcggctgattttgtgatgctagatatagaggaagataaggatttctcaattatattgagactcccattcctaaatacttgtgacatggcaatagaggatatgtga

SEQ ID NO: 4191 - DNA, 603 bp, Glycine max
  Peptide Sequence Number=SeqID_120969
atgatgatagtagtgcctgtggaacaaaatttgagagctaaaggacaaaatatgggtggcgcgggaggttctcggtggctgagagagggtggcgatgctaaggatccagcggtttccgacggcattaattctgacattaatgaaagagataggagaaaagagtcatggaatttgctgtgtgacctagccaatgatacttctttcccttggttaacttttggggattttaatgacttactctccgacgatgagaaaattggcttgattgatcaccccatgtggttaataagaggctttcgtgagaccttgaatgactgcaacctatatgatctccccatgaagggttaccaatttacttggaatagaagtcgtggggagaatgatgggataaaggagaaattggatagaggggctgcaactttggattggattgatcttttcccaaatttcaaaatactcaatgggttgtcaccaaaatatgatcattctccaatcaccatgaagctaaatgacgtgaagagaagacattttcaaaaacatattcgctctgaaaatgcttggttccttgaaatcgagttgaatggggtggtgatggaagtttag

SEQ ID NO: 4192 - DNA, 474 bp, Glycine max
  Peptide Sequence Number=SeqID_120970
atgacgtcagaacacacattgtattgccccacttcttcatcgcaaacatttgacaagctgcagcacaattggaacgtgttcctgactcatacttcaggggaaggaaatcaatgtgctaacttcactaagttacatgcaggacaagcagcagcacaattggaacgtgttcctgactcatactctcaggggaaggaaatcaatgtgctaacttcactaagttacatgcaggacaagcagcagcacaattggaacgtgttcctgactcatacttcaggggaaggaaatcaatgtgctaacttcactaagttacatgcaggacaagcagcagcacaattggaacgtgttcctgactcatactctcaggggaaggaaatcaatgtgctaacttcactaagttacatgcaggacaagcagcagcacaattggaacgtgttcctgactcatactctcaggggaaggaaatcaatgtgctaa

SEQ ID NO: 4193 - DNA, 969 bp, Glycine max
  Peptide Sequence Number=SeqID_120971
atgttctacttgcttgtgttcatgtgcttcggggaacgactcgacaatgggaaagtcagagacatcgaacgcgtgctgcgccaaatgcttctgcggtttggcaggttcaacattctcaacttttggcctaaagtcacgatgattctgctccacaaacgttgggaggagttgtttaggtatcggaaggagcaagaggatgtcatggttccgattataagagccaggaagcaaaagcgagccaaagaaggtgttggattaaacgacggcgttgttgtttcgtatgttgacacgttgttggatttgcagttgcctgaggagaaacgggagctgagcgaagaggaaatggtgacgctctgtaatgagtttatgaacgcgggtacagatactacttcgacggcgttgcagtggataatggcgaatttggtgaagtacccgcacatgcaagaaaaggtggtggaggagattagagaaatagttggtgagagagaagagagggaagtgaaagaggaagatttgcacaaactgagttatctcaaagctgtgattttggaaggattaaggcgtcacccgccagcgcacattgtgtcgcatgctgtgaccgaggacgttgtttttaatgattatttggttcctaagaatgggacagtgaatttcatggtggcgatgataggtttggaccctaaggtatgggaggatccaatggcgtttaaaccagagaggtttttgaatgatgaggagtttgatataactggaaataaagagattaagatgatgccgtttggagcggggaggaggatttgccctgcctataatttggctttgcttcatttggagtactttgtggctaatttggtttggaattttaagtggagggttccagaaggaggggatgtggatttgtctgagatactggagttcagtggggtgatgaaaaatgcattgcagattcatatttctcctcggatctag

SEQ ID NO: 4194 - DNA, 138 bp, Glycine max
  Peptide Sequence Number=SeqID_120972
atgcctctagccttctcaatttcagactctttctcagcagagaaagaagcagtagtgaaagctcaagctgttatgaagaattttgccgatgctaagcgaagggatgtgcaatattctgtggtgactgggtttatgtga

SEQ ID NO: 4195 - DNA, 315 bp, Glycine max
  Peptide Sequence Number=SeqID_120973
atgaataagaaagtcgaggaagatgttgaaatggagagggctaaataccgactacattctgtggaagcaatgcatttcaagattattttgatgatgccaaagaatctagagtcaaacaagtttcaagaatcaagaataatcaagatcaagattcaagattcaaaatttaaaatttttcaaaagaaaaatcttttaccaagagttttactctctggtaatcgattaccagaagacagtaatcgattaccaatagccaacattgttttcaaactgatttacaaagctgtaatcgattaccataatcattgtttctaa

SEQ ID NO: 4196 - DNA, 177 bp, Glycine max
  Peptide Sequence Number=SeqID_120974
atgacgagcagcgatcaccgtaccaaagggagacagaaagtgacagggaaggaggttggcgcagattgtcgaggtagggatgggagagcggcacagatcgtgagtgtttaccaacagttgataaaggctggtgtatccctcggcaaaagggttacgggctattctagcgagtgttga

SEQ ID NO: 4197 - DNA, 303 bp, Glycine max
  Peptide Sequence Number=SeqID_120975
atgtggtgtttttctttctctttctttttatcaatctccaccgcgctgcttattcaaattccttcttcgcgcttcacctccgttgtagctggtagaacccaatcaaccgacacggcaaggcacgaaattgtagttgaggttcggatggagttcgattttttggctgacaacattgggtggcggcagaggagcgcaacagagaagagacgggctccggtgaccgccatggcagcgggtgataggaacatgaaaaacatgcatatgaggaagctaaaggtgaatgagatattgtttgtgaaatga

SEQ ID NO: 4198 - DNA, 168 bp, Glycine max
  Peptide Sequence Number=SeqID_120976
atgagaagaaaagaatatgcttcccaaggtgaaactgaaattgaagtgttgagtggtggaagtggaggcgaggcggtgcagtgcatgcggcacagagggcgatggtcatggttatggatgaagttgggcaaagaggatgaagatgaagaggcaaagtgtgacgattaa

SEQ ID NO: 4199 - DNA, 1497 bp, Glycine max
  Peptide Sequence Number=SeqID_120977
atggaagcctggttcataatcctagtcactctttgtgtctgcgtgctgataagagccatactattctctcttcacaagaaaaccataaccatccctccaggccctcctcacatcccaatcatctcaagcattctatggctccgaaaatccatatccgaactcgaagcagttgtgaaaacactccacgccaaatatggccccatcatcactctccgcattggcactgagcccaccatattcattgccgatcactccctcgcccaccaagccctaatccaacacggttccctcttcgccaaccgccctaaggatggcggctttaaaatcctcaccaacaaccgacaccaaatcaactcctcctcctacggcgccacgtggcgcaccctccgccgcaacctcgcctcccaaatgcttcacccttcccgtgtcaagtccttctccggaatccgcaaggaagtcctccacaccctcctcacccgcctcaaatcagattctgaatcaaacaagtccataaaagtcatcgatcacttccaatacgccatgtcctgcttgctcatcctcatgtgcttcggtgaaccactcgatgaggggaaagtcagagaaatcgagctcgtgctgcggaaattgcttctgcactttcagagtttcaacatcctcaatttctggcccagagtcacgcgcgttttgtgtcgcaatctttgggagcagctgcttaggatgcagaaggagcaagatgacgcattgtttccgcttataagagccaggaagcaaaagcgaaccaacaacgtcgttgtctcctatgttgacacgctgttggagttgcagctgcctgaggagaaacgcaatctgagcgaaggggaaatttcggctctgtgtgccgagtttataaacgcgggttcggatactacttcgatgtcactgcagtgggtaatggcgaatttggtgaagtacccgcacgtgcaagaaagggtcgtagatgagattagaaacgtcttgggcgagagagtgagagaagagagggaagtgaaagaagaagacttgcagaaactgccttatctgaaagctgtgattttggaagggttgaggcgacacccaccagggcactttactttgccgcatgttgtggccgaggacgtggtttttaatgattacttggttcctaaaaatgggacagtgaatttcatggtggggatgatagggttggaccctaaggtatgggaggatccaatggcgtttaagccagagaggtttttgaatgatgaagggtttgatataactgggagtaaagagattaagatgatgccctttggtgctgggagaaggatttgccctggctataagttggctttgcttaatttggagtactttgtggctaatttggttttgaattttgaatggaaggtaccagagggaggggatgtggatttgactgagaaacaagagttcattacggtcatgaaaaatgcattgcaggttcattttattcctcggatctag

SEQ ID NO: 4200 - DNA, 396 bp, Glycine max
  Peptide Sequence Number=SeqID_120978
atgaccaaagtcacccatcaaaggctacaagaggtacaattgaaaaggagaagacgaaatatgggtattaaaatacagatgatgacagagcgaaaaggtagagaaaatctccaaagtgctacaaaggaggctgcaagaagattacatagaaagcaagttaggatgaatccttatgaagccaagctcaacttagaccaactcatttccacccctactactagtgtgtttggaaacctgctggtgttgctatactcaccagagagtgatgaacaaagtgtggaggacaaaaccctagagaatagaacagagcatgtgagggagaacgagaatgagcctctgcgagagagaagaactcatcgtggagagagcaaactgagtgagggagaacgagagtag

SEQ ID NO: 4201 - DNA, 255 bp, Glycine max
  Peptide Sequence Number=SeqID_120979
atggagtcatctaatgaaaagatgacgggcaaaagaaaagttttaggaaaaaataatgagaaacaagaagttattttacatggaatttggagatggaacgtgtattggttgatgtacttagagatcaaaggaatttgggcaacaagggtgacagaggtggaaaaggtgcttcacaactgggatgatatagtggatttgtgtgctaaagatagagccactggtcatggggctgaaactgccatggatgctgggtag

SEQ ID NO: 4202 - DNA, 225 bp, Glycine max
  Peptide Sequence Number=SeqID_120980
atgaatttaacccaacctcgtggctttgaaggattcaaaacgagcaccaagaggcaagaaggagttggtggagggaccatagaggaagttgggctattgttacgcgcacccagcataattgctggtacacccagaaaaatcatgaaattccatttttatccttctataaagctaatacggattaacgaatccataagtccaatactgattggaaaatctgtatga

SEQ ID NO: 4203 - DNA, 285 bp, Glycine max
  Peptide Sequence Number=SeqID_120981
atggcaaaaaatgccccacttctatcttcttccttaaaaagctgggtgaaggggccggtgttcattgttgcggtggttgatttgtcgtcggcgacatacgagggggttcttgagaacaagcataggcaaaaagaagaaaaattggaaggagcagcagctggtgtctcgctaagcctggaccatgcgcttagcaagtatcatccgctaagcaagacatcagcctgcttagcgagtaagggaaatcttgaagggaatctgccacgcaagcacgcgcccaatgcgtaa

SEQ ID NO: 4204 - DNA, 2901 bp, Glycine max
  Peptide Sequence Number=SeqID_120982
atgagccaccccttcatcaccctcttcgccaccatcatactcatcatagtttccctctcacaggccatcaccaccaagaataataatcagtcacagtttttctctctgatgaaggacttgtctctctcggggaaataccccacgaattgggacgctgcagggaaattagtacccgtgtgcggcttcaccggagtcacctgcaacaccaaaggtgacgttatcagcctcgacctctcagatcggtcatcactttctggaaatttcccaccagatatatgctcttaccttccacaattacgtgttctccgcctcggccacactaggttcaagttccccatagacaccatcctcaactgttcccacctggaagagcttaacatgaaccacatgtccctcaccggcacgctccctgatttctcttccttgaaaaaatccctcagggttctcgacttgtcctacaacagcttcactggccagttccccatgtcggtcttcaacctcaccaacctcgaggagctcaacttcaacgaaaacggaggcttcaatctgtggcagttacctgcggatatcgacaggttgaaaaaactcaaggtcatggtgctcacaacgtgcatggtgcatggccaaatccctgcgtccatagggaacataacttccctcaccgatcttgagctgagtgggaatttcctcacgggacaaattcccaaagagcttggccagctgaagaatttgcaacagcttgagctttactataactaccacctcgttgggaacatacctgaggagttggggaacctgacggagctcgtggatttggatatgtcggtgaacaagttcaccgggagcatccccgcgtcggtgtgtaggcttccgaagcttcaagtgttgcagctctacaacaacagcctcaccggagaaatcccaggtgcgattgaaaactcaacagctttgagaatgttgtctctctacgacaacttcctcgtagggcatgttcccaggaaactgggacagttctccgggatggtggttcttgatttgtcggagaacaagttttctggaccgttgccaaccgaggtttgcaagggaggtacgcttgggtactttctcgttctggataacatgttttctggtgagataccacagagttatgccaactgcatgatgctgttgaggtttagagtgagcaacaaccgtttggaggggtccattcccgcgggactccttgctttgccacacgtttcaatcattgatttgagtaacaacaacctgaccggtccgattcctgagattaacggaaattctagaaacttgtctgaactgttccttcagaggaacaagatttcaggtgtcataaaccccaccatatctagagccattaatttggtcaagattgatttcagctataaccttctgtctggtccaatcccttccgaaattggcaacctgagaaagcttaatttgcttatgctgcaaggaaacaagctgaattcctccatccccggttcactttcttcattggagtctctcaaccttcttgatctctccaacaatcttttaaccgggagcatccctgaaagcctctctgtgctgctaccaaactctattaacttctcacacaaccttctttcgggtccaattcctcccaaacttataaaagggggtttggtggaaagctttgctgggaatcctgggttgtgtgtgttaccggtgtatgctaattcatcggatcataagttccctatgtgtgcaagtgcctactacaagagtaagaggataaacaccatctggatagctggggtgtctgtggttttgatcttcattggctctgccttgtttctcaaacgtaggtgcagcaaagacactgctgcagtagaacatgaggacacactgtcttcttcgttcttctcttatgatgtcaagagcttccacaagatatctttcgaccaaagggagatagttgagtccttggtggacaagaacataatggggcatggagggtctgggactgtgtacaagattgagttgaaaagtggtgatattgttgcggtgaagaggctgtggagtcacgcgtccaaggattcggctccggaggatcggttatttgtagacaaggcattgaaagcagaggtggagaccctgggaagcataagacacaagaacattgtgaaactgtactgctgcttctccagttatgactgcagccttttggtttatgagtacatgccaaatggtaatctttgggattcactgcacaaaggttggatcctcttggattggcctactcgttatagaatagcactggggattgcgcagggtttggcatacctccaccatgatttgcttcttcctattatccaccgagatatcaagtcaactaatatcctgttggatgtggataaccagcccaaggttgcagactttgggattgccaaggttttgcaagcaagaggaggaaaggattccactacaactgttattgcaggaacatatggttacttagccccagaatttgcatattcatcaagggccaccaccaagtgcgatgtctacagttatggggtgattttgatggaactgttaactgggaagaagcccgttgaggcagaatttggagagaacagaaacattgttttctgggtttccaacaaagtcgaaggcaaggaaggggctagaccaagtgaggtattagatccaaagttgtcatgttcatttaaggaagacatgatcaaagtgttgcggattgctattcgctgcacctacaaagccccaacaagtagaccaaccatgaaggaggttgttcagcttctgattgaggcagagccacgcggttccgattcttgcaagttgtcaaccaatgatgtatcaaatgtcaccgtaataaagaaaccatatgaattataa

SEQ ID NO: 4205 - DNA, 1216 bp, Glycine max
  Peptide Sequence Number=SeqID_120983
atgagttgttattctctgaaactattttatgcacttttgctgcttttattgcatgctgctggatccattcttggattcaacagccttcccaatagcgcagaaattaagtgcattgagagtgagagacaagcactcctcaacttcaaacatggcctcaaagatgactctggcatgctgtctacatggagggacgatggcaataacggagactgttgcaaatggaaaggcattcaatgcaacaatcaaactggtcatgttgagatgcttcatctccgtggtcaggatacacaatatttgagaggtgcaatcaatatctcttcattgattgcccttgaaaatattgaacacttggatctcagctataatgcttttgaatggagacatatcccagaactcttgggctcgttcgccaacttaagatatctcaatctctctgtttgtttttttattgggagtattccttctgatattggaaagcttacacatttactgtctcttgatctaggtaacaatttttatctccgtggaaaaatcccttatcaacttggaaaccttacacatttacaatatcttgatctaagttataatgatctcgatggggaactcccatatcaacttggaaatctctcacagttgaggtatcttgatcttgcggggtggaattcattttcgggagcactccctttccaagttgggaatcttcctttattgcacactcttggacttggtggcaattttgatgtgaaatctaaggatgcagagtggttgactaatctttcttccttgacaaaacttaggctaagttcactacacaacctttcctcttctcatcactggctacaaatgatcagcaagcttattcctaacttaaaagagttgaggctatttgattgttctctttcagatacaaatattcaatctctgttttattcaccttccaacttctccactgctcttaccatccttgatctttctaaaaataagctcacatcctcaacatttcaactgttgtcaaactttagtcttaatcttcaggagctttatcttggtcataataacattgttttgtcatctcctctctgcccaaactttccttctcttgtgatccttgacctttcctataataatatgacatcatcagtctttcaaggtggtttcaacttcagctcaaaacttcaaaatctggatttgcaaaattgtagtcttacggatgaaa

SEQ ID NO: 4206 - DNA, 1450 bp, Glycine max
  Peptide Sequence Number=SeqID_120984
gagaatcgtcggtgatcgggccgtcgatgtaatagaagttgcgctgcacgctgtggccgttgtcctcgtaccacaggcccgcttccagctcgtggcccgccacgttccaggtgaacgcagaggtcacaccggtgcggtcgatcgcatactcggtggtgcggatcgatatcgggatctcgcggctggtacccgggttggacggattggacgggctgaaccagtggccctggccacggttgctgtggttgtagacgttgaccttcaggcgcatcgactcgttcaggccgaaatcgccggcgatgctggacaggtcgtcattgcgcaggccgtggccggagtagtacgcatcccacgggctgttgacgccgccgctgaacgtgccgcgtgcagcggccacggcacggttccagtccggcgcgtagttgtcccagtcccagccgagacgatcgatcatctccagcgacaggtcctggtaatcggcctcgacgcggcgcgaggcgttgaacagcgcggtaatcctgctgtccgttccgaagttgtaggtggccttgccgttgaactgcttcagctcctgcgagcccttgcccttccacttgtcgccttccgagtatgcgccggacaggtaggccgcaaagccctgatgttcaccggtctccaggcgcgcatagctgcggcgcgcgttgtcgctgccaaagccctgtgccagaaccacgccgtattcggtggacgggtcgatcgaatagaactggaacacgccgccaaggttgctggtggacggcgtacccagcgcgccaatgccggtggaaacctccgcgccgcccaggttctcgctgatcaccgcgcggctgatgtgcaggccgttgctgttgccgtaggccatgttgcccagcgggatgccatcaagggtgtagccgaggcggttctggttgaaaccacgcaggctgatgctggtggaccattcgtaggcgccggtggcatcggccgattcgaagtgcacgcccggcttgctggccagcagcttcagcgggttggcacccggcggcaggatcttcatgtcctcggcggtcacacgctgcacctggcgggcttcgccgcggccgatcaccgagatcgaatcgagggtggtggccgacggtgtgtcgatggcgggggcggtttcagcgacagccagcgacggcagcgaagcacagaccagcagggccagcagattgcggcggagcggagcgtgggacggcatgggggcggattccttgggcacgctggacgccgaagggcggcgtcgaagggcagcagcggcggaatcgtagaagcgtcgcgttacatgtcatttacacgccacatacggacgtttggtgtttggaatggtttgccggccaggaggagattgccggccagcggccggcacgcctgttactcgaacgagccgatcgaattgtgggccaggttgtag

SEQ ID NO: 4207 - DNA, 1134 bp, Glycine max
  Peptide Sequence Number=SeqID_120985
atggccgagcgttcacgccaggtgccgggtatcgaccctctgcgcgatgccgctctgtccttcgccgccagcgcggatgatccggccagcggtggccgccacaaggtgtggggcagcaagccattgtgggtgctgccgcagacctcgacgattgcttcgcacctgccgaaggcgctgggcaccgcgctggccatcgagagcggcaagcggttggggcaggcgctgccgctgccggcgccgatcctgttcgtctgcgaggacaacgggctgggcatttcggtgaagacgccggacggctggattgccgagcgcttcagccggcagccggggctcgactatttcttcgccgatggcctggacctggccaccgggcacgcccaggtgcaggccgcggtggaacattgccggcgcacgcggcggccgaccttcctgcatctgcgtaccacgcgcctgatgggccatgccggcaccgactttgaagtggaatggcgcgcgctgccggagctgtgcgcggccgaggcgcaggatccgctgctgcgctcggcgcagatcgcgatggaatcgggctggatggatgcagccgccatcgaagtggcctacgaaacgatgcgcgcgcgctgcatggcggcggccgccgacgccgaaggccacccgacgctgcagtcgctgcaggacgtgatggcgccgctggcgccgtacacaccggcggcggtgcaggccgaagcatgccgcgaggtgcccgccgagacgcgcgaagcgctgtatggcggtgcagagaccctgcctgagcggcaggcgccacggcacctcgccatccagatcaaccacggcctgcaggaactgctggcgaagtatccgcagagcctgttgttcggcgaggacgtcgcgcagaagggcggtgtctacaccgtcaccaaggatctgctgcgccgcttcggcccacgccgggtgttcaacaccctgctggacgagaccatgatcctgggcatggcgcagggcctggccaacatgggcatgctgccgattccggagatccagtacctggcctacctgcacaacgccatcgaccaggtgcgcggcgaagcgtgttcgttgcagttcttctccaatgaccagtaccgcaacccgatgctg

SEQ ID NO: 4208 - DNA, 435 bp, Glycine max
  Peptide Sequence Number=SeqID_120986
atggttggttgtttagagagagatacagaggtcgctaattcgacgcctggcgccgccattggcgacggcgcggcgcgattgaggcttcttcattctcttcttcttctgttgttcaccattgccacttcttcttctgattctgatcctgacttggagccccttcacatgactaaaaactgcgttcgagaactagaagccagtgaatcatcagcagacagaaaaatgcttcctttaagcgtagaaactggtggatgtgctggatttcaggtttttgagagggatggaattaagttggttgttgacaatatttcatatgattttgtgaaaggcgcgactgttgactatgttgaggaactatcttcgcattctttcctccacaggtattacaatacagaacttcatcataattttagcatggtagtaaataggaaataa

SEQ ID NO: 4209 - DNA, 2016 bp, Glycine max
  Peptide Sequence Number=SeqID_120987
atgtatattgcagcggaggatattgaagctggaactcctaagccaaagtttcagacggaacctactctgccaatatatctaaaggcaacgatgaagcttcatttagcgatcaacgccgccaatagaacatgttacatggctatcaatatagcatggtcaggttcagtcttgtacaaattcacagatgtaacctacaagttagtgatgaaaggcataactacaactaaggagaaggatatcttgaaggggatcactggttctgtaaatcctggggaagttttagcattgatgggtccttcaggaagtggaaagacatctttgttaaatctgctaggaggaaggttgattcaatgcacaattggtggctctatcacttacaatgatcaaccttattccaagttcctaaagagcaggattggattcgtgacacaagatgatgttctgtttcctcaccttactgtaaaagaaacattgacttatgcagccctcctaagattgccaaatacattaaggaaagagcaaaaggaaaaacgagctttagaagtcattgaagagctgggattggagaggtgccaagacactatgataggaggttcctatgttcgaggaatatctggtggagagaggaagcgagtttgtattggcaatgagatcataatcaacccttcacttctgtttcttgatgaaccaacttctggtttggattctacaacagccttgaggatagttcagatgctacaagacatagcagagttagtcattaaactcatgacatggaaagatgttagtctagactatggtttggtccaatttgagtttatcactaaccttttagtcttataccaggctggtaaaaccgtagtgacaacaatccatcaaccgtcaagcagactctttcataaatttgataagttgatccttctaggaaaagggagcttgctttactttggaaaagcatctgatgccatggactatttccagtttatagggtgtgcacctcttattgccatgaacccagcagagtttttattagaccttgcaaatggaaacgtaaatgatatttctgtgccatcagagttaaaggataaagtgcagatgggaaatgctgaagctgaaacatccaatgggaaaccatcagcttcagttgtacaagagtatctggtggaggcatatgattctcgagttgcagaaatagagaagacaaagctaatgattcctgtcccccttgatgaagaactgaagtctaagcaattttccatattattttctagaggattcagagaacggaggcatgactactttagctggttgagaatcacccaagttctagccactgcagtcatcttaggattactctggtggcaatcagatgctaaaacaccaaaaggtttgcaagaccaggcaggactgcttttctttattgctgtgttttggggattctttcctgtcttcactgctatattcacatttcctcaagagagagctatgctgactaaggaacgaacaaccgatatgtacagactaagtgcatatttcgtggccagaactacaagtgaccttctactagacctggtgctaccagtgtttttcctccttgttgtttatttcatggccaatttgagactcggttcagggcgttttttctttagtattcttaccgtttttctctgcatcatagcagctcagggtcttggacttgctattggggctacactaatggacttaaaaagggcaacaactttggcttcagtaactgtgatgactttcatgctggctggaggtttttttgtgaagaaagtccccatatttatatcatggattcgctacatatctttcaactaccatacgtataaacttttgctcaaggttcaatatgaacacattacacctaccattgatgggatcagaattgacagtggattcacagaggttgctgctctgacagccatggtttttggttaccgtttattggcatatctttctttgcggcggatgaaacttctagctggaaattaa

SEQ ID NO: 4210 - DNA, 405 bp, Glycine max
  Peptide Sequence Number=SeqID_120988
atggaggactccatgagattaggattcatggctgtggttgctgtatctggaagcatggccttctcggttcatcaagtccataaacgtatactatctaagttcatggatatatttgagtgtgaaatgggtggtgtcttaaacgcacatggccaaaagaatttgtgtggatcagagaaacatcaagcaaagaagaaggtgcggtttgcaaaagaagcattgagaaacaatagttgtcgtaaaggtgataaaatgattaagataaggctgcaacggatcaaagctgaggaaatttgggtgatgaagaatgttcagaaatggaggcatgggccgaaagaggacatgatgcctcctaatagggcagttctatacaagggaattatgaaatataggaaaaggagtatttaa

SEQ ID NO: 4211 - DNA, 207 bp, Glycine max
  Peptide Sequence Number=SeqID_120989
atggataattggtcactcatggatttggtgtggccattagatatcgttggtgacatgcgcatacatggtgatggtgttgttgccttactagaggtggatgatggagaagttgccacatggaaggacctccttggtggcttccagcgacacaaaggggtgccatcggcaatggtggcaatgtcgttggaccacaatgactattgttga

SEQ ID NO: 4212 - DNA, 144 bp, Glycine max
  Peptide Sequence Number=SeqID_120990
atggtggaagcctcacttgcagtggtggtcgcaaaaccaaggtcggtgatgacaatggtgatgagaatggaaaagagggagaatgagagtgaatggtgttgtctggaaacgatagaggccgaagagagaaaatgttgcatttga

SEQ ID NO: 4213 - DNA, 1497 bp, Glycine max
  Peptide Sequence Number=SeqID_120991
atgggtgataatattagtaacccgcgaaagatgctggcgtatcaatttgagccaatctaccaccgttgcaaaacgacggtttcttttgctcatcaccaccttcttcatattccctctccaaccatggacgtgggatcgtggagttcttctccctccaagatcaagtcccgattctccttccaagatcgcctcttccgcagaaagaattctcaggaaaatttggacaggtttattcctaatcgctctgcgatggacttcgattacgcgcactacatgctcacagaggggaataagaagggcaaagagaaagagaaccctgtggtgacatcaccgtcccgagaagcataccagaagcaactcgctgaggctttcaacatgaatcgtactcgaatcttggcgtttaagaacaaaccccgaacgccggttgaactcattcccagttccatcctaaaccctcctcctcctcctcctaattcctctaagccaagacggtacattcctcagagttcggagaagacgctggatgctcccgatatactggatgattattatttgaatctgttggactggggcagcggcgatgttctgagcattgcccttggaaacacggtgtatctatggaatgcctctgatagctccactgctgaacttgtcactgtggatgaggaagatggaccggttacaagtgttgcctgggcccccgatggacgccatgtagccattggtttgaacaactctcatgttcagctctgggattctcatgcttctaggctgctaagaacactgaagggtggacaccaagcacgagtgggttcactgtcttggaacaatcatatcctcacaacaggagggatggatggtaggattgttaacaacgatgttcgagtgaggcatcacattgttgaatcttacaggggacatcaacaggaaatctgtgggctcaggtggtctccctcgggacaacaattggcgagtggtggcaacgataatgttattcacatatgggacaggactatggtttcttcaaattcaccgacccattggcttcacaggtttgaggagcatagagctgccgtgaaggcactagcttggtgtccattccaggcaaatctcctagcttctggtggaggtgggggtgatcactgcattaagttctggaacactcatacaggggcgtgcttgaactctgttgacacaggctcacaagtgtgcgctctgctgtggagcaagaatgagcgtgagttgcttagctctcatggtttcacccagaaccagctcgctctttggaaatacccttcaatgctgaagatggcagagctcaagggtcatacctccagggtgttgtatatggcacaaagtccaaacgggtgtactgtggcctctgcagcaggggacgagacactgagattttggaatgtctttgggactgcacaggcttccaaacctgcaccaacagctagcactgatccatttgctcatgtgaaccgtattcgttga

SEQ ID NO: 4214 - DNA, 258 bp, Glycine max
  Peptide Sequence Number=SeqID_120992
atgacggcggcgccatcgccgggtggcggcggtggtgggagaaacacatacataaggaaggcaaggagcgctcagttgaaggttgaggtggacgaggttggcagcggcgtggctcttagccgagcttccagcgccagcttgggcctctcattctccttcaccggcttcactctccctcctgatgaaatcgccgattccaaaccattcagcgacgatgatatccagggaagttttgccatatcttcagctagcctatga

SEQ ID NO: 4215 - DNA, 333 bp, Glycine max
  Peptide Sequence Number=SeqID_120993
atgtggtttgatgcttatatttctagggtggttggggatggtcgtaatattagtttttggaaggatgtgtgggtagggaaggatactttgaaagccaaattctctaggctttttctactatctgagcaacaagaggcaaaggtaatagatatggggttttgggaggagggggagtggtcttggaactttaggtggagaaggaaattttttgtgtgggaaaatgacatttttaacactttacaagctctattccgcttcggtccaatgggttgccaacctgaccttatgtctacgagatcttctataaggcttggggtagtatttgttggataa

SEQ ID NO: 4216 - DNA, 123 bp, Glycine max
  Peptide Sequence Number=SeqID_120994
atgagaagaggggtagataatcatcaagggatgacaaaggggagattgacttcttacttctcacatttcccagataatttcaaggagatggatttttggcctatcttgaagcagtatggaaag

SEQ ID NO: 4217 - DNA, 555 bp, Glycine max
  Peptide Sequence Number=SeqID_120995
atggggaaatttgctacttttatagaatattttccggctgtcatgtctgacttgctacaaatcgtgttaaaagtcgagcgatgtcacgagctatcatttttgacgtcggagtcctcctcctccaccgacacgcttccgccgttcgcctctaacgacaccttgcaaaactcaccgtttctccactcaaaaactcctcgcctagggaaggcacgtagcaagtgctcacgcgcagcatcgggggactggtccacgcgcctgctccacttggtcacgctagagcaggtgaagccgccgcaggcgaataagagagagggaatgaatgtggagtgtttcggatgcaaatgccttcactgtggcacggagaagacgccgcagtggcgaacgggatcaatgagaccgaaaactctatgcaacatgttcgacatgaggttcaagtccaggaggctggtgccagaatactgcccgacagcgagtccaacgttcatgtcaacgaagcatttgaattcgcatcgaaaggttttggagctcaggtggcagaaggagatgcaacgataa

SEQ ID NO: 4218 - DNA, 1439 bp, Glycine max
  Peptide Sequence Number=SeqID_120996
tgctgctggatccattcttggattcaacagtcttcccaatagcacagaaattaagtgcattgagagtgagagacaagcactcctaaacttcaaacatggcctcaaagatgactctggcatgctgtctacatggagggacgatggcaataacggagactgttgcaaatggaaaggcattcaatgcaacaatcaaactggtcatgttgagatgcttcatctccgtggtcatggtagacaatatttgagtggtgcaatcaatatctcttcattgattgcccttgaaaatattgaacacttggatctcagctataatgattttgaagtgagtcatatcccagaactcatgggctcgttcaccaacttaagatatctcaatctctctgattgttattttattgggattattccttctgatattggaaagcttacacatttactgtctcttgatctaggtggcaatagctatctccatggacaaatcccttatcaacttggaaaccttacacatttacaatatcttgatctaagttataatgatctcgatggggaactcccttatcaacttgtaaatctctcacagttgaggtatcttgatcttgcgggggggaattcattttcgggagcatttcctttcaaagttgggaatcttcctttgttgctcactcttggacttggtggcaaatttgatgtgaaatctaaggatgcagagtggttgactaatctttcttccttgacaaaacttaggctaagttcactacacaacctttcctcttctcatcactggctacaaatgatcagcaagcttattccaaacttaagagagttgaggctagttggttgttctctttcagatacaaatattcaatctctgttttattcaccttccaacttttccactgctcttaccatccttgatctttcttcaaataagctcacatcctcaacatttcaactgttgtcaaactttagccttaatcttcaggagctttatcttggtcataataacattgttttgtcatctcctctctgcccaaactttccttctcttgtgatccttgacctttcctataataatatgacatcatcagtctttcaaggtggtttcaacttcagttcaaaacttcaaaatcttgatttgcaaaattgtagtcttacggatggaagttttcttatgtcatcttctttcattatgcgttcttcatcttctcttgtatcccttgatctctcctcaaatctgttgaaatcatcaactatattttactggctctttaactctaccaccaatcttcataaccttgaccttggttataacatgttagaaggtcccattccagatggatttgggaaagtaatgaactctcttgaagttctttacctatccgataacaaactgcaaggcgagattccatctttctttggtaacatgtgcgcattgcaga

SEQ ID NO: 4219 - DNA, 298 bp, Glycine max
  Peptide Sequence Number=SeqID_120997
atggatgaagttcaaggtcagtcttttagcaaggtatatgggaaaatctgggatctggaaatgatagaagtgttagttgaagtcattgcatctctcactcaatactatgaccaatcgctcagatgcttcacttttggggactttcaattagcaccaaccattgaggatttcaaagggatcttaggatgcccgataggaggaaggaagccatacctcttttctaggtactatctttttgtggcgagagtagcaagagtggtcaagatctcagaacaagaattagatcgagtgaagcaaa

SEQ ID NO: 4220 - DNA, 549 bp, Glycine max
  Peptide Sequence Number=SeqID_120998
atgttcttggatacccccgtggttttggagccaggggagtgctacgccacctacaccagttatgaagatggatatggacttggagtcgctcatttcaggccagatctcgcagatagcccaatccaactcctccaggctttgattttcgacacttatcactgccttatgcatcgcccggggagttgttccagattctttgaccttcgagactttgagtccctaagccctgccattaatttggcatacattaggaagaactgttggaacccagatgatcccacgatcacatttccgtggacccgtaaagctagggctcgagaaccatcagacacttcagccccttcttcttccgctcctcctacttcagctccactagcaccaccagctcccactcccgcaccagcaccctccggcacctttgctcaaagcacaaagattttagtgctgatgttgcggagccttcaccatggcttatgcctggtgatgcagagtattcatgatttggctcaacatcggtccattataagcatggaggcatttatggcctag

SEQ ID NO: 4221 - DNA, 168 bp, Glycine max
  Peptide Sequence Number=SeqID_120999
atgggtgcaagggattcatcattcatgaacagggctcatcatgaggtggggagggagcatcctgagctggttgaggagtatcctccgatgtctcctaagcctctgccccagcctctggtgtcacctctggctctggctcgggctcttgctgcgactcctgggctgtag

SEQ ID NO: 4222 - DNA, 3375 bp, Glycine max
  Peptide Sequence Number=SeqID_121000
atgtcagaaattattaaggttgttacaacattgccatcgaaagtatccattcttggattcaacagccttcccaatagcgcagaaattaagtgcattgagactgagagacaaacactcctcaacttcaaacatggcctcatagatcgctatggcattctctctacatggagtgacgatcacactaacagagactgttgcaaatggaaaggcattctatgcaacaatcatactggtcatgttgagacgcttcatctccgtggtcaggatacacaatatttgagaggttcaatcaatatctcttcattgattgcccttgaaaatattgaacacttggatctcagcaataatgattttcaagggagtcatatcccagaaatcatgggctcgttcaccaatttaagatatctcaatctctctcattctttatttcgtgggagtattccttctgatattggaaagcttacacatttacggtatctggatctaggcagtaatggatatcttcgtggacaaatcccttatcaacttggaaacctttcacaattactgtatctggatctaggtcgcaataaatatctccatggacaactcccttgtcaacttggaaaccttacacatttacaatatcttgatctaagttataatgatttccaaggggaactcccttatcaacttggaaatctctcacagttgaggtatcttgatcttgcgaggggcaattcattttcgggagcactccctttccaggttaggaatcttcctttgttgcacactcttggacttggtggcaattttgatgtcaaatctaaggatgcagagtggttgactaatctttcttctttgacaaaacttaagctaacttcactacgcaacctttcctcttctcatcattggctacaaatgatcagcaagattattccaaacttaagagagttgaggctagttggttgttctctttcagatacaaatattcaatctctgttttattcaccttccaacttttccactgctcttaccatccttgatctttctttaaataagctcacatcctcaacatttcaactgttgtcaaactttagccttaatcttcaggagctttatctttatgataataacattgttttgtcatctcctctctgcctaaactttccttctcttgttatccttgacctttcctataataatatgacatcattagtctttcaaggtggtttcaacttcagctcaaaacttcaaaatcttcatttgcaacattgtagtcttacggatagaagttttcttatgccatctacttccagtatgagttcttcatcttctcttgtttcccttgatctctcctcaaatctgttgaaatcatcaactatattttactggctctttaactccaccaccaatcttcataagctttccctttatcataacatgttggaaggtcccattccagatggatttgggaaagtaatgaactctcttgaagttcttgacctctccggtaacaaactgcaaggccagattccatctttctttggtaacgtgtgcgcattgcggagtttagacctctcaaataacaagttgaacggggaattttctagcttcttccgaaattcttcatggtgcaacagagacatatttacgaacttggatttatctgataaccggttgactggcatgttacctaaaagcattggattgctatcagagctggaggatcttaacttggttaggaattctttggagggtgaggtcactgaatcccatctttctaatttttccaaattaaaatacttgcggctatcagagaactcattgtctctgaaattcgtcccgagttgggttcctccattccaattagaatacttgggaatcggttcttgcaagttgggccccacttttcctagttggctcaagactcaaagttctttgtattggcttgatatttctgataacgggattaatgactctgtaccagactggttttggaataagttgcaaaatatgggattgttaaatatgtcttccaattatctcattggtgcaattcctaatatatccttgaagcttcctttcagaccatttatacatctgaaatcaaatcagtttgagggtaaaattccgtcatttttactagaagcttcccatctgattctctctgaaaataatttttccgatgtgttttcattcttatgtgaccaaagcacagctgcaaaatttgccactttagatgtatcacacaatcaaataaaggggcaactgccagattgttggaaatcagtaaaacaattactgtttcttgatttaagcagcaataaattgtcagggaagattcctacgtccatgggcgcccttgttaatatagaagccttaattttacgaaacaatggtttaacgggtgagttgccttcttctttgaagaattgcagcagtttatttatgctggacctgagtgaaaatatgttgtcgggtccaataccatcatggattggagaaagtatgcagcaattgataatgttgaacatgcgaggaaatcacctctcaggaaatctacccgtccatctctgttatttgaagagtattcaattgttggatctttcaaggaataacttgtcaagaggaattccaacttgcttaaagaatttgactgcaatgtctgaacagaccatcaactcaagtgacactatgtctcgtatatattggtataataacacttactatgaaatttatggtagttactcattgggaggttatatgcttggcataacatggatgtggaaaggtgtggaacgagggttcaagaatccagagttaaagctcaaaagcattgatctttccagtaacaatttaacgggtgaaataccaaaagagttcggatatttgcttgggttggtttctttgaatctatcaagaaacaatttgagtggagaaattccttctcagatagggaatttaagttcactagaatcacttgacttgtcaagaaatcacatctctgggagaattccttcttctctttctgaaattgattatttgcaaaaattagacttgtcacacaactctctttctggaagaatcccatcaggaagacattttcaaacctttgaagcctctagttttgaaggaaacattgatctttgtggcgaacaacttaacaaaacttgtcctggggatggagatcagacaacagaagagcatcaagaaccaccagtcaaaggtgatgattcagttttctatgagggattatacatcagcttggggattggatacttcactggattttggtgcttattagggccattactactgtggcctccttggagaattgcttacatccggtttctgaacagattaacagactatgtatatgtatgcttatggtga

SEQ ID NO: 4223 - DNA, 213 bp, Glycine max
  Peptide Sequence Number=SeqID_121001
atggttgtggaggaagccaagagcactatggggacaaatgcagaagaagaaaagatggtgatagtaaggtttggggacttgcaaacaatgagaagagtgaggactgggaagagattattaatgaagaagaagcaaatggctgtggctgcacaggctgagaagtctcttccggtgtctccggcgggtggtcctcagcctctacccttgttatga

SEQ ID NO: 4224 - DNA, 504 bp, Glycine max
  Peptide Sequence Number=SeqID_121002
atggatgccacctccactcttccgacaccggcatcaccgacattgctttgcactcctccgggatcaagtcagaaaaagagttgggcagcattggtggagaaagttagattggtgctcaatgagtatccacaactcaggctaacccaagggagaaaagtgctagagatctgtctaaccattaaatgggacaatggcaaggctcttgaatttttgttagaatcattggggtacgagaattcgaatgatgtatttccaatctatattggtgatgatcgaactaatgaggatgcttttagggatcgaatctggatggcgtcaagcaccatgcaaagcttactggacctcagagttgtgccaaaggggacgagtcattatcaaatcatacaacaagctctgcaattgttgcatgagtgcttcaaagctgattgtaacttagagaggcagcggaaaaaggctgccaaggatggtggcaagggcaacagaaaaggtgacagaggcagatga

SEQ ID NO: 4225 - DNA, 537 bp, Glycine max
  Peptide Sequence Number=SeqID_121003
atgggacccacatacagtgatatggggtgcaaactagcccttgaagacaaaaaaagagtcgcatttaggaggaggcagaggcatgaacatgttgatgcaacaaggcatgccaaaccttgcaattgttcaagtttggcctctcagcaacaaaaagcctgtgtctgttgtttcatcaagctaccatgccgaatctgtcatcaagcactgaggtgtgcccggaaatgggcatgttatggatcaaagaataatagggctgggtttgtgaattccttggcttttgcaaaatcaggagaattcttagttgctggagttggacataccgttgtcctcaaagttggtatgtcatgtcaagggtgtgctggagcagtaaacaggattttgggaaaaatggaaggtatttttattcctaagttccagttaatatctttttctcttaaacttcttgccattttctgttgggtgattaagtggttttcctgttcacaattaactttcggacataatcaagaataccctgcacaagtcaagggctgttaa

SEQ ID NO: 4226 - DNA, 144 bp, Glycine max
  Peptide Sequence Number=SeqID_121004
atggcttttgctaatgatttgagagagatagagatgagcacaacaaaaaagcttagaaatatggggaggaagcctctcaagtgcttttcggttcataagcttcttcaactccttgatagaaaattaaaagtgatgaatttatga

SEQ ID NO: 4227 - DNA, 507 bp, Glycine max
  Peptide Sequence Number=SeqID_121005
atgaagaagtacttcaagtcgacaatggatctcgcggtgaagcttaaggataatcctcccaatagcaagtcctcttttctaaaggagtacatcgatgcacacaacaacataggcatgctggagatgggtctcgacaacttgcacgagtcgtggaagattttaactagaggattggagatttgtgaggaagaggaggtcgctgaatatggtgatggccatagtagactccaccataaccttgggaatgtgtatatggatcttagggattgggataaagctaggaaatacattaagacgaatattgtgatttgtaatagaattgaacatgctcaaggggaaaccaatgggtatattaatcttggtgaagtgcattacaggactcaaaagtatgaagatgcgagttcttattacgagaaggcacttggtttggcgaagagcttggaggatgaggatgctttggtaaggcaagtcgagcagaatattgaaactgagagagaaactgttaag

SEQ ID NO: 4228 - DNA, 141 bp, Glycine max
  Peptide Sequence Number=SeqID_121006
atggctcatcctaaagatggttcaatgaagaatgagggtcatttagcaattgctgatggtatcttagagatgaccaaggaaactagattggggttttttctagcaatcttggggcctacggtgtgctacaagccaagttaa

SEQ ID NO: 4229 - DNA, 414 bp, Glycine max
  Peptide Sequence Number=SeqID_121007
atgcgaatcggaagcaggagggaaagagaagagaccgaatcgtgtcgtggaagattcaacggcgaacggtcaacagcactgacacgtagacaatggccaactgcagttattactgaggaggttgagcatgtggatcatgctgctaacgaggttcatgaggagcctcaggggccacttacagatcatgtatgtgttgatacaaagggtttttcaagcggcccccgtggtacatcagtgttgacatcatatgctgatcatggagaaaggcaaagaaatttggaaggtctatacctaagattaggggtgggtaaacgggttcaggtccatggactggtccgcggggctcgcggtctgcgcgaggctacggaggtttggatgacgccacttccggtgaaggaagataagtcagggtag

SEQ ID NO: 4230 - DNA, 126 bp, Glycine max
  Peptide Sequence Number=SeqID_121008
atggtgacatttggtcgtggtgttttcattggaggagagctcggttcacttgggaggaagcttcttgtggaaaattcaggcaccatccaaggtgttggttttagcatggagagtggttttggataa

SEQ ID NO: 4231 - DNA, 153 bp, Glycine max
  Peptide Sequence Number=SeqID_121009
atggctcctttttctctttctattggttgcaaaaggtttgggtgggctaatgaggggaagcatgttttgggagggtccaaatggtggagggacgtaggagaagtgacaaaggtaggaggggatttagactggtttgagggggagggggggtga

SEQ ID NO: 4232 - DNA, 471 bp, Glycine max
  Peptide Sequence Number=SeqID_121010
atgtcgttctcgctgcctctcgcacctccactccgtcgctgcctctcacacgtccattctctttctctcgtatcattcttgcactctcactcttgcatctcaacacctttgcctcactcccactcacgaccagtctcgctcccactcacggccattgccgctcttggtggtagtgcaaaatatacttctagaggaaaaaacgttgccaaaaagttactatcagacaaagaaaatattgtgttcgatgggtcctcggggcaggacccagacacgggtgtctcagagaaatgtgggttgtatatcgatgagaatcctccctacctgattgcccttggaagagtttatgaggggtcgacgatcgtccacaacgtccctttgggcaatgatcaagtgaagatcgatattgaggaagtttgcgatgctaatgctcgcattcctgtccccactcaagaggttcagttagtgggatag

SEQ ID NO: 4233 - DNA, 1711 bp, Glycine max
  Peptide Sequence Number=SeqID_121011
ccagtcgcctcattgctttctgcatagattcaaccaccaacttgctcattacgccataagggtcgcatcccaaatccaaaatcccaacttgttcatctacaatgcattcatacgtgggtgttccaccagcgaaaacccagaaaattcattccattattacatcaaagctctacgctttggtctattacctgataatatcacccacccttttttggttaaggcatgtgcccagcttgagaatgaacctatgggcatgcacggacatggtcaagccattaagcatggatttgaacaagatttttacgttcaaaactcacttgttcatatgtatgccactgttggggacataaatgctgcaaggagtgtttttcagaggatgtgccggtttgatgtggtgtcatggacttgcatgattgcggggtatcaccgatgtggggatgctgaatctgcacgtgaactgtttgatagaatgccggagaggaatttggtgacatggagcacgatgattagcggttatgcccataaaaattgttttgagaaagcggttgagatgtttgaggctcttcaggcagaagggttggtggctaatgaggctgtgattgtggatgtgatatcttcttgtgctcatttgggggctcttgcaatgggggagaaagctcatgagtatgtgataaggaataacttgagtttgaatttgattcttgggacagctgtggttggtatgtatgcaagatgtgggaatattgagaaagctgttaaggtttttgaacaactgcgggaaaaggatgtgctttgttggacagctttgattgctggattggccatgcatggttatgcagagaaaccactttggtatttttcacaaatggagaaaaaggggtttgttcctcgagacattacgtttactgcagtgttgacagcttgcagccgtgcaggaatggttgagaggggtttggaaatattcgaaagcatgaaacgtgatcatggggtggagccgagactggagcactatggatgtatggttgatcctcttggccgtgcaggaaagttgggagaggcagagaagtttgttcttgaaatgcctgtgaagccaaattctccaatatggggagcattgttaggagcttgctggattcacaagaatgtggaagttggggaaatggtggggaagactttgttagagatgcaaccagaatatagtggtcattacgtgctactctccaacatatgtgctcgtgcaaataagtggaaagatgttactgtcatgaggcaaatgatgaaggacagaggagtaagaaagccaactggatatagtctcattgagatagatggaaaagtacacgaatttacaattggagataaaatacacccggaaatagagaaaatagaaagaatgtgggaagatataatactcccaaaaataaaactagctggctatgttggaaataccgctgagacaatgtttgacatcgatgaagaggaaaaggaaggtgcccttcacaggcatagtgagaagctggccattgcatatattatcaagatttggcctcctacaccaattcggattgttaaaaacttgcgtgtctgtgaagattgtcacacagctaccaagttgatttcaatggttttccaagtggagttgattgtgagagatcgaaaccgattccatcactttaaagaaggtacgcgttcttgcatggattactggtga

SEQ ID NO: 4234 - DNA, 288 bp, Glycine max
  Peptide Sequence Number=SeqID_121012
atggtttgtttgggaggaagacatggtgatggagctgaaaaatcttatccaaaacatcactctctcacaacatgggtgatgtatggagttggaaggcaagaaacaaccattcatctactattttcatatccaaaatcatctcatttatggatggactggtatcaacgggaagggatagcaacgatgttactgcaacaacctacatcacacttcatgcaacactctgggtgtcgtatcggatcgtctgattgtgtggagtgcattaatacaatgtatttggaaccatag

SEQ ID NO: 4235 - DNA, 1413 bp, Glycine max
  Peptide Sequence Number=SeqID_121013
atggatttggaatcttctggcgattcggtgaaatgctgcaagcactgtggatgcgggtgtagtgattgctccatggcagctcaatcttcagggaattggctccgttctgtgaaaaggaagcacaagcagctggaacagggcgaccaattctctgtgccggggccagattgcgatctggtggcgcgtgttgagattgggaatgaatgtgatgcactacgcgaggctgtcagcagccaacagaaatcaatacaggatttgtatgaagaattggaggaggagaggaatgcggcctcctcggctgcgaatgagaccatgacaatgatattgaggctgcagagggagaaggcagagcttcagctggaagcacgacagttcaagagatttgtggaagagaggacgtcgcacgatcagcaggagcttctagcattggaggaattgttgtataagagagagcaggcaattcactcgctcacatgtgaggtgcaggcttataagcacaggttgatgagttttggcatcagtgagtccgagggagaaggggatcagtatgaatttcccccttatgagtaccctcctttgagatgtaatgcaatgcatgcttcaacagatgataatgatgagatagacattgacaaatatgcatttggcgaaactcctaaggaccgtttgaagaacctggaaagtaggatatctcaaatggagagaagtcccacttatagtcagatggatggggaattcagtggaaaaaatattctagagaaggtgatagttggacagtctccaagacgggctaaacattccaggaaattttcctgtgactcgtcttcattgtgccctgagtatatgatggattctcctagctttaggaagatagatgaggatctttccaatttgaagaaggtagataatgcatcggaagctggtgatgatatgattgataaagtctatacaattgactctgagttcaaagccggagctagcgtttacgattattatgcaaccactccaagggactttgttgatcatgcagattttgaagatctacatgtaaagaagctttacatgaggcttcaagcacttgaggctgatagggaatcaatgaggcaggcaatcatttcaatgcgcactgataaagcacagcttgttttgttgaaggaaatagctcaagaattgtgcaaagagatgtcacagcagaaaaaaatgacagcgagatcctttattagcagcttttcattctttacagtttttaaggggtttggcggtggcagtccacgtctcagcctctcattctcagtattcaaaggaccgatttctgattatgagttaggatatgatctggattcatggtcgtggcgataccaaaacactgtggtcttacccttggaaccttgttgcaacccaaaacacaattaa

SEQ ID NO: 4236 - DNA, 1898 bp, Glycine max
  Peptide Sequence Number=SeqID_121014
atggactataccctgtgcaaggtattcttcccactaatggctataagaggcatggcgcttgatgattattgtaccctgtgcaatgcatatcctgaaactctaagtcatgctcttggtgattgcacatgggtaagaggggcatggaacaatctgggaatcaatgacacttggaattttttccaacataatgttcataggtccttggtgcacgacaacagtgcaagagatgagtttattaaagctctgcaacttcatgcttcgttggaatcaatgttgcatgaataccctgctgaagacttggccgcctctctagaagattggggcattgctcgagatgttggggctcatatgatggtggttgaatctgattgttctgaagctttaaggctcattgatgaacatcccccaacggctagtgatttttctaatctattggacgagattcagatgcttggcggcatagtcactcactcacatattgaaaccgaaaccaaaaacctcgccgtcgacgacaacacgatgcggagcttcaggatgagaaacttgttatccagtgttaaaaagaaaaccatcgaaaacagaaacaaaacttcacgaaactgcatttctattacaaaagaattagcacgtttagtggaagaagaagaagaagaagaagaagttaacgaggaaggcttcaacatcaaaagctctgccccgtcacacactcacggtgttcagcccttggggaatctctatctgaacacaggttccaccaactccagagacactggcttaggtaatcttcataccctttcggatgatcttgttctcgacattctcgggtttttggatgcttcttccttggggattttagccactggtcttggaaatccacctatgtttctgcttgttacccttcatttgatttcttcactaatgctcttgggggtttcaaagttagcaacttttattcggattatctgcttccagagttggctctgtgctaaccttggaatgaagccggagtggttggagagggataatgtggagcctaataagccggtgttgttggaagggtgtattgataattggggtgttttgaggaattgggatagggattatttggtgaggttgtgtggtgatgttaagttttcagttgggtcattggagatgaagcttggagagtattttgggtactcgggtcaggttagagaggaaaggcctttgtatttgtttgatcctaagtttgccgagaaagtttcgaaattgggcgatgattatgatgttccggtgtactttagggaggacttgtttggtgttttgggcaacgagaggccggactacaggtgggttattattggaccttccgggtctggatcttctttccacgttgatcagaattcgacttcggcttggaatgcggtgatcaaggggtccaagaagtggatcttgtttcctcccgatgtgattccacctggcgttcatcccagtcctgatggtgcggatgcggcatctcctgtttcgataattgaatggtttatgaacttctatggtgcaaccaaaaattggcaaaagaaaccaattgagtgcgtatgtaaagctggagaggtgatctttgtgccttgtggatggtggcatttggtgatcaacctggaggaatctatagccataacccaaaattatgtcagtaagagaaatttgatgaatgtcttggattttcttaaaaggccaaatgccacactggtatctggaacaagggatcgagtgaatttgtacgataagtttaagaatgctattgaggcttcttttcctggagaaattgatgaattgactcggaaagaagaagagagaaagatccagcagaggaaactttccttctgggatactgatgcagatacttattcgggggctttcaa

SEQ ID NO: 4237 - DNA, 291 bp, Glycine max
  Peptide Sequence Number=SeqID_121015
atgccgctgtcgaagtaccgcgtgcggaacgagtacagcttggcggatcccgagctgtaccgcgccgccgacaaggacgatcccgaggcgcttctcgaagccgtcgccatggccggcctcgtcggactcctgcgccagctcggcgacctcgccgaagttttgaaggggaaaaaattaaaggaaatttggcggtggcagtgcggtgactggtttaaattgtgtaattgtgaagacttcaaatcttggactaatgaggttcctgatgataggttttggctagatggtagttaa

SEQ ID NO: 4238 - DNA, 4890 bp, Glycine max
  Peptide Sequence Number=SeqID_121016
atggctactgctgcaagaggccatggtcttatggctcgtgttaaacagcttgaggctgaagttccctcactagagaaggcgttcttttctcaaactcatcattcttcattctatactaatggagggattgattggcatccaaatctacggtttgaacaaaatcttgtgactcgtggagacttacctcgatttataatggattcatatgaagaatgtcgtggtcctcctagactgttcctgctggataagtttgatgtagctggggctggggcatgtctgaagcgttatactgatccgtcattctttaaaatggaatcaacttcatctgtaactgctacaatagaagttcagagagaaaagagaattcgtaaagtaaagctgaagaaaggagcacgactgagggatggtgaaacccctaatgctgtaccatcacatgcaaaattacatcagctgcttcttgaggagcgtattgagaatggttatagtaatcctgcacgccgagtgaagttgaagaaaagacaattgaatggaccagctgttgaaacaagagatgggaagagttacatggagaaatttctggaaactccttcacctgatcataaaatggtttgtgaaacttcaatctttccattgcctgtgaaacagacaccgtatgatactagtgaggctgggattaaaattcttgaaatcagcagcattagtcctgtgaaaaagtcattgggaaataaaaacacctattcatcccctgatgagaatgaattagaactaaaaccattttcagaaatggatggtgggacaaatgaagatcttgtgaaggtgaaagaacaaatctcagatggtgtgacagacaagaagtcttctaatcatcttaagttgcctgatgcagcagaattggctatcaatgaacaaaagaaaatagaaggcagcttagatgggcaccattctgatgatgtgactagtgaagttgacaattacatggatgctttaactacaatggaatcagaactggaaacagacaatgagtataaacctaagaatagtttcttgaatattcaaaaggcagcaaatactaatgataaagaagaacatcaattacaagctcaattttcagattctcaatcatttggggactcctcaatgtctgatgacagtagttctttcaatcaagatagaaacgaagaacatattaaagtggaagctcagtcttcagattctcaatcaactggaacctcatctacattagatgataatagttcattcagaagagatggaaatgggcagcatagagaaccgcaagctcacttctcagattctcaatctgttggtagctcctctacatcagacgaaaatttcaagaaagataaatcctatttacctcactctgattcgttaaccaccgcagttgaaaatatacaatcggaacctatattattcacaaatgccaagtgttgtgaactgaaggttgaagatgcaccatccaaccagcttccccaaaatgttgagtttcaacacacagattgtgagaggtttgtcatgcatgatgatgcaccggttcatgaagaagagatttcatctgatttggggcaagcctcttcagatttgatgacttcagggcaggtgttgtgttctaatcttggatccaccttgccagtgatcctacctgctgcaactcaatcagatgaaaccccatctgcccctgctgaacttaatttaagattagatgatgacaatgcagacagaacaggtcttgttgaatctatttcttccaaacctgtttctctctccctaacagatgatgctcacccagtgggttcttctgctaaaacatcattagacaacttggatgatgatgacccatatattcattgtgatgatctgttacaagttcttaatgatttggaattagctcatggagatgaatgcagtgatcattctgaaatcaaaatgtcccaggcagagcctcccaaagaaaatccttctaaaattttggttaatagagatattggttcaccagtagaggatcctgtttccccatccatggaagaattaaacttgaattcaggtgctacactggctcatgattgtcaagactcaaaagatgaagattgtactgtaactacccaacttaattcggagactcctgtttctccattgagttgctttaccggggggctattatctgattcaactcataacaacactcaagatgaaccgggctcagcagaaattgaagtctcatcttctgatctccaatcaaaagttggagagataccaaagatggtgcatgatgatgaaataaatggatccaccttcagtgtcaatccagttgaagatgatggtcattttaaacgttcatctcctgataatcatgtgatggtaaatgatctggtcactgaaaatgttcagtcagatgatcaagctgtgtattctgctccttctgttgatagtgctgaaaatgatgagggtgttgttagttgtccagcttcaagtcagatttgttctccatcaaggggtctttcagatttggaagagcctccgttgagttctcattcttatccaatggaaataaaatccaatgaagtagaattgacgcaaattgccatggtcacaaatgctgagaagagtgaaaatcaatcagcaccattgctagatgtagcgtcatctgatgtcgtaaattcttcattgagtaatattacaaagttagaagaatctctttctacctttgcagattcacagaagaaagagatagaagttgatgaggcagttgctagagattctttgacagaattagaggaacagaagatagtggatcagccagaaattgcttctgtggatgtacaattgaacctgaacaaactggttccctttgatcttccagattcagaaatatgtaataatattcaaaagtcatctccaagggagaaattccaacatggtgcttttgttgatgatgcagaaatggtgcctaaatttttggggttagatgcccagcaatcagaatcattatcttatggcctgcatgatccattacaaaatgacagagatggtttttcatcaccttctggtaaccagttggaacctgaaactgatttagatctgttctcaaaatctcaaattggtgaacaggatgcagaattcccactcagagaggagaaaaactttgcctctgaaaaacctcaatttcagcagatgcagaaatatcaattggagcaagaaagcactaatgctacttctgactgcgtatcagaaatccatgcagatgagccatcatcattttattccttgccacagtcatctagccaggagaataatgctgcaaaacgtgtcatggatccattgaagcctcttcttcctaacctctttcccaaggcaactgaaaataaacttgatgagatgccacccatgcctcctctaccgcctatgcaatggagaatgggcaaggttcaacatgcttccctagcttcgcaaagagaagagttagaagtaagtcaggtctcagtccagccaaatagacctgataaacaatctctatttggtttgccaacttctgagagagagaccttgtatcagaatccttttttgcctgtcatggctttggaaagtgataagctccaacattcttctgggtttgctgttggtgtttcagggcaccctgttgctataccttttcaatttcctatcatggttaatgaatcaaaaggtcaatataattacctattgctggacagcaaccaaattcaaaaccccttgttaacattacccgtggcatctatgggcatgcctcctcaaggtttcattgttgctcctgagggagaagtgatacagaattcaaacccatgcgcaccaataccatctgctgcatatgctgttttaggacacaattccatccctccacaagaaaaatcaactcaacctccacatcagttaatgatggagactactccagatgataaatcacttcaacagagtatgagtaatatggtatctatggacaggcctccacatggtcatgcagttgcttctgagggagaaatggaactgaactcaaacccaggccctacaattccaccggctgaatgtgctgtttctggacatgattctctctcacctcaagaaaaactgactcaacctccaagtcaattactgatggagcatagttctgatgataaaacacttctgcagtttgtaactaatgtggtgtctatggacagttctaacagtcacattgtttcttctgagggagaaatggaacaaagttctaacccagaccctccaactccacctgttgaatgtgctgttcctggacctggacatgattctatctcttctcatgaaaacccgactaaacctccaagtcaattaatgtcagagactagttctgaatttaaaacacttcagcagtctataagtaatgtggaaggggaacaaggacatctgcctatctcattcatgtctccaccaaacatggaaagtatggagcctaatcagagtttcctgccctttgaggggggaatggagatgtccttggatacgtctgatcatacatcagatcttgagagtgaaaggacaaatggaaaaccaaagaataaacttcctcgtcctcgtaatcctctaattgatgctgttgctgctcatgacaaaagcaagcttaggaaggttactgaacgggttatgcctcaaattgcaccaaaggtagatgaaagagattctttactagaacagataagaacaaagtccttcaacttgaagcctgctgtgactacacgacctagcattcaaggtccaaaaacaaatttgaagtttgctgccatcttggagaaagcaaatgcaattcgccaggctttggctggaagtgatgaagatgatgatgcagattggagcgattcttga

SEQ ID NO: 4239 - DNA, 423 bp, Glycine max
  Peptide Sequence Number=SeqID_121017
atgatggtgaaaggcgtgagattggcactatcttttgtctttggtgcaatcatcatcatgatgttgtttaatgtctacctacatttttgctcccaaaactacagggaggtggctatcattgtcactagtgatggcataaacaaccaagaagcaattgataaatgttccacctttgtttactcaatggtgaaggagcttgaaccgaagaagaacatggtagtggagtgcgcaatgtgcttgagcgattatgaagagtgcaacatggtaaacaacataagaccaaagtgcgacgtggtagacaacatggttgtggacaaattcactactgcgaggtttcttgaatctaaacaaaacactcttcaaacttgttcaagcacattaaggactctactatcgagttcttctccatttcaagatccctga

SEQ ID NO: 4240 - DNA, 636 bp, Glycine max
  Peptide Sequence Number=SeqID_121018
atggtggacgcgactcgttctaagggccagctctcgcgtggttccagtggatgcaccgcaacacgcagctctcttcgtgcgttcgtcagtaagcgcttatttgtccgaattcaagtctctggaaaatcatatagtgggactgccagcaccgtttgtgctgagttgcttcatttcggggttgagtcttgcattcggcgagaggtgcaagttcttcaacctatttcattggctcaagcagtatcgtatgcgcgcttacaggaagaaaagctcatggctgctcgccggccaccaccatatcaccctccaacaaccactgcgacaaccgtaatcactcaatcgccttcacccaaccctactctgcctttgttacctacacctcaatgcactacaaccacttccattccttttaaatgccttacaccggaagagcccgcggtctgtcgagaaaagggactgtgtttccactgcgaccagaaattctctcgaggtcacaagtgctcatctttgttatttctcttggtaatagaagatgaagagcttacaccacagttagcaccaccacgttcaccatcacctgatttacttcaagaacctcctccggcacagctcagtttacacgccctgtctggccattga

SEQ ID NO: 4241 - DNA, 159 bp, Glycine max
  Peptide Sequence Number=SeqID_121019
atggcattagctgatactgatgtggtcgttgacattgcattgttgtgctacacattcatagcataccaggctttcacaaaagaagacggtctgcccggggcaccttacccatgcaatagccatcgtggatgttcgtgtaacttgcagtttcaaatctag

SEQ ID NO: 4242 - DNA, 927 bp, Glycine max
  Peptide Sequence Number=SeqID_121020
aactcctacttctaccaaagtcgtacaattttgaacaaagcacgggagcttgctgcaaagaaagatattaatgcgattgaggaactggcacaaactgaggttgagaaagctatgtcactctggaacagtgacaaatcctttagggatgactatgagaaaagacttttgccatcactggacatgcgacaattatgtagggatggacggatgaggaacccagatgaaaagccactgctggaagaaccgaaacctgccgaaactgatacattgccgaaaagcagtgtaaaacagccaaaggaggaggagcctaaatcatctccaccagaaactgtgcctgagcagaagattcagaaagaaaccaaaaagaaaggaaaagatttgaaatccaatctgaacaaggttttagaagacactgatgaatatgaatttgaattgccaaaggtgaataaggagcctccgattgatccagaaaagctgaaggagatgaaaagagaagaggaaatcgcgaaagcgaagcaggctttggaaaggaagaaaaaacaagcggagaaagctgcagccaaagcagctaccagagcacaaaaggaagctgagaagaagctcaaggtacgtgagaagaaagcgaagaaggtggctggtggcactggagctgttccaagtcctgaggaaccagcaaatgaagctgtggaggttgctgaacagaagaccgatgatagcatggaagcctcagctccggcgaaggagaaggtcccaaaggagagcagtgttaagttcaggaatcgagccaaagcactgaaaggccccgacactatcccaaaagctattatgaagaggaaaagcttggatcttgaaggagctgtgaaccaattttctgtgggtggcttggctaggttctgcagactaatcatcagggaaatggcgcggtga

SEQ ID NO: 4243 - DNA, 324 bp, Glycine max
  Peptide Sequence Number=SeqID_121021
atgtatgtatgtattgtttcccttgccagcacagtaattgcgcatgctggtgatggtaatttccacacggttattttatttgatcctaaccaagaagaacagcggcgggaggcagagagactcaaccagtttatggttcatgctgccttgtcattagaaggaacttgtaccggtgaacatggtgttggaactggaaaaatgaagtatcttgaagaagaactcggagtggaagcattgaggacaatgaaaaaaataaaagcagtcctagatcccaacgatatcatgaatccaggaaagctcatccctccccatgtttgtttctag

SEQ ID NO: 4244 - DNA, 177 bp, Glycine max
  Peptide Sequence Number=SeqID_121022
atgtgggaattctctgttggtttatatatgatcaacatttggccagactcttcgctctatgcagcaatatatggtaccattgaatctgcctccactgcactgtttgatcccataattggaagatgggttgataagttgtcttatgtgaaggagaatacacaaacatctttagactaa

SEQ ID NO: 4245 - DNA, 828 bp, Glycine max
  Peptide Sequence Number=SeqID_121023
atggtgctaaaacacagggttaagcccgatgttttcacctttaacattttgattagtggttattgtagaaactcgcagtttaacttggcgttggagatgtttcacgagatggggaaaatgggatgtttacccaatgtggttacttttaatacgttgattaagggtttgtttagggaagggaacgttgaggaagccattgggatggctcgtgagatggttcaattagggattcgattttcgagtgttagttgtgagattttggttcaggggctttgcaaggaagggagggttttgcaggcgtgtgagttgttgctggagttttgtgagaagaaggttttgcccgaagggtttgattgttttgcgttgctggaggttttgtgtggggaagggtatgctatgagagcgttggaggttgtttatgagctgtggaatgggggtagtgttccgagtttggttgcttgtattgtcatggttgatgggttgagagggttggggaagattgacgaggcgaggagattggtggaaaggatgcttgaagagggtttggtgctggatgttgtgactttcaactgtgttcttcgggatatttgtgataagcggagaacgaatgaggcgaatagattgaggttgcttgcttcaagcaagggttttgaaccagatgagatgacgtataggattttggtcatggggtatataggggagggagggagagagcaaggagagttgctggtggatgagatgttggatatggggtttatacctgatcttgcttcatataatcaattgatgagtggattgtcgaattgccgacgccctacacgccgtcaa

SEQ ID NO: 4246 - DNA, 780 bp, Glycine max
  Peptide Sequence Number=SeqID_121024
atgttactctttgcaacacttcttctcttttctctgcaatcgagtatcttaacaccgattccagtaaaacccactaaactctcttcgaatctctccgtcaccaactccgcctcttacggcgagagaatcagcagtagcacgcgccggagaaccatttcacccttcgaatcccgaatctcactcattttcgccctcgctcctcaagccaacactctctcccagcgacttctagcggacgtggctgccgagactgcgaaatacgtgtttccgaagagatttgaaaaccgcaatctcgaggaggcgttgatgagtgttccgaaccttgagactgtcgagttcaaagttctgagtagaagggaccagtatgagattagggaagtcgagaatagagtcatttcttcttgttctccaaatgtgcaaccttactttgtggcagagacaacaatgcctggaaagagtgggtttgatttcaatggtgcttctcggtccttcaatgttctggctgagtaccattttggtaagaatacaactaaggagaaaatggagatgaatacacctgttttcacaagtaagaatcaatctgatggggttaaaatggatatgacaactcctgtgttaacaacaaagatggaagatcaagataattggaaaatgtcttttgtcatgccatcaaagtatggagctaacttgccactggctaaagattcctctgtgaggattaaagaggtgcccagaaaaataattgatgtagtttccttttcaggtgcgctattgccttga

SEQ ID NO: 4247 - DNA, 360 bp, Glycine max
  Peptide Sequence Number=SeqID_121025
atggccacacccacgattgaaacacccaaacagtcagaaaatttgaacagggaagaagcttcaaagaatgagaaatgcacaagaaatggtaacaaatggagaagaagagagaagaataccagtctggaggagggagataagcacaaaaggattattacccggatgagagagattgcaaaaaagaagacccctttgatagagggactccaaaattcaattccaaaatttggaaaagcacagaaactaagacggaaagagagaactgagagcagagctcttcccctgtctcacatgaattttgctatcatgatttctcttgacggtgaaaagccagatattctcttgatggtaacagtttga

SEQ ID NO: 4248 - DNA, 891 bp, Glycine max
  Peptide Sequence Number=SeqID_121026
atggatgttgttgttgagcctggcattggatggatggagcttaatgagtatttggaaccttatggcctattttttccacttgatccaggtcctggtgctagcattggaggcatgtgtgctacacgttgctccggttcattagctgtgaggtatggcactatgcgtgataatgtcatcagtctcaaggtggttcttgccaatggagacattgtgaagactgcatcacgtgctaggaagagtgctgcagggtatgatttgacccgcttgatgattggaagtgaaggaacacttggtgttataacagaagtaaccctgcggcttcagaaaattccccagtattcagtggactataggttcatcttaaaattgttccattcctttatactgccttgtgtttcttcctcctgcaatttcgtgtcatctccacattacatggcctatccaagctctctgaagaatacagttgcaatgtgcaatttcccttctgtgaaggatgcagcagatgttgctattgccaccatgatgtctggtatacaggtgtcaagggtagagctattggatgaagttcaagtgaaagctatcaatattgctaatgggaagaatttgcctgaatgtccaactttaatgtttgaatttataggaacagaggcatatgcacgtgaacaaacacaaattgttcggaaacttgtttctgagcacaatggctcagattttgtattcgcagaagaacctgaagcaaaaaaagaactttggaaggtaaggaaagaggcactctgggcttgctttgcaatggaaccaaatctggtggcaatgactacaatatccatatcaaaccaagtcaatatggatctaagagtgcacatgcttgttgtagatagggaaacagaatga

SEQ ID NO: 4249 - DNA, 234 bp, Glycine max
  Peptide Sequence Number=SeqID_121027
atgattaggagtgaagtgaaaatgaggttcgtcacatctcacgaatacagagcagagccatctgaacagaacatgggttacccagttacggggtgggttgacagcagaatggaaacagggacaattcaagaaatgaggactacgctaattaatcacgcggtttcacagataatggaagtaaaaagtaaaactaaacaaaaaatcttgctcaccagaacaccggttaaggaataa

SEQ ID NO: 4250 - DNA, 153 bp, Glycine max
  Peptide Sequence Number=SeqID_121028
atggttggttcgtcgttagaggtacaccagagaggtgtcgcttcggtggaggtgaaagtgttacgggtcggtggtgattgttacgatggttggttcgtcgttagaggtacaccagatcaagctgatccgttaggtttatacgaatcaacttga

SEQ ID NO: 4251 - DNA, 390 bp, Glycine max
  Peptide Sequence Number=SeqID_121029
atgatgaaggtctatgggaaaacatccctacaggctgagtgcgaaagtaatgctttgtttaatgtgatcatggccacagatccgacgtctcctccgcagtccgatggtcaatcagaggcgacttccaagaggagtagaacaacgacacggctgagaacattgacattaagaaccgtggatcagcccagaccggctgtttatgtggatcccgctaccgggagagcatccggaccgatgcgtgaaaagttccacagctacctaggcgtagtggcgcgagaaaaggttcccattatccacaataattggaaagacgtacctgaaacgctaaaggagattgtgtggaatgacattctaatcaaagttagagaccagaacaaatcatgtgtataa

SEQ ID NO: 4252 - DNA, 456 bp, Glycine max
  Peptide Sequence Number=SeqID_121030
atggatgcgccccagcacctgctcgcccagcgggtaattcagctcgccgtcctggttctcaaatgccgaggacaccagcgcccagctgccgataaatgcgtttaccgtcattacgcttctccgcctgccgcactactatttaatacatcgagagacaacgggctctcatccaatcaatacgctgaggaatacatcatgaaaaacgtcaaaatttttgctaccgctgcgctgctggctaccgcttctttcgcaaccttcgccgctgacctgccgtccagccaaccggctgcagacgcccagaaaatcggcgtagtctccgttagcggcgccagcaacctgagcgcgctggaaagcgaactggccagcaaagccgctgcgtcgggcgccagctcataccgcatcgtcgccgccggcggccagaacaaactgtacggcaccgcagaaatcttcaactga

SEQ ID NO: 4253 - DNA, 828 bp, Glycine max
  Peptide Sequence Number=SeqID_121031
atggcggcgcagctttacagcgccgtgcggccgcgtttcgccgccgacgatttggcgcaggggtcagagcgggagatccgcgccgccttcatcaatatgatttgctacttcggccgctatcaggtggaggaaagcgagcagcgggtggtgcatcagctcgaaggctgctcgttccccaactgggtaggcagccgtcagcgcattctgtggtttctggaagagctgggcgtgccctatcaggtgcaacgctacgaacgcgatccgcagaccatgctggcgccggcggcgctgaaaaagatccacccgctgggcaaatcaccggtgatcgtcgacggcgatctgacgctggcggaatccggcgccatcatcgaatacctgcaggaagcctatgacgcgcaagggatgttcatgccgaccgacttccacgcgcgccagcaataccgctactggctgcactacgccgaaggatcgctgatgccgctgttggtgatgaaactggtgttcagccgcctcggccagccgccgatcccttggctgctgcggccggtggccggcgcgatcggcaagggcgtgcagcgcgaatatctcgacaagcagatcgcgccgcactgcgagtatctcgagcagcacctgaacaagggcagctggttcgtcggcaacgacttcagcgcggcggacatacagatgagcttcccgctggaggcgatggcggcgcgcggcgcgttggatgattgcccgaaactgcgcggctttctgcagcgcattcacgcccggcccgcctaccagcgggcgttggagcagggcggcccttacgacctgctgagttaa

SEQ ID NO: 4254 - DNA, 354 bp, Glycine max
  Peptide Sequence Number=SeqID_121032
atgaccacagcacaacctctgcaaggcaaagtcgcgttcgtccagggcggctcacgcggcatcggcgccgccatcgtgaaacggttggcgagcgaaggggccgcggtcgcctttacctacgccgcctcggccgatcgcgccgaatcggtggcaagcgccgttaccgccgccggcggcaaagccctcgccatcaaggccgacagcgccgatgcggcggcgctgcagcaggcggtgcgccaggcggtcagccagttcggcaacctggatattctggtgaacaatgccggggtgtttacgctgggcagcaccgaggagctggcgctggacgatctggatcgcatgctggcggtcaac

SEQ ID NO: 4255 - DNA, 168 bp, Glycine max
  Peptide Sequence Number=SeqID_121033
atggtgtttgggttgacaatcgacagtggtttcggtggaggcttggcttgcttgggagagatagggtatttgtgtccattcgggtcctttggaggtgcaaggagcaaaaaaggaaggtgcaagaagaaaaaagggagatccagaaacaaacagtgtgcatttacataa

SEQ ID NO: 4256 - DNA, 101 bp, Glycine max
  Peptide Sequence Number=SeqID_121034
atggaaatggaagttaacgttagaatcacgatgcgaatccgagtccgaggatctccgcttcaaccgcatcgcaattttgtgttaaatagtcagttcacgtc

SEQ ID NO: 4257 - DNA, 2050 bp, Glycine max
  Peptide Sequence Number=SeqID_121035
aacaatagctgttgcttgtggagtgtggcatactgcagctgttgtagaggttatcgcaacacactccagtacaagcatatcatcaggtaaattgtttacttggggtgatggagacaaaaatcgccttggacatggggacaaggaggcacgccttaaaccaacttgtgtggctgcacttattgattccaattttcataaaattgcttgtgggcacagtttgacagcaggcctgacaaaatctggacgtgttttcactatgggaagtactgtttatggtcagcttgggaatcctcaatctgacggaaaggttccatgcttggtcggagacaagattgccagggaatcgattgaagaaattgcttgtggagcatatcatgtagctgtattaacatccaaaaatgaagtttatacttgggggaaaggtgcaaatgggagactgggtcatggagatattgaagatcgtaaaacaccggctttggttgaagcattaaaggatagacatgtgaaatatattgcatgtggttcaaattactctgctgccatatgccttcataagtgggtatctggtgctgagcagtctcagtgctctacgtgtagacaggcatttggcttcactagaaagagacacaattgttataactgcggactcgtccactgccattcatgcagttcaaggaaagcattaagagcagcacacgctcctaatcctggaaagccgtatcgtgtgtgtgattcttgttatgcaaaattgaacaaggttgctgaagctagcaatagtaataggaggaatgccttgcctcgtctgtcaggtgagaacaaggataggctagacaagtctgacctaagattgtccaaggcagtaattcattctaacatggatttgataaagcagctagatagtaaggcagccaagcaaggaaagaaaggtgatacattctcactggttcacccctcacaaccaccttctttgctacagctgaaagatgttgtcttgtcctctgctcttgatctgagacgaacagttccaagacctgtggttgcaccatcaggagtaagttccagatctgtctcccctttctctagaagaccaagcccccctcgttcagctacgcctattccaacaacttcaggacttgccttctcaaaaagtatttctgatagtttgaagaaaacaaatgaacttttaaatcaagaagtgcagaagttgcatgctcaggtcgagagcctgagacagagatgtgaactgcaagaattagagcttcaaaggtcagcaaaaaatactcaagaagctatggcactggctgctgaggaatctgctaaatgtaaagctgcaaaagaagttattaagtcgctcacggctcagctcaaagatctggctgagaagcttcctcctggagtgtatgatgctgagaacgttagaccagcttacctaccaaatggtattgagccaaatggcatccgccatccagattcaaatggggagcagcactcaagagcagagtcaatcagtgcatctagtttggcctccatgggacttgaatctgctctattgaatagaactgcagggaattcgccaggaacatatggaactaatcctcaccagcaaattcggagccctgtgtcctctaatggggccaataattatccagatgttaaattgcctaatcgtggtggtgcaattcaggcaagcagcggtaatgtgtcagatactgctgatggtcgagattctgggaatttccacaacggcgatagtggtttgaaattgaggagtgttgcacctgctgctgatagtaatcaagttgaggcagaatggattgaacagtatgaacctggtgtctacataacacttgtggcactgagtgatggaacgagagatctgaagcgagtgcgcttcagccgaaggagatttggggagcaccaagcagaaacctggtggtcagagaaccgagacaaggtatatgaaagatacaatgttcgcagcacggataagtcggccaaccaagcagcacgtagttcagaaggtgctgtttcgcctgtttcccaaacttag

SEQ ID NO: 4258 - DNA, 192 bp, Glycine max
  Peptide Sequence Number=SeqID_121036
atgaattattccaccttttctgttattcattatatcatctccgattaccaagggaggagattgtatgcagaatcccttaaacaaaagggatcagactataagaaattggatagcattatcgaattgttcatagagaacacgatccttggtgtacaggatcggtcgaacattaggcatcatatgggacgatga

SEQ ID NO: 4259 - DNA, 1707 bp, Glycine max
  Peptide Sequence Number=SeqID_121037
atgtcaattgctttgagttcagtttgcaaagaaaaggtacattgggaagggcaaccaggacattgttctggcgagccaatcttgatttacctcacagtggatggtgctgtgaccccaatgcgtgtgtttgagtctgattccattgcttcggtgaaactgaggattcagcagtgcaaaggcttcgtggtgaagaagcagaagctggtttttagtggcagagagctagctcgcaatggcaccctcatcaaggagtatggtgtcaccgatggcaatgttcttcacttggttcttcgcctctctgatcttctcttcattgttgtgaggaccgtttctgggaaggagttcgagttccacatcgatagacaccggaatgtggggtatctgaagcaacgcattagaaagaagaaaggggaaggtttcattgatcttgaggatgatcaagagcttttctgcaatgatgagaagctcgatgaccagagtctcttccatgacatatgcaagagtgatgatgatgtgattcatttgataattaagaaatcggctaaggttaggaccacaccaattcacaaggatttgaatctctcggtggaggcaccagctaagagagtaaaacataaatgggaaaaacatgttcagatagcaaaggtgccacctgatgtaggtttctggttggagccaattattgtgaaccctaagatcaatttttttcctttcctttgggacatgataaactccacatttgaaggtttgaagaaaggaaatcaccctattaggtcctctgagggcactggagggacatacttgatgcgagattcaacaggtcaggagcatgtttcggttttcaagcccatggatgaggaaccaatggcggtgaacaacccaagaggtcttccaaattcatctaatggtgaaggtttgaaaagagggacaaaggttggagaaggagccttgagggaagttgcagcttatttattggatcatcccaagagtggaccgcgtttggcgtccggtgaagcagtggggttctctggtgttcccccttctgttatggtgcagtgcttgcaccaagaatttaaccacccaaatgggtttgcttgctcctcaaaacatgttaagattgggtcactgcagaagttcatgagtaatgatggtaattgtgaggactatggaccctcggcattcccagtggaggaggtgcataagattgctgtgcttgatataagattggctaatgcagacaggcatgctgggaatatattgatcagaaaggaggcagatggccagataaagctcattcctattgatcatggctattgtctaccagataaatttgaagattgctcatttgattggctttactggccacaagcacgtcagccttactctcctgagactgtggattacatcaattctctggatgctgaaaaagacttggaacttttgaaatgttatggatgggatattccacttgagtgtgctagaacacttcgcatttccacaatgctactaaagaaaggggttgaaagaggccttactccctatgcaattggaagcattatgtgtcgggaaaatttgaacaaggaatctgtcattgaagaaattattggggaagcccaagattccttgcttcctggcatggaggaatcggcatttcttgaagccatctcccaaatcatggattaccaccttgataagcttgcaaactag

SEQ ID NO: 4260 - DNA, 279 bp, Glycine max
  Peptide Sequence Number=SeqID_121038
atggaggttgaggaaccttggttggggttatggctaccattgaattatcgagtggatatgagagcaaggatgatctttatggataactgggtggtgggtaaggagaagggttgttattggctgagtaatgacatagttgggttggtgggaaacagttatgctaagactcaaacctatatacaatatggtatcatgtcagtgaaaaaccaagtcgggcgcctacgagtacatgacaagacaaaccacacactagcaagtcaagtcactctcactaggtaa

SEQ ID NO: 4261 - DNA, 423 bp, Glycine max
  Peptide Sequence Number=SeqID_121039
atggggtgttgttgcaccaaacagcgagtcgatcataaagatccagcagttcttgcttcccaaacctattttaatatttctgaaattgaagcactgtatgatctgttcaagaaattaagcagctccatcatccacgacggggttatcagcaaagaagagtttcagcttggcttatttggaagcagcgagaaacggagcctctttgccgacagggtcttccaattatttgactcaaaaaatgatggggtgatagaatttggagagttcgttaaagctctcagcgtcttccacccagcagcgccacaagcacaaaaagcagattttgcatttcgactctatgatataagtcaaagaggctttattgaacgtggcgaggtaaacaacatgaactgtgtcaagcatgagtacttaccgttaccctaa

SEQ ID NO: 4262 - DNA, 525 bp, Glycine max
  Peptide Sequence Number=SeqID_121040
atggacgtgatctttcttcacaatgatctagaggagaaaatttacatggagcagccaaaagggtttagtataggtgaactaggtcggttgggttatgttgagaaggtgctagacatgttcaacatgagcaatgcaaagcctatggatgctgaggtggaatacatgtcaaaggttccctatgcaaatatagttggttgcttgatttatgttatggtgtgcactaaatcggatttggcacatgttgtaaaccaagtctgcaagtttatgtctaacccaggcaagcagcattgggaaggtggtccttcagttgcaagatatgtggattttgactatgctggtgatctggatgacagaagacctacagcagggtatgtttttactcttggagatgggcttggtgaagttcaattacattgtgatagacaaagtgctattgacttggcaaagaatcaggtgtatcatgctaaaaccaagcacattgatgtgaggttctacaagattagcgagttgacgacatctggtcag

SEQ ID NO: 4263 - DNA, 252 bp, Glycine max
  Peptide Sequence Number=SeqID_121041
atgaacacaaatagaatttgtgaagaaacatttccagatatctatgcaccaaacacattaaaggatacgacggacaaatcacttagcgcacaagtcagcgtgcctcctcgcttagcagacaagctcaagcttagtgctaagaagtccataaagaagtccaaaggtgcgctcggcgcgaaatcccgcgccaagtgcatgaacgccttgctcagcccaaacattgtcgcactcagcgcgggatcaccacactaa

SEQ ID NO: 4264 - DNA, 705 bp, Glycine max
  Peptide Sequence Number=SeqID_121042
atgatatgcctgcttccggtctgtctttcaggtaatgagatgcataatcatgttgctcgtgatgatgaccgtactggtcaccgaatgctaaaggacacacaaacaattggatctgcttatgaccactaccttcagagtgggcaactttcttcatttacttctggggaagtcagtgcagttggtggtcttgggttggctaggggtggtggtggtggattatcaggccattcactagctgatcctgctgtcatggggcgtcatgggggtggtggttcagatctagcgccaaatggacggggtgttaattatggtggtcagctaccagtagatgcggtttccagacctggacctgagacaggatctctacctccagatgcttcaagtactttatatgttgaaggtctcccttctgatagcaccagaagggaattatttatattccttaacctcaccttagatattttccgcccttttgttgggtatagagaagttagacttgtgagcaaagaatcgaaacatcgtggtggagatcctcattacctttgttttgtggactttgcaaatccagcttgtgcagcaaccgctatgagtgccttgcaaggttataaagttgatgaactcaatcccgagtccagtcacttgcggcttcagttttctcggtatcctggtccaagaagtggacctgcttttcgcagtaaaagatga

SEQ ID NO: 4265 - DNA, 150 bp, Glycine max
  Peptide Sequence Number=SeqID_121043
atgatggaagtgttggtgttaggttgcacaggagtggtggtattccttcacggtgcccatttctttttccatgctctcacccaacacattgctctccgctctctctctctcagcgtaggaatgaataggatggaccacaatggtatgtaa

SEQ ID NO: 4266 - DNA, 2079 bp, Glycine max
  Peptide Sequence Number=SeqID_121044
atgatgccgaaacaaccgatgaacgttttgaccacaaaaccttcacctttgagcaccatggtggtgatgctgatcctctgcattctgggtttctacgctctgcatttccctcactcttccacaccttccgaaaacctctctcacttggaaaaactttttctttccacttcctcaaactctactatttcgtcctacctccgcgctcttaccatgcaccctcacctcgccggaacaaaacccgcttccgacacaacccgctacgtgcttaaccacttcacttcattgggcctctcggcccatacaacaacctacaccactctcctctccttccccgtgcgctcctccctctcggcgcattttaacgacggttcttcggtgagcctgcggctcaccgaagaagcgtcgggggcgggggtggtggcagcgtaccacgcgtactcgccgtcgggcgcggtgcacgcgccggcggtgttcgcgaactacgggaggcagagggactaccgcgcgctggcggcgatgggggtgaacgtgagcggctgcgtggtggtggtgcgtaagggcggggagatggggcggggcgcggtggtggagagggcggaggtgaacggcgcggcggcagtgctcgtttacggcgagggtgacacgtggcggaaggggtttgagaggggacacgtgatgagaggggggataggagacccacttactcccgggtgggctggggttgaaggggctgagacgctggggttggaagatagggaggttttgaagaggtttcccaaaattccatctatgcccttgtcagctgaggtggctgatactattttgtcctctcttgggggtgttcatgtgccccttcattggaggggtacccttaggtctaaggtcaggcatgttggtcctggccccaccttgctcaatttcacttacgagggtgaaaagaaggtggccaccattcaaaatgtttttgctgtcataaagggatcggaagaaccggatcgatatgttctgcttgggaaccatagagatgcatggacgtatggtgctgttgatcccagcagtggaacagctgcattactcgatattgctcgtcgattttctgctctactgggcttggggtggaagccaaggaggacaatcattctctgcagttgggatgcagaggaatttgggatgataggatccactgagtgggttgaacaaaaccttattaatctaggttccaaagctgtagcataccttaatgtggactgtgctgtgcaaggtcctgatttctttgttggttcaactcctcagctagacaatcttattcttgaggtcacaaacaaggtcaaagatcctgactctgatggtgtgtcattgtatgagaattgggctgctggtggtggaggcaataatattcagaggctcagtggagttgattctgatttcgctccatttgtgcaacacgcaggggttccatccattgatatgtattatggaagagattttcccgtctatcacactgcgttcgactcctataactggatggcagagtatggagatccattcttccaccgccatgttgctggagtttgggggcttctagctcttcacttggctgatgatcccattcttcctttcaattacgtttcatatgcaaatgagttgcagttgtacaaaaacacgttgagcaacttgatagaccagaaaatttctctacatccattaaccctttcaattgaagaatttgcttctgctgccaaggaagctgatgatgaaataaagaaactgagattgcaagaaactgaaggttgttttgtagatatgaaaaagcgagcattgaatgatagactaatgcttgcagaaaaaggcttcctggatgcagatggacttcagggaaagcaatggtttaagcatcttgtgtttgggccttccagcgaccatgaaaggatcaatttcttcccagggatttctgattctaccattacgtcagcaggtgtaagtgaaagagaaaggctagcatcaattcaacacgaaatctggagggttgccagagccattcgaagagctgcttctgcactcagaggagaattcacctaa

SEQ ID NO: 4267 - DNA, 219 bp, Glycine max
  Peptide Sequence Number=SeqID_121045
atgtacaattttagagttcaattttttacacaagtggctaatggtggagcaaatgtaattctccaggcctacagctgtaaggtgttcacctcaaaattaatgcttgttcattctacgtcccatcctcttgccaaagttgtggagcgagtgcagcaaggatcaactgcactgcagcaactgtgtggcagacattatatattggcgaactcaactacctga

SEQ ID NO: 4268 - DNA, 324 bp, Glycine max
  Peptide Sequence Number=SeqID_121046
atgggagaaagggaaagggagcagggttatgaaagtttaatgcatatagacaagatattaatgtccatgatgtatttccaaggtaggcagaagatacaaagctcatatttatgttctaatctcttctgtgcagttgatatgatgaaggctggagctacagtaattcttcgcaatgcaaagattgacatgttcaagggatcaatgaggatggctgttgacaaatggggccgtgttgaggtaactgatcctgcagattttgaagttaaagaggacaacaacctatctctggttgaatatgaattggtgaacgtggttgaagaataa

SEQ ID NO: 4269 - DNA, 234 bp, Glycine max
  Peptide Sequence Number=SeqID_121047
atgaaaagtaggatagagttggaagtgataagattaccgattggggcaataacaggcatcgatagaggtgacatggaaggtgagggtggtgtcagggtggaggatgtggaggagggagaagtcgaaaccaaagaatttgaatggaaggaatttggcaaagtagaaaagaggcgtgtggtaccacgcggggttaaggttgcaggaggggaaagacttgacatagcaaaggagtga

SEQ ID NO: 4270 - DNA, 432 bp, Glycine max
  Peptide Sequence Number=SeqID_121048
atgtctcatttcataaaatggaagggaagagaaaagggaggaaataccttcaggggtccaaccataggagtggcgagacacagagagcatcgaattcagcaatgcggaagcagtagcactgtgataaggaagcatcgattccacgcagaaactcgcttcgaccgaaaatgcgtagaggagcggcgttacctaaaaacgcgattggagattgaggtttgctttgggagccgaaacggagatcgtgccggtctcggtctagctccggcagccagattggccgcaccggctgctcgggaggcggcggagcgaagcaaacacctggcggcggacatcgtgaatgaggaaacagagctatgggtttggattctctttttgggttgctgctatattggacttccttgggcctatttacatccagtgcttcttctgtga

SEQ ID NO: 4271 - DNA, 2805 bp, Glycine max
  Peptide Sequence Number=SeqID_121049
atggcttcaagattctggactcagggtggaagtgattccgaggaggaggagagtgattatggtgaggaagatgaacactcggcgggtgaacaagctccgaatcaagacgtgacaagcaagtactttgtggacaatgcaagtgacagtgatgattccgatggccaaaagcgcgttgtgaggtcggcgaaagataagcgattcgaggagatggtatccactgttgaccagatgaagaatgccatcaagatcaatgactgggtgagtttgcaagagagctttgacaagattaacaaacagcttgagaaggtcatgcgtgtcaccgagtctgagaaggttccgaatctgtacatcaaggcgcttgtgatgctggacgatttcttggttcaggctttggctaataaggatgccaagaagaagatgagtagtagcaatgccaaggccttgaactccatgaagcagaagttgaagaagaataataagcagtatgaggagttgattaccaaatgcagggagaatcctgagagtgaggaggaaaaggaagaggaggagagcgaggacgagtatgagagtgatgatattgagccggagcagcttccggaagcaaaatctgattctgaagcctctcagtatgacaatgaaaagcaagatgctggtgatggtccttgggaccaaaagcttagcaagaaggaccggcttttggataaacagtttatgaaagaccctagtgagatcacgtgggacactgtcaacaagaagttcaaagaggttgtggctgctaggggccggaagggcactggcagatttgaacaggttgagcagcttactttcttaacgaaggttgcgaagacagctgcacagaagctggaaattctgttcagtgtggtttctgcccagtttgatgttaatccagggctcaatgggcacatgcccataaatgtatggaaaaaatgtgtgcaaaacatgcttgtcattcttgatattctagtgcagcatccaaacatagtggttgatgattcggtggaaccagatgagaatgagactcagaaaggggttgactataatgggccgattcgggtttggggtaacttggttgctttcttagaaagaattgatgttgaatttttcaagagcttgcagtgcatagatcctcatacccgggactatgttgagagactcagggatgagcccttgtttctggttcttgcccagaatgttcaggaatatcttgaaagagttggaaatttcaaagctgcatctaaggtggccttgaggagggttgagctcatttactacaaaccacaagaggtttatgttgcaatgaaaaaattgactgagctgacagaggatggagataatggagtggaggcaagtgaggagaaaggatttgaggaatcaagaattcccactgcatttgttgctaccccagaggttgtggcccggaagcccaccttccctgagaatagcaggaccataatggatgtattggtatcattgatatacaagtacggcgatgagcgaactaaagcacgtgcaatgctctgtgatatataccaccatgctcttcttgatgaattctcaattgcccgtgatctgctgcttatgagtcatctgcaagatagtgttcaacatatggacatttcaacgcagatactttttaacagagctatgtcacagttgggtttatgtgcttttcgggttggactgatttctgaagcccatggctgcctgtctgaactgtactctggtgggagggtgaaagagttacttgcacaaggtgtgtcacaaagtcgctatcatgagaagactccagaacagttaactactattttcaattctcaggaaaggttggaaagaagacggcaaatgccttatcatatgcacatcaatcttgagctcctggagacagtacatcttgtatctgctatgctgctggaagttcctaatatggcagccaatgttcatgatgcaaaacgcaaactcatatctaagactttccgtcgcttgcttgaggtgagtgacagacaaacattcactggtccaccagaaaatgtaagagatcatgttatggctgccacgaggtttcttagcaagggagacttccagaaggcttttgacattattgtgtctcttgatgtgtggaaatttgtgagaaatcgagacactgtgcttgaaatgcttaaggacaaaatcaaggaggaggcattgaggacatacctctttaccttctcttcatcttatgaatccttgagcctggatcagctcacaaaattttttgatctccctgtttcttgcactcatagcattgtcagtaggatgatgatcaatgaggagcttcatgcaagctgggaccagccaactgggtgcattcttttccaagatgttgaacactctaggctgcaggccttggcattccagttgacagagaaattatctatccttgcagagagtaatgaaagagcaacagaggcaaggataggtggtggtggattggatctgcctctaaggcgcagagatggccaggactatgccgctgccgctgctggtagtggaacagcctcgtcaggtggtagatggcaagacctgtccctttctcagccaaggcaaagcagtgggcgtgcaggatatgttggtggtggtggaaggccaatggcattaggccaagggagtggctattccagggatcgatcgggacgaggatcaggtgctggctatcagagtggacgatatcaggggggttcagcattgaggggaccccatggcgatgtatctacacgcatggttagccttaagggtgttcgtgcttag

SEQ ID NO: 4272 - DNA, 2032 bp, Glycine max
  Peptide Sequence Number=SeqID_121050
ggaaagagaggtgaggttgtacttatttagtcctcgtaaaattcagaaatttgactttgttctgaatagaccagaagtaagaccagtaacatggaataatgatgagctttctacagatgctctgccagtacatgggttcgagcattacagggcaaaggactattctcttgctcatgctcccttctcaggtagcagttatgctgggggtcagtgggctgcaggtgatgaaccactttactatattgtatctctgaaggatgtagttattgccaaaccaagggatactgaagatcatatttcatggcttcttcagcatgggtggcatgaaaaagctttggctgtggttgaatctggtcagggacggagtgaactacttgatgaggtgggatctaggtaccttgatcatctgattgtggaaagaaaatacagtgaagcagcatctttgtgtcccaagttgcttcgaggatcagcttcagcatgggagagatgggttttccactttgcacatcttcgtcaactccctgttttagttccttacatgcctactgaaaaccccagactacgtgatactgcttacgaggttgctctcgttgcattggctacaaatccttcttttcataaggatctcttgtccactgtaaaatcctggccatctgtaatttattctgcattacctgtaatttcagccattgaacctcagctaaatacttcatccatgactgaatcacttaaggaggcattagcagagttgtatgtaatcgatgagcaatatgagaaagccttcttgttgtatgctgatcttatgaagccagaagtatttgattttattgataaacataacctacacgatgcaattcgtggaaaggttgtccaactaatgaggctagactgcaagcgtgcagttcctttgttaatccagaatagggacttaataagtccacctgaagttgtgaagcaacttctaaatgcggatgataagagtgattgtagatattttttacatttatatctccactcattatttgaagtaaatcctcatgctgggaaagacttccatgatatgcagattttttatgttgaggccttgagggtgagctttggtgaaacggtagaactctatgcagactatgatcctaagatgctgctaccttttctccgtagcagtcaacactacacccttgagaaggcttacgaaatttgcattaaaagagacctattgagggagcaagtcttcatcctaggaaggatgggaaactcgaaacaagccctagctgttattattaacaaattgggggatatagaggaggccgtagagtttgtcaccatgcagcatgatgatgaactttgggaagaattaatcaagcaatgccttcacaaacctgaaatggtgggcatattattggagcacacagttggaaatcttgatcccctttatattgtaaataaggttcctaatgggttggaaatacctcgtatttgggctggcctcaagttccagagatatattcaactccgggatcggctggttaagattatcactgactacaggactgaaacatcactcagaaatgggtgcaatgatatccttaaggcggactgtgtcaatcttttaattaagtattacaaagaggcaaggcatggaatttctttaggtaatgaagaagatgagccgcgggttaaaatgagtgatactcgtgcttctcaggtatttgacaaatctccaagtctgagaactgtggaggtgaagtcaaagactaggggaggtggaagatgttgtatatgttttgatccgttttctatacagactgtctcggtcattgttttcttttgctgtcatggttatcacacaacttgtctcatggattcatcttacactagtagtaacaagaaagaggtccaagccacgaccctagaggcagaaacgtatgatgattacaatggttatgacgatgatgctagtgatgacgatgaagaagccaaatcgggtggtcctcgtatgcgttgtatattgtgtactactgctgctagttga

SEQ ID NO: 4273 - DNA, 288 bp, Glycine max
  Peptide Sequence Number=SeqID_121051
atgaagacagagtccaaagtagcagctctggaaaatgaagtagccaatctcagatctactcttgctgaaatgaagtctaaggcagatgagcaccaggaaaagtcgatggagatgttgacaaagggtatggagaaattaacttcttcattgggatggaagaagcttcaagggaatccaatggatgaatatggatggatgagtgatggcaacattttcgagcaacttacggctcttcagcaagtagggagtgtagatgagatgagtaaatacaggaatttgaaaagttaa

SEQ ID NO: 4274 - DNA, 1077 bp, Glycine max
  Peptide Sequence Number=SeqID_121052
atggcaccgtttccgccagagaacggcgtcgaaggagacgatgagagagaagaggaagacgaagaagaagaagaagacgacgaagaagaagttgaagatgaagaagatgaagaggaaccgaggctcaagtaccagagaatgggaggaagcatcccttcgctgcttgcgagtgacgccgcgtcgtgcatcgccgtcgcggagcggatgatcgctctcggcactcacggcggcaccgttcacatcctcgattttctcgggaatcaggttaaggaattctctgcacatgcttctgttgtcaatgaccttagctttgacacagaaggtgaatatattggaagttgttccgatgatggatcagttgttataaacagccttttcactgatgagaaattgaagtttgagtaccatcggccgatgaaggcagtggcgttggatccagattatgcaaggaaaatgtctaggagatttgctggtggtggtttggctggtcatttatatttaaattcaaagaaatggttgggctaccgagatcagtaccttttgtttgttaacgataaaattaccccgccctaccctccccaccctccccaaaaggttttgcactctggtgaaggttcaatacatgctgtgaaatggagagcaagtcttgttgcttgggctaatgatgcaggagtgaaggtttatgatactgccaatgaccagcgtattacatttattgaaaaaccacgagggagcccacgccctgagcttttgcttcctcacctggtttggcaggatgacaccctcttggttattggctggggaacatctgtcaaaattgcttcaattaggacaaatcaccaaaaagcagccaatgggtcattcaggcaagttcctttgtctggtatgacccaggtggatatcgtggcatcttttcaaaccagctatttcatctcaggacttgctccctttggtgatgctttggttgttctagcatatattcctggagaagaagatggagataaggattttagtagcactgctccttcacggcaggaaattcctccaagcatcttaaatgaagtagtcacttcttga

SEQ ID NO: 4275 - DNA, 855 bp, Glycine max
  Peptide Sequence Number=SeqID_121053
atgtcaggcagagggcggggacggggaggatggggatggggacgaggaggtggatttaatacatttgcctctcaagttccatttgatctttttcctgaggctgttactttgcctgatgttaaccttgatgatattcatgatgataccaaaaagttgcttcgttgggatagtcaccttcaaaattattgggaagcctctccttattttctcgaggacaaaacctccaagaagaggcaaagtatgcacatagctaaattctctgacaggaagaagaacgatttcactcgtgactctctctcacaagttttaatgttcaatgatttccctcaggagttagttcaaggtgcatctaagcgtgcgtcgagaagaaaaaagtttcgatggaacccagagtcagagatgaagaaacttgatttctttgaacaacaagagaaaacaaaccagggcaaagaggaaaatgatgaaaatgaaaagaaagatggagaagatggagacgaggatgaaaatgcacaagaggaggatgaagaagatattagtgatgatgattataatcagaatatagattttgatgacgatgaagatgattataatgatgtagatgacggggatggtattgtcactttacttttccaatgcatttctcatttttcattcacttcaatcatcttaatccaaattcaacaactgtggcaagtttgttcaacttatcaattcttctgctcaactactatttttcctttatcacagatgaacctacctattagatatcagtatggagaatgttcttctgctcatcccgtgacagctatacaagcatggactgttgctcctttaattttacagtttggaagttaa

SEQ ID NO: 4276 - DNA, 573 bp, Glycine max
  Peptide Sequence Number=SeqID_121054
atggcactaagctgtgcttatttcatggctgagatagccatgagcatcaagaagtcttttctttatgtgatttatgaaccaaaggtgaatgttctatggctttctgattctacagtaatggaaatgatgggctcatattcatacagacttccagctgatgatgttttgcaaggtggaaatggccccaagacaaatgttgattcattacaaaatactattattgccactaccctgttaggaagcataatgatcttcatccctttatcaagggaagaatatgagctcttagaagcagtgcaagcaagacttgttgtccatcatttgacagcacctgttctaggaaatgatcataatgagtttcgcagtcgcgaaaatcgggttggagtacccaagatacttgatggtgacatgttgacccagtttctggagctgacaagtatgcagcaaaagatgattttgtctttggagctaccggatatggtaaaaccaagtttgaagccactcctaccctcccatgtttctgtaaatcaggtggttcaacttcttgaacgagtccattatgctctgaactaa

SEQ ID NO: 4277 - DNA, 573 bp, Glycine max
  Peptide Sequence Number=SeqID_121055
atgacaaagttgacctttaataatatgtccaaaacaataagggaaatccctaaatggagctggagcacagttcctaaacgaatgaagatcaattacttatcatacatcaacaaacttcttctaatatgcattgttgtattacttacaacattcctaacagtcaaatgttcactacctcactcttcagtcactgaaatcaacctcccagaaacctcaaccagtgtatacaatatcacacttaactcattcttcaacttcaaacacccaaccacaaagtatcttctaccatctgcgccaccaaacaacacgttgtcatggccacgcccattcatactcaatctgtcgaacacaatacttcaccaaataagtacaaacataacttgccaatcagaaatctccaagaaaaacgacgatcttgctacaaaccgcgcgaaccacgaacccaccggacccaatcggcacatccaaaaaacgacccacacgaaatcgatctcgaacgaccaccaatgcactgttttgcaactacaatcgtgctccacctccactcaggaatcgagctcaagcttcatttag

SEQ ID NO: 4278 - DNA, 624 bp, Glycine max
  Peptide Sequence Number=SeqID_121056
atgtacttggagattgttcctggttgcgtggttcttgaatctggaactggcagtggatcgttgacttcttcgcttgcaagggcagttgctccttcaggacacgtctatacctttgatttccacgaacaaagggctgcatcggctagggctgattttgagaggacaggtctaagcagcttagtcactgttcaagttagggacattcagggtgaaggatttcctgatgacttgactggcatggctgactctgtatttttggatctacctcaaccttggcttgccatccctgcagctgcaaaagtattaagacatgatggcacactgtgctctttctctccttgtattgaacaagtacaacgaacatgtgaaacactccgaacccggttcacagacacaaggacatttgaggtactcttacgcacgtatgaagttcgggaagagaaaatgcaaagcttatgtggggatagcaatggttctgttcctagcaagaggaaacaatgctctggtggaagctatgtactaggcagcagtccatctacttcttctgtcatggctagaccttgtggtgaagctcgaggacacacgggctatttgacatttgcaagagttaaatcactctcatga

SEQ ID NO: 4279 - DNA, 828 bp, Glycine max
  Peptide Sequence Number=SeqID_121057
atgggaacagcatgtggttatggaggaggcatagttgatgccctgaatgctaatttctatggaaatggtactcaaactttggttctagctcacggatatggcactgaccaaacggtgtggcgttatcttattcccttccttgcatgctacttcaaggtgctggttttcgatttgcctttcgccccaaatgtaaggccttcttctctttatgacccaaagaagtattcaacctttaatggatatgctcaggacttggtgtgccttcttgatgagctcaatttgagcaaaactatttacgtgggtcattccatgtccgccatgattggatgcttagctgcaacaaagaaacctcaactctttgaacatctagtcctactggctggttctccaatgtacttgaataaagaagggtacgaaggagggttcactagatcagaactggacaaaatctttgaatcaataaagcaaaacttttcagggtgggcacacagctttgctccatacgctattagcgcaaacgatcctgctgcagttgcagaatttgaatgcagtctgctaagaatgaaaccagaagttgcactaagtgttgctaaaacagtgtttctaagtgacctcagatgtgttctgccacgagttcgtgtgccagcttccaccataattcagaccagaaaagaccctattgttcctgtaaacgtttctttttacatgcagaaagaattgggttctctttccaaagtcataattctagaaacagaaggtcattttcctcagctgacagcttatcgttcgttgttgcaagctcttaaggattcattgtctctgaattga

SEQ ID NO: 4280 - DNA, 570 bp, Glycine max
  Peptide Sequence Number=SeqID_121058
atgaggaatgaggaatggcggggcatgagaactgagaaggggggactggaccctttggcagtgtctgcagtattctctgctgcgcaatacatgggagagaaacaaatctcaggcatcgattgcttcgttctaaagctgtcacctgatcagaaggacctcgttgaccgaagtgacaacactgctgaaatgatcaagcacgttgcatttggctacttcagccagagaaacgggcttctggtgcacctagaggactcttaccttactagaatccaatcccctgggacacaccccacttattgggagaccactatgtcaacgaaaattgaggattacaaaatggtggatggtgtgatgattgcacatgctggccattcaaccgtgatcatcacaaggtttggagacaatcttaaaacaggacctgccatcacacggttggaagaatcatggaccattgatgatgttgcgttcaatgttcaaggcctttccatggactgcttcataccccctaaggaactccacaaggattacccacaagaagatctagattggagatcacccttgcatagatga

SEQ ID NO: 4281 - DNA, 1047 bp, Glycine max
  Peptide Sequence Number=SeqID_121059
atggagggtgagggtgcagcagtgtggcaaggtgcggttttaggtggaataatcttctggcttgtttctgcttcataccttaacgctactcgcaaacttaggtctttcttacaaccttgggttactcatcacgttgacactcaaacccctattatcctcaagatccagagttacgggtttgggttcctggatgcacttttctctgggttgtcttgcgttgtttctgtgcccttttacactgcttttctccctctgctattctggagtggtcatggcaaattggcgaggcagatgacgttgttgatggcgttttgtgattatattgggaactgcacaaaggatgtggtttcagctccaagacctgcttctccacctgtcaagagagtaactgccacaaaagatgaagaggataatgcgttagaatatggattgccttcttctcacacacttaacacagtttgcttatctggctaccttttgcgctatgtcctgactcatactcaaattcaaggtgcctatgttacttatcttggagtttctcttgcctgtatgctggtgtttctcattggattgggaagaatttatcttggcatgcatagtgtggttgatgtccttgctggccttcttattggacttgttgtccttgcattttggcttatggttgatgaatacatagacagttttgtgatctcaggacaaaatgttacgtccttttgggctgccttgagcttcctcttgctttttgcttatccaactcctgaacttccaactccaagctttgagtatcacactgctttcgatggtgttgcattgggaattggagtgaaaggggaccagaatggggaaggagagaattgtggtgttagtttgggcagagagctatctcttagagcttcagctctgggactgctgtatgctgcagttgtaatagaactatttggagatgttagaatcaagtactcccctaggatttgttttggtagtcctccgatattaactgagcatgccaggaagggccagagaagagctgttctatgtcttggttga

SEQ ID NO: 4282 - DNA, 188 bp, Glycine max
  Peptide Sequence Number=SeqID_121060
atggactacctagacgaggagcagcgtcgcgccatcacgatgaagagctccttcatccttctctgctacgccgtagggtttggtctagggtcggccaaggctggcgagtatttgggtgaagtaaatggcggattcgagtggtgcgagcgtggtgttgcggcagcggcggcggcgttgatagtgttaca

SEQ ID NO: 4283 - DNA, 1179 bp, Glycine max
  Peptide Sequence Number=SeqID_121061
atgcagttccataggtgtatttgttgctgtcctcttattaaattggagtttcacctcggtaatctatgtgataaaggtttgcattatagagaacagcaccaaaaagcacttcagcacctgagttttgaatgtcgtagcatgttggcgagagttttctatagagtcatagttttgttggtccgaggtttatgtgagaaggctaaggagattttaacggatgaaagtaatgttcagcctgttaaaagccctgtgacaatttgtggcgatattcatgggcagtttcatgatcttgctgaactgtttcgaattggagggaagtgtccagatactaactacttgtttatgggtgattatgtggaccggggttattattcagttgagactgtgtcagatgaaaatagaaaatgggactatgcccaagtggtagatagttcagggtttagaatgtgctgcaaagataggggttgtttcacatacaattttaggcattgtggtggtttaaaagaaatcatactgtcatacaatttttccatgattgacagtctcctcgtggcactgaaagttcggtatcctcagcgaattactattcttagaggaaaccatgaaagccgtcagattactcaagtatatggattttatgatgaatgccttagaaagtatggtaatgctaatgtttggaagacctttacagacctttttgatttttttccattgactgcattggttgaatcagaaatattctgtttgcatggtggactgtcgccttcaattgagacccttgataacataaggaactttgatcgtgttcaagaggttcctcatgaaggccccatgtgtgatctattgtggtctgacccagatgacagatgtggctggggaatttctcctcgtggtgctggatatacttttggccaggatatatctgaacaattcaatcacacaaacagccttaagttgattgctagagctcatcagcttgttatggatggatttaactgggctcatgaacaaaaggtggttaccatttttagtgcacctaactactgttaccgatgtgggaacatggcttccatattggaggttgatgattgcaagggccacacatttatccagtttgaacctgctcctaggagaggagaacctgatgtcactcgtagaacgcctgattacttcttataa

SEQ ID NO: 4284 - DNA, 1079 bp, Glycine max
  Peptide Sequence Number=SeqID_121062
atgaaccatgttgagcatatcgcttatgacatggtcatgatcactctatccatatctctcatcgttcttgccatcatcctcttccttgcttgcaagaagaagcccgttgaatccgaagaaacacttcccgtgaagctttgtgctcgtgcataccccttgatggaaatcgatgctgccacagatggcttcaaccacaggagaatcattggccagggtcgcttaggaaccgtgtatgcagggacactagagcaagaagaacaacaacttgtagccgtgaagcgtattcacccctttcttgtgttgagcaatgcagggtttggtttctcatccgtgttgaagtggctctccttggctcaacaccccaacgtggttccaatcacagggttctcagaagcacccggtgagagagttgttttgatggagtttgtgcacatggcaagcttggacttctacttgcaccaaaaccaagatggggcttcgcttttggattggaacaagaggttcaggattgctgctggagcagctagagggcttcaatacctgcatgaagtggtggcaccaaacatagtacatggatgtgttaagtcctctaatattctaattgatgttaacttttgtgctaggatttgtgattatgggcttaactttttggcacctgtggaaaagagggggatagtggggtatgtggatgatgagtattggagtgaaagaaggggtggtggtgtagctaccaaggaaagtgatgtttatgggttaggggtggttttgttggagcttttaagtgggaaagggtgtgagggaggaatgttggtgaagtgggctttgcctttgataagggaaacgagttttagtgaacttttggatcctaggttggtgattccttctgacatgaagcctttggttagattagccaaagttgcttcagcatgtgttggtaattcacgcaaatgtaggccttcgatggctcaagtggcaaccattttgaacaacttagaaacggaagctaaggagtcagagaatcatttttggtggggaattttgaaagagaaaggtgggacggtgccgttgtcgttaggacg

SEQ ID NO: 4285 - DNA, 300 bp, Glycine max
  Peptide Sequence Number=SeqID_121063
atggctgaaaattttatcttttggaagtttccaaatatgtccttgtaccaggagaccttgagatggttgctaacagttgagagcatagaacttctcagtgaatggattcttttgaatgcctttatgcaggactttgatccaattaggcatgttttagagcacgttccagttgaagagaacgagctaacatattttgaaaaacaggctgcccttagattggcacaactagatagagtagccgagcgtttatctcgccatgttatggagcatcatgaagtgatgggtaagttgaagaggtga

SEQ ID NO: 4286 - DNA, 852 bp, Glycine max
  Peptide Sequence Number=SeqID_121064
atgacattgacgctctcaatacccaagaaatacattacactatgtaaccatgtaaggggggtttattgtaaagtgaaggggatgaatttggtcagagaattggaaaaagacttaagaattgcaaatgtcatctgtatgaatggaagaagacacttgacatcatctatgaatgaggtttcaagagatctgattgtgaattcttattctaaaaagaaacaagctcttctggacatgcttccaaccttgactgaacttcgacgtgcattggacatgccatcaacacttgaatcccttgtagaagaagggaattactggaaggcatttcaagtcctatctgagtatttgcaaatcttagatagtttgtcagagctttcagcaatacaagaaatgagtcgtggtgtggaggtttggctgggaagaactttacagaagctggatgctcttttattgggagtatgccaagaattcaaggaagatggctatataacagtaattgatgcatatgcattaataggggatactgccggtcttgctgaaaagatacagagtttcttcatgcaagaagttatatcagaaacacactctgtattaaaggctattgtgcatgaggatgaggagggactttcgcaaaatagtaggcttacttacagcgacttatgccttcgaatacctgattcaaagttcaggcaatgcttattacgaacattggctgttttgtttgaccttatgtgttcataccatgaaattatggaattccagctagaaagaaaggactcagcagcacaaacttcaaataagtgcaatgaagagatttcctgtagtccaggtgagactcaggaagttgattcagat

SEQ ID NO: 4287 - DNA, 240 bp, Glycine max
  Peptide Sequence Number=SeqID_121065
atgggttctcatctccaattatctttccttgtgcttgttatggtcactttggcaacatttatgatccctacctttgctcagctcactcctaattattatgacaaagtttgccctaaggcgttgccaatcataaagtcaattgttaagcaggcaattattcgtgaaaaacgcattggagcatccttgctgcgtttgcattttcatgactgctttgttaatgactgcttttttataatatga

SEQ ID NO: 4288 - DNA, 454 bp, Glycine max
  Peptide Sequence Number=SeqID_121066
gctaagtgccaatatgcttatatttttcagtcctttgaataactgcgctaagcccttgttgtgtgtcgaggcggttaagctaagtgtgccctgctacgctaagctcaactctctcactgctaagtgcgagtctgctgcgcttggcccatggatggcatcaaagaagagaaaggcacctgccacaccttcccaggtccgatatgaccgatccaggttcacttctcccaaggctttggaaaggtacactgacattgtggtacccaggaagatactctcggaaagaaatatggtaatctaccacactgagtttgataagttcaaggaagaattggagagaagaaaatgggatgaggagttcaccaattttaatgaaggcaacattgatgctgccattgtgaaagagttttatgctaacctctatgatcccgaggataaatcacctaatcatgtgagg

SEQ ID NO: 4289 - DNA, 609 bp, Glycine max
  Peptide Sequence Number=SeqID_121067
atgtcggagaccacggtgttcgtgcgcggctgcatggaaaaggccttcctggaaggcgggctgcccgacgttatccgcaccgacaacggctcgcccttcgttgcgccgggcatcctcgcgctgacgcagctgagcgtgtggctgataaaactggggatacagccggaaagaaccgcgccgggctgtccggggcagaacgcccgccacgagcggatgcaccggtcgctgaaggtcgccatgagccatcacgacgtctttggctcgctgccagagcagcaggcgtggtgcagcggatggcggaacgagttcaatcaggaaaagccgcatgaggcacacgggcagcagccgcccgcaaaaatatggacgccttcaccgcggaaatggaacggaaaagtgccggaggtgggttatccggagggggcgaagctgtacaaagtcggtgaaaaaggcgacctgaggctgaacgggcggaccttcctgagcgcagcgttacggggcgagtacgtgcggttcctggaagtggacgacggcattgacgtcatcctcttcgacaggctcatccttgcgtattatgaccgggcagaaaagcgtattatccggatcgactga

SEQ ID NO: 4290 - DNA, 693 bp, Glycine max
  Peptide Sequence Number=SeqID_121068
atgttgtttggcgccatcattctgcaagccgtgctcgccatctcactgctttccggctttcaggagcgctttgaatatgtgcagaccaacgccatcccctcaatcaaagacctcaacacgttgattgatcgcagcaatcagctggcgctgacgctgtacaaacaccagacccagttgcaggacagcaacatgcccgccgttgaagcggacattgatcaacagatcggcgggctgaaatcgctcaccgattactacatgaagcatgatatctccagcgaggaagataagcgcctgactgaggtggcctttagcaatattcagcgcgtgactgagcggctgcccgcttttctcagtgcgtcgcgtgcacaccagaatgccatcagcctcgacctgattgagggccagagcggcatcggtgccgctattcgtcagctgattgccgattatcagaagcagctgatgctgaacatcgccattggcgacgaattacgcgccaccaaccgcagcaccttccataatgtgttgtggacgaccatcagcggcgtggttgcaacagtgctggtattcggtctgttcgccctgttcaccgtactgcgcatccgccgcagcctggcggatgtcggcaaagtgatgatgcgcgccagtgaaaatctcgacctgacgctcagcgcagacgaaagccgtcgcgatgag

SEQ ID NO: 4291 - DNA, 888 bp, Glycine max
  Peptide Sequence Number=SeqID_121069
atggcttcaaggaaaagaaaggcaccttctacaccctctcaagtgcgatatgacagatcaagattcacatcccaggaagcttgggagagatacacagacattattgtgcctaggaaatttctacctgagagaaatgtggtggtctacaccacagaatttgatgaattcctagatgagctggatagaagacactggagggaggagttgaccaactttctggatggcaacattgatgtttccattgtaaaagaattctatgcaaacctctatgaccccgaggacaaatcacctaagcaggtgagggtgagagattcggaggaagagcatgacactcttgctcagacttggagtgttctttccttttcaaaccttattcccacttcccacacttctgatgtcactcttgacagagccagactcatttatggaatcatcatgaagatactcatgaatgtggggtacctcatctcccaccagatgtccctcatagcacagcatgacacatccagactaggattccctgccttgatcatagctttatgtaagactaggggagttcagccagattcgaggtccctagagagcctgagtcctgccattaatttggcatatattaagaagaactgttggaatcttgatgatccaacagtaactttcagaggacccaggaaggccaggggtaagagatctgaggccccttccacttcagcaccatcagaggcaccaacaccttcttcttctctagtacccccctcttcatccactcagattctagttattcctccaacacctctacagatgccactcccagctccatcatctacaagaccattagactttttaattactccgcagatgcttcactccatgatgcagagtttgcactga

SEQ ID NO: 4292 - DNA, 210 bp, Glycine max
  Peptide Sequence Number=SeqID_121070
atgaaatctaagcattttcaggtgaaaaagaggctaagttttgaagtgcaaaaatgcgaaggagaatctggaaaagcatcagcatcaaggctacgcgttaagcgcaagatcagtgcgctaaccacagcaggtgtcttcagccaggctcagcacaagactggcgctaagcccaaacccacttactcgcgcaaagcgcgagggtggcactaa

SEQ ID NO: 4293 - DNA, 270 bp, Glycine max
  Peptide Sequence Number=SeqID_121071
atgttacagatgaccaaccaaatggacaaaaatggtatacgaatgaagattgaaacattcaagagtttataccacgtggatgaaaatggtaaaatgcctctttgggcttataagaaggcagcccctacaccacaggagtcaatcacttcgaggaaaattgaggcagaggctgtagactgtcctaaaggagagcttgtcacgagaatttcaaacaaaagagatcgtcccaatgcagcattaggaggaagcgtaattgttgtaacgccataa

SEQ ID NO: 4294 - DNA, 216 bp, Glycine max
  Peptide Sequence Number=SeqID_121072
atgcctatgactaaaataaaactgattcagaatgaaactcttgccctggcgagcacggccgcacacagagaccacgccaacgagttccttgacgagctggagcgtggcgacggcttcggggtccatgcggaaccgttcattctcgtcgcaatagacaaggcgaattggactcgccggatcaatcaccggcgacgaagaaggcgtcgcctacagtga

SEQ ID NO: 4295 - DNA, 984 bp, Glycine max
  Peptide Sequence Number=SeqID_121073
atggcggatccggccggaatccggctccgtgagtggtgcaagcgtggtgttgcggcggcggcgttgatagggttacagtgcggctgtgagctcacgccttacgtgctcctacgccgacctgataagaccgttaccaccgatgatttcccggaaaccgccccgttagacggccatttcttgcgctacaagtggtatcgtgtacagagtgataaaaaggttgctgtttgtagtgtacatccttctgagcaggccgcactgcagtgcctaggttgtgtaaaggctaaaatacctgttgccaaaagttatcactgctctccaaagtgtttttcagatgcatggcagcatcatcgtgtcttacatgaccgtgctgcaagtgcagctaatgaaaatggaaatgaagaagaagagttatatgggcgatttaataattctggatctggatctggatcaatcaataccagcttatcttcctctgcatcaagtgctagcttgacaaatgggtctgcacctgtgtatccagcagctgtgacgcaacggagtggtggtgaaacttggtttgaagttggacaatttaagacgtataccccaacagctgatgacattggacatgtccttaaattcgagtgtgctgtagttgattcagagaccaaacttgctgtagggcatgtaaacactctactaacttcccgtgtcattcctgctccctcgcctagcccgcgccgactgatacctgttgatgggatgggacatttggatgctgatgggcgtataacatcttcaggaacttttactgttctatcatacaacatattatctgatgcatatgcctcaaatgacctatacaattactgcccttcgtgggctctttcctggccatatcgcaggcaaaatctgttacgagaaatagttggttaccgtgcagatattatttgtcttcaggaggtacataaatgttgttttggctgtgattttgttggtcattaa

SEQ ID NO: 4296 - DNA, 1986 bp, Glycine max
  Peptide Sequence Number=SeqID_121074
atgacagctataaagatttcagagaatagatcgggtagaaatctggattggaagtgcattatatccatgctccttgatgaaagtccatcagttgagctctctgacagtgatgcaacaaacttggtgcgactcctgtgtgcatccgtgaaaaaggctattggagagaggattgtgcctgctacagataacagaaagcattactacaacaaagcccagaaagaagtatttgaaagtaacaaacaggatataactgttgccatgatgaagacttacccattactcttgcgaaaattcatttcagataaagcaaaagtctcatcactggttgagattgttttgcatatgaaccttgaatactattccttgaagaggcaggaacagaatttcaaaaatttactccaactcgtgaaagaagcattttttaagcatggtgacaaggaccctcttagggcttgtgtgaaggctattgatttttgttgcatagaaagtcaaggggaattgcaagattttgctcgtaataaattaaaggaacttgaagatgaaatcattgcaaagctgaaatccgctattaaagaagtactggatggtggtgatgaatattctcttcttgtaaacttgaagaggttgtatgaactccaactaaaaagatctgtgcctatcaatagcctatatgaagacattgtcacggtgctacgtggtaatagggatatggaggatgaggttgttggtttcctgcttctgaacatgtatttgcatctggcttggggtctacagtctatagtaaatgaagaagctgtttctgaagcatccttaaattctcttttgtctaagcgtgataccttgttacaagaacttgaatactttctcaacttggctgatgataacagggaagggggtaaatatacaagtgaactcggctgcagagtatgcactatacttgcagaaacatggttcttatttaggacaacaaatttcaacaagacaaaactggaaaaattaggatatcagcctgacacagatatgcttcagaagttctgggaactttgtcaacaacagcttaatatttcagatgaggcagaagatgaagatgttaataaagagtatgctgtggagacaaatagagatgctgtgatgattgctgctgcaaagctgatcgcaaatgatgttgttccaaaggaggatcttgcttctgagattatttcacattttgtgatgcacggtacaagtgtggctgagattataaaacatctgatcacagttttgaagaaaaaagatgttgatttggctagcatttttctggaagcacttaaaaaggcataccataggcatcttgtcaatatgtctggaagtgagaatgtttcttcagaaaacaactcttcctcaggatgtaaagatctggctgctaagctttctggaacatttatcggtgttgcccggatcaaacacagacctgacattttaaaagttgtcagggatggtattgaatatgcttttgtagatgctccaaaacaattgtcatttcttgaagaggcagtgctccattttgtgtcaaaactgactgcacctgatctatcggacatcacgaaggatgttcaacagcgaacaacaaatgtcaatacagacgagaaccccagtggctggcgtccctataaagtatttattgccaacttactagaaaaatgtgcaaagaatgagggatttcaagatgagaaagaaggggtttctgttaggcgtaggggccgtcctcggaagaggcaaaacataccaggaaagaagctttttgatgagcagagttcaagtgaagatgaggattccattagtgcatatgaacaagatgcacaagatgaagggaaaagacaagaggatgaggatgacgatgaccgattgataaattcaatcccatcatcatccaagcttaggtcactgggagtttctaggggggaaagcaaagtatctgcttctagaacatcaggggcatcaagctag

SEQ ID NO: 4297 - DNA, 210 bp, Glycine max
  Peptide Sequence Number=SeqID_121075
atgaaagccggattagcctctgattttgtagtgcaagggcgtgctcacggggtgaagatcccagaacattggtgccacaagatgatccatttaagcaattgtgagttgcagaaatgctttcaagagtgctctaaacaaccatatggcattggagattgcaaggactccacttgcttctgcacatactattgtaaagaacccccactataa

SEQ ID NO: 4298 - DNA, 279 bp, Glycine max
  Peptide Sequence Number=SeqID_121076
atgacgttgaatttgtggtgtatgtggtcatgttttgttcttgatttgggtggcatagctttagctgaatttataatgaggatggagtctcaggtgaagcacgcacttgttgtcaaagtaatgggtcgtactggatccagaggacaggtgacccaggttagagtgaagtttctggatgatcagaaccgtcacatcatgaggaatgttaaaggaccagtgagagaaggagacattctcaccctactcgagtctgaaagggaagctagaaggttgcgctaa

SEQ ID NO: 4299 - DNA, 267 bp, Glycine max
  Peptide Sequence Number=SeqID_121077
atggagccgtggccgaggttgagagacgagagaggcgcgtcggggttggacatgtcggtgaatcggtggagatcttctagggattttgccaagaggaggttctggtttgtggacagggccgtcgcggctacgaattctgagcatcatcgtgacggtggtttcaagacaatggggaattggagtgggagagaagcgattggggttagtagaaaaggttcgcgcaaggaaaagaagaaacaagtttcagcttcgtcgacggcagaatga

SEQ ID NO: 4300 - DNA, 1766 bp, Glycine max
  Peptide Sequence Number=SeqID_121078
ccttgactgttcttattcagttggaatgaggttcaggatgcgttttgaaactgaagatgcggcagatcgaagattcactggattaattgctggaattagtgatgttgatcctgttagatggcccggatcaaaatggagatgcctactggtaaggtgggatgacatagaagctgctaggcacaatagggtttccccatgggaaattgagccatctggttctgcttcaaattccagtaacttgatggcagctggtttgaagaggaacaggattgaaatgacttcagcaaagctggaatttcccaatcccaatgggattcaaacatcagactttggggaatcgttaaggttccggaaggtcttgcaaggtcaagaaattttgggtgttaatactcccccctttgatggtattaatgctcagagtccctggttatacgagttagggaggtgctatcctggttcaaactgttctgggattcctccaacaggaaataacatcagagtgccgcatccggcatctgatttttcctgcaatggcataggctttagtgaatctttccggttccagaaggtcttgcaaggtcaagaaattcttccaagccaaccatatggaagagccttatctattgaggaggctcgagcaaatggtcgctatggattttatgatggctgtcagttacttaactccagaaatggatggtctgcacagatgcatgacaatgcttcacatttgcatgcatctgttacacctgcgcaagtgtcatctccatcatctgtgttaatgttccagcaagcagttaatccagtttcaaactgtgattataacattaacaaatgtaataaggaaatggagggtagaatccattatcaaggcttatacacatctgaaatgaaaggtagaacattggcatcttccccatctgacgatcttattgtatctaggcgagctccagagggtgctagttctataggtatgtttgatgttcataatcagttgggtagttcacagttacatgaatcagtgtcagcattgagaagcagtcaaaagttggtttcctcatgtaaaagtagttgcagactctttggtttttcattgactgaggacacacatgttgcaaatgaagaggtatcagcctctaccatcactttaccattgagttctggaccttcgtttactagacttgttgaagatgagttccatcctggccattcgcatccgagtaaggcggttggaagtaactgcaccaagtatttcaaaaggaaaaggaggcagtccctctctgaggctcttgaaaagattagaacagaattgatgcttctgggtttcacatctctgctgctaacggtgagcgaaaaatcaattgcaaatatttgcattccaaagggtgcaggcgaaactcttattccctgtgcaagcataacttttgatgatgccaagaaacaaaatgtgcagagcagttggaaacttaattcagagaaaggcactcaagttagaacatgcatatatgcatcacataaggcatggtcattggaagagaaaacaggggagccaggtgtaagagagcagcaatacttcatcttttatctggctaggtgtcatgttgtttccagcttcctcacctttggtcttggattggcgaaggggatgttggacttgtgtttgacaaactcacctttggttagtgaccgtccttggaagcatatgcagattaggcgttcggagtcttgggaaggagaaactagaacattggaatatcagtttgcatatg

SEQ ID NO: 4301 - DNA, 969 bp, Glycine max
  Peptide Sequence Number=SeqID_121079
atgaagataagattttttcttgtagcttgtttggcagtgttctgtgtcttaggggtttgtcaaggaggcaacctcagaaagaaattctacaggaaatcctgtcctcaagccgagcagattgttaggaccaaaatccagcaacatgtctctgcatgccccaatttgcctgccaagttgattagattgcattttcatgactgttttgtcaggggttgtgatggctcagttttgctggactccactgccaccaacattgcagagaaggatgccattcccaatttatctttggctggctttgatgtcatagatgacattaaagaagcattggaggctaaatgtcccggaattgtatcttgtgctgacatactagctttggcagctagggattctgtttctgcagtcaaacctgcgtgggaagtgcttaccggtagaagagatggcacagtatccgtaagtggtgaagccttggccaatctgccggcacctttctacaatttcaccacgctcaaagcaagctttgctagtaaaaatcttaatgtgcacgacctggttgtattatcaggagctcacacaattgggataggtcactgtaacttattcagtaaaaggcttttcaacttcaccggaaaaggtgatcaagatccttctttgaaccctacttatgccaatttcttgaagacaaaatgccaaggtctcagtgacaacactacaacagtaaagatggatcctaacagctcaaacacctttgacagtaactattattctatccttcgccagaacaagggtctattccaatcagatgctgcccttttaacaacaaagatgtcaagaaacattgtcaacaaattggtcaaaaaagacaagttcttcacaaagtttgggcattcaatgaagagaatgggagcaattgaggttctcacaggctccgctggggaaattaggaggaagtgctctgttgtcaacgcttaa

SEQ ID NO: 4302 - DNA, 2748 bp, Glycine max
  Peptide Sequence Number=SeqID_121080
atgaacccttccacactcaccccttcccacacccaccgtcctctcctcctaccctctcccttccacaccagacggcgtcgttttaaagtctccctccctcgctgttcctcctcctccgccgcctcctccccccctcctccgccacctccgccgccgcagcgaccgcccaaggacctcaagggaatcgatgtcctcgtcgacaagctctcgccgccggccaggctcgccacctccgccgtcatcgtcgccggcgccgcggcggctggatacggcctcggctcccgcttcggcggaagccgctacgctgcgctcggtggagctgtcgccctcggcgcggccggcggtgctgcggcgtacgctctgaacgcggctgctccgcaagtcgccgccgtgaatttgcacaactacgtcgccgcgttcgacgacccttcgaagctgaagaaggaagagattgaggccattgcgtccaagtatggtgtgagcaagcaagatgaggcattcaaaactgagatttgtcatatatattccgagtttgtatcttctgtgcttcctcctggtggtgaggaacttaaaggtgatgaggttgataggattgtcagcttcaaaaattctttgggaattgatgacccggatgctgctgctatgcacatggagattgggaggaaatttttcaggcaaaggttggaagttggggatcgtgatgctgatgttgagcaacgtcgggcatttcaaaagttgatatatgtgtcaaatcttgtatttggagatgcatcgtctttccttctaccttggaagcgtgtattcaaggtcaccgattcccagattgaagtagctgtacgtgacaatgcgcagcgattgtttgcttccaagctgaaatcagttggcagagaatttgccatatctgatcatcttttaccacaattcatttttggcataggtggagagtatgatggtgacagaaaaatagaggacttgaaactcctttacagggcatatgtttcagatgctttgtctggtgggcgcatggaagatgataagcttgctgcactaaatcagttacgaaatatattcggactgggtaaacgtgaagccgaggccatttcacttgatgttacgtcgaaggtatatcgcaaacgacttgcacaggctgctgcagatggtgagttagaaatggctgatagcaaagcagccttccttcaaaatctatgtgatgaacttcattttgatccacaaaaggccagtgaacttcatgaagaaatttatcggcaaaagcttcagagatgtgtagctgatggggagctcaatgaggaggatgttgctgctttgttgaggatgcgtgtaatgctctgcataccgcaacagattgttgaagcagctcattcagatatctgtggcagtttgtttgaaaaggttgtcaaggaggcaattgcatcaggggttgatggatatgatgctgaaatccagaaatcagtaagaaaagcagcacatggcctgcgacttactagggaggttgctatgtctattgcaagcaaggcggtaaggaagatttttattaattacataaaacgtgcacgggcagctggaaatcgtaccgagtctgcgaaagaactgaagaagatgatagccttcaacaccttagttgtaactaatttggtggaggacattaaaggggagtcaactgatatttcctctgaagaacctgtgaaagaggacattacacaaactgacgatgaagaatgggaatcacttcagacactcaagaaaataagaccaaataaagaacttacggaaaagttgggaaaacctggtcagacagaaattactctgaaagatgatcttcctgaaagggataggactgatctttacaagacatacttactttattgtctaactggtgaagtgacaagggttccatttggtgctcagatcactactaagaaggatgattctgagtatcttcttctaaatcagcttggtgggatcctgggattgagtagtcaagaaatagtggaagtgcacaggggtctagctgagcaggcttttaggcaacaggctgaggtaattttagccgatggacagttgacaaaggccagggtggagcagcttaataacctccagaaacaagtaggcttacctcaagaatatgctcagaaaataatcaagagtataaccactacaaaaatggcagctgccattgaaactgctgtaactcaagggaggctcaatatgaagcagataagggaacttaaggaagctgatgttgatttagacagtatggtatctgagaacttgagagagaccctcttcaaaaaaactgttgatgacattttctcatccggtactggagagtttgacactgaggaagtatatgaaaaaatcccgtcagatctcaacattaacaaagagaaggcacgaggtgttgttcatgagcttgcaaagggtagactatccaactctctgattcaggctgtctctctactaagacagagaaatcagcagggagtggtttcttcactcaatgacttgctggcatgtgacaaagcagtaccctcacagccagtttcatgggaagtgccagaggagctttctgatctatacaccatatacttgaagagtaatccaactcctgagaatttgtctcgtttgcaatatctgttgggtataaatgattccacagctgctgctcttagggagattggagatagattactcaatactactgcggaggaagagaagtttgtattctag

SEQ ID NO: 4303 - DNA, 975 bp, Glycine max
  Peptide Sequence Number=SeqID_121081
atgaagatgagattttttcttgtagcttgtttggcagtgttctgcatcctaggggtttgccaaggaggcaacctcagaaagaaattctacaagaaaacatgtcctcaagctgaggagattgttaggacgaaaatccaggaacatgtctctgcaaggcctgatttgcctgccaagttgattagaatgcattttcatgattgttttgtcaggggttgtgatggttcagttttgctggactccactgccaccaacactgcagagaaggactccattcccaacttatctttggctggctttgatgtcatagatgacattaaagaagcattggaggctaaatgtcccggaactgtgtcttgtgctgatatattagcattggcagctagggatactgtttctgtcaaatttaataagccaacatgggaagtacttaccggtagaagagatggcacagtatccataagtggtgaagccttagctaatctgccagcacctttcttcaacttcacccagctcaaagaaagctttgctagcaaagggcttactgtgcatgacttggttgtattatcaggagcacacacaattgggataggtcactgcaacttattcagtaacaggcttttcaatttcaccggaaaaggtgatcaagatccttcattgaatcctacttatgccaatttcttgaagacaaaatgccaaggtctcagtgacaccaccacaacagtagagatggatcctaacagctcaaacacctttgacagtgactattattctatccttcgccagaataagggtctattccaatcagatgctgctcttttaacaactaagatatcaagaaacattgtcaacgaattggttaatcaaaacaagttcttcacagagtttggacagtcaatgaagagaatgggagccattgaggtcctcactggctctgctggggaaataaggaagaagtgctctgttgtcaactcttaa

SEQ ID NO: 4304 - DNA, 1122 bp, Glycine max
  Peptide Sequence Number=SeqID_121082
atggaaatcccggaaaatgcgtggaacggagacccttatggctttggccttgcaaattatgttaactcctatcttccctttgatattaaagttattagcattttgccctcacaaaggagctttgatcccaggaaggaatgtattttgcggaagtattcctacctcctccctgctgaaattattggtattcaaagccatttcagcgatgaagttgattaccacatatcagagttcaatgatattcttaatgtatttgaggggatacatcctttccataattatacggctaggtccaagtacaggaaacaatttcctaataggcagtcatcatcaaagagtggcacatcagcaagggagagtttgtcatatgagtctgaatgtgagtacagtgacggggaagaaaactctgaaactgatgaggcatatacagaaaatatagtgtgccaaagccagaagttttcagaaactcatcattttgctgaacctgttgttggctctagcaataagaatggaaatggtttgcatgaccaagactctagattggttgctcgtgcaagatggttatatgaacctgatgaagcagacagattaagtgcttcccatttcagaaaagtttttcagtgttcctgtggaaaactggaaacatcactgggatataattacatagagatctccatccagggagagtccttcatgttacatcagataagaaaaatggttgggacagctgtggcagtaaaacgcaaggcactgccaaaagatattataaagctgtcactgacaaggttctcgcggattattctaccccttgcaccttcagaagctctgatattaaggggaaacagattctcaataagaacacgaccaggaaacataacaaggcctgagatgcagacaatagttaaatcagaagaaattaagaaggcagttgatgatttttacacatcagttatgctacctcaagtttcaaaattattggacccatcaagatctccttgggatgaatggattgagaagctggatgctcacacaagcataccaaatgatcagttggatgaggtcaggaaggcttggaatttgtttaaagaaaaatttgaaactacaactagcactcatccatga

SEQ ID NO: 4305 - DNA, 231 bp, Glycine max
  Peptide Sequence Number=SeqID_121083
atgtcatccgtctcttctgcacgcgccccaacggtcagagagaggctactttcgtcatttcgggactttgaatgggggtgggccccgctggagggttaccaaaaggaactagaccggtctttgtctccatcagaggctgtcagctaccgtcaagtgggtttggattggacggtcacgattcgcccaagagacccacccactctttatctctctgtgatacctggaatctag

SEQ ID NO: 4306 - DNA, 240 bp, Glycine max
  Peptide Sequence Number=SeqID_121084
atgggaggatacgtaggagcaagagcctcacttttgtcgaccacaccaccttttgttgtcatgacccaagagctggtagcaagcggagacaccttacggttatccgcacctcgtcattcagtgaccccaagtgtgattgatgagcagaggccaatatggtcatctgcgccctttccggagatgtcaacatcttccggtggagactttttcaagtctcataagttatctagaactacgtag

SEQ ID NO: 4307 - DNA, 1560 bp, Glycine max
  Peptide Sequence Number=SeqID_121085
atggcgagtagctgtgtttcttcttcgcctcactttctttcaattccaactcgtgtaagagataacagaagaatatccactttggtggcaatgctattcccttcttcttcttcttcatttccatttctgcttcttcctccaacactcctcaaatgcttctgtgcttccacttccactcagtcccttccaaccccttctgaaaagtgggaacctttcctcaagaaaaaggttgtaatgagagttggatatgttgggaccgattttagaggtctgcagatgcaacgagatgaacacagattatccactgttgagaaagaactggaaactgcaatctttacggccggtggcatgcgtgatagtaattttggggacttgaacaaagtgaaatggggccggagtagcagaactgataaaggagtgcactctctggcaacaatgatagcctttaagatggaaatccctgagaatgcatggaaaggtgatgactatggcattgtgcttgcaaaccgcattaactcttatcttcctaatactatcagagtttttagcatactgccttcaacgaagagatttgatcctagaagggagtgcaacttgcggaaatattcttatctcctccctgctggtataataggaatccagagtcattttagccaggacgaaattgattttcatatttcagagttcaacagtatacttaatgtttttgagcctaacttaactgtgactggggactgtttatgtattgctaacaagggagagcatcctttccataattatactgttcggtctaagtacaggaaaaaataccaagtaaggcaatcatctggaaatgatgtcatgtcagatagaataggatcatctagtttgacatcagcttgtgaatcagagagtgaggaaggtgatgatgatgattttgtgagtggcagaccaaccacatttagtgacaaggaagagagccacaagcctccagagtctagtgaatccaatggcttgagtagtcaaaactctagtgtagtagttcgtgcaaaatggctatatgaaccagatgagacagatagattaaatgcttcccatttcagaaaggtttttcgttgttcatgtgggaagttggaaacatcacttggatatgattatattgagattcgcaaaatggttgggactgctgtagctgtaaagcgcaacttaatcccaagagatgccattttgttgtcactctccaagttttcgcggattgtcctcccccttgcccccccagaagttctgattttgaggggaaatgctttcaaaatgagagcaagtgctggaaactttacacggcaagaaatggtgtccatggttgaatcagaacaaattctcgaagcagttgacgagttctacacatctgttgtgttgcctgaagtatcaaagttcctagactcatcaaactctccttgggcaaaatgggttgagaatttggataagtactcaagcattccagatgctgagttggatgaagtcagaaaggcttggaagacatggaaggaaaatttcaggttaaagtcagcatcaaaggcatag

SEQ ID NO: 4308 - DNA, 402 bp, Glycine max
  Peptide Sequence Number=SeqID_121086
atggacatgatgaagaatagcccttgtgatgtctcttcttcttcttacatgcttattgaggccagtggtgactctgaagctgattggaacccctttgctatgggtgaacatgcttatgaaattggcagagcagatgatgatgctcaatcttgcatctatgatgattctgagacttgtaatgctgctgatgaactcaatggatatgatgagtcctggaataatgatgatgatgatgctgaagacgagaagaaagatgatgttattcatcatggaacttcatattgtgatgatgatgagatgcagcaacaccagaagtcatgtgtgtctgatgattctggccaagaatttgtggatgagatggaaaagaacaggcttttctgggaagcttgcttggcatcttga

SEQ ID NO: 4309 - DNA, 126 bp, Glycine max
  Peptide Sequence Number=SeqID_121087
atggccgtaaaacatcaagtaggcaacgtgggtgtggttattgaatcaggcactaggcagccagcatacatctatgaagcgtgtgggcaattgtcaatgccatcagcaaaacctaagatgccttaa

SEQ ID NO: 4310 - DNA, 858 bp, Glycine max
  Peptide Sequence Number=SeqID_121088
atgacaaagtcactgatattgctaactcgacaaggttcaagtgttcccttagttgtcaaatgggctgatactgaaaaggaaagacaagctcgaagagctcagaaagcacagtcccaagcttctaatgtaccacatactgattctcagcacccatcattgtttggagccttgcctatgagttatgttcctccgtataatggatatggttatcaggctcctgtaggttatgggctgatgccgtaccgcatgccaccgatgcagagtcaacacggttaccataatatgatgcctcacatgaatcaaggaaatgcattacggcctgatcttggccccaatatgaaccctagaaactatcatgtgcctcctgcaagttatgttggctcttatcctgctgtgccaggtctacaacatcctatggcatatcctacaggaatgattagtccaaggcccatgaatacttctcctggttcagtttcacctgccagtggaaataacaaccatgctgcatcttcaggtgccagcaaaaattctgggggtcaggctgaaggaccacctggtgccaacttatttatttatcacatacctcaagaatttggagatcaagagcttgctactgcttttcaaccatttggtagagttttgagtgctaaagtttttgttgataaagcaaccggtgttagcaaatgttttgggtttgtaagttatgataccccagaggctgctcaatctgccatcagtatgatgaatggatgccaattaggaggtaagaaattaaaggtccagcttaagagggataacaaacagggtaaccttactgatgaagctgaacaatggaattttgtacaattcacattgtaa

SEQ ID NO: 4311 - DNA, 787 bp, Glycine max
  Peptide Sequence Number=SeqID_121089
taatcatggtgcaacttctgaagggattcttgagaatgtgtgggccaaaattatgagcagtgatagagcagatggaagaaaaggtgatgccgcagaatgttctaactcttgggaagaacttcctaaccttgatggaagagaagggtccatggaaattctacaaaggcttccaagtttagggaggtggatatcaatgggagctgatttctgggaagaagttttagaaggtattattctacctaacacaagcaatacagaatattccggtagcaataacaacttggaaattggaagcgctaatgaaactcataacaaggtgggagatgctgtgagaatagagaagtcagttacaaaacactaccggggagttaggagaaggccatggggtaaatatgctgcagagattagagactcatcaaagaaaggtgctagagtttggcttggaacatttgacactgctgaagaagcagctttgtcttatgacaaggctgctttgaggattagaggtccaaaggcataccttaatttcccacttgagatggttgcaaatgctttagcatgtgaccacaaagctgtaactcatcttgcttgcacatgtatagggaacaaagaaaaattgatcaactccaggaagagagcatcaagggaaagggaagcatttgatgatatcatgaatgaacaacctgcaacaaaaaagttggaatgcatggtagaaaatgaactaggtgcttttgtatttcatgacctaggaagtgattacttggacagtttactgtcttctttttga

SEQ ID NO: 4312 - DNA, 795 bp, Glycine max
  Peptide Sequence Number=SeqID_121090
atggcaatccaaaacgaagggcagcaaagaacaagtagggaaagtaagtccactcctccctgggtgtcccagaaaccacaaaatattctatacctatgcccccaccattctatagatttatgccgagtccaaaaccacttgacacaccttgccaacttgcccttccttcaaaaaccaaagagagacagaccgactccgagaagaaacaaagaaacaaacatgggaagcaacaaaacctacgaggaagaagaaagcacggttctattttcccattcccaaacacaaacagagttgttacccttcaacgagaacgacccgcaggacatggtcatataccaagtcctcaacgaagccaatgctctcaccaacacatttctccctcagaggcttcaccaacctcagttgtgcctcgagcccaccagaaacataacaaagaagcactacagaggagttcggcgccgcccctggggaaaatacgccgctgagattcgcgactctgcccgccacggcgccagaatatggctcggcaccttccaaaccgctgaagaggctgccatggcttatgaccgagccgcgttcaagatgaggggctccaaggctttgctcaatttcccagctgaaattgttgctgcaacggagttatctttcaataatactaatagtaacaatcacgatgctgtttctgattccagtgctggtagctcttgcacgaacaattccgttcagctaaataggaatcagtcagaaagctgcacaagtagcacaggacaccgaaaattaattcatttaatgtga

SEQ ID NO: 4313 - DNA, 785 bp, Glycine max
  Peptide Sequence Number=SeqID_121091
ctaggatctctctgttgggactgctcatgaactctgagcctcatcgagcactgttggtcaagatcttgaatgaaccccatgtagctcaagacatatcagtggagggcttcaggggcatagtcagcaacatcactaccaacaactaccttaccttcactaatgaggaggtaccagtcgaaggcaggggacacaacaaagccttgcacgtgtccatcaaattcttggaccatatagtgaccaaagtgttcgtcgacaatggctcatccctcaacgtcatgcctaaaaccacgttggataagtttccttttaacgcatcgcacataaggctgagttccatggtagtgcggacttttgatgatccactcggttggggtggtcccgtcaatgctacaccagaaattaaagtttgtagtggaagggcagctggttatagtatcaggggaggaagacatactgaggagtcgctggaaacatcattccaagtactggaaattgtgagcaatgcttatgtggaatctcctctgatgcacctacgcttatcgggtaccgctttgatggtggctcgtgttatgttaaatgatggatatgaatccggaatgggtttaggtcaaaacggggatggcacgacaagcttggtggagttcactgagaatcgtggaaggttcgggagagaagcctggctcatcaacaagggcatggactgcgagtggaaagggtccccatttgtcacatcagcaaaagctttgttagtgcgggatagatgtgcgaggatcaggttgtggtga

SEQ ID NO: 4314 - DNA, 264 bp, Glycine max
  Peptide Sequence Number=SeqID_121092
atgtgcgaggatcaggttgtggtgatagatgaggaaaaccctcaagaccgaccaaattgggtgcaggcatgtcctccgggctttgaattggagaattggaaaatcatcaaacaacccgagatttccattacaaattcaatatctaatgatgagtcctatgaaagtagtgataccgaggactcagatgttgatttggagcaactaataaatcaagccgagaaaggaaaagatgaggattgggggcttcctccaaatttggaatga

SEQ ID NO: 4315 - DNA, 408 bp, Glycine max
  Peptide Sequence Number=SeqID_121093
atgtctggacctggtgccagcggagtcctaaaagcaacatccgctgatccctggtcggcatcgtttatggttgagactaggacgttgttcgtctttcataaatccaagaatttcacctctgactatgaaatacgaatgcccccgactgtccctgttaatcattactccgatcccgaaggccaacacaataggatcagaatcctcaccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccg

SEQ ID NO: 4316 - DNA, 709 bp, Glycine max
  Peptide Sequence Number=SeqID_121094
gtttgcactgctgaggcctgatcctcaggagttggctgctaagctctgtatcccagggaggggatttgagctaaatgttgatgggcagtcgttgaagatattgagaaagaacatgaccactttagctcagacatggagtgttctttccttctctaacctgattcctacctcccacacatccgatgtcaccttaaacagagccaaattaatttatggcatcattatgaagatggatatgaatttgggggccaaggaaggccagggtaagagatcagaggtccccactactttagcactaccagagacagcagctccttcttcttccaaaactctagtacctcctagtcaaactccagctattcctcctgcacctactcaaacaccacttccaactcctttatctgcaggaccttcagatttttcatttacaccacagatgcttcattccatgctccagagcttacacagggggcagtccattatcatgcaaagccttcagggcttgggcctgccatccatcatgagcatggatgagtttgatgcgcaggtggcctggccaggagcccagccttctccttccggagggggtggggccttcgcagcccagaagcctgagtcagaggagccagcagtagcaacagtagagggggaggatgagttcacccctcctgagctcttttatttggatgcaagtatacacatggcttag

SEQ ID NO: 4317 - DNA, 258 bp, Glycine max
  Peptide Sequence Number=SeqID_121095
atgtgtagaatgcacaacacccttcaactagccaacgatcaattagtggatgaagtctactaccgacaaccattcatagatgcagaattattatgtactattattagaacaccggatgctatactcaacctgcttcaatcaactattactcctattcatgatgcacttatgtattacaacgggaagtggaacataccacgacaagacgtgctaaaggtattagcacaatccaactattggaaacgactctgcaaatag

SEQ ID NO: 4318 - DNA, 255 bp, Glycine max
  Peptide Sequence Number=SeqID_121096
atgaaaagtgataaagcctcacaagatatacactctatctctcaagcttgtagtgagcttcaaacaaggaaagggaaacaaggctcaaaagggctatcaaaggaattaattcaaggtaagtccatttggctagaagcttataagaacaaaattgcctcaatcatttcaaaatatgcatgtgaattaggaagcatcaacaagaatcaagccaaggctattgtgcaagcaatcaatggggcaaaacacaccaaatga

SEQ ID NO: 4319 - DNA, 446 bp, Glycine max
  Peptide Sequence Number=SeqID_121097
gatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtggtagtagcaaatattcaaatgagaactttgaaggccgaagaggggaaaggttccatgtgaacggcacttgcacatggttagtcgatcctaaggacggggaagcccgtctgatagcgctctgtgcgcgtactcgaaaggaatcgg

SEQ ID NO: 4320 - DNA, 321 bp, Glycine max
  Peptide Sequence Number=SeqID_121098
atgggaagaggaagggttgttctggaaagaatagagaacaagatcaaccgtcaagtaacattctcaaaacgcagaagtgggttgctgaagaaggcctttgagctttctgtgctatgtgatgctgaagttggccttatcatcttttctagccgtggcaagctttttcagtacagcagcactgaagaaaaagatatggtcctgctcctgcattttcacttttataattacacatgcattaagcaccaccgtgtgcttcatgctagaggtctcgaattttcagatcttgctgagagtacatcagattatgtttgtgatttgtga

SEQ ID NO: 4321 - DNA, 483 bp, Glycine max
  Peptide Sequence Number=SeqID_121099
gtcatgagtgtgagaaatttgggggttaaggtattagtgattagaggagtgtaccaatttttggcggttttaaactgccagaaaacaagctgtctcaaaaccttccatgttaattctagcaacttgagtcactcatttcaaaggagtgaaagaactcagcctgtgaaagcttcagagatttcaggggactgggaacaagaaactgagtcaaaaataattgctaactgcaaagacctaagtgctacttcaaagacaatatatgcttcaaacttggcatacagtatggagaaggatgatatggagtttcttttcaaaaattgtggagaaattgttgatatccgcctacatacagatcataacgggcggtttaaaggccatggacatgttgagtttgcaaccacagaagctgcacaaaaagcatggcatagttcacgtttgtttatagccttgtctttggaatccaatgttggattggcatcgtga

SEQ ID NO: 4322 - DNA, 252 bp, Glycine max
  Peptide Sequence Number=SeqID_121100
atgaatgataatgtctttgatgatctgttgattctttcttgtgaggacgactatgcaatatgccaccgtttccttaagagaggaactgcagtttacagttcagagcttgttctgaacggaattgtaatccaaaaattggaacttgagagacaccaactcttcatgaatcaagttacaaggaataacccaagtgtgtcgaatcggtttgggaagatttacagaaggcgtagaggccttttttctggaccgtag

SEQ ID NO: 4323 - DNA, 660 bp, Glycine max
  Peptide Sequence Number=SeqID_121101
atggcggaagggaaggaagagagtaaatctagcgaggaaagtgtgaagctgttcgtagggcaagtgccgaagcacatgaccgaacccgaactgcttgcaatgttcaaggagttcgcgctcgtcgacgaagtcaacataatcaaagacaaagcgactcgtgcttcccgaggttgttgcttcgtaatttgtccgtcaagggaggaggcggataaggccgtcaatgcgtgtcacaataaaaggacgttacccgggcttttaagtgttttgcattgtgctgtattttctcctctccggggcttatttgtatttgcatctagtccattacaagtgaagtatgcagatggggagttggaaagattagaacacaaactcttcattggcatgcttccaaagaatgtttctgaagttgaaatatctgctcttttctccaagtatggaactataaaggatttacaaattttaagaggctctcagcaaacgagtaaaggttgtgcatttttgaagtatgaaaccaaagaacaggctcttactgctttggaggcaatcaatggaaagcataaaatggagttgtactatgttaattttgctgatgcaattattttggatcttcaagcggcattcagccacgaaatcctgttggtgagggacgtgaacatttaa

SEQ ID NO: 4324 - DNA, 735 bp, Glycine max
  Peptide Sequence Number=SeqID_121102
atgtatggggaccatcacgagttcacaacattactggctcaagatgccctattaccccaatccaaagttggcattcagggggaacaaccaaacacctatccacctgaaaactcagaataccaacctttggctcttgagataaccaaacctgcacctacttttgcacaaaccttaccagaccagaaccataacactcaaacagccgaacctttacctaaactagctgaaaggacagcaaaggttgtgacagaacctgcagcagaaactaaacaggatgtagttaaagtttcaactacatctcaacagaaccatggccaagaaacacaagaagataactggaaggtttataagagaaaaaggaggaaggatgtagagtcaagcacaactcaaatgcaaaaccatgaatccaaccaggctctaggaaatgaagttcccacagatactgatattcctaatgctaagggaaaaggggtgagaacttgcactcaacaccctattgagagatatgtctcctatggaaaaaaactacgtaccccattgtccagaggctcttcgctatgcgaaggtatgggggagggatgttgtacgcagtcttacccttgcatatgcaaagaggctgtttccggattcgaacccatgaccaacaagtcaccaaggcacaactttaccgctgcaccagggctcgccctcatgtctcctatggaaaattgtcacaaaagtgcaggtcctttgtag

SEQ ID NO: 4325 - DNA, 177 bp, Glycine max
  Peptide Sequence Number=SeqID_121103
atggctgatatgtactattccgatgaggttcatttactaagcaaggaaaaaaagaaaattgcccggagtggctctattggtcaggatgaggttaggggaaaagtgaaagaagtgattacgtcaattcaattcaatcttattcaaatgcagaatgaggcaaggtataatgtagtttga

SEQ ID NO: 4326 - DNA, 202 bp, Glycine max
  Peptide Sequence Number=SeqID_121104
gcattttcaaggagaagaccttgagccacttagctttaaagatttgcagagcctggagaagcaactagacataacgctcgcactaactcgacagcaccaaacgaagaaactcatggcacgagcggatgaattacgcgaaaaggacctcaacatgcttcatttttctcatggttcctcgccatgtgggactttctacacctag

SEQ ID NO: 4327 - DNA, 2319 bp, Glycine max
  Peptide Sequence Number=SeqID_121105
atgcttgaagggtacaaaggagctttagttgatggtgacagctttgatgacaacaaccattcatatccacctgcaatgctaagtcacattcactcaccagagcctggggattccactgaagctgcacttggctttgtggatcagtacttgtcatcaaatgatatggacttgtttcaaggaattcatcgtggaaagaccactagggagaaatcaccttatgatgtcctgagtgcaagaggagcactaaatctggctaagaaaattaaagctcgaactcaaaatgaagaaaaagaacctttcaaatgggttgaaagttgccaacatgacaacaaagctggtatgtttggtaaaaaaattgaagcatcttcaaattttggaagatacaaacagacatatacgagaaaaaggcagaaagaaggtggccatcttcagggacaaggaaactgtaatacaagtaatagatgtgatgagaggttacgccaaggatcaagaatggcaactaaaaataataactctccaaaggaattggatgttcaaccaattgctataaatgagaatgttaatgtttattccagtgtaacacatatagaagacatgcatgatattggtttagacactcaaatagctgctgaagctatgaatgccttagcctttgtgcccccttctggctgccagtttaatgatactcatcaaccagagaatgcattagatggctctttgagcgacttgacagaaaatgaagctcgtctgaagaattcttcatatattcagaatcctgatttacattctatcacaataaaatcaaataagaaaaatgcatcttcttctagatttagtaaaataacttttaactcagcttgcaagcaggagccaaatcttgtatcatggaaaatgaaaaaaatgagaagcaagtcatcttctgagggacagtttgaaaataatactagttttacaatgtgcagtaaacatgtatcgcttgaagaggtttgctcactgggagagcatacaagtttccaacctgctgccgaagaatccgaagattggaacaatgagagcagacagacaagaatcaaagatcaacaaagccatcttacagaggggaacaataatgtcaaggagaagggtattaaacacaagaggaaggggaatgatttagaggctgaaccagtgaagtttggtgtttggacaaggcgtcttaaattccctaccaattcatgtacagttgctaggaaaagcaggttgaatcatctggctcaagttagtccacagttatctgcaaccagcagtttttcaaggactgattcttgggtgtatccaaaaagatcgagagggaaaagaaagggggctaatgtgggaaccagtcttgatgcaccaacagctgtgtgtattgatggaaaagaaaacaaagttttctccactagaagtctacaggatcaagatgatgtggataaatcatgttttcctcacacccgtccactctgcaatgcttcatgtgcagatgatggcagatgcttgttgcagggaaactttgtgccaccaggttcagctggtgatgcaatgaaggtagaaaacttgcctgatatgcaccccttattgctggcacatgttggaatatcatcaaacaaaagcattgcacaatcgagatcagaaatgccagctacagttactgcaagcaaaggcataaaagtttcaaatgctaaccatacatacactgagcatcaacaaaagctatgtgaaaaaaccctgccaaagacttcagttttgaaagagcttatcagattaggagctcccaagttcacatcagataagatgtggaaagatctgagacatcgaagagatatgacagatgttcgagttctgtttagccaacatttggatgacagtattatgaagcagcaaaaaaagatcttggcacgtctcaatatatctgttgcatcatgttcaatggaggccacacatttcatagcagacaaatttacacgcacaaggaatatgttggaaacaatggctcttgggaaattagtcgtgaatcacttatggcttgagagctgtggacaagccaactgttttattgatgagaaaaattacattctgagggatatgaaaaaggaaaaggaaataggctttaacatgcctgtttctcttgctcgagcaagacagaagccgctcctaaagggtaaaagagtctacatcacgccacatattaaacctgataaggaagtggttgcaagtttggtcacagctgttcatgcccaggtatacatatcacctatgcatgccactccacatctgcagctgaaccggtggctgcaatattag

SEQ ID NO: 4328 - DNA, 561 bp, Glycine max
  Peptide Sequence Number=SeqID_121106
atgaacgaatcaacaccaaacatagagagctatctctatctacatccaagcgagaatccggcagtagctctcgtatcaccagctttagactcaagcaactatcactcatggagcaagtccatgatcacaacactaagcgccaaaaacaaggtggagttcataaatgggaacgcaccagagcctctgagaaccgataggacttacagtgcgtggagtcgctgcaataatatggtagtgtcatggatagtgcactcggtatcggtcgcgatcaggcagagcatcttgtggatgaacaaagctgaagaaatatgggatgatttaaagtcacgatacgcgcaaggagacctcttgagagtctcggatcttcaacaagaagcttcatcaatgaaacaaggaactctttctgtcacggagtacttcaccaaacttcgtatcatctgggatgaaatagagaacttcaggcccgaccctacttgttcttgcaccatcaagtgtacatgttcagttcttaccaccatcgcgcaacgtaaattagaagaccgagcaatgcaattcctatga

SEQ ID NO: 4329 - DNA, 495 bp, Glycine max
  Peptide Sequence Number=SeqID_121107
gacactggaacatcgtcaatggcagtttttggtagcgagaaggataaacaaaccagcaatagagaggcaggatcaaacgtgaaggtggtgatgcttggaaatagaagcaatggcgcggagaagagatggctatctaggcataaccagcaccacagggcagagtcaaacaggggatttcatttatcgcattcttccatcgtactatcagtgccaatggaaaccaaagcatgtgcggaggaggtggacttgaaataccttggaggagatatggttctgatcacggggattggtgaagacataatcaaggagctctgcaaagagggtgttgttgcaggttggtttgggtgttgtgttgggggtatccctctccatgcttgggattctcagaacatcaagaagatagtagggagcatggacgatgttatagatgtcgacgatgacgtcgagaacttgcatagaattgactgcgctagagttcttgttaaaacagcatga

SEQ ID NO: 4330 - DNA, 561 bp, Glycine max
  Peptide Sequence Number=SeqID_121108
atgccctccataccaaagatcttctcatatgtagcccagcaagaacgacaactatcaggtatcaattccctttcgaatctaagccttgaatcaaaagaaaatgtttctattaatgccgcgaaggttacttgtgaattctgcggacgagttggtcacaccgaaagtgtttgttacaaaaaacatggagtacccaccagttatgaagggagaagcaaaacctatagcagaagtgtgaaaacatgcactcattgtggaaaaataggacacaccattgatgtgtgttacaagaaacatggctatcccccagggtacaagtttggtaacagcaaagtagtcaataatatcatggaaggaaaaactgtgaatgatcaaatgcaacgacaagagtctcatgatttggttcatttttcacctgagcagtatcaagccttgctcgccttaatacaacagccatcttcaggaagctccattcctacccaaccccaggttgcatctatatcctcatgtcccactaacacttcaccaggatatcaacaccaaagcgaagattggtacagttga

SEQ ID NO: 4331 - DNA, 1074 bp, Glycine max
  Peptide Sequence Number=SeqID_121109
atgaatgtgccattaccctcaaacctagcggttgttgatggaagccctgaatggtttagtagagcagacaatgcatggaagctaatagctgcaaccctagttggtaaccctagttggtctgcaaagtgttctagggctcataatcttgtaaggtggagcagtgaagaagaaatgggtagtgaactcagcattcatgtcactctatgcttttacataatgtcttttggtgatgagcttcttcctttctggggaaagcctgctatgtcacttgagcatgcatatcttttcaagaaggcatttttgggggccttcccaaatgccacaatgtgtgtgtttgctgccatcactttgattctcattgctggggccgtgttggggcacatgaacttctatgcttggatgcttccctggccgttctcaacacccacgcttgctcacttggtcatccttgatgtcctctttttccgaaagccttctgtaattggagctgttcaaggcatgatcactggtttggtttgcataacccctgctgcaggtgttgttcagggatgggcatcacttataatgggacttctctcaggctcaattccttggttcaccatgatggtcatccataagagatcaaagctactgcagaaggttgatgatactatggcagtgttccatactcatgccattgcagaaaccctaggaggactcctcactgggctctttgctgatccaagactcaaccggttgttctatggacatgatgctcaatacgttgttttcttttatggtttcggttccaacaagctcagcaccggcttcaggcaaatgggagtccaaatccttgggattatctttgttatctttgtcaacttcattcggatcttttttccattgagaatttctgaagaggatatggagataggtgatgaggctgctcatggtgaagaagcttatgcaatctggggtcagggtgataagcttgaaaactcaagttcaaagtatggaagttcattatataatgatgttgaagctggtgcccccaagaagaagcgtgctggcactgttcagatgatgtccaactaa

SEQ ID NO: 4332 - DNA, 336 bp, Glycine max
  Peptide Sequence Number=SeqID_121110
atgaatgttgaattaaaggccgaagcttactcagacgaggtttatgctcaagttacattagttccggaggtccagaaagataacctttgttttgaggaggaggtaaacatagatcagataccttccagaaatgcagcttattcttttagtaagatactgactccgtcagacacaagtacacatggtggattctctgttccgaagaaatatgctgatgaatgcttccctccgctggacatgactcttcaaacaccagcgcaggaaattgttgcaaaggacttgaatggatttgagtggcgttttcgtcacatatatcgtgttgcaagaatgtactga

SEQ ID NO: 4333 - DNA, 303 bp, Glycine max
  Peptide Sequence Number=SeqID_121111
atgactgcaaccaggctatatacagaagaatattttcttaaccacatgtctaatgagggaattccagagatacagagatcaaatatggtctcctgcctaatccagttaaatgccttggggattgatattatcttgggctttgactggccagcatctccgtctgctgaagcaatgatccgagcactagaaattctctactcacttggggtcttggatgatgatcctaagctgacttcaccaactggatttcaagttgcagagattccacttgtaaatttctcttaccacaaacatcatgtttga

SEQ ID NO: 4334 - DNA, 846 bp, Glycine max
  Peptide Sequence Number=SeqID_121112
atgcaattgcaattggtgtcgccgtgtagggttccacgtgtaggaggtgcagtggtagtgggaggcattcatagaattgggaccttgacctccactgtcaccgtgagaagaagaagtaaagcagtgactactgcaatgcgagcggtggttcagcgcgtggcctctgcctccgtcgaggtcgaaggccgcatcgtctccgagattggccccggccttctcgtcctcgtcggaatccacgactccgattccgacgccgacgccgattacatatgccgaaaggtcttgaacatgaggctgttcccaaatgaaaatacgggcaaagcgtgggaccacagtgtgatgcagaaaaattatcaagtcttattggtgagtcagtttacgttgtatggattcctgaagggtaacaaaccggattttcacgtagccatggcgcctcagagagccaagcccttctatgcctctttagttgacaggtttaggaacgcctataactctgatgcaatcaaggtaaggactaatattaacaggttgtgtagcgtgttgaacacgttttcctctgcaaaaattcaggttatttatgaatcttctatcaaatctgttcacttctctctcttgcctgacaaagcagagttatacgacggtgtatttggagcaatgatgaaggtaaagttatgcccttcaatccctgtgcagggaatacagttgatgcagcagaatcttgatcagtggttgatctggcttgatgaaattgagcttgaattttggctcttccgtcagaaagaccaaatgcaagacacacattatgtgttattcattctagttgaagttctttctcccccaatgtag

SEQ ID NO: 4335 - DNA, 1219 bp, Glycine max
  Peptide Sequence Number=SeqID_121113
cggcttgaagaagcaatcaaaacgtccaagagttccaaaaagaggacccggagtggcggaactcgagaagatcttgagagagcaagaaaccatagacttagttgacaacaagggaaatccagaaggattttcatcttttgtttcccatcattctaattccaattcttatccttcttcttctatgaaactgcagcctccaacctcaccaaaaaagactataccttatccttcctttatgtcaagcaattttcctactaatgttccttcagccccaatatttgatcatttaggtgccactacacccccaaccataacatctatctatggtaactatggatcactagaaaaaaacaacggtggatctggtctggtttctcctgaaaaagaattgttccctttgaatctcaattcatgtaagtctaatttgaacatgaatgaaccaatcgatgtaaatcggtgtgactttgccaattctcccactaggaatttgtccaatgagactaattccatttggccttaccatgcaactgttcagaagagaaacaacaataagtattcttcttccacggcaaatcaattccctgggatcccaacctcctcagtatcattgtcaatgagacttcacagcaataatcatccagatccagagcttccttcaaaccaaagtttgtgttacagttacatgtctagagtcccggaagaacataaaatggttggcatgaagcgatctcactcttccgccttggaaaactctctgattccaccatcaaactttcacgttcttccaagtttttctcactacaatagagcacaccaatcatccataaatgatagtcatggtgcaagtagtttcaattccaccaaggagtgctacagggatgccaaatggggtagcactctggagctcagcaacacaaggttcaattctgacatcacagtgcctggtcatgcaatcccaccatttgttactcctgaggttccttcacctcctatgcatttgtttcctggtgttctttccaagggaaatgtgctccctagccaagttaatgacgaaaaaatggactcatacaaacattcagaatcaagtgaatcaaatcgtaagcctttctataacttcctagaagtggaggactcagaggtatcagagaccacgcgtggcgcaaatcgtgggggacgtgaaacaggaagagttggcattgatctcaacttgaagctctga

SEQ ID NO: 4336 - DNA, 246 bp, Glycine max
  Peptide Sequence Number=SeqID_121114
atggaagaagagggtaataagttgaagggtgaagaggcatttaggaaaacaagggtgccaccatggacaaaacaaataacagtgagatcagtggtgacaagctttgtcctaacaatcaaggcctacactgcactcctcaacaactgtggccttctcaaacaaccattcactcgccaagagaacactgtcatccaaacctttgttgttgcctcctctggaatcgccttcagcagcaaccataattga

SEQ ID NO: 4337 - DNA, 258 bp, Glycine max
  Peptide Sequence Number=SeqID_121115
atgaaggatcggtctcgtaaatttatactcttgttcatggatcgggatattttgtacactgaactgtggcgtgcatgtgctgggtcattcgtttatgttcctcgcgttgatgacagggttttctacttccctcaaggccacttggagcagaacgaagatggtcatttcgaaggaatctcttctgcatatgctcttgttctctttgttgggtttgattatcaatcaaatctatgcatagaaacgtttatatgtgcatga

SEQ ID NO: 4338 - DNA, 132 bp, Glycine max
  Peptide Sequence Number=SeqID_121116
atggatgaatataaacttcctgttatcctcttaacgtcttatacatcccgttatgcctgtatgccttttaacaagtgtgtcaagaagtatctcacctctagatggcacgcattagcaaaaagccagcagtga

SEQ ID NO: 4339 - DNA, 2289 bp, Glycine max
  Peptide Sequence Number=SeqID_121117
atggcgaggccctgtgctggttccaatggctctaccggaatgaccagcttccctcctggtcgtccttcctccaagctttggagatgcgatttgctccttcgatgtatgatgacccccgcggcgccctttgcaagatcgtggggtctccctaccccgttcctgcttagctgctttatctcaggactcactcctgagattcgccgtgacgtcctcgccctccaacccctttctctggtccaagccgcggccattgcacgactgcaagaggacaaactgacggattctcgccgtcccaatcgcactcgacccccacctcttcccccaccaacaaccacccacccaccaccactcccttcaccccctttacctccccttcttcccgcaccaccccgtaccacctacaagcgcctttctccagccgaaatggccaatcgccgcgagcgtggcctgtgctataactgtgatgaacgttatagccccactcatcgctgccgtgcaaagttcttcctcctggtggccaccgaggacgacgaccccgacttttcacctacccttccttcgaccccagactcccaaacactttccaccaccaccccaagccctgacccaactcccctcgacctccctacggcacagctcagcctccacgccctctccggccaccccatcccctccacactccgcgttcggggttccatccacaaccacgagttagtggttcttgtggacggggggagcactcataatttcatccaccaccgcctcctccacttcctccgactcacccccgaacccatcccccgcctcgctgtcatggtgggcgacggcaccgacatcgactgcactagggtttgccgcaatgtcaccctcacaatccaggagcaccaatttatcgtggacctccacgtcatggggttaggtggcgctgatttgattctcggtgtggcctggcttacccatctaggcccaattaccagcgactattcacaccttaccatgcgattctctcaccagggcaagcccattaccatttacggggacgcttcccttgacccatctgagattagccacggccaagttaaacgtctggtctcaacccaccaaatagcaggcctttttcatctccagctccaggccacacaccccatcactgccgacaaccatacccctccttccccgatacgcaccctcctctctaaataccctcgtctcttccaacctctccatcaccttcccccttcacaatccacagaccacattattcacctcgaacctcattccaagcccgttaatgtccgtccctacagatacccatatttccaaaaaaccgaaatcgagaaacaggttcaggacatgttaaatcgccagttgatccgacccagtcggagtccctattcatcgccggtgctccttgtcaaaaagaaagaaggcacatggaggttctgtgtcgactacagagcattaaattccatcaccattaaagaccggtttcccctccccaccatagacgaactccttgatgacctgggcaattcctcctggttctctaagatggatttagctcaaggcttccaccaaattcgtatgtctgatgctgacattttcaaaactgccttccgtacccacgaaggacattatgaatatgtcgtgatgccttttgggctctgcaacgcgccgtcgactttccaggctactatgaactccctcttccggcctttcattcgcaagtttgttttggtcttcttcgatgacattttagtatatagcagtgacctccaatcccacctcaaccatttggattgcgtcttgcgtactctgcaacaagctgatttccgtttgaaagcttccaagtgtatctttggtcaacgaaggattgagtacttgggccattttgtttcacgtcgaggtgtcgagcccgattcttctaaaatacaagctatgctccactggccgcctccgacaacaactaaggccctacgcggtttcttgggcctaatcgggttctaccgctgcttcgtcaaaaattatgctcagattgccgctccgttgactcatcttttaaaaaaggaccaatttgtgtggacccttgagacccaacaagcttttgaagctttgaagtcagctatgaccactaccccggtccttgccctgccggacttcagtatcccatttaccgtcgagactgacgcctctggctccggcatgggtgtagtcctcatgcagaggggacatcccctggctttcttcagcaagcaattttgcccaaaattgctccgttcatccacgtaa

SEQ ID NO: 4340 - DNA, 336 bp, Glycine max
  Peptide Sequence Number=SeqID_121118
atggaagaagagggtaacaacttgaagggtgaagaggcatttaggaacacaatgatgcttccatggacagaacaaatcacagtgagatcagtggtgacaagctttgtcttaagtatcgttttcatcttcatcgtgtgcaaactcaacttcaccactgggatcataccatccctcaatgtagctgcagggttgttggggtttgcagtgatcaatgcctacactacactcctcaacaattgtggcattctcaaaaaaccattcactcgtcaagagaacactgtcatacaaaccttcgttattgcagcctctggaatcgccttcagcaaggtagggtaa

SEQ ID NO: 4341 - DNA, 1701 bp, Glycine max
  Peptide Sequence Number=SeqID_121119
atgggaagttatctacttggtatgagcccatacattgcttctcaagttgatggggggaacacgccaatcaatacaaagactatctcacttggttggatgtttggttttctctttgttgttagctttgtgggcctcttctctattgtgcctctaagaaaggtgatgattctgaagtacaaactaacatacccgagtggaaccgccacggctctccttgtcaatagcttacacacaccaaaaggagcaaaactagcaaaaaaacaggttgctttgctcttcaaaagcttttgtggtagttttgcttttggttttttccagtggtttttcactgcaggagatggttgtgggttcagcacttttcccacatttggtcttgaagcttacagtaacaggttctactttgatttctcatctacctatgttggggtcggaatgatttgcccttacttgataaatgcatctttgcttcttggagctgtaatctcatggggcattctatggccctggattgagcacaagaaaggaatctggtatagcgcagatctacctggtagcagtctaagtggcatccaaggatataggatcttcaccgcaattgccatgatgcttggtgatggtctttaccattgcatcatcatgctaatacgagttgcctacagtctcatcacccaatacctaaagaaaaaagtgccatcaactgtaaaccatgaagatgttgatcaaaactcaagtgaagattttgatgctcaacgtcgcactgagtatttcttgaaagacgagattccctcttgggttgctattattggttacagtgttcttgcagttatttcaatcataacggtttcactcatctttcctcaactgaaatggtatcatgtactaatcacttacctcattgctcctattctggccttttgcaatgcctatggatgtggcctcactgattggtctttggcatcaaactatggcaaagttgccatcattatattcagttcatgggttggccttgagcatggaggcctcattgctggccttgcatcatgtggtgtcatgatgagcattgtatccacagcttctgatttgatgcaagacttcaaaaccgggtatctcactcttgcatctcctcggtccatgtttatgagccaagttttaggaaccgccacgggttgtcttctgtcgcctttgatgttttggtttttcaacaaggcttacacacttggtgaccctcagggctcttaccctgcaccatatggagaggtgtaccgtgggatggcccttctaggagcaaagggtttctcttctcttcccaaaaattgtcttgaactggctatcattttctttttcttggctgtgtttattaacatagtgcacgatttgttggagcattatgagaccaaatataggatatacaggtttgttccaaaccccatggccttggccatcccattctatcttggtggttactttgctattgacatgtgcattgggagcttgattctgtttttgtgggagaaaaaaaacaaacaaaaagcaaaagattatggtcctgctttggcatctggactcatttgtggtgattctttgtggagtgttcctgctgctatactgtcccttgctggagccaacccaccaatttgcatgaagttcttgtctagtgctgtgaacaaaaaagttgacaccttcttaagtggtggtccttga

SEQ ID NO: 4342 - DNA, 1350 bp, Glycine max
  Peptide Sequence Number=SeqID_121120
atggccaatattcgaatttttgaccgttggggcccgttgcagacaagtaacggttgggacaagggggaaaacttccagagccgttgccttcaccttttcgtcttctccaataccttaaaactaacaaaacattcagagagagagagagagagagagagagagaacttcactcactcactcatgggctgcgtctcctcaaaacacatcaagaaagacctcaagcaagaagaagaagtcactgtcaccaatggcggcggttacgtgaaccacgtggtatccctgacttcctccacctatggagcactaatgctggacaaggagaaggagcaacttcaacttcaacccaccgtcgaagaagaatccaaaacatcccctcctcggattcgcgaagaacccgaagtcatcaacgcttgggaactcatggagggtctcgaagagggagtgcccatttcaaataaccccatgaaaagccccaagtccacacctttccttcgcggattcatctccaccgacccaaaacccaaaattacccccttcaaattccttaaccaattcgggtcccccaagagtctcaggaagttcacagggaaagagaacaaagttcaagttcaaccacccaatgctggtgttagacgcttggactacaatttcagcccaaagggtattctcaaaccctccaatttttgttctcctctaaaagggtctccgattcgtgctcgaaggaacagtttcgggaccgacattaagcgaaggagtcctagtcctctgttcgatccagagcttctcgcctcttacgaaaaggaactctccgaagaggaagaacagatcaagagaatggtgtgggccacccccaagacccgaagagtcagaaaacctttggattcacaaactttcattaagacgtttgaggaaaaattgccccctggaggagaaaactgcgttgtcatttacaccaccacgttacgggggatcagaaaaacgtttgaggagtgcaacaaggtaaggtccattgtcgagtcctattgcgtgcacgtggtggagcgtgacgtgtcaatggattcggggtttaaggaggagttgcggaagctgatggggaccaaacaagttaaggttccggttgtgttcgtgaaaggaaggttggttgggggtgctgaggaaattgtgaagttggaagaagagggaaaattgggtgttctctttgaagggattccccacaaggctttgggggagtgtgaagggtgtggtggtgtgaggtttgtaatgtgcgtggagtgtaatggaagttgtaaggttttggatcatgagaatcacaagaagactctgaggaagagagggacagaacaggcatga

SEQ ID NO: 4343 - DNA, 417 bp, Glycine max
  Peptide Sequence Number=SeqID_121121
atggacgaaagttggagtgagggaaaaaggagcatgagttacaaggaggaggatgagtacgaagaagaggaagaggaggaggtgagtgagtatagagatgatggtaggaaaaagaaggtggtgagtagtaagagagggtccaaagctggaggctcagtgccaccttcatgtcaagttgatggttgtagcgctgatctaagtgaagctaagccctaccataggcgtcacaaggtttgtgagtaccatgccaaggctcctgccgtactcattggagaccagcaccaacggttttgccaacaatgtagtaggtttcatgagctatcagaattcgatgactcaaaaaggagttgcagaagacgtttggctggacataatgagaggcgtcgcaaaaatgcatctgaataccacgaactttga

SEQ ID NO: 4344 - DNA, 540 bp, Glycine max
  Peptide Sequence Number=SeqID_121122
atgaagaaagacatcagaagttgctgctatagtgaagggtcaacctccactctcaacaagcagaatgatacttgcaaggtaagttcactagcactgcaggatctcatgatgcaatttgagttagaagctaagcttagtgatgatttcagtggaatgaggggaaggatgtcatgtgtgaatgactccaacattttgaggcctacaaggaaagctttgaatcagtatccaaggttgtcacttgatggcggtagagatgctatgaaccacagttttgtgaacatacaaggaagaagatcagtttgctgtgatagaagactaaaggaaggatcaatacaagagaataatgatttaggttccaagtttaggttttgtgatggtgagagtatgtctttgccacatactttggctggggagagtgtggtgtggtgtaaaccaggggttgtagccaggttaatgggcttagaggctataccgttgccagtttgtacttatcaacacgaaagcaaacaattcttagagaatggacgcgttaaagaataa

SEQ ID NO: 4345 - DNA, 1563 bp, Glycine max
  Peptide Sequence Number=SeqID_121123
atggcgatgagttttggttttctccttctgggtatgtgtagttctggtggaacaactctttcagcttctgggatgctcgtacctgataccctttgtgatgctcaagtagctgggtgtctctatggtgataactgtgaggatagggtgttggttgtgacggttgcttcagttgttgagccttttctgtcacctcaacagagagacaatattcctcagggtaggccagacttgatttctggtgttcggattgatgttatgacagaggaagccaatgaaaaatccaatcagggaactccttgttggcttgcggcagagcttttgtcattagtaggcattttgaaccttttagttccttattatgctgttgatattcctgcttcatccaattgtctccagtcacttattgaagcatctttgggtttgccagagcatgaatgggaggttggttggtctttggcatcttacaataatgattctcaaccttccaaagatttttttcaaactcatccttggatgtccatgttgagtaatgaaataggaagtatgatggctgaaacttgttgtggtttggatgtgtggagaagacctgacttgctggatagtaaagtatctgccatgaataaaaagggtgattttcttctggcagttggatctccttttggagtcctgtcacctatgcacttttttaacagcatctctgtaggatgcattgcaaactgctatcctcctcattcatctgatggatcgttgctgatggctgacatacgctgtcttcctggaatggaaggcagtccagttttcagtgagcatgcatgtcttattggtgtcctgattagaccattgagacagaagacgtatggagaggaaatccagctggtgattccttgggatgccattgtgactgcttctagtagcttgctgcgaaagaggcctcagaacacacagaaaggctcgtcaccattaccaattgagaaggcaatgacttctgtctgtcttgttactattggtgatggagtatgggcatctggtgttttgcttaacagtcaaggtctcatacttacaaatgctcatctgttggaaccgtggagatttgggaaagaacatgtaaatggtggaggatatggaactaattcagaaagaatttcttccatgttggagggaactgcatatcttgttaacagagttgcgagcaatcaagttagtcaaacttcaccattgaagatgccaattctttatcctttcgctgctaatgagcaggggggatataagtcgagtccaacttatgacaaccatagaaacattcgtgtacgtcttgaccatatcaaaccttgggtttggtgttatgcaaaagtagtttatgtttgtaaaggaccatgggatgttgccttactgcagcttgaatctgttccagataatcttttgcctatcacaatgaatttttctaggccatccacaggatcacaggcatttgtcattggccatggattatttggcccaaagcgtgttcctgcttcagcagttccaactatatttactgggaactacaacaaagttgcattctga

SEQ ID NO: 4346 - DNA, 237 bp, Glycine max
  Peptide Sequence Number=SeqID_121124
atggttgatcccgaacatgtcatatcatatcatttccaaggtagaattgaagtcttattcacttgtgctctattcaatcttggttcagaagttggagattttatttatattcaagacaagttggttgggctggacaaagtgaaccgtgcaggacataaggaggcccaattcgttcctggcatcttggatacatattacagcgacgactaccggattaattggcgtagacattactga

SEQ ID NO: 4347 - DNA, 267 bp, Glycine max
  Peptide Sequence Number=SeqID_121125
atgccgtcgacaccaacaaccccgatgactccgacgactccaacgacaccgggatcggcccgtaaagctgacaacgtttggaggagcgtcttccatcctgggagcaactccgccacaaagaccatcggtgctcagatgtttgacaaaccacttcccaacactcccactgtctatgactggtatattattgctgtacagtggggagaccagaagcaggcaccgctgaagctgaagtctttagctaagatgaccgtgggttgcatgtaa

SEQ ID NO: 4348 - DNA, 348 bp, Glycine max
  Peptide Sequence Number=SeqID_121126
atgcaatcacagggacttgcattgcctcctgagccagaggttggtccttcagctgctcgtgtcagcacaaagaagagttgtgttgatccctcagggaatgacctagacacaggtgagtcaaagaaatgcgagttgtacgtcaaagaaaatcctccccgcctggttgtcctaggaagactttatgagggatccacaaccgttcacaatatccctttgcgccatgatcaagtcaagtttggtgttgaggaagttagagatacagatgctcccattcctgtacttattcaagaggttcagttaataggcagacacttaacaccttcattgcttgtccaacacattttgtga

SEQ ID NO: 4349 - DNA, 210 bp, Glycine max
  Peptide Sequence Number=SeqID_121127
gattcgttggaggagcatgcctcacatggttcctttgtcgcccatgggcgtcaggatgtactgactgctgccattgggcgaccagaacacattggccgtgtgtgtgctattggagctagtatcacgatcaaacaatactttgaacgggttccaaggaccttccgcacttcttcgttcatggctcccaaagacctggagcaactgacttaa

SEQ ID NO: 4350 - DNA, 948 bp, Glycine max
  Peptide Sequence Number=SeqID_121128
atgggatcaagtcaaaagccttcgcttaaaaagaggttctatcaagtcaaaatcaagagcttagaggtcactagtttacgagagttggggcaattaatgggtcaacttcaaaggcaagccttccgcaaagcctatggtaagatttgggacttagctagggtagaagtctccatggaaccgattgcatccctttcccagtattatcaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaagtaccaaggaagtgtttggaggaaagggcaaaggccttggcaaatcaaggcgaatgggctttcttttattgacatcttggcgcttttgatctttggagttgtcctctttccgaatatggaagggttagtggacctagcagcgattgacgctttcctcgcctttcatcatggcaaggaaagcccggtcgtcgccattttggccatgtatgacacgttcgaccggggatatgaaaagagcagcgcaagaattgtttgttgtgcactggctctctatgtgtggctggtttcacacctttttctccaagaaggtaggcctgtctatccgctacaaggtcaccgctcatgcgtcgaaaaaggaaaggcgaattgggacggaagaatcaggattctgtcttcatgcgaaggatgtccaaatgttcccttgatgggaacaaggggttgtattaattataatcccgtcctcgccataagacagcttggctaccccatgagaggagtgccatcagacgaaagcatcacgcctttcatcgcatggggtttcagtgaccacaacgcgagggtactccaaggatttcgcaaggcatgggatgcggcgtga

SEQ ID NO: 4351 - DNA, 552 bp, Glycine max
  Peptide Sequence Number=SeqID_121129
atggccattaaagatactctaagccatgaaattttgatttctagtgtgtgctttggtggaagcaagaaacaactttgcgtccacctcagatggctcacacgaagcaaacatcgtacaatgcaggatgtgacccctcccatgaaggcccctcataggaaagggaaaatgttgcagagagacatcgaagggaaccactgtgttggccatgtttggatccgtgaggagcgattagaggtgaagcttgtcagcctaggtgctatcgtaccctacccatttatttggatctgccaggaacggcaaaaggtgaaccttgttagtcacaatgccccaggtgctaccataccctactcatccacaagttcaggtttacatggaccggttgagggattgatgaatgtcatttttgagaggtgtcaccaagagacttcttccttccacttgcctaatggagaaatgaccatcactctgaatgatgtgtcttgtctgctacattggcctatgacaagcaggcctattaataatgtcctctcactctttaacggatcttgctag

SEQ ID NO: 4352 - DNA, 489 bp, Glycine max
  Peptide Sequence Number=SeqID_121130
atgttcttgtgttctatgctgaagactaaagtactaaacctcgatccctcgtgctcttccagattccttcttcatgctaagcgcgttaaagcagcgcttagcaatggatatgcgctaagcccattgagttcgcctagtgcgatagtcactttggcacttcaagaaattagctcctttttacctgaaattttgtataagacgactaacaacggtctcgatgctatcaacaatgaggtccctggactggaggctttagcacatgccacgggtgcccatggagatggcgccactgacaccaatggtgttgaagcagaagggaaccatgccagcggaggcaacaccgtcatgcacggcctcggaaaggtggaggaggtgcatgttgcaagtgtttcccttgtaccaaaccgaggagacgccgacttgcagcttggctatttcgtcctcggagagaccaacaccgtagagcacggcctaggaggcgccctgtga

SEQ ID NO: 4353 - DNA, 753 bp, Glycine max
  Peptide Sequence Number=SeqID_121131
atgaagcagttggggataaagctattggagcttttggcaattagcttgggagtggataagttgcattataactacttgtttgaagaaggttgttccgtcatgagatgtaactattacccatcatgtcagcagccaagtcttgcactagggactggaccacattgtgacccaacgtctctcaccattcttcaccaagaccaagttggagggcttgatgtgttcgcagacaacacgtggcagaccgttccacctcgtcctgacgcccttgtaattaacatcggcgatactttcatggtgtttgaaaagcagcactaccaaactacacctatcagtcatggagtcaatggcgaaaatttgaggcttttcacaacaatcttcatactcaagtatagacgtcagtatctttcctccagtatttttgttcctggaaacaagtggtgggcagaacaagaaacagtcaagaagaagttgcagttgcaggcattatcaaacgggagatacaagagttgcctacatagggcagtggttaacaagtacaaagagaggaggtccttggcattctttctgtgcccgaaagaggacaaggtggtgagcgccccagaggatattgtgcgtagggatgggacaaaacagtatccagatttcacatggtcgaggttgcttgaattcacacaaaagtactacagagccgacgaagctacactgcaaaacttcaccaagtggttgctatcctccaaacaacaaacactttag

SEQ ID NO: 4354 - DNA, 286 bp, Glycine max
  Peptide Sequence Number=SeqID_121132
ggatcgcgcccacaagacacccaatggacccggagaagtccaacaggtcatagggtttccagctctgattacgggcctctgtcagtcctacagggtgcccgtcccccctacaagggatcgcacccgcaagacaaatagtggacccggagaagtccaacagggtcttaaggtttccagctctaattacgagcctctgtcagttctacaaagtgctcgtcgcccccaacaaggtcatcaagcccctattaacagggctttcatcgagaagtactgcgcccccaggtag

SEQ ID NO: 4355 - DNA, 555 bp, Glycine max
  Peptide Sequence Number=SeqID_121133
atggacaagctcacctcacatgtggcgtatgatagcatttcatattcattggactcgctctcttttagtggccttgttgctattcaagaccaccaaccaaagctcccttctcctaaccgggctaaagactaccaggtaagcaagcatgactcagaatttgaatttaccagcactaaagcaaacttgaattctgctgtcaatccaatcaagatcactcctgctgaccaacttatttccaatggtcgacttcaaccacaagcacttgccatccaaacaaatcagtctctgatcagaaatctacccagttcttcaagctcattactagcaacccatagcagcagtaagatgtcatgcagtaaaacaggcagcaatatgaaatatcacgaacaacttaacgaagcaagcaaacatgcaaacaagaaaagcacggtgacaaggacagggtttggccagaaaatgaagtcttttctatcaccatgccgagaatgtcgaaccattaagcaaggtgctgttaaagcacaaacagttccaggagaaaatctcaaaattgactga

SEQ ID NO: 4356 - DNA, 234 bp, Glycine max
  Peptide Sequence Number=SeqID_121134
atgcctgaagaagaggcaatggttactgaattgagaaaagtgaggcagaggtttgttagagagaataaagaagagaatctagatgcagccgttagaggcaccagtggccatacactattgtcggaaagaagagaaatcaaatcttctattttgtttgtgacgggcactgcactaaactgctatgctatgatggcccctatagcgacaaggtgccactccaccacatatctatag

SEQ ID NO: 4357 - DNA, 1185 bp, Glycine max
  Peptide Sequence Number=SeqID_121135
atgccgaacttagcaacgtttcaattccttctgctgtggacgctcttcccctgctttgcctttattgcgcgtgcagctcaacgagggccatttggcatgcgtataagctgtggggctcgtcataatgttcaaacagaaccaaccactacactttggtataaagactttggatatacaggaggcattcccactaatgcatctacaacaagttacattgcccctcctctcaagactcttcgctatttccccttgtctgaaggtccttcaaattgctacaacatttataatgtgccaaaggggcactactcaatcaggatattttttggacttgttgcacaggctagagctaccgatgaacctctatttgacatctcaattcaaggaactcaaatatattctttgaaatcagggtggaccactcaggatgatcaagcatttactcaggcccaagtatttcttatggatggttcagtctcaatctgtttccatggcacaggtcacggagatccagcaattctttcaatcgagattcttcaaatcgatgataaagcttattattttggaccacagtggagtcgagggataatacttagaacagtcaaaagactgagttgtggatttgggcagtcaaaatatggtgttgattatggtgcagatccctggggaggcgacagattttggcaacatattaaaacttttggtgatgattctgatcgacgtagatctgttgaaactagaatcaaaaaggcttcacgtccaccaaacttttatcccgaaactctttatcgatcggcacttgttagtactagtagccagcctgatttaacgtatacattggatgtggatcccaacagaaactattctgtttggttacattttgctgagattgataactcagtgactgctgaaggtcaaagggtctttgacattatgataaatggtgatgttgcttttaaagatgttgacattgtgaaattgagtggggatcgttatactgcccttgtgcttaatacaactgttaccgttaatgggagaactttgactatagctttgagcccgaaaaatggtagttttgccataatcaatgccattgagatattggagattataatgaccgagtcaaaaacattatcagatgaaggtacatacagcaccctatgttttcaactcgaattttcatactga

SEQ ID NO: 4358 - DNA, 642 bp, Glycine max
  Peptide Sequence Number=SeqID_121136
atgtctatccccgattctcctttcgccgaagatgtcgaaatcgatccatcccttgacgacgacgacgaagaagaagaagaaacagaggaggaggaggaggaggaggaagaagtcgaagaggaggaggtcgaggaagaagaagaagtggaggaggaagaagtagaagaggaagaggttgaggaagaactggaagaggaggaagtagaagagatagaggtggaggaagaactggaagaggaggaagtagaagagatagaggtggaggaagaactggaagaggaggtagtagaagagatagaggtggaggaagaagaagaggagggggaacaaggagaagaacaacaagtagaagaaatggaggaggaagaggaagaagaagtcgaagaggaggaggaggaggaggaggtggaagaggaagaagaagaggaacaagaacaacagcagcaagaagcagtggaggagaagaaggaagagcaacaacagcaacaccaagcagaagcagcaatggaggaacaagaagaagtgccaatggaggagaaggaggaggacaaaccggcggtgccaggttctccactcgatgcggataaggatcgcaaagccgaccctaaaaccactgtaacaggattgcacatggcaggatag

SEQ ID NO: 4359 - DNA, 2226 bp, Glycine max
  Peptide Sequence Number=SeqID_121137
atggactcaaatcaggagaaaacttggagggttggattgtgcggatgggcgacccaggcactgaaattgcagtcggaaataatgctggacgtgccagaaaagacgttgtttggtgcttgtttggcacagtattgtctgcaactaaggtgggctaaggggtgtccgcaattaaggcagtttttccaactcaatcttaattacggccaacatatggagtttgaggggcaagacaaaaacttgggaccagtttcttctgtggctgaaaaccctgaagtaatgccaccatctagtacgcattgcatggaagagaataatgtcatgctcaaaaaaagtgacatacctacattgaaaaaggaagagcttcccctgaaatatgaaatttcaagtcatccaaaatcaagagaaaatctgacttctgttgaagtttgcagaagtcaaggattagatgttgaagttgaaaatgctggatcccttctgcagaagaaaacatttagaggatactgtgtgccaggttgcaatagcaaagctaatttatgtggtgacaataatattgattccagggccagggccaccaagtcatctagtgatactgtacaagatatggttattggccccctaccgagagattgccttgttgaggattctaatggtggtcagaattctagaaacaaaatcatgctgtcggagatggagtcaagggatgatgcgaaacaaatgacatcaaggactagaaatctgtctcccagtgctgagattaaagatggaaacaaacgccccagaattatatgtgatttttttgctaaaggatggtgtatcagaggtagttcttgtagctttcttcatataaaagatactggggacaatactgaccaggaagctgaagcagactcagtttctacttatcagaagagacaattgaaagtggaagaaggtgttagggaaaatgttgagagatccaggatgaatgagcaagaagcaactcctagttggcatccatctcaagaaaaacagaagtttccgccgagggacaacttgtttccagataatagatttccatttagtgcatcagacaattatttgagcccaaatctttctttgaattcaacctgtgcagatggaatggctactcctcgtaaccaacatatgtacaaaggatatacttccacacttttgagccattcgccgaattcgagcctggttactcaatttgcagcttcaagtatgtcactctcccaccggattctagctcaatcaggacgttcgctgccttttagttcatctttaggggctagtaatgtggattctctaaagtttttgaacactgacaaagaatatctcacatctaagtccactttctctggttcagggcgggaagatttttctcttgttagttcgtctagggttccatcatatcctgctggatataaatcaaaaatctgttcttatgattgggaaccttctgttccctttcgaccatctttttttattacttctatgaatgtatcatctcctggagatctttatgaccctcttcgtgatagcattgagatacctaatataggagatgggtctttgaaggcttcccttttaattcatggatcaaatgtgcaggtttcatcacaggttcggacatatggtgattctgctgtagttggggaacacatgtccaatcttaatgatgacaaaagttctgtatcttctcataataaattttgtgaaaatgagccaaataaaaattgtcttcctcatgaaaaagattgtcttccacctgaaacagagataacatcaggaacttatcaaggtaaaatgggcatgggacaacatacctttggtgttgcagatagtacaaaaaatgagagagatgtgaccgagtgtgatgctagacgtcatggtgaaggatcagggcataaaaagaagagagtagacagggataagaaaaatcatgaaatggatgtcgactttcagattgatggcagcattcagaaggaatcaaaggcattaaaattttttcgcgcagctcttgttgatcatgttaaagagttgttaaaaccagcttggcacgagggtcatcttagcaaggatgcacacattatgatagtcaaaaaatcagttgacaaggttgttagcaccttggaaccccatcagattccgatcatggatactgctaagcaatatgtttcttcaagtcaggtgaaaattgcaaagctggtcaataaatatctttga

SEQ ID NO: 4360 - DNA, 414 bp, Glycine max
  Peptide Sequence Number=SeqID_121138
atgggaatgaggagaaatgttggagcttgtaagaaaactccacctaaagtaagtattgttgagggaagcctatcagaagaaacaagcagaaaaatattgaagggatcaatgtttgtgaagaatgttgatgcttctgggagcatgaagaccgaggagaaattatttgagctcttgaatagtcttgttaaggagattggagaacaaaatgttgggcaactgattatggacaacgaaagtaattatttgttggctgtttgttactcatttaagtttattgacttcggtcttggtgaaattttcagaagccaaaagggtattaggaagatggctaaagctaaaaaagcaatagcagtcaataacagccggagtggtcacgatagctgtggagtggggctaagcagcaatgtggtgtga

SEQ ID NO: 4361 - DNA, 1269 bp, Glycine max
  Peptide Sequence Number=SeqID_121139
atgggtgtagaggcgggcgtggaagcgttcacacgaagcaactccgttcttcagcctctcaaacgcaacttcattatccaattgccttcgcaaaatgtcggggaagcgaaagaggaagttgaaattatccatatcattggtagttttagagttcttaatggtgacagtatgatattgtataatgctgataatagaagaaaaacagttgctgaggtgaaaactgaaaatttggagctgcaatcctgggctgatctccctgctgaactcttagaatcgatcttgtcccgattgattctagtggataacatccgggcttcttctgtttgcaagagatggcattctgttgccagtgatgtacgtgtagtaaaccaatcaccatggcttatgtattttccaaaattcggtgactgttatgaattctatgaccctgtgcagcataagacactcaccttcgagttgccagagttgaatggatctagagtttgttatacaaaagatggttggttattgctataccggcccagaactcaccgagtattcttctttaatccctttactcgggagctgatcaaactgccaagatttgagatgacataccagattgtggccttctcttgtgctccaacatcacctggctgtgttctgtttactgttaagcatgttagtcctactgttgtagctattagcacttgttatcctggggcaacagaatggaccactgttaattaccaaaaccgcttgccctttgtcagtagcatttggaataagcttgtgttttgtaatgggctattttattgtctgagcctcacaggttggcttggtgtgtttgatccagttgaatgtacttggagtgttctggcagtacctccacccaaatgcccagagaacttttttgccaaaaactggtggaagggaaaatttatggcagagcatgaaggagatatattagtaatttatacatgctgtagtgaaaatcccattatttttaagttagatcagacattaatgaaatgggaagagatgacaacactagatggggtaactctttttgctagttttttgtcatctcattcaaggactgacctcattggaataatgaggaacagtgtctacttctccaaagttcgtttctatggaaagcgttgcatatcattctctcttggtgactatagatactatccccgtaaacagtgtcatgactggggagagcacgacccttttgagaacatctggattgagccaccaaaggacttttcagcttgcatgtga

SEQ ID NO: 4362 - DNA, 135 bp, Glycine max
  Peptide Sequence Number=SeqID_121140
atgttgaaagtgtattttctaatagtggagatagaggaagaactcaagaatattacaaaaggcgatccacctcaacgggagagaagtgaaaaaatcggcataaagaaaaagttcaagaaaatggcacaaggttag

SEQ ID NO: 4363 - DNA, 465 bp, Glycine max
  Peptide Sequence Number=SeqID_121141
atgctccatagcctctacaagtccaaggatgatctcaaagcatattttgcacaccctagccatgacagcatcatcaagggaaacatgctccccatcatcaacgatctcactgacctcattacattgtcaagttttgttgttcatgtcagcttcttgaaattgaaggaggacacggataaggatgaggtgttgggtgtggccagaggaattcccaagagttctaagcatattagtgatcaagttcagcttttggggagaatttctcactggggagagccaagggcaatggattcaaacgaggagttagagaattaccaaaaggataaggttaaggatcaaatcaagagtgtggttgcggcattcaaacctccatttgacatgagccaagacatagattttagtgaagatccacatcctgaatcggcccaaaaagatcatttagtttctgaagggatttgtgcttga

SEQ ID NO: 4364 - DNA, 471 bp, Glycine max
  Peptide Sequence Number=SeqID_121142
agtatggatatatcaaatcctgcagccttagtcaatgcggaactgttgcacttctatgttggaagaagggtaaggatcgtggtgcaggttgtgcgatctgatggtggagttgtcattggaaaatcaacagatgagaaacaactagttgtaaaaggatcacccccacctgctgctcctcttacaacttttgttgaagtttatggtcttgttaacagtgataagtcaattggtgctgagatatggaccaattttggtgatgccatcgatatggatagctacaataagctttgtcagctcgcaaatggagaatttaaacacttgttcctggctatccagcctagtgctgcagtgatagcattttacatcagattctggcctttcatgcttcaaaggcagctgatgctcgtctgcactgaattttgtgaaacatatctatcgaacaattcacatttggttaaatgcataatgtag

SEQ ID NO: 4365 - DNA, 312 bp, Glycine max
  Peptide Sequence Number=SeqID_121143
atgattgtctttgaaatgttccttctatttactaatgtcgcaacctacccttcgacgggagggcgatgcaaaggctcacaggtgtgtcttccaagggaggaaaacgcgcagagtcgccaccaacattttttcatggaaaacgtcgaaaaaaccgaaatgtgtggtctacgaactttaatcatgaaaggttcgagagttgtttttacgcatggggaagaaggggtggtcgacaaaagcggggcttttgttcctacgtatcctcgatttgtggggaagaaatcgtacctacgtagttcctgcgtaaagcggtaa

SEQ ID NO: 4366 - DNA, 483 bp, Glycine max
  Peptide Sequence Number=SeqID_121144
atgtatgctactacgaggcatgatctgggtaggggtggaaatagtaaaatagagaacacaactaacaaaaatggcaaagcaaacaaaaatcctatccttttcacttcaagctttgatagagcatccactcatgcaaataagaatgaggtgaatgtacaagttcctacagattcaactcaagtagaagctaacaatcaagaaaatgaacatgaagaaccaattgtcgggagaaagaggaaaaaaacttcaattaatgtgaagaagacttttaagaaggctatcaggtcaggctacacttttaagaagaaggaagtgtacctgaggaagcagctagccgtcataaatgacacgggcaacgttggctccagcagaacagttgcggactttggcggtagccgtggcgagactggtggtgcagtcactgttggaaagatagttcctgaattgaaacatagaatagacaggatctgttccaatggttag

SEQ ID NO: 4367 - DNA, 492 bp, Glycine max
  Peptide Sequence Number=SeqID_121145
atgtggctggggtgcaatctatcccattgcaatctatcccactgcttgtcagttgaacatagcagcatacaaggttgtctacccaaaacaaatcgtagggcattcaatgttgggtgctttattgtagaagcaaagcttcatgatgaatcaagattgattcaaagatgttatgatgataacaaagatgatgacaaaaagctcaaaggtcaatcaaagaatgagttcaagatgttcaagatagaatcaagaacacttcaagattcaagaggaaagttgaagaacactttaagattcaagaggaaagttgatttcaagaatcaagaatcaagattcaaggatcaagcttccaagaatcaagatcaagattcaagactcaagattcaagaatcaagagaagacttaatcaagataagtatgaaaaggttttttcaaaaactgagtagcacatggatttttctcaaaacatgtttaccaaagagtttttactctctg

SEQ ID NO: 4368 - DNA, 348 bp, Glycine max
  Peptide Sequence Number=SeqID_121146
atgctcacaaggccatgtcgtggtggtagtgggtcatggggaaggctggaagggagactgcacggtggtgtggtggtggctaatctatgggacgacgtgggttatgcttgtgtgtggcagcgcaaggaagactggaatagagttagggtgctcacattttgttatgtcaagctgaatgcaaatcgcatggttgttggtactctccgtggcttcgaccagtttatgaatttagttgttgacaacactgtggaagtgaatggcaatgagaaaaatgacatagggatggtggtaatcagaggaaatagtgtggtcactgttgaggcgcttgaacctgtgaacaggacttga

SEQ ID NO: 4369 - DNA, 1509 bp, Glycine max
  Peptide Sequence Number=SeqID_121147
atgacggaagtgcttcagttgccttcatcctcaagctgttcgcgtcggccatgtggtggtctcacacccaatgatgggtcgcacccaattccccttattaacgctcccactgtggaagaacaacaaagtgtggaaattgaagaagaagaagagaaagaaagggaaagggagagggatcagctttctattttgacccttttgattgctacgttcaggaaatctttgattgggtgcagcactactacatcttcttcttcttcaatggagattgggtggccttccaatgtgagacacgtggcacatgtcaccttcgatcgcttccatggctttctcggtttgcctgtggagttcgaaccagaagttcccaggagacctcccagcgctagtgcaaatgtttttggagtttcaacagaatctatgcagctgtcttttgatgccagaggaaatagtgttcctacaatactgctgttaatgcaaagacatttgtatgcacaaggaggcctgcaggctgaaggaatcttcagaattaatgctgaaaatggtcaagaggagtttgtgagggaacaattaaacagaggcatagtaccagatggcattgatgtgcactgcttagcaggtctcataaaggcttggtttagagaactaccaactggggtattggaccctctttcgccagagcaggtgatgcaatcccagtcagaagaagaatgtgctcagcttgtgaggcttcttcctccaacagaagctgctttgctagattgggcaataaacttaatggcagatgttgctcaaatggaaaacttgaacaagatgaatgcacgcaatattgcaatggtttttgctccaaacatgactcaacaattctttctcacgtgtctcctacagatggcagatcctttgactgctctgatgtatgcagtacaagtcatgaattttctcaagactcttgtggtgaagacactgagagaaagagaggaatctattgtaaaatcaaatcctgttccagaccttaattcttttgacgatgatgggaaccatagcaatccagaaatgcttgacaaggaggacagtgaaaatggaaatgattgtggtgatgacgatgaagatacagtgtttgtcactgcagagccttctcaacaaagccctagtcatctcactgaagatggctgtgaaactgaaaccgaatccaaaagtttgcctacatctactgagaattttatttcaagtgggaataggttggtggttgacagttgtccatgcacttttgtatctcaaatttgctctttggcaattggacttcaagactgtggcctcgctaccgggcagacaaaaggggatcaagcaaaaatttgcaggagcaaaagccttcagttgagtacttacgatacagacaagtgttccagaaaggtgattgagcttccagtaagcggagctgcagagaagaactgtggaatggcaattattgagcgcataaattcgagaacagagttggctgaagcctggcgttga

SEQ ID NO: 4370 - DNA, 273 bp, Glycine max
  Peptide Sequence Number=SeqID_121148
atgcatcaggttgtaggcggatatacccaagtgatcattcgtacaaagacaacatctgttgatcttgacccatgcgttaggtggcaggcggaaataccccaagtggtggtaggcggatatacccaagtgattatccgtacaaagacaacatttgctaatcctgacctatgcgtcaggcgacaggcggaaataccccaagtggttatctgtagaaagacaacatctactgatcctgacccatgcgtcaggtggcaggcggatatacccaagtga

SEQ ID NO: 4371 - DNA, 258 bp, Glycine max
  Peptide Sequence Number=SeqID_121149
atggggtccgcgtacttcttcatgttctcttgggctttcataagcttcttgcgtatagctcaaaatgtctcatccctgtctactagcatttcttcaactgcatcaattttggaagaccccgtgtcgcaacccatccttcgacgggagggcgacgcagggctcgcaggtgcgtcttccaagaaaggaaaatgtgcggagtcgccaccaacgtttattcgaggaaaacgttggaaaaaccagaaaagttatgttctatga

SEQ ID NO: 4372 - DNA, 273 bp, Glycine max
  Peptide Sequence Number=SeqID_121150
atgggttctttagcaaacagccattgccaatggcgagtttgctgtgcaaagccacgtggcatcaaaaccgccactcgtagtggcgagttgctttgcaggttcaagtcgccacctgtgctggcgagtccgtggttggctttggaaaccgccattcaaactggcgggttggctacggtgctgcaggttgcagcagcaggagcagaaagccaaatcgccagtcatggtggcgatttggctgtgctgtttgcttccaaaaaaatttctggcctataa

SEQ ID NO: 4373 - DNA, 261 bp, Glycine max
  Peptide Sequence Number=SeqID_121151
atggagaaaaacaactcactccctaaatactcatgctcctactctgaatttgggttcacggaacgatcaaactcatacaatttcaacgggccaatccagaagggaagtgggttttctgcagcaaatgatccagagcttaagaggaagaagagaatcaaggcgtataacgtgttcactgtggagggaaagcttaaaacaagtgttagaaacgggttcaagtggatcaagaacaagtttggtgacattcgcaatggggagtga

SEQ ID NO: 4374 - DNA, 147 bp, Glycine max
  Peptide Sequence Number=SeqID_121152
atgtgggatctcaaacctctcagagctcatgtctgggcactgggcagttgcacactaagatgtttcactccagcatttctgattcaagtagctaacctcctccaaagggtctcccctatacaccagagcagctgcccagtattctaa

SEQ ID NO: 4375 - DNA, 414 bp, Glycine max
  Peptide Sequence Number=SeqID_121153
atgccgaagaagcgaaagtctatcgccaccagcctcgacgaggtggatcgaaccctctacgcgtcgttttgcaccgccgccaactccctctcgcagctctacacgcactccatgaaccaccagaagctctccttcaacgccggggaacgacacgccctcattggtggcttgtgttatgttgtggtggtggtggtggttaaatattgggtgctgttgtggggaattttaaaatgtgggatgttcttctgttctgacatgcttgagtcagagtttgttcgtaggaagaaaaactttatcagtggatttttagacaacaagagggaggatcacgggttggaacagttgatgtacttaattacattcaggttggctttagaatgtacaatagccttgggagttgggattggtgattga

SEQ ID NO: 4376 - DNA, 537 bp, Glycine max
  Peptide Sequence Number=SeqID_121154
atgatcaaagcattagaacgagaaacaaaaagggctcaaaaagaagaatggggccgaaacaagttccgaggggctttatggggtagcaacagcgaactcaagcttcggagggccgaaagggacgagccgagggtggaaagtatgatattagagggcaagttgaaggcttgtcaaaggtcgaagaggagcttgaccgaacaattgagtaggacggaagagaacatgtgggcaatcaattgccagtataaagagaagctaaatctacctgctagccatgagcaaagaatagagggcgagcatgcaaaagtatcagctctacaagcagaaaaggaagcaagagagagagtgatagactcattacacggagaagctatgatgtggatggataggtttgctttcactttgaatggaagtcaagagcttccaagactgttagccaaagccaaggcgatggaggatatgtactcagctaccgaggaagttcatgggcttttcgattattgtcagcatatgatcgataaaccatgtctcacataa

SEQ ID NO: 4377 - DNA, 222 bp, Glycine max
  Peptide Sequence Number=SeqID_121155
atgaagaatgaagaaatgatggttcttcaggctcaaagtttaagggccattgaaggaggcggagattatgcttttgctgacatggcagagttatgcctagtgcctgatgtcgtcatccttccgatgttcaaggtgtcggatttaaataagtacaaggggactactttccccaagaatcacttgaagatgtactgcatgatgttagttgatgaatactactaa

SEQ ID NO: 4378 - DNA, 270 bp, Glycine max
  Peptide Sequence Number=SeqID_121156
atggatcctcaggagcttacctccaagctttgtattctagggcatagatttgttcttaatgctgaaggagcaccctggaagctcctgaggaaggatctgacgacgctggcccagacttggagcatgctgtcatattctaacctcgcccccacttctcatacctctgatctgaacatggatcgggcgagatttttcagatggcctagtccaactcctcgaggctcagctttccagctctcatctttgcactctacgtggcccaaggagtag

SEQ ID NO: 4379 - DNA, 1740 bp, Glycine max
  Peptide Sequence Number=SeqID_121157
atgtcttcgaaagagaagggcgtcaacgttcaggtcctcctccgttgcaggccgtttagcgacgaagagttacgaagcaacgtgccacaagtcgtgacttgcaatgaatacaatcgagaagtggccgtgtctcagagcatcgccggcaagcacattgacagggttttcaccttcgataaggtttttggtccttctgcacagcaaagggatctttatgaccaagctgttattccgatagttaatgaagttctagagggctttaattgtactatattcgcgtatggtcaaactggtacgggaaaaacctacaccatggaaggggaatgcaaaagggccaagagtggtcccaatggagagttgcctacaggagctggagttattcctcgggctgtcaagcagatttttgacacacttgagagccagaatgctgagtacagtgtgaaggtcacttttttggaattgtataatgaagaaatcactgatttgcttgccccggaggagctttcaaaggcttctttggaggagaagcagaaaaagcagctgcctctcatggaggatggtaaaggtggagttctagtaagaggcttggaggaagagattgtgacgagtgccggtgagatttttactcttctggagagagggtcttctaaacgacgaactgcagaaactttgttgaacaagcagtcaagtcgatcgcattcgttgttttctattacaatccacatcaaagaagcaaccccagaaggtgaagaactgataaagtgtggtaaacttaatttggtggatctggctgggtcagaaaatatatctcgttctggtgctagggagggtcgtgccagggaagcaggggaaattaacaaaagtttgcttactttagggcgagtgatcaatgcactagtggagcacctgggtcacatcccttacagggatagtaaattgacgcgtttactgcgtgattcacttggaggaagaacgaagacatgcatcatagcgacagtgtctcctgcagttcattgcttagaagaaactttaagcacgctggattatgcacacagggcaaagcacataaaaaataagcctgaggttaaccaaaaaatgatgaaatcgacacttatcaaagatctttatggtgaaattgaacgccttaaggcagaggtttatgctacacgggagaaaaatggagtatatattccaaaggaaagatactatcaggaggagaccgaaaaaaaggccatgtcagatcaaattgagcagatgggcgtcacaatagaaactcaacagaagcaacttgaggatttgcaaaacaaatacgtcgaccaaattcggcagtgttctgatttgagcaacaaacttgatagtactcagaaaaacttgaacaagactagcaagttgcttgccaacacagaggaagaattgaagaaatgccactataccctgaaagaaaaagacttcatcatttccgagcagagaaaagcagaaaatgctctggctcatcaagcatgtgttttacgagctgatttggagaaagctcatcaggataatgcttcattatttttgaaaattggtagggaagataaattaaactcagataacagagctgtagtgaacaatttccaagcggagcttgctcagcaggttggttcactttgcaatactgttgcaacatcgttgtctgaacagaatgaacatctagaaggtgtgaagaagctctgtcattcttttttggaccttcatgataag

SEQ ID NO: 4380 - DNA, 1191 bp, Glycine max
  Peptide Sequence Number=SeqID_121158
atgttgtacgcttgcataaggcgggctctgatgctaacttggaggaactatcatcagttatatcctctaatgtttcttgcatctgaggccactgaagctggttcaatatttgacgatcttcagagaaccctttcaactcagcaggatgaactggaactatttgcagggaaactacgcagtagattcaatctcagtcttgaacaaataaaagatatctctgatcgctctcaagaatttgtggataagctatttgaagaatcaaaaaagcttgaagactatgcatcacaggctgaccaaatgcaaatgaagagcattgatgagtttaagaaagcatatgaggagcaatcaaaatctgatacagagaaacttattgccaatatgactagtttagtttctgatcacattcggcgacaaatggatctggtagactcaaagcttgttgatcttagagaaagtggcatcaagaacaagtccttcttagatggacatgtgtcatcaatgggagatattgtgaccaatgcaaaaaggaaatggcaggccttttgcgtgcaagcagaaaaggatgcaaaagacactgctgatgattctgccgcaaagcattgtcgtatggagaaactcatacagcggggtgttcatactgctcaatcggctttcgaacatacaaagaagacacatgaggctgtaaatgagatggggaccaaacatatttcagcaacagagtcaattgtcaggaatgctactgataacaatgtgcaacatgtcgttgaggtccattctgcacgagttacagcagaggaagatgtggcaaagaacagtgaggatcttcttgagcagttagatgtcacgtctgcacaggagagggaatccatatctggcgtattaaatgtggtgagaactcatgcaaatacacttgagacgctacgagaggatcacaatggccaagctacttcaattgaacacacaacaagcaaaactttccaacagcagtacagggactatgaggctagcggcacaacacctataagatgtgagcctgatgttccgacaaaggggacaatagagtctcttcggtcgttgccaatggaagcccttcttgaggaattccgggaaaataatccatatgaatctaatgatgtaaaggagttgaaaccatcgcttattccacgatcgcctcttactcagctgaactaa

SEQ ID NO: 4381 - DNA, 342 bp, Glycine max
  Peptide Sequence Number=SeqID_121159
atgatctcgtgcctttatgtggaaaaaattacaattttatccgaagagcaagagagagtcaatgagccagtgtcacatggtcctgcatcagagcgtcaatttcccgcacaacagtttcacatacttcagtcaagtgttgaaactcagggcatagacagacgaagggagactgttgaagcagaagaatattcccaacaaatggcggagcgtggccatggaatgtattacatgccacaaacatttgctcagtatccgacacagatgtatcagtatccttttcagggtcatcacactgatacttctgcaagccagcaatcgttcggtggtgttgtggaaacataa

SEQ ID NO: 4382 - DNA, 1008 bp, Glycine max
  Peptide Sequence Number=SeqID_121160
atggtgggaaatgtccaacacttggagtgtagttgcctatgtacaaacattccagttgaaattcagaccgccaagttcacggtggacctttatgtcttaccaattctgggtgccaacatagttttgggagttcaatggctcaaatcattgggtcatgttctcacttattacaacaccttaaacatgcaattctttcatgaaggtcgcttagttgaattgaagggcgacaatgatgccaatttaagactattatcttctccacggttccaccatttatgtcgccgacaaggggatgaattttgttttcacatcacaatgctttctaacgacaccccttcattggatgcttcaagttttcctcatgaaattcaaactttgctcatcaagtttgatgccctgtttcaactccctcagtccctgccgctggcgagagctacaaatcatcacattcacttgcttcctcagactacaccagtcaacgatggctcttggagattttgcgtggattatcgggctttaaatgctgtgacggtcaaggatagattccccatccccaccattgatgaacttttggatgagctaggcggtggtcattacttctcaatgttagacttgctgcagggatatcatcaaatacgcatgcactctgcggatatccctaaaacagcctttcatacacaccatagccattacgagttcaaagtaatgccatttgggttgtgtaatgcaccaccatcttttcaggccaccatgaacatcctcttcggaccttacctccgccagttcatcatcattttctttgatgacattctcatttatagtggagtatctgggatacctagtatcacacatgggggtagaactcgtggctttgaaggtggcagctattcagcaatggctactcatgtagcctttgatcgtctaaaggaagttctatccatagcgttgattctggccctaccggacttcaacaaaccattaacacttgagactgatgcattagggtag

SEQ ID NO: 4383 - DNA, 285 bp, Glycine max
  Peptide Sequence Number=SeqID_121161
atgttggcacccagaattgggcagccccaattgcgtgaccagttgcttttgaatgaagttatgagtgcttcctctgtcgatgaggaggataaccttgtggtcaccgcaacatttttggctaagcgcgccctgtgcgctaagcctgagtgtcactctattaaagctaagctaagcgcagcttgctgcgctaagcccgtattatgttttagtgaggttgagcagagcgcaccctgttgcgctaagctcaagtcctcttctgttttagaaattgtagatctaggctaa

SEQ ID NO: 4384 - DNA, 381 bp, Glycine max
  Peptide Sequence Number=SeqID_121162
atgctctcgatcgtagtgggagaaccttcagtatgtcgtacactctacaatgagcaagagaacaaaaactccatcagaagagagttgatcttgttgaggaacttaagggtatggctaagacaaaatgccttgccaaggactccttggtgtagtgtgcaaatccaagagaaatgccttactaaggtcgctcctcaatgcagtgcacataaaaactataaggcttaccaaggtcctaccccttggtgtagatggcataatcttattaaaatctctaccagggtcctatccctcgatgtagatggtgcaatcttattaaatgccctatcaaggttttatccctcgatgcaatgttcaaatgtatctaaactagtcctcagatga

SEQ ID NO: 4385 - DNA, 249 bp, Glycine max
  Peptide Sequence Number=SeqID_121163
atggattctgtttttaagccgtgttggtccattttgctcctgatgcacggtcgttgggtgttggcactaggtcatgtaggcattttgcagcatatcttattctatttggattcatccgtttcgcatatgcactctgtgtcagtgacagaagacgatggcgcacttctaagggttccgttgatgttagcacttcaaagggttccgttgccacccacaaatcatctatcatcttatcaactgggcgattaa

SEQ ID NO: 4386 - DNA, 554 bp, Glycine max
  Peptide Sequence Number=SeqID_121164
acccacttccatcgtgttcacctccaaggggtcgggacctagtccctcctatttgtgcacctgcttgcacaagtattagatgtgggtctcgacatcctttctcacaaaaggtcaagacacagggtaccttgtcttcatccgatatggagttattgcccaatgcaaatgctaagcatggagcttcatcttttttcgatgttatggctcgtgcatgggccctgggtcaatttgggtggcctgagagggggaattttgatgagcttaatcataaggttgagaccttggatggccaagtaaaggtttttgagaatgagaaggtagacaaagagctaaaattaaaggaggttgaggaccaacgtcagtctgatcgggatgagataaagaaattgaggaagtctttagaagtggctagtcatatggtagatgatgagaagttggctaagttgaagttggaggctacaattaaacaagaagtgcttctaatgtgccttcgtatcgagacttgtgttgcggaatctagagaggtgggcgagagtgagcagaagaaggattag

SEQ ID NO: 4387 - DNA, 411 bp, Glycine max
  Peptide Sequence Number=SeqID_121165
agtgggcgtcttccggaattcttcccggatgaaccacttcttccggaaagttcccggaagacgttttccggaagtcttccggaagaagtgttcttccggaagacgtttggttacttccggaagaacacttcttccggaaactttccggaaaacgttcttccggaacttccggaagaacccctaacgggtcttccggaacactccgccgtcagcctctgttccccattttttccggcgtcctctcctctcgttttctaccgtcctctcctctcgttttctaccctaaagggagttagggagactaacctcgttcgcggagaagaagaagacgacgttcgcgcttgccttgccggagaagaagaagcagttcgcggagaagaagaagcagttcgcggaaggaatgaggaatga

SEQ ID NO: 4388 - DNA, 402 bp, Glycine max
  Peptide Sequence Number=SeqID_121166
atgtcttcaacaaagggatgccttcgggttccaactaccaagcttgttgatgtcaagttgtgtgtcaacgtccgtgtccattaccctcctccaagcatcgagaaggggcgttcctacgaaggtactccgacactcaacaaaaacatgtcttggaaagcttcaaagacggagcacaagatacctactaggtcggaaccaaggctccctttaaacctctacaacaaagcccataccattagaagggagaaaacaaatacaaaaggagaacaaaccacaccatggtgggaaataacaccgaacccgtgtgatagttacatggaagtgttcccaacacttgtagcggaaaagtatgatctattttgcattaaaaaatatacaacaataataaatagagaaaaatag

SEQ ID NO: 4389 - DNA, 165 bp, Glycine max
  Peptide Sequence Number=SeqID_121167
atggaagtcagaccgccaggtggatgtgcggaagcggaatggtttttggagaagaagtgcgagagtcaccgactaattgcgaaagcggaatggtttttgtgggaagtttgtagcattattgatggttggcttcgaggattgtatgtgaagagtcacatattataa

SEQ ID NO: 4390 - DNA, 621 bp, Glycine max
  Peptide Sequence Number=SeqID_121168
atgggaaatatgccaccaggttatcgcttctaccccacagaagaggagctgattttgttctatcttcacaataagcttgaaggagaaagggaagacatgaatcgagttattccagtcgttgatatatacgactacaacccatctcaactcccacaaatttcaggagaggcaagtatgggagacacggagcaatggttctttttcattccgaggcaagagagtgaagccagaggaggaagaccaaagcgtctcacaactacagggtactggaaggccacagggtctcctaatcatgtttattcttcggataatcacatcatcggaattaaaaggactatggttttctatagtggaagagctccaaacggaaccaaaaccgattggaagatgaatgagtacagtgccatcaaaggtgaaccatcatcctctatttccaataaggctgttcccacgttaaggaaggaattcagtttatgccgagtgtacaaaaaatcaaagtgtttgagggcatttgatagacgaccacctccaaggagggacgtagttagctattccggtgctcaaaatgtagaagagcaacaaaagggttcaacattatatgattatcatcataaaataatg

SEQ ID NO: 4391 - DNA, 246 bp, Glycine max
  Peptide Sequence Number=SeqID_121169
atggaatctcaacatcctttggaagaagttaacctgaggactgaaggaaatcgaaagcctacatatgattatggagatatgcctagactcataagggaattggtggaacacaaattgcctatctgtgaagggaaaaagctagtgaagcaggcaccaagaagattttatcccaatgtcatggaggccatcaaagcaaagatagaaaggctactaaaggccagcgtgaccccttttggtgaattttga

SEQ ID NO: 4392 - DNA, 708 bp, Glycine max
  Peptide Sequence Number=SeqID_121170
atggaaaaattaaggtgtcaatgcaatgagcagcaagcatgcacatcatgggaaggcgtgaaactacttgtggatcaggctcataacaatctttcattcaggaatttgttccaagaacctaagggaaaggagtatggatttggagcccatgatttcccaacaagtggagtatttgaagtggagccaaggaagtgccctcgatttgtgtacagatgttctgttactttaggccatgtaaatatgcatccttctgagtttcggacatttattgaaagtatagccaatgagtatcatggggatacctatcaccttatttctaagaactgcaatcattttacgaatgatatgtctcatagattgaatggaaaacggatcccaggttgggtgaatcggcttgctagactagcggtaaagttgtgccttggtgacttgttggtcatgggttcgaatccggaaacagcctctttgcatatgcaaggctgtctacttcctgaatgtgtggaagtaacaactgttaaacagctaccagaatatcatgaatgttcagtgttagcagaagatgaaatcattgagtctctttcgactacctcgccttgtggatctcaatcaacatcaggattagatgatgatcaagaaaagcgccttctgtcacctctggctaataaaacagataacctttcttttgttaaagaggccccactaaaatga

SEQ ID NO: 4393 - DNA, 177 bp, Glycine max
  Peptide Sequence Number=SeqID_121171
atgcagagtcaactagatgattcagtcaacactgtctacagagacagtatttttatgagacttcctgctagtttcggaaatctgcaagtagggatcaacatgacagggtgtactggagacacatctttttttattggaaaatatttgatacacttctgttcgtcaaaattaccttaa

SEQ ID NO: 4394 - DNA, 595 bp, Glycine max
  Peptide Sequence Number=SeqID_121172
atggccacaatgatggaggccatgatgagcatgaagaagataatggaggtcaatgcggctatagttgccgctaccagtgccgttgcgaagcacacactcccaccatatgacttgcctcccaactatacaccacccaatgtggcgcacactcctgatgagaatgtcaataaatccactcccacactcattgagagccaacaacctcaatctgatcatgcacatatctctcaacccatgggggagacatatgaaataccccaccacaatctagccgacttcgagtctcgcctcgaatacgccactgaggggcaagcagttggtggtgtacccccgccaaccacaaccctttccttttgcatgcctgatgtcatcatccctccaaagttcaaggtgtcggagttcgataagtacaacgggactacttgccccaagaatcacctaaaaattgctgattttcatcctcttgctaagccaatcttctgtcttagcaagccattcgctgagcgtaacactcctttggctgagcgggaggaagaatctggaagaaggatgagttgtgcatgttctagaggtggaggagacatcctcgccgctg

SEQ ID NO: 4395 - DNA, 282 bp, Glycine max
  Peptide Sequence Number=SeqID_121173
atggcctccatcattgtggccatctactctttcatggcctccatgttggccttcatctgtccttgcacctcctctatttcactcattactctagctctggcacaagttcggcaaagaagcgatgtaactcgattcatcttctgccccaattttcgcaaaccagttacttccatacttgacctcgacttgatgaaccttttcttaaaagcatgtgcttggttcaaaccccataatcctagaaatagcaagtttgattgccaatacttcgaccacatctcatag

SEQ ID NO: 4396 - DNA, 291 bp, Glycine max
  Peptide Sequence Number=SeqID_121174
atggtttgcaccaaccaagcggatatgaccggaaggcttctcgccggttcattggcattcgaatgccgcatcatgcactacttgattgttcgcatcctactccctagatcatccaaccttgcacagagggatggctcttgggtgaagaaggatgctccagtacaggccgctgaagaccactctctatcaccacatcctcagagagatgactcttcatctcttatgcacaacattcttgacaagttggatggactccacactttcgtcggagatcgctttgacttgtgttag

SEQ ID NO: 4397 - DNA, 414 bp, Glycine max
  Peptide Sequence Number=SeqID_121175
atggagttcttgcagctcaagcaggggaacatgaatgtggctgaatatgcaaccaagtttaagaagctggtgaggagtacatgtccaatgaagaacaatatgaatggacctcaacatcagggaaaaccatacttgacctctcctaagcaatatggtaatccccctaacaatcggaggacaattgctatgggctttgctagtggtagtggtcgcaaacccactactttctcaacccatatcacttgttacaagtgtggtaagccaaggcacatctccgcaaattgtgcttataaaggcacgacctgtttcaactgtagacaaaaagggcatattcagagagattgcccatatcccaagaaggagcagaatgatgggggcctaaatgaccaaactggacatctgaaggccacgtga

SEQ ID NO: 4398 - DNA, 564 bp, Glycine max
  Peptide Sequence Number=SeqID_121176
aaaaaccagctgcacgtcatcgatgaacgcgcgcgggatctgtttcctgcggtatccgctcgggcccagtttgcggacgaaagcgtgagccattttgacgcgcggttggcgtatcggggggtggccttcgcttacgacgctggtcaaccggtgttgcgcgatttgtcgctgacgctggagcgtggcgagtgcatcgccatttgcggcggttccggcgcggcagggggagctgacgctggatgggcgcgtactggcaagtgccgccgcgcagcggctgttcttcctgcaaagccaggaggacattctgttcaacgcctcggtgttgcagaacatcacgctgttcgcgccgtcggcgccgggccagcaacggcaggtggaacaggcgttgcgcagtttggggctggcggacgcggtggcgcagctgccggggggcgtgaacgccctggtgcgggagagccatgccgggctgtcgctggggcagcggcagcgtctgttgctggcgcgcgccatgtacagccgttgcccggtgttggtgctggacgaaccgacggcgaatctggatga

SEQ ID NO: 4399 - DNA, 367 bp, Glycine max
  Peptide Sequence Number=SeqID_121177
cttttctccatcacgatgtattagccctacaaatgaagctaaatcaccgttcatcaatagaaataaccttcctttgagaggggtaggagtcaatagagttttgacttattttggtagtattgagaggaaagagaactttgttccaacattggaaacatttgaggaagttccaacatcaacaacatttgatgaagtggtagcatgtgaagtgatgcaagctccattggagcttgtaggcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 4400 - DNA, 324 bp, Glycine max
  Peptide Sequence Number=SeqID_121178
atggtgagggttagtgtgttgaatgatgctctgaagagcatgtacaacgccgagaagcgcgggaagcgccaggtcatgattaggccatcctccaaggtcatcataaaattcctattggtcatgcagaagcacgggtacattggtgagttcgagtatgttgatgaccacagggctgggaaaatcgtggttgaattgaatgggcggctgaataagtgtggggttattagccctcgctttgatgttggtgtcaaagagattgaaggttggactgcaagactactaccctcaagacaggttatagtgtttggcctgttttatttttaa

SEQ ID NO: 4401 - DNA, 237 bp, Glycine max
  Peptide Sequence Number=SeqID_121179
atggcggcgttgttccacttctctcttcttttcacagttctcctttcttccattctcttatcgaatcactcagtaaaatgcgacgaccatgtcttcttctttcaggctaataagtctttttctgtcctttacttttcaccttttcttcttgtgcttgcttcggtttccaatggaaaatctgagttagatctgtttgggagaacgattgatctgacatcaccgaatctctggggatag

SEQ ID NO: 4402 - DNA, 288 bp, Glycine max
  Peptide Sequence Number=SeqID_121180
atgcttacccaaggttttcagaaattttacggaagcattacggaagccacggaagccccggaaaccattttccaaaaacgtggaggagcttgccgcccagttgcttcctccttaagcaacccaacttccaaaatagctttacggattgcgcaacaatgcttctttttgacttccagaatgtcacgaaacattacggattacctaacgatgagtgttaagtacctcgaggtggtcaagcgaaggttgcatgccaccaaacaatggtccccggacgaaattagggtatga

SEQ ID NO: 4403 - DNA, 418 bp, Glycine max
  Peptide Sequence Number=SeqID_121181
atggctccgaggaagctttccttgaagagatctaggaaggacgtcgcggtcgaagggactagtgccactcccgagttcgatagccatcgtttcaggagcgctgagcaccaacagcgtttcaaagccatcaagggatggtccttccaccgagagagacgcgtccagctcagggacgatgagtacacagatttccaggaggagatagctcgccggcgttggacgtcgctggtcactcccatggccaagtttgatccagatatagttctcgagttttatgccaatgcttggcctacagaggagggcatacgagacgtgcggtcatgggtaaggggccagtggattcctttcgatgcagacgccctcagtcagttcctgggatacccgctagtattgcaggagggccaggagtgcgaatacg

SEQ ID NO: 4404 - DNA, 240 bp, Glycine max
  Peptide Sequence Number=SeqID_121182
atggaacatacgaatttggggatcccacggtcatgtggctccgcatgcccccggactcttgggtcacgaggaagcactgggcccaacaaagataggagaaaatcactcaaagtgtatcaatctcacacagtgcgtggcgagaaagtcgctagcgcacaggattttgtcggccatcaaagggagaggaccactttaggttgtggtttcctttttcttggtgacaattctgtactgttctga

SEQ ID NO: 4405 - DNA, 385 bp, Glycine max
  Peptide Sequence Number=SeqID_121183
atgcatcattcacatgcatccatgcttatttttcttttcacattggtggcattgctcactgcattctttcctagaaatcagaactgtaatcattgtaatcaaaaggaaataacacgctttacgacacccttactgagagctagagtaatgagtgaaatagaggagatgcaagagcagatgaaggtcgacatgaaggccatgaaagagcaaatggccataatgatggaagccatgatgagtatggaaaaaatgatggaggtcaatgcggctatagttgttgccgcaagtaccgccacaaaagtggaccccgctcacccatctggcctcaatcaagtaaatcctccagtctcggatatagtaggacagggaggcgaagcgttaggaa

SEQ ID NO: 4406 - DNA, 681 bp, Glycine max
  misc_feature (38)..(38): n is a, c, g, or t
  Peptide Sequence Number=SeqID_121184
catttgtgggccgtcggcgcctacgctccacagaatgncggcataaaccggcgactggaagctgacgtaggccagcaggtcggcgaggttgcgcagcacgaactggccgcgcgggcagcggcgcgccgtgcgaataaacagatcgcgatagcggccgtagggccaggcgatcaggatgttgaccggaatcgacagcaggcgcgaagagagggattgctgaaagctcatgccggagatcaacacttctatcgccatgccggcgataaagcagtacaccaccagtgcgaacgtatcggcagcggcgctacgccagagttatggccttattccgcgatcgattcgccaggcgccgagccttggcgggcgcggctcgccagcggttaccgcactgagattgccgagctgaaaaatgagacatggcttgcagaaggaagtaatgagttaattaatcgccagttcgtcagctcccaaaatgaccagagaaatattgccaaagcgctggcgctctggcttgacaaggttttcataccctccgtaaactccattgtgtgggaatttgtggggaatgttccgtggagcgacgatggtcaacctcgacagcaaagggcggctcgccgtacctacccgatatcgggaattgctcaacgaggaatcgcaaggccaaatggtctgtaccattga

SEQ ID NO: 4407 - DNA, 561 bp, Glycine max
  Peptide Sequence Number=SeqID_121185
gataaggagcttaggggaagcaacaatgggatcatcgacgactatcacaagtggctgaaagctcagacacaagagttagtttggctcccgaagctaaaggcatcaagtgaggaagaggctgaaacccctgaggagagtgaggaggtgcaagccttgaaggcgaaacttgaaagggtgcaagcagtcaaggaaaagttcaagatgaaagctatcaagtggggccgaaacaagttccgaggggcattgtgggacagcaacagcaagctcaagcttcgaagggctgagacagaccagtcgagagtagaaggtatgatattagaggacaagttgaaggcttgtcaaaggtcaaagaggagtttgtccgaacaattaagtaggacggaagaaaacatgtgggccatcattgaccaatacaaagagaagctaagtctagctgcaacccatgaacaaaggctagaggacgagtatgcaaagcttcccagtctgctagccaaagccaagacaatggcggacatgtacttggctcccgaggaagttcatgggctcctcaattattgttag

SEQ ID NO: 4408 - DNA, 234 bp, Glycine max
  Peptide Sequence Number=SeqID_121186
atgtgcttagcgattaggaggaatctggaagggaatttgtcatgcaggcacgtgctcagcgcgtcatcagcttactcagcgattcgtttgccaccttccaggcttagcgcgagtttggcactgagcgattattcgcttactcgcgctaagcgcgagaatggcgctaagcgcgacgtcgaggagcttccttgctatggaaggaaggatcctcagttggggattcttactgagtaa

SEQ ID NO: 4409 - DNA, 331 bp, Glycine max
  Peptide Sequence Number=SeqID_121187
atgggcttggacaatgttggcgagggcagctccaggttccgtgtggggatggaacctcccacgactccttcagaggaacaaccttcccttgtcacaacaataatgcctccttcctctcaaaaggccgtgggaaggggtgacggtgaagaagctttgctgtggaataagcatcgtcatggtggcgagacaccatcttttccctcatttattattggtttcgagtggttggccaaaccgggtgacacccgcaagatgactttaatggcttgcaaagaggatgagtacccgttcatgcgtcctgcccctggcggtcccccttctatgtctactg

SEQ ID NO: 4410 - DNA, 366 bp, Glycine max
  Peptide Sequence Number=SeqID_121188
atggtgtctcgccaccatgacgatgcttattccacagcaaagcttcttcaccgtcaccccttcccacggccttttgagaggaaggaggcattattgagtcgtgggaggttccatccccacacggaacctggagctgccctcgccaacattgtccaagcccatcaacctttcaaaagaggaggacccattgcaaaaacctcacaaggcacctcctctaacgaggaatttccaatgggaaatacttcccgctctactagtggttggcgaatagaaccccaggagtcacttctgcccatacccaacacagagtcagaaatagtagacatagcggggaaaagaggggtacctggagtgaaggtgaaatag

SEQ ID NO: 4411 - DNA, 1608 bp, Glycine max
  Peptide Sequence Number=SeqID_121189
atgccatttttcccctgcaaaagaactattgggtttccagatatatgttgtggtagtcctggaattcatgaagatgagattaggcgtgccagttcttatcattcatattctcaaagtcctccatatgattatcaatatgaggatcggcggtatggaaaacaagtagctgcactgaccaggaagcctggttcagataaagctcgctataaagggaagatgtctagtattatatacagtcctgaccgcttcagtgatcacgtgtatgatgacagatttgcaaatgagagatctggtccacgaatttccgacttttctgtgtctagtggtggcgaacaattgaaatctgatgttcagtctcccaactttcataaggatatcaagattagcagtccatcctatcagcggcgttctggtacaagttcaagtgaagatgtgtggtcccaagcaagaaatgcatctctggaaattaatgccaatgccaagagagatgtagatggaattcgtcctccgcagagaactgcgtcagctcaatcaacagacaacaaattttcatccttgagatcttataattctggcagtttagctgattttttctcagaaccagtccaagcttcagaaccacttcagaatagagcatttggcattccacgaccacctggtcctacaagatctgttagcatggacttctccaaggcacccctggaatcagcttcatctgttgatccttttcagtttccagcagcaccatctgcagctccgacagtggatttgtttcaatcatctgtttcatctgcagctccatctttcaatgagaatcaacttactcaaacatctcaacttgcatctattgatttttttgccgatttttcagagcagccttctactgtaacctcagatgggaaggcactgggattatctgtccctaaaaacaaaggatgggcaacttttgatatgcctcagagcacctcctctgctgcacaagtggaaattccagccactgtaccctcaagtgctaaatctatagaagaaagatttgatccattttcaacctcacatgcaaacgtgcaacaatggccatcttttgaaatttctagtgtcaatgcaccttcgtctgttatatctaatttaaggcatgatggtgtgtggaatggagaagaacaagtttctgctatagcagaaaacactaaaccatggaatgcatttgaagattctggtgaccatcatcatcttgtggatggccttagtcaaggattacaattgcacaattttccatcagctgataatcatattttgggtttaatagagtcggagggatccaatgaagatgaagttaaaggcattgcccctgttggtcgatttgataatcatgacatcccatcacatgtcagtggctcagcatatcccccacccatgcttcccccaatgggagatattcaacataatgaaacgaaatctaaatcaaccaatccatttgattatccctatgaaactgatgtagatcacaacaatatggaactccttcatttgaaaccttttgaaactccaccacagttaaaaaaatctgaggtgtttgtttcacggaatgatattgtattcccaggaatatga

SEQ ID NO: 4412 - DNA, 447 bp, Glycine max
  Peptide Sequence Number=SeqID_121190
atgggtgattttgagaatctcacaatatcaccaaatatagaactactaccacaaacacaaccaagccttctccaagtaaaaagaaagaaagaaagaaagaaagaaagaaaagaagaagctgagtttggttatcaaaattatttgatacatcttcgattcggcggaagcttcatgagacctctgataattttctcgttcctctcttcttcctttctgcttcccatttccgaaataccaaatcagaaacacagaaaccctagaaactgcaaacgaaatcagagcgagagaaaggaaaaatcgcagatattcgaatttcggaacagagaccggaaattttccaccaccgagaatcgcgaaacggtagtggcagcgttcgatctagggttttggggattcctgaattggcgaaaggtagaagaagatgaagaacgcaaaaacgctttgtga

SEQ ID NO: 4413 - DNA, 486 bp, Glycine max
  Peptide Sequence Number=SeqID_121191
atgagtggaaagggattgcagcatgttcgaaaatcactttctcaatatcagcgtcttagagcatgtttggaaatcaaatgggataccaattgggaaagagggtttctaaactcaaaaacttcgacatccttacctttaggaacactcaaaaggtggcaacgccactcaaaaaggcacgacttcggctacacggcggtggtgggagcagtaggtccacttcggcttcaagtacttcacgacgggaaacaaaacgtcagggtggtagcgggacggagttcacggcgggatgaagtagttaaggcaatagcgggggcgctaggtttttggagggtacgagagagggtgtttaccgcgagactatataaactacaaaatttacgacggtgtttaatgacaccgactttgtatgtgactatttctaggacggtgtacctgcaagcaccgtctttgatgacctccatcaaaactacaacggcggggttatag

SEQ ID NO: 4414 - DNA, 351 bp, Glycine max
  Peptide Sequence Number=SeqID_121192
atggaggccatgaaagagcaaatggccacaatgatggaagccatgatgagcatgaagaagataatggaggtcaatgctgctgcagttaccgctaccaatgcagttgctaaggcccctcagttttgcccacaaacacaacccttgcattttacggtgggaagggtccctcctgccatggtggaaagggagaaattgcatcatatagaggaaaggctaagggacattgaaggaggcggagattatgcctttgccgacatggaagagctgtgcctagtacctgacgttgttatccctctgaagttcaaggtgtcggatttcgataaatataagggggccccaagaatcacctga

SEQ ID NO: 4415 - DNA, 298 bp, Glycine max
  Peptide Sequence Number=SeqID_121193
aaatcactacgcatggctccaaactcgtgggtggaggatgcatgaaggaaaacgcaattcatgagggtctgaaaaagggtagagaatggagaattgcactaagcaatcactacgcatggctccaaactcgtgggtggaggatgcatgaacgaaaacgcaattcatgggggtctgaaaaagggcgaggatggaggattgcactagagggtgctcacgagtcaatcatgaagtatggatccaaactccttggtggaggatgcatgaacgtaatagcaattcatagggctccgaaaaaggg

SEQ ID NO: 4416 - DNA, 429 bp, Glycine max
  Peptide Sequence Number=SeqID_121194
cttgggaggattgatggggacccggtcttgagagaaacgaggatatgggctacgtgggagtacgtgagctcagttggaggtgggcaacaggggatggagaccttggggacgtcaggtggggtgctattgcccaaaaccaagcttgaccaatcccgacccaacccgggcatagtcggggactggaacactgtggaggcctctggtaatcgattaccagcctgtgtaatcgattacacagagggatgggtcactggtaatcgattaccagtgcatccagatgagcctgcacggacgcttcagcgcacggtggagtggatactacccacgcctacaccatatcgtctagtggagcccgtccaagtgatcgaggtaacgtcatccgaggaagaccctgaggaggatctggaggagctacctcctaagcctgct

SEQ ID NO: 4417 - DNA, 279 bp, Glycine max
  Peptide Sequence Number=SeqID_121195
atgggtccgaaatctactctaaggctcatgagaaccctagggccttctcttgcatctctggtccaatctacttggagtcttctatccaatgtccttgcgggaaaccatgaagggaggattgaaggctctgttctctaccgaatcctggagttgagttttgaagattccacttcaattagttttcctttccttgcaatggtcttgcgacaagcagtgacatctcgtggcgatcaccggtggtcgttggtggtggagggagaggttgggggtgttgggtga

SEQ ID NO: 4418 - DNA, 339 bp, Glycine max
  Peptide Sequence Number=SeqID_121196
atgaccggccctctcgatgagttgatcccttgctttctcataagggtggacccttgggtactagtacctatcgccttaagagggttgcatgccctcaccttcagagggttgcacgtccttgccttaaggaatacacgtcctcaccttcagagggctacatgccctcaccttcagaggactacacgtcctcgcctcgaggactatacgtcctcaccttcagaggactacacatcctcaccttcagaggacaacacgtcctcacctttagagggctacatgccttcaccttcagagggctacacgccctcaccttcagtggactacacgtcctcgccttga

SEQ ID NO: 4419 - DNA, 975 bp, Glycine max
  Peptide Sequence Number=SeqID_121197
atgggaggctgttgcagccacgatgtttcggttcgagggaaggtggagagcgagatgggtgatagagaatatgagtatgaacatgagaatgatgtgtcttttgaacaaggtggagcattggtaaggttaagaggttcctctaggtttgtatcaatgtacgcacaacagggtcagaaaggtgtgaaccaagatgcaatgacagtttgggaggactatactggagaaaaggatgtgatcttttgtggtgtgttcgatggtcatggtcctctaggccacaaggtttcacaatttattcgtgacaatctaccctcaaaactgtctgcagcaatagaaatttcacagcagaagaccatcaaatactatgatgccaatgatgcagagactggcagctttgatgatgcctacgatgacaataaccacaacatgtcccttgcttcatgggagggatgcttgctgaaatccttcgatgagatggatgagtaccttgctcaggaaattaacactgacagctattgcagtggttgcaccgctgtgacattaattaaacagggtggccagttgatagttggcaatttgggtgattctcgtgcagtactttgcacaagggatagggaccaactcattcctgttcaactcactgttgacttgaaaccagatattccaagtaggtcttggttttggcttcaattcccaagtattactagtccatcaagtgaaacctcaagaattgttaactgtgaaggaagagtttttgcagcagaagaagaaccagatgtgtacagaatatggatgcctgatgatgactgccctggactagccatgtcaagagcctttggggacttttgcctcaaagattatggcctcatctcagttcctgatgtgttttacagaaaaattaccccacaagatgaatttgtggttttggcaactgatggggtaagtaataacattacagtgtcacctttgcatacttga

SEQ ID NO: 4420 - DNA, 387 bp, Glycine max
  Peptide Sequence Number=SeqID_121198
gtgtgggatgtgctcactaacagtgaagtgataaacatagttgcttcagcaccaaggaggtccattgcagccaagttgttagtgaagcgtgctgttagagcctggagatacaagtatcctggttccaaggttgatgactgtgctgccatatgcttgtttctgggtgaacaatctgttttgttaaattcacaatcctacatgagtagaaagagtagacagcgcagcaagcacttgaatcgcactaagtccactagaaatgaagacaatgaaactgtgtatggcaagattggggtggagctagagcgagccaactctttatcaaaacttcctcgccttgctaggggtatgagtaaacggcaatcatctaagtactacacaccaagttga

SEQ ID NO: 4421 - DNA, 181 bp, Glycine max
  Peptide Sequence Number=SeqID_121199
ggtgtgggaagaggctggggggtgtggggggacaggcgcttgttccctaggcgcctggggtcgcgcctggtgcagggcgccaccagtcgcgcccagcggcagggcactaccagacacgcccgcgtcaggggctgctgctccctcgtgcgccgcgccgtatcacgtgtcgcgtactccatga

SEQ ID NO: 4422 - DNA, 342 bp, Glycine max
  Peptide Sequence Number=SeqID_121200
atggttgatctgacaacaaagttgaatgccatggagatggaagtgagtgagtcctttctagtacagtttattttgaactcttttcctgctgaatttggccaatttcaagtgaaccataacactcttaaggaaaaatggaattttcaagaaattaaggccatattaattcaggaagaaaggagattaaagaaaatgaaggacaactcaattcatctcatggctcatgatggagccagtactagcaagatcaagttaggtaagaaaggaaaaggaaaattcaacttaagggttaaagatggaggagtcgggattcctttcgatctaaatcataagaagaactga

SEQ ID NO: 4423 - DNA, 255 bp, Glycine max
  Peptide Sequence Number=SeqID_121201
atggaaagtaactattctaaaaagtggctcaatgagatgaaagaagagttgaaatcaatggatgacaataaagtatgggatctagttgaatttcctaaaggaaatattgaaaggtataaagctagactcgtcgccaaaggcttcactcaaaaagatggcattgactacaaagagaccttttctccaatttctaagaaggactctttgagaattgtattggctttggtggctccttatgatttaaagcttcactag

SEQ ID NO: 4424 - DNA, 265 bp, Glycine max
  Peptide Sequence Number=SeqID_121202
tccgatagagcatccaactcagatgatcgaagaatcaacattggagattgtccagaagaaagatgaatcccaagtgaggaaagcattacgaaacaagtgggtgttgaaactcaagaatgaagagaacaacccaaacccaaggtacaaagctcacattgtggtgaaaggatgtaaccagaagaaagacatagattttgaagaaatcttctcactagtggtgaagatgacatccattaaagcaattcttggtctagctgcaaaataa

SEQ ID NO: 4425 - DNA, 492 bp, Glycine max
  Peptide Sequence Number=SeqID_121203
atggtgtctaaattaaagaagtcaatatatgaactaaaacaggcatttagacagtggtatcttaagtttaatgatactattatgtcgtatggttttgtagagaacaccgttgatcggtgtatctatatgaagaaaggatacatcaataaagtttcaaagagatttagaatgaaaaaatgctctacagggattgttccaatacaaaaaggggacaagtttattcatatgcaatgtcccagaaatgacttggaacaaaagaaaatgaagtatatcccttatgcatcagtggttgggagcttgatgtatgctcagccatgtacattgtcggatattagctttgtcgtaggaattttgggccgatatcaaagcaatcttggaatagatcattggaaagttgcaaagagagttcttaggtacttaaaaggcacaaaggattacatgctcacatataggaggtcagatcaccttgaagtgattggctactcaaattga

SEQ ID NO: 4426 - DNA, 202 bp, Glycine max
  Peptide Sequence Number=SeqID_121204
gcccttgttccctaggcgcttggtgcagggcgccaccggtcgcgcccagcccagcggcagggcgctaccagacgcgcccgcgtcaggggcgctactctgctgctccctagtgcgccgcgccgtaccacgtgtcgcgtactccatggaagcgcctgtctgggagacgctttgtaataaaaaaaacaaacccccaagtaaataa

SEQ ID NO: 4427 - DNA, 228 bp, Glycine max
  Peptide Sequence Number=SeqID_121205
atgaaaaaaaatgctaataatttaacattccggaagaccttcttccggaagttactaaggcctattccggaagaagtgcttccggaaaatacttccggaagaccttcttccggaatgggtcttagtaacttccggaagaagttcttccggaagtggtcattccggaccttcctcctgctgtgcctaaaatttcttccggatacagtttttactgtttttcttctctaa

SEQ ID NO: 4428 - DNA, 468 bp, Glycine max
  Peptide Sequence Number=SeqID_121206
atggtgaagggtactacctcaggttcaggtaaatcccaaacatttgctacttctggtctggctggttgcttggatgttgtccaagcaaatcagaatgcttatactgcttcacaggataatcttgtaggcaaggtgctcgtaaaaaaggcagggacaaattctgcaaaaactgatgatgtcgcacaccaagtgttttataatttgtcggaatgtagtactgaatctgaatcttccccaaaggtcaatctgttcaaagataacagaaacccttccaaaggttttggaatgaagttctcctctccatcctctgatgatgaagtgctgttggaagaaactgatttgcaacccctggaagaggcttggggacatagccttattggctatgtggctagccgtttcccaggaaagaaagctctgctagattattgccaaaaatggggagtcaagtttttatactcaagctcatga

SEQ ID NO: 4429 - DNA, 351 bp, Glycine max
  Peptide Sequence Number=SeqID_121207
atgtcatggccactaataccgcgacctccgatccaagtggtttcttgttctacaatgatcattagagttaatggatggatgaaggaagtggttgctagaattgtgtccttcgacacaattgattgcaaaaaattaaataagataagggaagagagaatgcaaacacagttttatactggttcggccataacccgtgcctatgtccagtactcaagcaacccacttgagatttccactatctttgtaaaatccattacaaagtctgaaccacacagggacaacccatcccttgtgttcaggaatcctttacaacaagagactcacagtctcttaaccaatctcattgaataa

SEQ ID NO: 4430 - DNA, 225 bp, Glycine max
  Peptide Sequence Number=SeqID_121208
atggctctctcacacacttccacttccaccagttgtcaggaagaaaaagggcgtgactgtgactctccaattgaaagcagtgtttgtgatgatttgtgtttgacaaaggagagaacttttgatcataaactagtgtcacgtaattcttctggtcaaggtttgccatatgcacatgaagggttgatgcaatcctaccccgtaagggcattggatagaagactctaa

SEQ ID NO: 4431 - DNA, 573 bp, Glycine max
  Peptide Sequence Number=SeqID_121209
atggagaagacaatgaagaataagaaattaaaagcttgtaggccttggatcttcttcatcaatggagtcatttgtttcttgaagatcaatgacagcggaatagagaaggaggaaaggctaaagactgctcaaagtaggcagaaaagctatcaggacaagaggaggaaagacctgaaatttgagattggtgatcatgattgtaaccgaaatattcacgctttgactgttgggatttatcaaataacacttttggacatctcgctaagcgagacaagcgtgctaagcgcaactccaacccaagaggaattgcgctcagcgggaaatgtctcgctcaacgccaaaagtggatttctgcttactgcttttctaaaaaatttccgcccaaaaaccctaactcctcctcctccaccacccacgaccatcagtggccaccaccacaagccatcgttgattgttgccggaccaccgcacggagatgaacgctttaaccggagcaaaattctcagaatccaactcgaggatttggtggagaacaaactctcaatcctttctttcgtagtttctctgaggtaa

SEQ ID NO: 4432 - DNA, 363 bp, Glycine max
  Peptide Sequence Number=SeqID_121210
tcgcgtatttccgcccgtcagcgtgactcaaatgtcaatatgacagatcttgtgagcgcggaagatgacagagcaaaaaagaatgtttttaccgataaccacttgggtatttccgcccgtcagcgtgactcaaatgtcagtatgacagatcttgtgagcgcggaagatgacaatgtttatacggataaccactcgcgtatttccgcccgtcagtgtgactcaaatgtcagtatggcagatcttgttagcgcggaagatgacgcagcaaaaaagaatgtttatacggataaccactcgggtatttccgcccgtcagcgtgactcaaatgtcagtatgacagatcttgtgagcgcggaagatgac

SEQ ID NO: 4433 - DNA, 711 bp, Glycine max
  Peptide Sequence Number=SeqID_121211
atggccctcaacacctcttgctccaaggccattgttgacatgctaggaactcatgttcctaaatgtgctattgatgtttccaacacacccagattttccttgtcccagaatgacaaaaagggctgcaacttgggattccccaaacttgttcaaaacaagggccttttcccacttcatgctgtgccatccaaaacaatggtggacttggacaatttggtgcttcaatctcaagaaaaaccaaaggaatcaaagacaataaatgtcaaatttcagttacaatgcaattgtaattatggggaacaatttctagtagttggtaatgatcctatgtttggttcatggaaccctgaaaaggccataccaatgacatggtcagaagggcatgtgtggactgcagagatgggtgtacctgttggaaaataccaattcaaaatcatcctgaaaacagcagaaggtgagattgtttggcagccagggccagatagaaacctccacacatgggaagcaatgaacagaatcactgtttgtgagtattgggacaatgctgagcaacagaaagtaacagaagatgatgaagttcccaacacaatggaggaagatcaacttgctcgcacaaacaaggaattacagatggagtcagaaatgccaaattttgctgagaatttgggtaatcctaaagagaagctgaaatcaaggcagccaaagtgctaa

SEQ ID NO: 4434 - DNA, 858 bp, Glycine max
  Peptide Sequence Number=SeqID_121212
atgcaggcacttctgtttctgatttgcagaggcatattgctccatctaagtctcagctatcatcggggaacactcatttttcctagtagtgcccagtttcttttggctaaaacttaccccggttgctcctctaatttaacatccttatctgaggaggatgggatatctcagaatcatgccacttctaacagcaaagattttcaaaatgaagctggaaaagtgaacttcttaccctctctatctatccaagtgctgcaagaaattgggaggcgatgtaactctaaggttgaatttaagactattttaagcaccagcaaagacttgcagttttcagtggaggtactattcactggcgagaaaataggtgttggtatggctaggacaaggaaagatgctcaacaacaagctgcagagaatgctcttcgcagcttagcagaaattatcagcaagcatggctcaagggagaagtatgtggcacatgtggagccacaatgtagagctgtggataaagattttgacaagctttctcttggacgtgacaatggtttcttgtgggatgtggtcaatctggaatccagtgaactgcaaccagaagatggagtgcctagagaaaatgcttctgaggctttggatgctgagactaggtcaagtacccctaatgccattaatcagcaaatggacaagcgtgtcagctccccgaggagtttcaagaaacaagatttaccattggtgcagcaactggagaattggccatctgaattctgggaacggcatattatcgttttatacgcaaaaggttttgatgtaatttgctcgtgcaatatctctgccgtagcggttgtagatatgctgaggtaa

SEQ ID NO: 4435 - DNA, 189 bp, Glycine max
  Peptide Sequence Number=SeqID_121213
atggagcaaccggctaacaatcacaacgaagacattcatttagaagactatggacttaggtctctgagatgcaaaagcaccatgccgaggaaattgttgcccttcagcgcgagaatgctcaccttcgggaggcacaggggttgtgacaacttgagactaacttatcggaagaaggggaggttgaattaa

SEQ ID NO: 4436 - DNA, 993 bp, Glycine max
  Peptide Sequence Number=SeqID_121214
atggctgaaagggattatgctttggaaatatggaggcttcttgaccccggggcacatcttataggttcaaagcaagtccttaatcgtgtgatttgtgtcaaatcaggctcccgaaaatccttactaaatgttttccaagatggtgtgtgccatcccaaaatggcaatggtgattgatgatcggtcaaaggtttgggaagacaaggaccagcctagggttcatgttgtgcctgcctttactccttattatgctcctcaagcagagacggccaatgctgtcccagtcctatgtgtagcaagaaatgttgcatgcaatgtcagaggttgttttttcaaagagtttgatgagagtttattacaaagaattgctgaaatcttctttgaagatgatattggacttttacctctccctccagatgtcagcaactacttgatgtctgaggatgtaccgaatggtaatgctaatgcccccatcagtgaaggaatcaatggtgcagaagtggaacgaaggttaagccaacctgatgataaattttcggttgatttagtcacccgacccatgacaaacagtgttgaattcagacatgaaacctctcagccaactgctgaacctggtttgcttggacctcctgtcaagcatgacggcaactctgttgatcgtgattatgacatgagaaaaggacttttaggcatgaggcatggtccagatataagaggtcaaatttcagctgaacctcctctgatatcaaggccacctaatcaaacatcaccatctttaattcagccatttggaggtgggttggtagaagatgatattgccagcagaactcagacaaatagttggccttctgcatcttttaaagaatctaatgtaataaagtttgataagcatcaggctcaacagaaaccattttctcatagtgtcataggttcatctcccaatgttttacccccacaagcatcacaagtaaagactgaagaggtttgccaatga

SEQ ID NO: 4437 - DNA, 309 bp, Glycine max
  Peptide Sequence Number=SeqID_121215
atggtcaagaagccaaatgggaagtggagaatgtgcacagattacacaaatttgaatcgagtgtgccccaaggatacttacccactctcgaacatcaatcgcttagtcaatagggtggccgaacacatgatgttgagttttctggatgcgtattccgattacaatcaaataaggatagaccccaaggatgaggagaaactgacattcatcaccaagttttgtaacaaagtcatccctttcgggctaaaaaatattgaagccacgtataagcacttaatggaaaaagtttttcagggtcagcttggatga

SEQ ID NO: 4438 - DNA, 807 bp, Glycine max
  Peptide Sequence Number=SeqID_121216
atgactttaaatatccgaaacttggacccaccgatggtcatgcaccacttaataacggcgttacgatcgagaccctttgtcaacaacctctgtaagaaaccgacatctgacctcgatgagttacgaatgagagcagataagtatacgcagatggaagaattggccgaatatcgggaccaattcgggtcgatgtcgtgtcaaccaaaaaaagtaatgacaaactcaactttagcaaggtccgtgacgatggaaggagggatcagccgccgagagagtcacgttttacccaatacattccttttaccgctagcccgtatcatggatcaagccttatttgtcaacatttttccattcccaagaaagccaacaccctcaaaggtcgattactcaaaacgttgttggtataatcgtaatcgtggtcactcaacggaagagtgtggtgccttgaaggacaagatagaggagttcatcaagctcgcccacttaaaggagttcattcacaagccacggatgtaccaatccgaggggaggaataaggtcgagtacagtcgggggaaagatcaagaatgggcaagacgattagaaaggcagaaaagccagagttgctcccgggagaaagaagagagacccctcaaccaaccaaggtggatcaccaacaccataattaggggtggggccactgccttcacacgaaagaaacatctcttgcaggtccgatccgtcaacatgatttcccgacaccaagtacctaacatgccacccataaccttcactatagatgacttcaaggcaattgacctagtgtag

SEQ ID NO: 4439 - DNA, 888 bp, Glycine max
  Peptide Sequence Number=SeqID_121217
atgagtcgtttagggttcaagcacgaggtttacgacggcgacaagcacgttggcgaactcgacgtgattcctctgtcgtcgtcgtcgacaacgacgccgtttcacaatagcttccgcttcccgaacaacgagattcgcatccaccacttcagcgcgaagagcgagcgctgccctccgctctcgatcctccaaaccgttgccgcattcaacgtccgctgcaagctcgattcctcagtcgccaccgagcaaaaggaactaatcgccatccacgccagttgcttctacgaaatgaagacggcggtggtggtggtgaacgacgaggagattcacctcgtctcgatgccgagcaagaggaagaagttcccgtgcttctggtgcttcgcggtgccgttggggctctacgacgcgtgcttggcgatgctgaacctgaggtgtctcgcgattgtgttcgatttggacgagacgctcatcgtggcgaacacgatgaagtcgttcgaggataggattgaggccctgagggggtggcttttgcgcgagaccgatccgttgcgggtccaggggatgtcctcggagcttaagaggtacctcgaggaccggttgttgctgaagcagtacgcggagagtgacactgttgttgataacgggaaggtgtataaggttcagatggaggaggcaccaccgctgtccggtagccacgagaaactggttcggccagttgtccggttgcaggagaggaatattgtcctcacgaggattaatcctgagtggaaaatttctgttgtgtttgtgtttgatttgggttattggttagtttttgtggtgtttgggttttggggttttttgagggagtgtgagtggtgggctgagattgctcgatatggattttag

SEQ ID NO: 4440 - DNA, 300 bp, Glycine max
  Peptide Sequence Number=SeqID_121218
atgcaaataggtactagtacccaagggctcaaccttataagaaagaaagagccaaattgcggtgttcaacaccagttaccgcacaaagcaaaggatcactcagtgtttagatcaagaatacaaaaggatactaaggaaggggggaaaaaggtttttttcttgattttcctagaccccaactcgcccaagctagcatatggcttacctgggccatggaatcacctcctggctaagcaaccagctcgcctgggcaagctcactacttcagggctaaggtttagctcgcctgggcgagcttaa

SEQ ID NO: 4441 - DNA, 246 bp, Glycine max
  Peptide Sequence Number=SeqID_121219
atggttagaaccaggtctgggcaacccggcccaacctgcgattatacaacagggtttccaaccctagttgcctcacccaagaaatggcgtaatcaaggaggaaccaccacagagaatggtgcgccaaccccgacaccactggtgcaaggcccgatgatgcgagaccaccatagaggcagtggtggtgtgacggcagcaatggcacgtgggtgtcgtggtggtgcaaaaaaaggaaagaaaaaatga

SEQ ID NO: 4442 - DNA, 378 bp, Glycine max
  Peptide Sequence Number=SeqID_121220
atgattgatggtctgggtgttgctggatggggagttggtggaatagaagcagaagctgcaatgcttggccagacctgtgtggttttgactatcggagaagttattgtaagaagttgttgtatttatctaaaatctttttattcgggggtttggagtttggacattaaggttttgtctgggtttgttgccgaggtggaggaggaccttgggtgggatgacattgaggatcttagcagtattgatgaaaataaaacaaggcagcagagtggtggtggcgcaagcaaagttgatttgtggaagcggcttagtgctacggaacaaaaggaagacttgagctgggacattgaagatgatgatgatgagactgttaaggcttga

SEQ ID NO: 4443 - DNA, 354 bp, Glycine max
  Peptide Sequence Number=SeqID_121221
atgggttctgtaaggcaacaatattgtcaacagtacaacattctccttgttttgaaggagctttggagatcaaacgaagaattattcaagccaaggaaggtgtccatcgagtctcgatacaagggaagaagggaattacttcaaatggaagggcttaagtggcgttgcatgatcttccttcttattcgaacaaatcaaaatgcaacagaaattctagaaacttttatgtgtgtcatgttggagcacaacacaacggttcatgcaagctatgttgaagaaatcaaactcgacgggaagaacctgtacaatgaacttcactttcagctcaagatcctgggttcatgtagagggtga

SEQ ID NO: 4444 - DNA, 801 bp, Glycine max
  Peptide Sequence Number=SeqID_121222
atggctagcaacccttccaaagttcagaagaaagccaaaacctcgaaaaggaaacaaagagagtgctctcaagcaactcttaacatgttggatatgtggttcacagatcaaaacaagaagaataatttcaagatgatttatgtcatgaagaatgtgagaatacccaagtttctggacatggaatggttctctcagcagggattcaactttcccaatttgctcgaagcacaaggtctttcaaaatttgtgcagatgaaaggaactttctacttggagttggtaaattttttctacacttgtgcctgcattgacatggaaggcaatctatactccattgtcagtgggggagtccgcaagttcgaagaatctgcagatggttacaacaagatgcaagcatataaaggtatgctccttgacctagctaggaatctgagaaaccgcttcagagttggtagtttaactgctgaagataggatgttagagtatcttatcacctacattctaacaccaaggatacaacaatcatgcacagagcccccaacagtagcaaacatgaaccagatggaagaagaagtggaaaaagaagctcaacaagagcctgcacaccaatggaacccttttgagtctcttatgattcagaagatggatgttgttcttcacctccatcaagagcaccaagctgaagttcatagttccttagaaaacattaccacaaggcttgtgaacatagaaataaggctatctcttagtaaacttcttaaccctgatgaggatgaagcatggttatgttcttgtgcttag

SEQ ID NO: 4445 - DNA, 474 bp, Glycine max
  Peptide Sequence Number=SeqID_121223
atgaaaccaagcgagaggaaggaggaggccatcgacattgactcactttctgccaaagtgaccaatatcactagactaagcggcgtgacccacagaggtcacatctttgtggcacttgacatgccagtacgacccacgaatgccaaaggaaaagctaaggtagctgtggaggataccaacgaagcaagccccactccagacgaggatgttccggcggggaggttcgctgttgtcacaacatgcccttttacgggcgagcgaggcaaggctcacgggtgcgctttccaaaggaggaaatatgtgcggagtcgccaccaacgtttatttgtggaaaacgtcggaaaaaaccgaaggaaaccggtcataaagaatattccaagttcgggagttgtatttacgtttgaggaaggtcgacaaaagcggggctcttgctcctacgtaccctccatcgaagaggaaatcagacctacgtag

SEQ ID NO: 4446 - DNA, 429 bp, Glycine max
  Peptide Sequence Number=SeqID_121224
gcctctgttagtcctatagggtgcccgttccccccagcaaggtcacaccatcatgacatagggatcgcgcatgcaagacacccaatggacccaaagaagtccaacagggtcctagggtttccagctctgattacgggcctctgtcagttctacggagtgcccgtcgcccccagcaagttcatcaggccccctattaatcaggctttcatcaagaagtaccgcgcccccaggcaggcgcagggcgagacaccacaacagcctggggatggccagcaacaggcaacaaatgcaccgccgccacctccagagcacctcagctcatccacaaaaaggcgaccaagtccaaagccaaaggtaagcaaaagtactaggtccatgatcgacaagtcatcatgcgtccagctcaagacgttaaagaagcgctactag

SEQ ID NO: 4447 - DNA, 273 bp, Glycine max
  Peptide Sequence Number=SeqID_121225
atggagattgctaagcatatggctacaccaatgagtactgcttgctatttggataaagaagagaccggtcagtcaatagacattaagcaatatcaaggatattctgattctgactttgccggttctaaaattgatagaaagagcaccagtggaacttgtcatttcattggttatgctctagtttcttggcatagtaagaaacagagtagtgttgctttatctactgcggaagcggaatacatttctgtagttgtgctcaaatcctttggatga

SEQ ID NO: 4448 - DNA, 698 bp, Glycine max
  Peptide Sequence Number=SeqID_121226
atgtcctctcgggggaagaaaaccatatctttcctccgggtgtctcccctctttgagcagaattgcaactgtggtcaaggattcagcaagaggtttggaccgcataaaacagactcggaatggcatagcgggcctaccacagaagtacctagaagacaaggcgaggggtatggccaatcaaggagactgggtcccgtttatggatgtgttagctttgctaatttttgggacctagtagcaatcgacgctttccttgcctaccaccatagcaaggaaagtccggtggaacgaggggttgtattaactaacaatcccgcgctcgctataagacaactagggtaccccatgaggggagcaccgacggaagaaagcatgtctccattccttgtgagggatttcggcgcacaaaattccaagactatacaaagaatccataaggcgtgggaaaccccgttaaagaaagatcaagagcttagaggcattcgtaatggcatcattggtgggtaccacgaatggctgaaagttcatatacgaggtttagattggctcgccaagttaaaagtcgtcagcaaagagagttttgaagcaccggaagaggacgaagaagtccaagctctcaaaagcgagttaggaaaggcaaaacttgccaaggagaagttcaagttggccgctacacacgttcggaaggagtgtgccgg

SEQ ID NO: 4449 - DNA, 288 bp, Glycine max
  Peptide Sequence Number=SeqID_121227
atgacgagtcattgcagttttttttttttggagaggtacgccaccatctccattagaattagagacctcgaccatggtgtcgtgctacattctatgatcacaacgctcaagccatggatttttgccaacaacctctgtcggaagcaacccaaagatctggatgaacttcaagcacgagcaacgagatacatccaaatggaggagctatccacctttcgtaaccaagtatgttcggcgaagcagaaaaaagatgaccacacaagtgtgaaccatgtcaataaaccttga

SEQ ID NO: 4450 - DNA, 249 bp, Glycine max
  Peptide Sequence Number=SeqID_121228
atgagtgtgttgcagtggagaaagagaaatgcaaaagggaagaaggaaatacctgaaggtgagtgtgttgcggtggagaaagagaaatgcaaatccgaaaggagaagagatatgaagagagaggaaagatctcactttgtcgctgccacatgtcaacaactttgccacgtgttagcaaattacgcaaaggccaaaatgaccaaaaaaaccaacaaatgtgtccatgtgtcaaactggatttacggttaa

SEQ ID NO: 4451 - DNA, 242 bp, Glycine max
  Peptide Sequence Number=SeqID_121229
gttcaaaaggtaaatatgttgctctggattggccaaagagggctgctatttgtcgtggcacggcttctggtctaagttttcttcatgaagaggctcaaccaaacattgttcacagggatatcaaggccagcaacatattgctggatgggagctttaatccgaaaattggggactttggtctggcaaaactttttcctgacaatgtcacccatgttagtactcgagttgcaggaactgtgtaa

SEQ ID NO: 4452 - DNA, 737 bp, Glycine max
  Peptide Sequence Number=SeqID_121230
atggtgtccttcagttggacagaattcatggtagtccaaaacttggtgccagggatgttctacaaggtttccaaagggtggcacaagtttgcaggaatgggagttcctatctcaggaggtaatgatgggaaccgagtgttagaagcagttaagacagttattgtcaaaatgaatttcaatgatgaagataaaaattgtcgcgttggcagttgtgggggatatcttgcaccagaatatgcacttctgggacaacttacaaagaaggcagatgtgtacagttttgggattctcatgcttgaaataatcagtgggaaaagtagtagcatagctgcatttgaagaggattatttggttttggtggaatggggtggaacttgcattcagttccgcataagaggtgagattctcgcaactcactactcattagcaagtattctgagttttggcctcttctggctagcttggaagctgaaaggagaaaataggcttctggaccttgttgattcagaactaagtgaatatgatgagagtgtggtgtaccggttccttatagtggctctattttgcacccaatcagcagctcaacatagaccaagcatgaagcaagtattggaaatgctttccaaggaagttcatctcaatgagaaggcattgactgagcctggaatttacagatggcacagcactggaaagaagtgtggttctttgaatgagacatcatcttctcaagcaatcaa

SEQ ID NO: 4453 - DNA, 234 bp, Glycine max
  Peptide Sequence Number=SeqID_121231
atggatttcaatgatgaagataataacagtcatgttgacagtttatgggtagaagagttagaagcaatggtgtatcatctgagtatgtgtaatgtttgtgatcagggaatattctttataggagacttttgtctcttggagggcaattgtattgtgagggaaaggatggatctattggaagagaaactccatgaaagccagaattctgagcagagttctgtcaagtgtggatga

SEQ ID NO: 4454 - DNA, 346 bp, Glycine max
  Peptide Sequence Number=SeqID_121232
atggctggcaagggtggttggccattgtttgtggttgcaactaaaaagtttagctataactcattgagatcagcaactcgagattttcatccttcaagtaaaatcggtggaggaggttatggagttgtctacaagggagttttaagggatggtactcaggctgctatcaagtctctttctgtagagtctaaacagggaacccatgaatttatgacagaaattgatatgatatcaaatatacgacatccaaatcttgtggaactgattggctgctgtgttgagggcggtcaccgaatattggtttatgaatttttggagaacaatagccttgcaagctctttgcttg

SEQ ID NO: 4455 - DNA, 272 bp, Glycine max
  Peptide Sequence Number=SeqID_121233
ccattctcgactcatgtcttgactcctccacacagccacccacatgtctcatgctcgtacaatggaaaggcttggcccccgaagactccacctgggagaattggactgatgtttgccacgcccaccaccttgaggacaaggtggttttcccaggggcggataatgttagcagcagcagtgagaagggaaccccaccacctgcaaatcacgaagatagaccaagaaggaacactatgcgccctaagtgtctagaagaatacgtgagcacgtga

SEQ ID NO: 4456 - DNA, 3354 bp, Glycine max
  Peptide Sequence Number=SeqID_121234
atggccacttctcgccatgcaactataccatcctctgcatcactcacattacaacaaactgaagcaaatgctttgttgaagtggaaaacaagccttgacaaccaaagtcaggctttgctatcttcatggggtggcaatactccttgcaattggcttggaattgcttgtgaccacaccaaatccgtctccagcataaatcttacacacgttggattaagcggtatgcttcaaactctcaatttttcatcacttccaaacatcctcactctagatatgagtaataactccttgaaaggaagtattcctccccaaattagggtgttgtcaaaactcactcatcttgatttaagtgacaatcacttctctggacaaattccatctgaaataactcagttggtcagtcttcgtgttttagatttggcacataatgctttcaatggttctattcctcaagaaataggtgcattaaggaatttgagagagcttattattgaatttgtcaatctcaccggtactatcccaaattctattgaaaacctatccttcttgtcatatctttctctttggaattgtaatctcacaggggcgatcccagtttctataggaaagttgaccaatttgtcatatctagatcttacacacaacaatttttatggacatattcctcgtgaaattgggaaattgtcaaacttaaagtatttgtggcttggaacaaataactttaatggttctattcctcaagaaatcgggaagttgcaaaacctagagattctacatgttcaagagaaccaaatatttggccacattcctgtggaaattgggaagctagtcaacttgacagaattatggcttcaagacaatggtatttttggttccattcctcgggaaattgggaagttactcaacttgaacaatttatttctttcaaacaataatctttcaggtcccattcctcaagaaattggaatgatgacaaatttgcttcaacttgatttgtccagtaactctttctcaggtacaattccctctacaattggaaatctgagaaatttaacccatttttatgcttatgccaatcatctatctggttccattcctagtgaagtgggaaaactccattctcttgtcacaatccaattgttagataataatctctctgggccaatcccatcttccataggtaacttggtcaatttggactcgattcgccttgaaaaaaacaaactctctggatcaattccttccactgttggtaacttgacaaagctcaccactcttgttttattctcaaataagttcagtggaaaccttccaatagaaatgaacaagcttaccaacctggaaattttgcaattatctgataattatttcacaggtcatttacctcacaacatttgctatagtggaaagttgacacagtttgctgccaaggttaactttttcacgggcccagtaccaaagagtttgaagaattgctctggccttacaagggttaggcttgaacaaaaccagctgacaggaaatataacagatgattttggtgtttatccgcatctggattacatcgacctgagtgaaaataacttttatggccatctttcccaaaactggggaaagtgctataatctcacaagcctcaaaatctccaacaataatttatcaggcagtattccaccagagctaagtcaggcaaccaagttacatgtacttcacctgtcttcaaaccatctgacaggaggcattccagaagattttggtaatttgacctacttgttccatctttctctcaataacaataatctttctggaaatgtccctatacaaatagcatcattgcaagatcttgcaaccttagaccttggagcaaattattttgctagcttaattccaaatcaacttggcaatttggtcaagttattgcatttgaatttgagccaaaataattttagggaaggtattccatccgagtttggtaaattaaagcatctccaaagtcttgatcttagcagaaactttttgagtggaacaataccaccaatgctcggagagttgaaaagcttagaaacattgaatctctcacacaataatctttcaggtgatctctccagcctcggcgagatggtaagcttgatatcagttgatatatcatataaccaattagagggttcacttccaaacattcaattcttcaagaatgctacaattgaagcgttgagaaataataaaggcttgtgtggcaatgtctctggcttggaaccgtgcccaaaattaggtgacaaatatcaaaaccataagactaacaaagtcatattggtgtttttacccattggtttgggcactttaatactggcattatttgcctttggggtctcatactatctttgtcaaagttcaaagacaaaagaaaaccaggatgaagaatcactagttcggaatctatttgcaatatggagttttgatggaaaactagtgtatgagaacatagtagaagccacagaagattttgacaacaaacatctcattggggtcggaggacaaggaagtgtttacaaagcaaaattgcacacaggtcaaattcttgccgtgaagaaactccatttagtccaaaatggggaattgtccaatattaaagctttcacaagtgaaattcaagctttgataaacattcgacatcgtaacattgtgaagttatatgggttttgttctcattcacaatcctcatttttggtgtatgagttcttggaaaagggaagcattgataagattttaaaagatgatgaacaagcaatagcatttgattgggatcccaggattaatgccattaaaggtgtagcaaatgctttatcttatatgcatcatgactgttcacctccaattgttcatcgagatatatcaagcaagaatattgttttggatttggagtatgtggctcatgtctcagattttggagcagccaggcttcttaatcctaattcaaccaattggacctcatttgttggcacttttggatatgctgctccagaacttgcatacacaatggaagtgaaccaaaaatgcgatgtgtatagctttggggtattagcattggaaatacttcttggagagcaccctggagattttataacttcgttgttgacatgttcatcaaatgccatggcgtcaacacttgatattccttcattgatgggtaagttagaccgacgcctcccttatcctataaagcaaatggctacagagatagctttgattgcaaagacaacaattgcttgcttgactgaaagccctcattctcgtcccaccatggagcaagttgccaaggagcttggaatgtcaaagtcatctttagtgtattaa

SEQ ID NO: 4457 - DNA, 2183 bp, Glycine max
  Peptide Sequence Number=SeqID_121235
atggttttacaagccatcttcaacggcgccttcttctcgacgacgggttcttcttctacagctctcttcattggcaattctgcaagtactcttgttgccgtcgattctcgtcatcattggttcccatcaatgttgtttcttgtttgtgggtgtgtttgctgtgctgtgaaagatgtcttgtataacagaaataaaaagttgtcaaaagttcatactctagggttaaaacacatttgctcagaatgtggtagtggaattgctacttgtccgaaagttactaatgcatatttggttgatttgaggagggtttgtgaagagactgaaaacagattaaagtctaagaatgttcctttacctactgacaaaaggactccaacatcaccaacattaccaccaaaaagaagaaaatcaagcaatatagagagtgcatttaatattgaggataggaatcatcttagagcagagatagcaaggatgttttattctgccggcttgtcattccatcttgctagaaatccacattttgttagttcttattcatttgctactaactgtaatctaagtgggtttcttcctcctagttataacgcattgagaactagtcttttacagcaagagaggtctcatattgaaaggttgcttcaacctatcaaatctatgtggagtttaaaaggagttacattggttgcagatggttggacagatgctcaaagaagacctttgataaacttcgtggctatatctgaagaaggacctatgtttttaaaggccattgatgggtccaaggagtacaaggacaaacattacatgtttgacttattaaaggatgtaatcaaggaggtagggctacaaaatgtagtccaagtcataactgataatgatcctgtttgtaaggcaattgggttattgatagaagctgaatttcctcatattttttggaccccttgtgtggttcatactttgaatcttggagtgaaaaacatttgtgctgcaaagaatgttgatggtaatgaaaatgtcttcaatgaatgtgggtggattgctgaagtaattggcgatgcttcttttatcaaggttttcatcatgactcattcaatgagattagcaatttttaatgagttttcttctcttaaattgctttcaattgctgaaactcgttttgcctctatgatagtcatgttaaaaagattaaaattgttgaaactttgtttgcaaaatatggtcattagtgatcaatggaatagttatagagaagatgatgtcagaaaagttgcacatgtaaaagagttgattttgaatgatatatggtgggataaagttgattacatcctttctttcatagatcctatatatagcatgattagaatatgtgacaccgatgtttctaatcttcacttagtgtatgaaatatgggattctatgatagaaaaggtgaagacaaccatctataggcatgatgaagtgctagaaaatgaagtttctagtttctttgaagttattcatgaaatacttaattctaggtggagtaagagttgtaatccacttcattgcttagctcattctctaaatccaaggtactatagtgataattggcttaatgaggttccaaatagggttcctcctcatagagatgatgaactttctagccaaaggaataaatgtcttaagagatattttccacatgttaatgttaggacaaaagtttatgaagaattctctaaattctcatcttgtgcgggtgactttggttcatttgattcaattgaggatagatgggcattagatccaaaaacttggtgggtgatgcatggatcctctacacctatactccaaaagcttgctttaaagcttctagtgcagccatgttcttcctcatgctgtgagaggaattggagtacatactcctttattcattctttgaagagaaacaaaatggatccaaagagggctgaagatttggtttttgtgcactctaatcttaggcttttgtctagaaaagaggaaggtgtcacaatctcttttgtggctgaggaagacgcccttaatggagcctgtcctacagaagagaagagtgattgcttggaagcaggagatgtaaccaacatagcattggatcctttattcatgtttgttttccatttgggtgttaatggtgcagctattgctcatgttataaaccttag

SEQ ID NO: 4458 - DNA, 378 bp, Glycine max
  Peptide Sequence Number=SeqID_121236
atgcgtgccgtcaggaatcatcaactatgtggaaaaagcataagatccgagctcaacactcacattacaacaggaaaggaagcttctgtcaccattaagaactctcgttgtgacgataagcttttgtcaatcttccgtgaaggtgtgaagtatggtgctggaattggacttggtgtctatgacatccactccccaagaataccaccaaatgaagaaattgctgacagaatcaacaagatgctggcagtgcttgagaagaacatcttgtgggtgaaccctaactatgggctcaagacccgtaagtacactgaggtgaagccaaccctcacaaacatggttgtcgcaacaaaaatcacccgtaacgaacttgccaagtga

SEQ ID NO: 4459 - DNA, 447 bp, Glycine max
  Peptide Sequence Number=SeqID_121237
atgttttacagttggacccctaatcgtcatgctgttaaggcacttggccttgcaattaggtcacattttgagggcccctaccatcattatgaggctgtccctgaggatgtgcagacaagagttacttggacagctcaggatgagtggcaaattaaaaaagtgtatgaaacaaaagttaaaaaacgcctttctgatatgctcaccaaagctagggataagaggaagagacctcattggataggtgaacaggcgtgggttgatcttttaatatattgggtgactgataagaagttcaaggatcagtctgctcaaaataaaattaaccggacttctagtcgtggtggagcagtgcacactacaggacgcaagtatcaccttgacattgcagtaggcctagaaccttcagcaatgccgtcaacagaaaatttgcagcagagatcagtttag

SEQ ID NO: 4460 - DNA, 1548 bp, Glycine max
  Peptide Sequence Number=SeqID_121238
atggtgatgaagcagagagatgaagagctctctttgttcctcgagatgaggaggagagagaaagagaacgagaaaaacaaccttcttctgcttcaaaactctgaagaacttgatttgtccaatttggaatccaatcatggggcctccatgatttccaagatggtgtcttcggtgccaccaaggaagaatggaattgaagagtttttgaattcagagaatgacaagtctgactatgaatggcttcttgcacccccagatgcacctctttttcctactttagagaaagagtcacaaatatcagtaaagagtgaacaggagactcgtaatgctcgcccaacagctttaaaacctagggtagctaatatccaagcagaacctgcttcaagaagccatgtaatttctaagcatcatgcatcaatgccaggactaggttcttccacaaatggtagtaggagaccttcatcatctgggggtccaacctcagccacttcaagatcttcaactccatttggaaggccaacattaccttcaacaaccaaatcctctaggccctctacacctacttccagggccaccttaacatctgcaaagtcaacagttccaccagtgagatcatccactcctacaagatccactgccaggtcctcaacacctacaacaaggccttccttggcacctccaaagacatctcaaagatcagcaacaccaacacttagatcatcaaccccatcaagggcatttggagcaaatgctcctcctactagaccttcatcagcttcaaaagcacgccctggccccatagttgctaagaatccggtgcagtcacgcggcagctctccctcggtgagatctagaccatgggaaccctcacaaatccctggtttctcacttgatgcccctccaaatttgaagacatcattgtcagatagaccagcttcagccactaggactaggcctggtgcactgaattctagatcatcttctgttgatgccagcagcaatgcaaaatctagaaggcaggcaagtaccccttccaaaggaaggactaccacagggttggtccacaataatcacacctctatgcaagttttgagtagagctcgtttcactgatggtgatgatgaaagcccagttgtgattggaacaaagatggttgaaagagtagtgaacatgaggaaactggcccccccaaaacatgaagaccatcattcttctcgtgacaattcttatggaaaatcttcttctggtagctctggatttggaactacactttcaaagaagtctttggatatggcaatgagacatatggacataaggcgaagcatccaaggtaatctgcggcctcttgtgacaagcattccagcttcctctatgtacagtgtgagatcaggtagttcctcaaagagcaggacagtgagtgcttctgattctccacttgccacaagcagcactaccagctctgaaccaagtgttaataccaactccatgtcttatgatggaagtggggttgaagaaaatgattttgcatgtgagaggggaaactcttga

SEQ ID NO: 4461 - DNA, 1099 bp, Glycine max
  Peptide Sequence Number=SeqID_121239
atgcagagctcgaatcgtgcgctcgacgaggcctatacgcggcaactggccgcgaagaccgcgctgtccgcggcgagcctgaacctgacgatcgtgcgcaccacgctcgaccgtgcgctgctgcatccggaagcgccggacgtatcggaactcgtgaagaaggccgagggctatctcgcgaaggccgacacggcgtggcgcagctacgcggcgatgccgcacggcgacgacgaaggcccgctcgcgagccgcctcgatgccgcgcgccaggcgctgatcgggcaggcgctgaagccgatgatcgacgcgatccgcggaagggcggcgcgacgaagccgaccgcttgctgatgaccgtcgcgccgccgttgtcggtcgcgctcacgcaggcgaccgacgcgctcgatgcgtaccaggccgcgcgcggcaaggacgtgtacgacactgcgcagacctattacggctggatgcggatgggcgcgatcgcggggatcgcattcgggctggccgcgtgcctcggctgcgcgatcggcctgcatttcgcgatcacgcagccggtgaatcgtctgctgtcgcatttccgccgcctgtcggaaggcgacctcacgtcggaagtgcgctggtcgtcgcgcgacgagatggccgaactggtcaacggcgtgaccggcatgcagcgcagcctcgcggacaccgtgcgccaggtcagccagggttccgaggcgatttcgacggcgacgcaccagatcgcggccggcaacaccgacctgtcgcagcgtaccgaggaacaggcgtccgcattgcaggagacggccgcgagcatggagcagctcaccgcgaccgtgaagcagaacgcggacaacgcggtggaggcgcaggcctgcgcggacaccgcgagcgagatcgccacgcgcggcgcgaccgtggtcggcgaggtgatcggcacgatgaacgagatcgaccagagctcgcagaaggtcgccgacatcatcggcacgatcgaggggatcgcgttccagaccaacatcctcgcgctgaatgcggcggtcgaggccgcgcgtgccggcgagcaggcccgcggcttcgcggtggtcgcgggcgag

SEQ ID NO: 4462 - DNA, 363 bp, Glycine max
  Peptide Sequence Number=SeqID_121240
atgaagatgaaagcaaacaaaacaataaatgaattgaaagtctcggattcaaacacttaccgattgaagaacgaagaacgaacaaagaaagaacaaagaacggtgaaaaacagaggaaaatcttcacatatttgctcacagaaacgtctcggaagcgttacggaagcacttcgactcgattcttcttcacagaaacggaaaaagggaggtgctagccgctcagaggcttctggaggaagatttctaagcgcaccccaattactaagttcaccccctttttgtactttacgaaaaatttacggaagtgtttcggatttgattttcatctttttttttctcttccctttcaccaatattaagtga

SEQ ID NO: 4463 - DNA, 446 bp, Glycine max
  Peptide Sequence Number=SeqID_121241
gatattgttgtcaagtgtccttatgagctacataggggtgtgaggcctttcgcacaagagacccttttctctgacttcatcaaatgcgggactgaccaatacattgttcctctgggtgatgttgtgccatgtaggagtccttgggtttgcacccctgactatctgtcttggttttacaaggtttcccacccctatgccatttcgttgaaggagggacaaccaccatgttgtcctagcttgttggaccttagagttatgccaatgggcaaaagtcaacatcagctcatacaacaaggtttagtatttaggtgtagcttagagaggcaaagaaagatggccaaggccaaggatggtggcaagaaggcttgtaggccttggatcttcttcatcaatggagtcctttgcttcttgaagatcaatggtagaggaatggggaaggaggaaag

SEQ ID NO: 4464 - DNA, 735 bp, Glycine max
  Peptide Sequence Number=SeqID_121242
atgccctcgaaattcagaggactacacgtcctcgccatcagagggctacacaccctcaccttccaaggactacatgtcctcaccttcagaggactacacgtcctcgcctttagaggacaacacgtcatcgccttcgccttcgtagggctacacgctctcacctttagaggactacatgtcatcgccttcagaggactacacgtcctcaccttcagagggctacacgccctcgccttaagaggactacatgtcctcaccttcagaggactacacgtcctcgccttcagaggacaacacgtcatcgccttcaccttcgtagggctacaccctctcacctttagaggactacatgtcatcgccttcagaggactacacgtcctcgctttcagagggctacacgtccttgccttcagaggactacacgtccttgccttcagatcactgcacgtgctcggctttagaaggctacacgtcctcaccttcagagggatgcatgtcctcgccttcagaggactacacgtcctccacttcaaaggactacacgtcctccacttcagaggactacacgtcctcgccttcagagggctgcacgccctcaccttcaaagggcgacacatcctgaacttcagagggttacacgtcctagcctttagagggctacctgtcctcactttcagtgggctccatatccacaccttaagagaatttaaggtcctatgccttttaaatgcttaa

SEQ ID NO: 4465 - DNA, 234 bp, Glycine max
  Peptide Sequence Number=SeqID_121243
atggacaaattgtacgggttgagtcatctcttcatggcagtgtttcttcataacttctccatgttcatggtggtaccagccatcaccgatgtcacaatggctgctctttgtcccggacaagatgaatgctcacttgccatctacatcactggttttcaacaagcgcttttcagtaataagcaacacacaaaacatacgtacggtacaagtaagaactgctatggaactaaatga

SEQ ID NO: 4466 - DNA, 954 bp, Glycine max
  Peptide Sequence Number=SeqID_121244
atggtaggagttttccggcgctccctttcattcccaaacaaaaatccgaaccgtccatcagctccgaaaccgcacatatctcaccacatcaggtccatcagtcttccgtgcagatctcaccctctgatctcagagatcaaggacgagatcaacggcctcagagcctgggcctccacctcaaaatccaatccacaaacacacacaacaatttcccacggtttaacccttctcaaagacacacacgaaacccttcaacacattctccaactcccccagactctagaaaccctcagaagccaccctctctgggtcgagaagcttctagaagacttcctccgtttcgtcgacgccttcggaatgttccaaacagccattatgtctctcaaggaagaacactcctccgctcagatggtcataagaaaacgcgacgagtccaaggttgtcgcctacgtaaaagctaagaagaaaatttccaaggaaatggaaaagctcgtgtctgtcctccgatgtgttcacgtcacacaacatcagcaacattccatgctgcaggttccatctttcattgtggatgctgaactgagacacgtcatcgcggatgtcatgagcgtcacggtgtccgtttccgttgcgctgttcaacgggattggggtgtcgttttcgtcacgaaggataacgtggacgcagatggtgaagttgtccagaaattacggtgggagggtgaataataataaggagcatgaaggcattgaagagcttcgaaatggggtggaattagtggaaaggcttcatcagaatctgaagaagaagggtgatgaagaagtcaggttggttttgaagaagatgcgggatttggaggaatgtgtttgtggcattgaaagtgttaccgagaaagttttcagggctttgataaactctcgggtggcgctgctcaatattcttacccttacacggtag

SEQ ID NO: 4467 - DNA, 844 bp, Glycine max
  Peptide Sequence Number=SeqID_121245
atgggctgcaacacctcgagacttgaccggctaccggcggtggccctgtgccgtgaccgttgcaagttcgtggacgaagcgcttcggcaaagctacgccctcgctgacgcccacgtggcacacatggaggccctgaaaacactaggacccgctctcctctgtttcttcgacggtttcgacgattccgacgaaactagtgttcgaattaaggaaaccaaagtccctgtcgccacgaaatctccaccccctcgctccccttcttcccttagttcggactcagacgatgcaaacgttcttttgcattccgaatcagaaaccgaagacgcggaaaaagaagagttccaattgttcactcgcgcgcgttatgattacgcgcactcggctcgttaccctccgttttctccgccgcgtggctattccggctcgaagccgccgtctccgccgcctccttccggctccgcctgggatttccttaacttcttcgagccgtacgagaagtaccacgtgccgtattttcctagcggcggtgatgctgacggggcagagaaggacaaggggaaggttgagaaacgtgacgagtttaaatccaagggagaaaatgaagaagtgaagaaaaagaagggtgattcgaaggaaaagaaagtggtttcggagaaagaggaagttgtttcagtttcagagcaatgtagtgactctgcgagagtgaagtcagggaaaggtttctccgaggcaatgaaagagattcaggttctgtttgagaaagcatcggagtcggggaaccccgttttggaaatgctggacgttgggaaactccgttaccatcgaaaatttgacctcaatccgg

SEQ ID NO: 4468 - DNA, 310 bp, Glycine max
  Peptide Sequence Number=SeqID_121246
tgttctgctcaaagcccattgtaactactgcgaatgcctacacaactggtccaaaggagttgctacgtgcacccagcattattgctggggcacccagcaaacagtgaagtggcgaaactgcccttcagcaattattcttccggaaaaactcacagacaatttccggaagaagcttcttccggaagtcttccggaagaagcttcttccggaagacactggaattcttccggaagaagcttcttccggaaacattccggatgacgttcttccggaaattgtctgtgagtttttccggaagaataattgctga

SEQ ID NO: 4469 - DNA, 624 bp, Glycine max
  Peptide Sequence Number=SeqID_121247
atgaagacgaagatgacgatacacgttcttgaatcaaacatggcgttacaattagaacaagctactaatataaacctcagggttttgtggaaaaaaagaaggaagagatcgacgatgttacagagccccagaaagtttgtgacgccctttactaaatgtgtttctgatctcaattggcgtttaactgggttgatcatccctctagttttattcatcacgttcttctctctccattattcatcttccacttcttcaaacggtttttcagccttttaccctgttcagcagtttctcttcaacctcccttttaagtttatcagcgaggaagatcctgttgtttccaaggatgagttgttgcggtccaaaattgcggtgtgtttggttggtggtgccagaaggttcgaactcacgggaccctccattatcgaaatggtgctcaaagaataccccaattcggatgtttttcttcatagcccgttagacaaggacacgttcaagttctcgctcctgaagtttgcgccgaacgtcgccgccgttcgaatcttccaccctcaaccgttgccggaaaacgagtcgtatgttcgagtcctcaccgcgcataactcgcccaacggaatccagtga

SEQ ID NO: 4470 - DNA, 960 bp, Glycine max
  Peptide Sequence Number=SeqID_121248
atggggaggccaccttgctgtgacaaaattgggattaagaaaggaccttggactccagaagaagacatcatcttggtgtcttacattcaagaacagggaccagggaattggagagcagttccaaccaacacaggtttgatgagatgcagcaagagctgcaggcttagatggactaactatcttcgaccaggtatcaaacgaggtaatttcacggaacatgaagagaagatgataatccacctccaagcccttttggggaacagatgggctgcaatagcttcatatcttccacaaaggacagacaacgacataaaaaactattggaacacccatttgaagaagaagctgaaacaaagtgggagtgatgagggtgttgaccaagagggacattcttcttcttcttcttctaattcacatccaaagggtcaatgggagagaaggctacaaacagatatccaaatggccaagaaagccttgtgtgatgctttgtcccttcacaagccagcaacagcaacagcaacaaaccttgttgtgcctgatgatgccaccaaaccttcttcaacttctcaccaaccctacaagcatgcatcatcctcatatgcatcaagctacgagaacatttcacgtttgatggaaaactggatgaaatccccaaactcaaactcaacaaataattcgccagggtattattcttcttccttcagcaacatggtcaataataacactacaactggatccagttctagtgagggagcacatagcaacaccactactacaacacaagatcagggttttgactccttgttaaccctaaactcctccaaacaccatggctcttcatctcagacgcaagtgcctcttactctgctggagaattggctctttgatgatggggctgctcagtgccatgaagatctgatgaacatgtcgctcgaagaaagtaccgcaggtttgttttag

SEQ ID NO: 4471 - DNA, 129 bp, Glycine max
  Peptide Sequence Number=SeqID_121249
atggctactctagttgttccaaattcaaattcacctgttgaagatgctgaggctcttcacaagtccttcgaagcgtcgttgaatggtggttgtgacgtgcactatttcatgcccgcattcgataattaa

SEQ ID NO: 4472 - DNA, 663 bp, Glycine max
  Peptide Sequence Number=SeqID_121250
aggcagcaaatcagaagagtctatgaggaaattttccaggaggatcttgtgaaacgcctagagtctgagatcaaaggagactttgagaaagccgtgtaccgatggatactagaacctgcagatcgtgatgctgttttggccaatgttgccatcaagaatggcaaaaactacaatgtcattgtggaaatcgccactatcctctccccggaagagcttttggccgtgagacgtgcttatctcaaccgctacaagcactccttggaagaagatgttgcagctcatacctctggccatctacgccaggcaagtccttgtgcatttacatgtctgatccactttagtttgggaaaaaaacttttagtggggttggtgacctcatataggtatgttggtgatgagatcaatccaaaattggcacaaactgaggctgaaattcttcatgatgctgtgaaagagaagaagggtagctatgaagagaccattagggtcttgaccacaaggagcaggacccaacttgttgcaactttcaactgctacagagagatccatggcacttccatctctaagaaactggtggatgaaggatctgatgagtttcaaagggcattgtacactgccattcgtggcatcaaggatcctattaagtactacgaaaaggtttga

SEQ ID NO: 4473 - DNA, 213 bp, Glycine max
  Peptide Sequence Number=SeqID_121251
atggggttgttttcaaagcatgcatgcacaaagcaaatcgccagtggaattggcgagtttgctatgccgtactggactcgccaaccccattggcgatttcgccatgcatggggagttgccagtcaaactggcgaattccaggacgtaggcttggcagacagctttttcagttggcaagctaaagggaagttgccactgccattggcgagttag

SEQ ID NO: 4474 - DNA, 201 bp, Glycine max
  Peptide Sequence Number=SeqID_121252
atgttccttgatttgtcagtggaaaggatagttacttacctatttgttgattgggttgctagtgtaaaccttgaatccctcaaatgttggttacattctaagcaaggtaacctaaagaaggatgctggtccgaatgtgataccagctttctcgagtagttgtccagatgtcacgatgatgagcagcaatggtgattactag

SEQ ID NO: 4475 - DNA, 222 bp, Glycine max
  Peptide Sequence Number=SeqID_121253
atgtttatcaccgaagcatatcaaactcttcacgactggggtccataccctgctgatcaggtcctcaaggaacttcaagacagtcttggatttatgatctatgacaacttttgtaacatttggggtatgtttcatagtgagcatggtctcatgagctttgaacatccatcaaataagatgaaagcaatgcctagaattgacaattttgtttttgaggaatag

SEQ ID NO: 4476 - DNA, 462 bp, Glycine max
  Peptide Sequence Number=SeqID_121254
atggggacaagcagttttctatggaactgtactaaaaaattcatcacagccgggatcgtcactgtgactgtgactgatcattttgtgacagttattccagttcgaggcggatctatgtctcccacatttaatcctaaagctggttctcatatgggagatgtttttgatgactatgttttggttgagaaattttgccttaggaattacaagttttcacatggcgatgtggtggtctttcgctcccctctaaatcacaaggagacacacgtaaagagaatagctgcattacctggtgaatggtttggcactcatcataacaatgatgtgattcagattccattaggacattgttgggttgaaggagacaacaccgcttctagcttggattcaaattcatttggaccacatctactctatgctaagttgttaggaatgctacatttgacagaaaatatttactga

SEQ ID NO: 4477 - DNA, 849 bp, Glycine max
  Peptide Sequence Number=SeqID_121255
atggggtttggcctgaaaaggaggaagaagagaggagaaggagaaggaaagatgcgcaagtctttcaaggattcactcaaagctcttgaagctgacatccagtttgccaacacactggtggcagggatgcctgactttgtggcaatgtcccctcctctttttgtaaagaggagcgcaatcatagcttctgagtatccaagtgctggtgcttgcttccaaatgagattgtcctacagcccagctgctcaattcttcctttttctggttaagtggactgactgtcaccttgctggagctttaggattgctcagaattcttatatacaaggcatatgaagatgggaagacaaccatatccatttatgaaagaaaagccagtctgaaggaattctatggtgtggtgtttccctctttattgcaacttcacagaggaatcactgatgttgatgaccggaaacaaaaacatctatgtgctactaagtataagcataaagatttgacaagcaaaggaaagcttcctgagattgacatggagagagaagaagagtgtggtatttgcttggagatgaatagcatggttgtattgcccaactgcaatcattcaatgtgtatgaaatgctatgaagactggcatgcaagatctcagtcttgtcctttctgtcgagacagtctcaaaagagtgaactctgatgacctttggatctgcattagcagcagtgagattaatgacttggcttcgatcaacaaggagaatttgaaaagactatttatgtacatagaaagtttgcctctcactgccagaccccatattcagcatgtcatatcatcaccaccagtgattgccaattag

SEQ ID NO: 4478 - DNA, 642 bp, Glycine max
  Peptide Sequence Number=SeqID_121256
atgaaggaaggcataggtcacatcttagacatcactcccataggagggaaaaggaacaaaagcctcaagaggttaacattaacctcccacacttccatgggaaggacaatgaagtctacttcaaaatcttatggcactcactcatatccaaagaaagaccaaggtcaaagcatcttaggggcgacaacttctaagcctaaagatgataagaggaagacaatagaaaagcaaccccctaaggctagtatgcaagagaagactagctctataaagtgctttaaatgtcttggaagaggacacattacttctcaatgccccaccaagaaaaccatgattatgaggagccaagacattcatagtagccaagatgaggctactacttcaccttcctctagtgaaagtgaagaagcaaaatgggaagaatctagtgaagaaatctacccccaagaagaaggacaacctttaatggttaaggatgagtttaaagaggtaagtgtctcctccaagaggtgctcatatgtgatgcaatcttaccccccaagggcattagatagaagactccaagaagattgggccagagatgcaagagaaggccctaggattctcatgagccttagggtagatttcgggcccatgggctaa

SEQ ID NO: 4479 - DNA, 291 bp, Glycine max
  Peptide Sequence Number=SeqID_121257
atgaagaaaaagttggagctacaagtgtttcagtattgcgaagtgtggcagactttctggctaagtgagaactgggatagcaatgttaatgtttgtgatcaaattgctaatagcctaatggaattggaagaaagatttgaggatttcattctaaagttgaaagaagcagaatgggatacccatcaattaaatttgaagttttgcaagcattcagagcaagatatctatttttcacatgcagatattcaacaaagggagacccggtatttatggtggccaattggcttatag

SEQ ID NO: 4480 - DNA, 2930 bp, Glycine max
  Peptide Sequence Number=SeqID_121258
atggcgggtgtaccagccacagatactttccgcctttacgggttcattaataagtcacgcgtcactatactaatagatagcgggagcacgcataattttgtccagccccgcgttgctaagttcctgaatctaccagtggaagacaccttgccccttagggtaatggtaggtaatggttcagtcatgacctgcaaccaattgtgcttagatacaaagcttctcatccaagatcatgcattcacagtgaccttgcacattcttcctcttagtggagctgaagtggttctaggtgtggaatggcttcgaaccttggggcccgtcatcaccaactacgcttctttcaccatgcaattctcctactcaggtgagtccatcaacctccacgcggatgttcaatcagatcccaacccagcttcagcaaaccaggtaaaatgcatgctctctaatagttctacctcgggtttattccatctctctctcctcccggcagacccccctacaccatcgtcaccacccctccatcatatcccagccattaacacccttcttcacaaataccacaccttatttcaacaaccttcgtccctacccccttccagacaccacgaccaccacatcaacctcctccccatagcgaaccccattaacgtaagaccatacagataccctcacttccaaaagacagagatcgaacgccaagtctccgccttactcgatgctgttcaagatagattccctcttccaactatagatgaactccttgacgagttaggaaaagcatcatggttctctaagttggatctttggcagggatttcaccaaatcttaatggcagaagaagacactcccaaaaccgcgttccgcacccaccacggtcactatgagtaccgggtgatgccgtttgggctctgcaacgcaccctcaacgtttcaggccaccatgaactcccttcttcgaccctttctgcgcaagtttgcggcagtttttttttacgacatcttaatctacagcgagactttaagtgatcaccttcaccacctcgagtgcgtcttcaactctctcttacaggctcgttattacttgaagcaatcaaaatgcttcattggccagcgacagcttgactacttggggcacgtcgtctccggcagtggcgtgcgaccggacccaacaaagattcaagccatcgtcgaatggatcatgcctcgctccccaaaggaccttcgcgcactcctcggtctcgccagattttacaggaagttcgtacgcgggtatgccgccattgcagccccactcacgaagcttctttgcaagaacgcctttcaatggtcctcagaatctcaaactgctttcgagaaattaaaggccgtcttgactacagctccgatattggcccttcctgacttttcaattccgtttatactagaaacaaacgcatcaaatgtagccatgggcggaatcctgcaacaaaacggccaccccatagcttacttcagcaaaccattttgcccacgcctccaacacgcttcagcctatgttcgtgagttgcatgctattgtcaccgccgtccgaaaatggcgacgatatctcctaggacacaagtttaccatctacatagaccatcggagcctccgtgagctcatgtctcaggtcgtgcaaacactagaacaacagttctatctagctaagttgttgggctatgactacgagattcaatataaagcgggatcctcgaatatagtggccgattccctctctccccctcactctgagttcatggtccaactaaaagccacactattagctaacccagaatttcagaagctacgcgaagccatacgttcacaccttcacgagtaccccgactactttatctcggctgaccttatcatcttcaaaggcgcgatatgggtagactccaaaaacccattcatcatatccttgttacatgaatatcacgcgacacctattggaggccatttcgggataaagaagaccttgcatcgtcttcaatccgactttcgatggcacaacatggtcgcagatgttaaagctttcgtacggcgttacgcggtgtgtcaacaagtaaaacacctcacacgtagaagtgctgggttactccaaccgattccagttcccacaggcacctgggaaaacatctccatggacttcgtgacccatctccctgcctcacacgggttcaccgcagtcatggtcatggtggatcgcttctctaaaagtgttcacctaggtgctctacccactcacttcaccgccttcaaggtagctacccttttcatggataccgtgtgcaagcaccatggcttccctcgaagcataatttcggaccgagaccccatttttatcagttcattctggcgcgaactcttcaagatgactggtacaaccttacgcatgagcaccgcctaccacccacaaacggatggtcagacggaggtgatgaaccggacgctcgaacaatacctctgctcctttgtacatcaccaaccagctacctggtacaaacttctcacgctcatggaatggtccaataatacctcgcatcacactagcaccggtctgactccatacgaagtcgtctatggcaaacctcctccttctcctccaatgtatcttcaagggttatcccgcaacgacgcagtcaataccatactgcgtacacgcgaagaaacccacgcaattctccagcgtaagcttgtcaaggcgcaagaggctatgaaacatttcgcggaccagaagcgtcgtgatgtggtttatgaggttgaccaactcgtctatgtcaagcttagaccccaccgtcaatcctccctgcgatcccagccaaccagcaaactgaccaagcgctatttcggaccttacccagtcatggaacgcataggaaatgttgcatatcgactgaagttacctgaggg

SEQ ID NO: 4481 - DNA, 177 bp, Glycine max
  Peptide Sequence Number=SeqID_121259
atggagtccaagcgaaacaagcagcaaccgaggaggagaaaacgcagctcgcggaagagggaagcaaaggaacaaaagcagaagcaagaaggagacgcgatttcacggaaccccacttcttctgtattgtatctgacatcttccattgcgtatgggacttttgtgtttgtgaattga

SEQ ID NO: 4482 - DNA, 1335 bp, Glycine max
  Peptide Sequence Number=SeqID_121260
atgaaggtagagaagatgaacagagttaggcctcgtggctttcaaattctatgctcttctgagcattccagtttcaaagatgaagatgatgctgaaaatggaggaggtcaagtttcatcgcgggtgatacaggtggagagatatagcaatggtactgctaagaggtttttgctagactataccaaaatttgggcacaaaaatcaaatagtagtctctgtttgcttgttcatgggaaaattctagtagactcttgtactttttatcatcaccatttggccaatcatgcttcaactatccctcttgtgagcagatgtgtattaggtgatgatttgcagttgcaaacctttcttgttgaggaggatacgtctacgccaaaaaggttccaggattcatattcccctgatgaaagcctatcctggcttccagacacaatcaaagattttatcctaccagcaggctttcctggatcagtttcagatgattacttggattacatgttattacagttccctaccaatgtgactggatggatctgtcacaccctagtcacttcaagtctcctaaaggccgttggtattggctctttctctggaacctcagcaactgcttctgcttctgccatcaggtgggtctctaaggatggcattggagctgttggacgattatgccttggtgggcggtttggaagtctttttgatgacgatcctaagcaatggagaatgtatgcggacttcattggcagtgctggaagcattttttatctgacaacccaagtatatcctgactatttccttcctttggcatctcttggaaatcttaccaaggctgtagcgagaggactaaaagatccttctttttgtgtgattcaaaaccactttgcaatttcaggaaatctaggagaggtagccgcaaaggaagaaatttgggaagtggttgctcaactgattggccttgctttaggcatattgattctggatacacccagccttgtaaaatcatatggtgtactttcattaccttggttgggtatgcagtttctgcatctttggctacgctacaaatcactttcagttctccagtttaacacaataaatctaaagcgtgtgttacactctactgttccaggttacattcagacaaattcagtgctctgctgtatgatttatttcccttcacagatgttcaattttcaaaatggatttatttcaggatgcacatattgcaaccgagaagagaatatattaactaggtcgcaattcatgaagccaaaaataaattttggcttgcccttggagaaaatagatggcgtggagagatctcattttatggtatag

SEQ ID NO: 4483 - DNA, 357 bp, Glycine max
  Peptide Sequence Number=SeqID_121261
atgtcaggaaacaaacctagagagataaacataaagctgatatgcccctccctctcgaaggttactcaagtggtggcgtgggacgaccagagaatcgacttgggcttcgttgcgcgagcctttgggctagacccgtcgtcgctgaggctcaacagtcacttcatcggcagaggggtcgaccttgttgcctcttctgttacttggaagagtcttctttctttcttctcttccaaagggttgcccactggcaaagaccaacgtgacgctcttgttgtcactggcaagctatgcaaagttggactcaagctgaagcaattggagttgttgggagggaatgtttatttcacatgcgaatag

SEQ ID NO: 4484 - DNA, 750 bp, Glycine max
  Peptide Sequence Number=SeqID_121262
atgagagaagaacaacttaaagccatcaaagaagaagtcgacaaactcctcaatgcaaattttatcaaagaagtcaagtattctacctggctcaccaatgtcgtcatggtcaaaaaggccaacgacaaatggcgaatatgcaccaactacactgatctgaacagggtatatgtggatgacatggtcgtcaagtctcaaagcatagcccagcacgtggcagacccagaagaagtctttggggaactccgcaaatatgacacgcgcctcaatcctgaaaaaatgtacttttgggatgcgaagcctgatcaatatccaaaaagtctagaagctgaatggccaggagtaccactactcatgtatctctcaatagctgatgaagccattagctcaaccctcgtacaagaagaagggaagcaccagctccctatctatttcatcagtcgcatactcgatgatgccaagaagcgttatcaaatgatagaaaaggttttgaggaagcttgaactcgtaggaaggatagttgcatggtctgtagaaacttcagagtttgatattcactatgaaccttgcagccccatgaagacacaattcatggctgactttctagcagaattcgctggaaacgacaaaaccaccccagaccggaggaccctttacgttggcaacgggacaaggatcatcctcgaaggccctgacaatatcaccttagagcaagccctcaagcttaacttcagggcctcaaacaactag

SEQ ID NO: 4485 - DNA, 1107 bp, Glycine max
  Peptide Sequence Number=SeqID_121263
atgggttttaggtctctgttaaaggtgtcacctcgtggatctatgtcgaattcatccccaggcttgcttgatcctagaatgcttgccttgaccgaaggtggtcatcaagtccacatagcctctggtctctaccatctcacttgtaaagtcaaggaatggaccggcatgaggatggacaatgttgggggagatgtctctggaaaacaccatgaagtttggaataatgatggagacaaccacgaggtcgtcttggttgatggggttgatacccttgaagtccctatctgtaaagtgataggagggaaacttcgttgtagtgggtgggttcctattcttttgggggttgtcgcttatgccgttgttgctggtgtctttgtctacctcagtattccgctcttcttctatctgcttcgtggttcctatgctactcctcttggtgtcctccaagtcttgcttttgcttgtcggtcttggcacttccttcttgcttgtcgcacttttgtctagcttgtcaggcttcattcttgaatctggacatttcttccatctagatgagcatcgaatgcaatgctacctcgaggttaagattttggatttggacggttgtgcaccaaaatctatccatgaattttctgagagactctttgtctgcttgtcgcaggctggccaaggtcatgcgatgaaatctgttggtcgtgtacttcacattgaagcgttcaatgagggtgtcgaagttgtctatggacttagaggttcgtctgagtcaaaaaggcatccagatgctcatctgaatatgttgtcccatcgtaccgctcaagtcgacgaagagatgttgacgagtagtccgccttgcttgaagtgtaagcagagtgtttttcgccctggggacgtctggcatgaacctccaactgatcatggtcaacctttaactttctcagctccttctcatggcatcgctttatctccacaatgtgggaaaagtgtaagcagagtgtttttcgccctggggacgtctggcatgaacctccaactgatcatgctgccggatgaggatgtcttcgagaggagtctcatgtctgaggttagaccgagtgctaaccatggatga

SEQ ID NO: 4486 - DNA, 541 bp, Glycine max
  Peptide Sequence Number=SeqID_121264
ggtcaggagaccttggggacgtcaggtggggtgctattgcccaaaaccaagcttgaccaatcccgacccaacccgggcatagtcagtcactgtgaactttgtttgatatatgggatatggcctttggtaatcgattaccaagggcttaaaaacgagatcaggaagctaagagggcttctggtaatcgattaccaagggatcgtgatggtgacgcagctaatccatgatcgagtggagatggagtgcctagagggagcttgggagaccctcgaaggcaacatgagcgcactgtggagtggatactacccacgacttacaccatatcgtctagtggagccagtccaagtgatcgaggtgacgtcatccgaggaagaccctgaggaggatcccgaggagctacctcctgagcctgcggtggatgctcttgactttctagagggcgatgaggacccacttcctgaggtggattctcccgaggaagtcatgtcggcatctgaggcagactctacggaggatagtggaccgagagagatggcgacca

SEQ ID NO: 4487 - DNA, 791 bp, Glycine max
  Peptide Sequence Number=SeqID_121265
atggcagcgagttctagaggcttctccactacgcagtttgatttcaagctcagagtaacgcgactcaatgccgctctgcttcctaagagtcccgtgctcgaattaggtcccagaaagcgtagaaagctttgtttcgacgctgaccgagttcgactcggtaatggcgcaatacgctgttgctgttccgactcggttactccgattcgcagaacgagtggacctggcaaaggcggtgataagaacgaggaacggaggttcgacaccaaaaagccccctcacattcacagagtgagggttcaggcctcccctgccgcaatgcctttcgcttctccaccgtatgaaaaattctttcctcgttgcaccccaagaaattctggcccacagtcacgtgatacgccccccaaaagagacactggtatagcaaatgagaaggactggggtatcagcttgttaaacgaaaatgttaatgagtctggcactaatgaagatgggagtacctggtacagagaaagtggggaagaactgggtgaaaatggatataaatgtagatggacaagaatgggtggtcaatcgcatgatggctcctcagaatggaaagaaacgtggtgggagaagagtgactggactggatataaggagctaggtgtggagaaatctggtagaaattctgagggggatacttggtgggaaacatggcaggaaaatcttcatcaagatgaatggagtaacatagcaagaatagaaagaagtgcacaaaaacaagcaaaatcaggaactgaaaatgctggatg

SEQ ID NO: 4488 - DNA, 852 bp, Glycine max
  Peptide Sequence Number=SeqID_121266
atgctaaggttccattgctatgctaacagtgatgcacattacaagctaagggtaaggggaaggggaactaacctgttcgcggagaagaagaagaaagccttggcgcgcctcgcggagaagaagcttcacggagaagagaagaagcaggttccgggagaagaagaagctgttccgggagagaagaagctgtgttccgggacgggagagaagaagaatttgttgtctagcagagctgttccggaaatgatttgcgttttttataattttattttaaagggcaaaatggtactttcaatcaattgctgggtgcaccagcaatattgctgggtgcacctagcaactcccctggtccaaaaatacggcttcagaaaaagaaaaaagaaaaaaacccagcgagcagcaactctactttgtattgaggtgtcgcacggcgggtgtagtattagattcggcgtcgaagaaaaagaaagagcaatgcaagctgcgtcttcaggcatcggatacggtctaaaatatcaggctaggtgcatatcggatgttaaagcagacacagatcacactagcttcctcgctggcactctcagcctcaaagaagaaaatgaggtacatctgattcggctttcgtcgagtggaactgaactcttctgcgagggattgttctctcaccccaacgagatctgggaccttgtctcttgtccctttgatcaacggatcttttcaaccgtctactctaacggtgaaacgtatggggcagcaatatggcagatccccgagctatatggcgagttaaattcacctcagctagagagaattacctcacttgacacagattctggcaagattaaatggtga

SEQ ID NO: 4489 - DNA, 690 bp, Glycine max
  Peptide Sequence Number=SeqID_121267
atggctagagtgatggaggaaagttgggacgcaatatctggagttctcgaaattcagagcacttccatggatgcagcaattccagcaacaagtttcaaagtgcgtattattgttggttcagtagtgaggagtgatgcgataagctcaagtgattacacagccgaatcggtatttgatgatcacaacaagtggaggcttgaatcaacaaagaactgggtaattacagatgctgttgttgctgcgcgaattttgaatgctactcttgtagttccaaaattggatcaacgatctttctggaaagactctagtaacttctcagagatctttgatgttgattggtttatatcatttctgtcaaaagatgtcaaaattatcaagcaacttcctactaagggtagtaggaaagcattatctgcatacaatatgcgggttccaaggaagtgtaatgaaagatgttatataaatcgcatattacctgtactccttaaaaaacatgctgttcagctcagcaagtttgactacaggcttgcaaacaggttggatacggaatatcagaagctgagatgtagagttaattaccatgctttaagatttaccaacccaatacttgcaatgggtgaaaaattggtccatcggatgaggatgagaagcaagcattatattgcactgcacctgaggtacactgattga

SEQ ID NO: 4490 - DNA, 108 bp, Glycine max
  Peptide Sequence Number=SeqID_121268
atggcattgcgtgtgatgttggtttggggcagaggaattgatatgatagcgccttggcttggcgtgactggacgcaataacagaaatggagtgagagtgggtggataa

SEQ ID NO: 4491 - DNA, 634 bp, Glycine max
  Peptide Sequence Number=SeqID_121269
gtgggaaaagtatgatgctaaaggctggactgagaaaggggcacataagtacggtagactgaatgaacaatcatggtgggaaaagtggggagagcattatgatggaagaggatctgttctcaaatggacagataagtgggcagaaactgagcttggaacaaaatggggagacaagtgggaggagagattctttaaaggcataggttcaagacatggagaaacatggcacgtatctccaagcagtgaacgttggtcaagaacttggggagaagaacactttggaaatgggtatgtcttttattcaattcctcaaaatgctttcttgaaatgttgcgtttctattctatatgccgcatcgctaattggttttgcattcgtctgtaacaggaaagtccataagtatggaaatagcacaactggtgagagctgggatatagttgtagatgaggaaacttattatgaggccgaacctcattatggatgggcggatgttgtgggcgattcaagccaattactttcaattgagcctcgggagaggcctcctggtgtcttccctaatttagattttggttcacctccatcgcccgaggctcatgatgactcacttgaagaagatttgcccccatcacaatga

SEQ ID NO: 4492 - DNA, 2091 bp, Glycine max
  Peptide Sequence Number=SeqID_121270
atgttccttttaccaccacaactaacaacagccccattcccttccatatccatccacgtcactcacttccacttccccaccacccaccaccgccacaaccacaaccacaaccacaaccatgttctcccgccgccgcaatccaccgcaaaccccataaccgccaaaccaatcatcctcgaagaaggccccgacgacatcctctccttccacaaccgccgctacgacttcacccccctcctcaccttcctctccaacccatcgaccacttccgactcggactccaactcaacccctcccacctcactcggctcaaccgagttccaactcgccgagtcctaccgcgccgtcccggctccactctggcacgcgctcctcaagtccctctgctcctcctcctcctccatcgccctcgcatacgccgtcgtctcatggctccagaaacacaacctctgcttctcctacgagctcctctactccatcctcatcaacgccctcggtcgctccgaaaagctctacgaagccttcttgctctcccagcgtcaggtcctcacccctctcacctacaacgcgctcatcggcgcctgcgcccgaaacggcgacgtcgagaaagccctaaacctaatgtccaaaatgcgccgcgacggttaccaaccggacttcgtcaactacagctccatcattcagtacctcacgcgctccaacaaaatcgactctcccattctccagaaactctacaccgaaatcgagaccgataagatcgaaatcgacggccacctcatgaacgacatcattctagggttctccaaagccggtgatcctacacgcgccatgcggtttctagctatggctcagagcaacggactgaaccctaaaccctcgacgcttgtcgcggttatcttggcgcttgggaattcgggaaggacgcacgaggctgaagcgctgtttgaggagattagagagaacgggtcggaaccgagaactagggcttataatgctttgcttaaaggttacgtgaaaactggttcgcttaaggatgcggagtttgtggtctctgaaatggagaaggctggggttaagcctgatgagcaaacttatagtttgttgattgatgcatatgcgcacgcggggcggtgggagagtgcgaggattgtgttgaaggagatggaagcgagcaatgtggagcctaattcttatgtttatagtagaatcttggcgagttatcgcgacaaaggggagtggcagaaatcgtttcaggttctgaaggatatgaagagcaatggtgtgcagcctgataggcatttttacaatgtcatgattgatacgtttgggaagtataactgtctcgatcacgccatggctacattcgagaggatgttatcggaggggattcggcctgataccgttacttggaacacgctgatcaattgtcattgtaagtccgggcgccacaatatggccgaggagttgttcggcgaaatgcagcagaggggatactcgccttgcattactacttataacattatgattaactctatgggggagcagcagaggtgggagcaagtgagtttgtttttgagcaagatgcagagtcaggggttgctgcctaattcaattacttacacaactctggttgatgtgtatggaaagtcgggaagatttagcgatgcgatcgagtgcttggaggtcttgaagtctacggggttcaagccaacttcaaccatgtataatgctctgatcaatgcctatgcacaaaggggtttgtctgaactagcagtaaacgcattcaggttgatgacaactgagggtctgacacccagtctcttggctctcaattcattaattaatgcattcggtgaagacagaagggatgctgaagcctttgctgtgctgcagtatatgaaagaaaacaacattgaacctgatgtagttacttataccacccttatgaaagctttgattcgtgttgaaaagttccaaaaggttccagccgtgtatgaagaaatggtcacatctggatgcactcctgatagaaaagctagagcaatgctgcggtctgctcttagatacatgaagcagacactaaaatcatag

SEQ ID NO: 4493 - DNA, 1302 bp, Glycine max
  Peptide Sequence Number=SeqID_121271
atggctctttccatttttcaatttcttctgttctcaatcagcctctgcttcctcgcttcttcttttcaagatcttcttcttctctccgttaatgcgcaatcacacaatctcactcaaccttcagttacgccaatcaactacgatctctaccattccagtgacaatttgatggaggagatcagggccttggtccatcgtcacccggataaactcactacggagacaattaaagctggaaataaaggctatggtgcggaggttacagtggttacttattgcaaggaaaagaaaggcaatgatgagaggtcgaagcttagaattcttattagttttgggcagcatggaagagagctgattaccacagaacttgctttaaggattttgtctatcttaagtgaagaaaaaattctacccagcatggatcaagcttccttaaacagtgcacttgacaagcttgtcataaaggtagttccaatggaaaacttgaatggccgcaaagttgttgaagctggagatctatgtgagagaagaaatggtagaggagttgatctcaaccgaaattggagtgtagattggggaaaaaaggagaaggattatgatccatatgaggagaatcctggaattgctccattcagtgagcctgaaagtcaaattatgcggaaacttgccatatcttttgaaccacatctatgggtcaatgtgcattctggaatggaggctctttttatgccttacgatcataaaaattcaacaccagatggattgcctatgcaacggatgagatcattgcttgaagaagtaaaccaacttcattgccaagagcgctgcatgattgggtctggaggcggttctgtaggatattttgcacacgggacagcaactgatttcatgtatgacattgtgggggtacccatggctttcacctttgagatatatggagatggaacagcctcatcaagagattgcttcaaaatgttcaatcccatcgaccttgccacctacaatagagttctcagtgactggtcggcaacattctttacaattttcaaattggtgccgcagaagcttggtgattcaaaagcgtctattttgaagctagataagttagtatcgatagatgagtatctagatgggtatttgatggaaagaagaaatagatatggaaagaagatggagtgttattactgttcatgttctgttctagaatttcaaaaacttcattcaggcactgttggagcgtacatatccggcatgacacagacatactgccccaaagcacctgtcgtgaaggggttatgctag

SEQ ID NO: 4494 - DNA, 166 bp, Glycine max
  Peptide Sequence Number=SeqID_121272
atgatgggagatggtggtgtgatatcatctgctgctaccatgatggaagctccaccacctgatggaacaacaacaacttcaatggattttgattacatgggtgagcttttcttagatgggtgctggatggaggcctctgctgatggatctgatttcttgctgcaaa

SEQ ID NO: 4495 - DNA, 2298 bp, Glycine max
  Peptide Sequence Number=SeqID_121273
atggagaagctaataagggccctcatgtggatcaaagattacaataggagcaaagatatgctgatacagatttgggtgccagttcataaagagggtagtccgattcttgcagccgatgatcttctgttctcgcttgaatccaagtctctgaaccttgccaagtaccgcgaaatctctgtgacatataagttctctgcagaggagagtgactccaaggagttggcgtggggattgcccggtcgagtgtttagggacaaggttcctgagtggactcctgatgttagattctttaaaattgatgagtatccaagagttgaccatgctcaagagtatgatgtgcgtggaacgttggcagttccaatctttgagcaaggaagcaagacgtgcttgggggttattgaggttgtgatgactactcagcagattaactatggccctgaacttgagagtgtttgcaaagcacttgaggctgttgatcttagaagctcaaaacaattaagtattcagaatgtgaaggcatgcaacaggtcctatgaagctgcactacctgagattcatgaggtgctgagatctgcttgtgaaatgcacaaattacctttagctcaaacttgggtcccatgtgtccaacaaggcaaagaggggtgccggcactctgaagataattatctactctgcatatctcctgtggagcatgcttgctatgttggtgatccttctattaggtcatttcacgaggcttgcactgagcatcacttgttaaaaggtgagggtgttgctgggggagctttcatgacaaaccagccgtgcttctcagatgatataacttccttaagcaagaaagactatccaatgtctcatcacgcgaggttgtttggattgcgcgctgctgttgctatacgccttcgaagcatctataatagcacagatgactttgttctagagttcttcttgcccgtagattgcaatgacattgaagaacagagaaagatgcttacttcattgtccaacattatacaaagggtttgtcgcagcttgcgcgttataagagaaaaggaattggaggaagctaacttgtcagttaatgaagtgatagcccttgcagacagtggatttactagggatgaaatttgttcggaaccccaacaaaaagggatggttgcctcattggatactgaagaaaaatcaagtgaaacaatgggtagaaaattctctgaaccaaggcagcaacaagaaagtcctattttaaaaggaaaccttgactgtgttagggagtgttctacgtctgttgagggtaacttatcaagtccgggaacaagtaaaactggagagagaagacgggttaaagcagagaaaactataactttgcaagttcttagacaatattttgctggaagcctaaaagatgctgccaagaatattggtgtttgtactacaactttgaaaaggatctgccggcagcatgggataaagcgttggccttctcgaaagatcaaaaaggttggccactccttacaaaaacttcaacttgtcatcgactcggttcaaggtgcctctggtgcatttcaaatcaattccttctattcaaacttcccggatctagcttctccaaatttatcaggaactggcttcttctcaactttgaatcaaagtgataatccaaactcaacaagcacgcagcctgaacatggctcattgagcccagaaggtgcatcaaaatcaccctcttcgtcgagcagccagagttccatttcaagccattcctgctctagcatgtcagagctacaacagcagcacacaactaacattgccagtgacaaagatcctgccacggttggtgaatattctgctgatgttgtgttgaagttgatcagaaacgaggcaaagcttaaaagccttagtcaagatagagcaaagctcttgccaagatcactgagccaggaaacacttggtgaacacccgaaaactcagtatcaactgcctttattgaaaaccagtagcagcaaggtggattctcacagagtaaaagtcacatatggagatgagaaaacccggtttcggatgctgaaaaattgggtctatgaagatcttctgcaggaaattggtaggaaatttaatgtgagtgacatgagcaaatttgatgtcaaatacttggatgatgattgtgagtggatactactcacttgtgatgctgatttagaggagtgcattgatgtttgtcaatcttccgagagtggtaccatcaaacttagtctacaaccttctagtcatagtgtgagaagttctttagaatttagataa

SEQ ID NO: 4496 - DNA, 3783 bp, Glycine max
  Peptide Sequence Number=SeqID_121274
atgatttttgtggagtacgacatggtctatttcatcacgtggctcaggctatgtttattttactggcttgaatccgatttggaagtttttctaattttatctttggtagaagcagacgatttgtccacaaggcttctattgacttccaatacaaacacaacgggggaaaggcattccgaggattattgtgcaatgtatgacatttgtggaacgcgcagtgatggtaaagtagtgaactgcccacatggttccccggctgtgaagccagatgatttgctttcatcaaagatccaaagtttgtgtccaacaattactgggaacgtttgttgtacagaagctcagtttgaaacattaaggacgcaagtccaacaggttagcggtaattcgacagtgggcgggattgattattttgtaactgatgcttttggtgaagggttatatgaatcctgcaaggaggtaaagtttggcactatgaattctagagctctacaatttattggtgctggtgctcaaaattttaaagttttgaactgtagaaacataacaaatatattagctcttcagaattttagatgtgcattgcttgtaagcttgatgcttacactgggattgcttttggcagactggtttgcttttattggtagaaaagctgcccctcatggtcttggttcaccttatgcaattacattccggccaaatgcaaccgagtcatctgacatgaaacctatgaatgtttcaacttattcatgtggtgatatttctcttggctgttcttgcggtgactgtccttcgtcttcagtatgctctagttcagcttcaactaccaccaataagaaggattcctgctctgtgaaaattgggactttaatggtgaagtgtgttgacttgattttagcagtcttatacgttatactgatttgcgtgttcttgggttggggattgtatcatcggataagggaaagaaaaccgacatacagaacaaaatcaatgtctaatgtcattagtgatggtgcgctgtattctcatagtagggagaaggatgagaacgtccctatgcagattcatatgatggaagatgctcaacaaaacagaaatagagtccggctctcggctgtacaaggatatatgacaaatttttacaggaaatatggatcatatgtagctagacatccaattatggtgttggcttcatctctggctatagttcttctcctctgtctaggtctaatccaattcaaggttgagacacgacccgagaagctctgggtaggacctgggagtaaagcagcacaagagaaacagttttttgatactcatcttgctccattttacagaattgaacagctcattctggccactgtcccagataatgtgaatagtacatcaccaagaattgtgacagaggacaacattaggtttctgtttgaaatacagaaaaaggttgatgcaattcgtgctaattattctggcttgacggtatctctccaagatatctgtatgaagccactagacaaagattgtgccactcaaagtgtccttcagtacttcaaaatggatcccaaaaattttgatgattatgggggagtagagcatctcaattactgttttgaggcaaatcaaatggttgataaatgcattgagcattattcctcagcagaccgatgtatgagtgcatttaaagctcctctggatccaagcactgtattaggaggtttttctgggaatgattattctgaggcttctgcattcattgtaacatatccagtaaataatgctattaataaagaaggtaatggaaccagaaaagcagttgcttgggagaagacctttattcagttggtgaaggatgagctgttactgatggtacaatcaagaaatttgacactggctttttcatctgaaagctctgttgaggaagaattgaaaagagaaagtactgcagatgctattactatattggttagctatcttgtgatgtttgcttacatatctcttactttaggggataccctccatccttcgtctttctatatttcatctaaggtaatgcttggtctttctggagtaattcttgttatgctatctgtccttggatcagttggattttttagtgtgcttggtgtaaaatctactctgatcatcatggaagttatcccatttcttgtcctagctgttggggtggataatatgtgtatactagttcatgctgtaaaaagacaaaagctggagttgcctttagaaggaagaataagcaatgcacttgttgaagttggaccatcaataacattggccagtgtatcagaggttttagcatttgcagttgggagttttatttccatgcctgcaatccgtgtgttctccatgtttgctgcattggctgttcttttggacttcctcctgcaagttaccgcttttgtagctctgatagttcttgactctttacgggcagaggataagagagttgattgttttccatgtataaaagtgcatgcggaccctgatacaggaactggacgaagaaaacctggtttgttggctcgatacatgaaggaggttcatgctcccattctgagtatttggggagtaaaaatagttgtcatagctatttttgtgggatttgcattggctagcattgcattgagcactagaattgaacctggtttagagcaagaaattgttcttccccgagattcatatcttcagggttatttcaataatgtttcagaatatcttagaattggacctcctgtgtattttgttgtgaaaaactataactacagctcagaatcaacgcatacaaatcagctttgctccattagccattgcaattcagactctcttttaaatgagattgtgagagcagccctagtaccagacacaagttatattgccaagccagctgcctcgtggcttgatgattttcttgtgtgggtatctccagaagcatttgggtgttgcaggaagtttacaaatgggagttattgccctcctgatgatcagcctccttgctgtgcccctggggaaagctcttgtgtttcagtaggaacatgtaaagattgcacaacgtgttttcgtcactctgatctccataatgatcgtccatctacaacacaatttagggagaagctgccatggtttcttagttctcttccatctgcagattgtgcaaaaggtggtcatggagcttacaccagcagtgttgaactgaaaggctatgacaacggcattattcaagcatcgtcattccgtacttatcataccccactcaacaagcaggttgactacgttaattctatgagggctgctcgagagttcagttcaagagtttctgattctttgaagaagattgagatttttccatattcagtgttttatatgttttttgagcaataccttcatatatggaagactgcactgatcaaccttgctatagctattgggtttgatggccattctgaatatccagttgaatgcgctctcggtggtcaaccttgttatgtagcaagtggagacagagatcaacgtgctaaggaagctttgggtacaatgggtgcttcggtgttcagtggtatcacactaacaaagctggttggagttattgttctttgcttctcaaaaacagaagtgtttgtgatttattactttcggatgtacttgtcattggtacttcttggtttcttgcatggacttgttttcttgccggtgctattaagcgtctttggtccaccttcaagatgttcaatcattgagcaaggggaagatcgttcatcaacctcgtcatag

SEQ ID NO: 4497 - DNA, 624 bp, Glycine max
  Peptide Sequence Number=SeqID_121275
atggatttcctcttgcaggcagataacattccagaaagtggacgaagcactgcgtttggaattctttcgggaattgcgtctgccgcgtttgtgtgtggcaccttatcggctcgatttttatctactgccttgacttttcaagtttccacacttatcgcggtgattggagcactatacatgcaatttttccttcgagattcggccattgatgacaaacacctttatactccgatcattcacaagaaaatccaattatatctaaggtcaatggaaaactggaaagtaagaagcatcttttttaaagcattgcgctctatagaggacctgacttctttcctcaatagcagcttgactattactcaagcagcaattgttgcattcttcaatagccttgcagatgttggtcttcatggatcattgttgtattttttaaaggctcaatttcactttgataagaatcaatttgctgacttgatggtcatttctggaatagcaggaactgtgtcacagcttcttcttatgcctattttggctcctattttgggcgaggcaagactactctcagttggactattctttcattgtatacatatgttcctttacagcatagcatggtcctccttg

SEQ ID NO: 4498 - DNA, 249 bp, Glycine max
  Peptide Sequence Number=SeqID_121276
atgtggcgtcatatgaaggaaagaagcttgacaaacaaaggtaatcgaagcaagcaagaaataaaatcaattattggcacaaaattaattgtgcaaaagacatttgaaatgaaagaagattcaaaatctggtgaatggtcagatgccgtagaagtttggaaggctacacatatgagatctaatggaacttggtgcattccaaaaggagaaaaaatcatggtaaagaaaaaattcattttaaagtcttga

SEQ ID NO: 4499 - DNA, 438 bp, Glycine max
  Peptide Sequence Number=SeqID_121277
atgttggacatgctgaatgagatgctatttctcaaaggctacagaccacttattctatatttttccataccttgtccttggccccattacaaccatgtgtccgtcaagtgtttggaccacatcgcggccaaggttcttattgacaatggctcatcgctgaatgtcatgcccaaaagcatgttggacaaacttcctttcaacgcgtcacacctgaggtcgagctctatggtgctgcgagcttttgacgacagccgtcaagacataagaggggagattgatctcccaattcaaattggacctcacatctgtcaaatcactttccaagtgatggacatcaacccgacctatagctaccttttaggcagaccttggattcactcagtcggagtagtcccttcaacactccaccaaaggttgaaatttgtggtggaaggatag

SEQ ID NO: 4500 - DNA, 456 bp, Glycine max
  Peptide Sequence Number=SeqID_121278
atgaagatgaaagccaacaaaacaagaaatgaattgaaagtttgggattcgaaaacttaccaattgaagaacgaagaatgcacgaagaaaggacaaagaacagcgaagaacggcggaaaatattcacgaaattgctcacggaaacatcttggaagtgttatggaagcacctcagcttggattttcttcacggaaacacgttttttcacccaaaacagttgaaatgcatagcataggggccagggacactttgcaacaacccccccccccccgcctatttatagaaaaaatggggagaaggttgccgcccagctcgcacaggcgaacaggaattttacggaagccccaaaagccatttttcaacaaaacgggggaagagcttgccgcccagctcgcccagattctatggcgatgggtgttaagccttccgaagcgatcaacaatagttctcgaatga

SEQ ID NO: 4501 - DNA, 378 bp, Glycine max
  Peptide Sequence Number=SeqID_121279
atggcaccggaggacaaggaaaagacaacatttgtcaccctgtggggaatgttctgctgcaaggtgatgtcctttgggctcaagaatgctggggcaacttaccgacgggctatggtagcattattccatgatacgatgcacaaagaaattgaagtctacgcggatgacatgatttccatgtctaaaactgaggaggaacatctcgtcaacttgtggaagtcgggaaaattgctcggctttatcgtatgccagaaagggatagaggtggaccctgacaaggtaactgctacctgtgagcctctcttcaagcttttgtgcaagaatcagtccgtccaatggaacgacgactgccaagtggcgttcggaaggaccaactga

SEQ ID NO: 4502 - DNA, 522 bp, Glycine max
  Peptide Sequence Number=SeqID_121280
atgccagctggtctatgctattctgacccaggtatcacgcctctaagacacccagtggacccagaaaagtccaacaaagcactgggatttccagccttgatcacaggtcactgccagttctatggggtgccagttacacccacaaagctcatctgcccacccattaataggtcgttcattgagaagtactacatgccaaggcaggcacagcaaccgaggcaggaccagcagcagcagtcggccttagacgcaccaccacaacctctacagcagccaccatctctagagtccatctcggctcacatgcagagaatggagctctacatgcagcatttggctaaccaacaggcggccaaccataggggtcaggaccccaacccttacccatggcctactccagagcagtttgaggccactgttgcttggactagggacaggcataattttcaggcgggggcaggcctcacaaaggcccaggggatgaggacgaagcttaggaagagggtgacatggaagatatga

SEQ ID NO: 4503 - DNA, 585 bp, Glycine max
  Peptide Sequence Number=SeqID_121281
atgggaaggcgggtgcagatcatgcgcactagcatgaccatgttgacacaaatctggatgacgcttctccttagcaacatctttcccagtgaccataattctgatatcctgctacctaaatgccagctggtctatgctattctgacccaggtcagtgttcatgtagctcgacttatctcagatgccatttaccagtttgcaggtatcacgcctctaagacacccagtggacccagaaaagtccaacaaagcactgggatttccagccttgatcacaggtcactgccagttctatggggtgccagttacacccacaaagctcatctgcccacccattaataggtcgttcattgagaagtactacatgccaaggcaggcacagcaaccgaggcaggaccagcagcagcagtcggccttagacgcaccaccacaacctctacagcagccaccatctctagagtccatctcggctcacatgcagagaatggagctctacatgcagcatttggctaaccaacaggcggccaaccataggggtcaggtgcagttgaatgacaatttctaccagtataccctgcaccggtaa

SEQ ID NO: 4504 - DNA, 480 bp, Glycine max
  Peptide Sequence Number=SeqID_121282
atgaaggtcgatatggaggccttaaaggatcaagtggcttccatgatggaagccatgttgagcatgaagagaataatggaaagcaacacggtcgcaattgccgtcgccagtgccaccgtcgaggcagatcctacccattcgcatgccacaaaccaagcacaccaacccaccccggacatggtgggacaaggaggagaggtgttgggcagcaccggtggtccactcattgggtataataggaatgcttatccctatggcttaccccccaattatatgccgcccaccgtgcacatgcccaacgagaacgctaatcatgttgttcccgttacctttgagggtcagcaaccccagcctataggaggcgcccatgaagaacctcaggagcctgctcaaggtgatttcgacctatatcccacattcatcgccgaggggccgacgtttaatgttgtgcctcaacctaatatcacaggagctccttga

SEQ ID NO: 4505 - DNA, 602 bp, Glycine max
  Peptide Sequence Number=SeqID_121283
atggcgcctctacagcatgacagagcgcgcattgatgcgcaccgggcaatccgctgcggcaatcacgcatcggatgggggaaacagccacgctgcggcgctgaccctctcgctgactgctcgtcctgctaatctccctgttgctgattacgggcgcaggcagcatcggcattgtcatcaggcccgcactttgcaccaggaccttacacatcaaagaggcaacgacatgactatcgtaggaaactttatcggcggcaaaatcacgcacagcgccagcaacgaaaccattccggtctacgatccggcgaccggcaaagtgatccgcgaactgacgcaaagcacggcggcagaagtggcgcaggccattgaggtcgcccatgcggcgtttccggaatggtcaaaaacggcgccgctgcgtcgtgcccgcgtcatgttcaacttcaaagcgctgatggaaaaacatcgcgatgaactggcggcgctgattgtttctgagcacggtaaagtctggtccgatgcgctgggtgagctgacgcgcggcatcgaagtgatcgaatttgcctgcggcattccgcacctgatcaaaggggaaactcaccgaac

SEQ ID NO: 4506 - DNA, 952 bp, Glycine max
  Peptide Sequence Number=SeqID_121284
aagagacagtttcatcacacacagagccttctgtgatgctttggcacaagaaagtgcaagagaggcaccaaacctgagcagtgccattggcaaccaactgtatggaaacagcaacaacatgtccttaggcttatctcaaatcccttccatccatgaccaaaaccctcaacctagtgaactaatgcgtttaagtggtgcgccaagggctggtcaatttgaccacattctcccaccaaacattgcctcatcatcaccctttagaccttccatgcaaaccccaccattcttcatgcaagaaccaaaccaaacctaccatgactcaaacaagccattccaaggactaatacaattatctgacctaaacaacaacaatgccccttctggctccaactttttcaaccttccttttctatccaaccgtgccaacaagaacaacaactattctgaggaacaacaacaattcaacacggctgaagagtccaatttcttctcagaaagcaccatgaacattggcactgatcaccaagcaaactccaccaccactgccccttctctcttcagcactaattcccttcaaaacaccaacatttctcacatgtccgcaacagcactgcttcaaaaagctgctcaaatgggttcaacaagttcaagcaaccacaacatcatcaacaacaacaccaccaataacaaccctagtgcctcctctattcttagaagcttagcatcaaaatctgatcagaggcaactcggtggtggtgctggaaactatgcaacaatcttcaacaacagtgttcaggaaatgatggacatttcagggtttgaagcatatgatcatcatggtggcatgaacaaagaacaaaaactcggtgttggaggctctgataggctcacaagggactttctaggagttgcgcagcagcaacaacaacaacaacgagaagggtttaacttg

SEQ ID NO: 4507 - DNA, 513 bp, Glycine max
  Peptide Sequence Number=SeqID_121285
atggccaccgtcacttctgcagcagtttctattccctcattcactggcctcaaggcaagcgcaggcaaagtgagtgccgccgcagttaaagtctcagctccccaagccacaaggttctgcggcatcaaggcttccctcaaagacgttggagtcgctgttgtggccactgctgcgagcgcagttctagctagcaacgccatggccattgaagtgttactgggcactgatgacgggtctctggttttctctcccaactctttctccgtggcccctggggaaaagatcgtgttcaagaacaacgcaggtttcccccacaacgttgtgttcgacgaggacgagattcctagcggcgtggatgcagggaaaatctccatgagcgaagaagaccttctcaatgcggctggtgagacttacagcgttactttggatgccaagggaacctacagtttctactgttcgcctcaccaaggagctgagcctaattcatctttcttgttagggcctatgggatga

SEQ ID NO: 4508 - DNA, 576 bp, Glycine max
  Peptide Sequence Number=SeqID_121286
atggaaattgttctaaaggacgtttaccaccaccaccaatattgggcacacgaaacaaaacgtgaagacgaagaagaagaatggggcgaactacccccagaactactggaatcaatatcgaaaaccttaaccatctacggcgattacctccgattacgttcccaaaacccctctccatggctcatgctctctcgccgcgtcttcttcgacctctccgatcacgcatgggaggagtcgaatttggtgtataggacggtggggtttgaggttttcaagatgaattgggggtttctgacgtgtcagagagtcgagactttgggcgagcgactgttttttgttggggggaattcgtcgctttcgttctgtgcgtctgaattcgatgcgtgttcttcggattgcatctatttcaccgacgattattcggagtccaatgaagatgatgcgtgtgggaagcatgatttgggcgtatttagtttacgggataagagcattgaaccgttgccgtgttttgatcataattcctgttctcggcttggctggccgctatcaatttgggtttcgccaaatccctgttga

SEQ ID NO: 4509 - DNA, 201 bp, Glycine max
  Peptide Sequence Number=SeqID_121287
atgtcgattagagagcttcttcggctacttggagtgaaaaatgtagagttagatgagaacatgtctaaaagggggaaggtccctcatattataggctcaggagtgaaaaatgtagagttagatgagaaatggttacctaccagccaagcaggtctaggaatggtcgaggtgcacattcaattcccgaaatttgtgacctaa

SEQ ID NO: 4510 - DNA, 240 bp, Glycine max
  Peptide Sequence Number=SeqID_121288
atgagggaggagcttgcgacccagctcgcccaggcgagctcagcgcgcccaggcgaactaggtggcttcctccaaaagcaaccaccttctggaggaacatcatggaatgcccaagtgggcctggttgctattttcactgtagatgcaattggctttgatgttttgatgatgatcatgatgagattaaaattcaagacaatacttcaagattacaagtcacaacatcaagatgatcactag

SEQ ID NO: 4511 - DNA, 732 bp, Glycine max
  Peptide Sequence Number=SeqID_121289
atgatggacaatcaactgacacaagtaatgataattaccactcttgaagaatttgagtatctttccaatagtgatgatgaaggggacaccaattctaaaatcgaatatcctcaatacaatcctagaagttgttttggacaagtgcatttgaaggttgggatggagtttgatactatcaaaatgtttattaaagctgcaagaaactataccatttttcatggtagagatctgaaatgggtaaaagttgacaccattcgagctagagcacattgtaaacaaattgaatgtccatgggaaaaattttgttcatggtctgaagttataagaagctttcaaatcaagacttttttggaggagcacatatgtggaaaggtcttaaaaaataagcaagctacaatgaaatgggtggcaaaaaggggggctgataagcttagggttcatccaaacctaaatcatgttgaggcacatgaacatattagagaacattatggtgtgtatattgatgaaagaaagatgtttaaaactatcaaagaggctcgatcactggttgagggaaatgcatgcaagcaaggattcaaggctggttgtagaccttttattggtcttgatggttgttttctgaatgggtattatggcgatcatttgcttgcgccggtgggacaagatgggttgcttcctgcaatgcaggaagttatgccagatgttaaacacacgtattgtgccaagcactaa

SEQ ID NO: 4512 - DNA, 228 bp, Glycine max
  Peptide Sequence Number=SeqID_121290
atggcacataaccactatgtctataactctatggctgaaaaggaaggaaaattctcattcaccttagcacaccccaacttctaccagggaagagggagagaagacaggatgagagtactaacccggcaacctttgcaaccatgggatctgaatgcagaggattgtaatcaccagatagcctatagagcaatgcctgccaaaatgaagaacattcagaatctgtgttag

SEQ ID NO: 4513 - DNA, 285 bp, Glycine max
  Peptide Sequence Number=SeqID_121291
atgataacacgatcgaatctggttgaacagctgcgagagtatcagattcgatccaagcatgattgggcctctgtctcgttcttctcctccacttcttcaaacatcaccacttccaggacttgtatcttgttgggtataatattgaaattaggcggtggtgaaaagtggcttcaagtagttattagattcattggagtaggagaagattggtatgttatcaaaattgatgttgtcactatatactggagtagttgtctaggctctatggctaagttccaagtttaa

SEQ ID NO: 4514 - DNA, 1038 bp, Glycine max
  Peptide Sequence Number=SeqID_121292
atgggaaaactactagcactcttcccaatcatgtatttatcgggtggaacgtgtgtgacacttatcatgatcggagctggcacaatgaagatattctttcagatggtgtttggaacgccaagcccactcacaaccattgaatggtatttggtgtttacatgcacagccattttgcttgcccagttaccaaacctcaattcaatcgctggggtttccctcataggggccatcactgcagtgagttattgtgttcttatatgtatagtatctgtagtccaaggtagacttcatcatgtatcctatgagccacgaaggggacactcagagtcagaggctagcatgattcttagcgcgtggaatgcactaggcatcattgcttttgctttccgcggtcacaatcttgtgttggaaatacagggaaccatgccttcggatgctaagcaaccctcacgcttggccatgtggaaaggtgttatgtttgcttacatagtcatcgccttgtgtttgtttccccttgccattggaggttattgggcttatggaaatttaatacctaccaatggagggatgttaggtgctttgcaaaaataccacgaacatgatacatcaaaatttatcattgctttgataagcttgctagttgttataaacagcctcagttccttccaaatctatgcaatgccagtatttgacaatctggaattcagatacaccagcaagatgaacagaccttgcccgagatggctacgaatagctttcaggggtctctttgggtgcctagcattttttattgctgtagccttgccattcttaccaagtttggcaggtcttatagggggtgttgctctaccaataaccttagcatatccctgtttcatgtggatacagattaagaagccacaaaaatgtagcacaaactggtacattaactggacactaggcgttgttgggatgattctaagtgtactggttgtcataggagccatttggggaatagttgctcagggcatagagatccatttcttcaatccccggtag

SEQ ID NO: 4515 - DNA, 1609 bp, Glycine max
  Peptide Sequence Number=SeqID_121293
atgccgctcaagttggcgggagtagccactgtcggttcccttcttctatgtgttgctatttctctctttcacatcgctggggccgaagatccctaccgcttcttcaactggaatattacttatggtgatatttaccctcttggtgttcgccaaacgggaatattgatcaacgggcaattcccaggtccagatattcattctgttaccaacgacaacctcatcatcaatgtcttcaacagtttagatgagccttttctcctctcctggaatgggatccagcagagaaggaactcgttcgaagatggtgtttttggaacaacatgccccattccagcagggaagaatttcacttacatccttcaagtcaaagatcaaattgggaccttttactacttcccatcccttgcattccacaaagccgctggcggttttggaggcattagaatccttagcaggccaagaattccagtcccattccctgatccagctggtgattacactgtcctcattggagattggtacaagtccaaccacacgactttgaaagcccgtcttgataggggcaagaagctgccttttcccgatggaatccttatcaatggtcgcggacctaatggagtgtctttcaacgttgaacaaggaaagacttataggcttagaatatcaaacgtggggctgcaacactcccttaactttagaatccagaaccacaaaatgaagctggtagaagtggaaggaacgcacacccttcagaccatgtactcctctcttgacgttcatgtagggcaatcttattcggtgctggtaactgcagaccaacctgctcaagactattacattgtggtttccacacgattctcctacaaggtcctcaccaccactggagtgcttcgctatagcaactccgcaggcccagtatcaggcccaccccctggtggacctacaatccaaattgattggtctttgaaccaggcccgctcaattcggacaaaccttacagcaagtggaccgaggccaaacccgcaaggatcgtaccattacggtatgataaacacgacgaagacgatcatactggcgagttccgctggtcaagtaaatgggaaacaaagatacgcaattaacagcgtgtcttatgttgtcccagacacccctcttaagctcgccgattacttcaaaatctccggtgttttccgccccggaagcatatctgacagacccactggcggcggcatttaccttgacacatctgtgttacaagctgactacagaaattttgtcgagattgtcttccaaaacaacgagaacatcgttcagagctaccatcttgatggctactctttctttgtcgttggtatggatgggggacaatggacaactgctagcaggaaccagtacaatctccgagatgcagttgcacgttgcaccacacaggtataccccttttcatggactgctatttatattgcccttgacaatgtgggaatgtggaacttgaggtctgagttttgggcacgacaataccttgggcaacagttatatttgcgcgtttatacaacatcaacctcaatcagagacgagttccctgttccaaagaatgcaattctttgtg

SEQ ID NO: 4516 - DNA, 489 bp, Glycine max
  Peptide Sequence Number=SeqID_121294
atggaggaagtggtggaagtaaaggtgagtgctagaccgagagagactcagagctctctgcaggggatttcaactccatcagaggatggggtcaaaagcccatttgcaactcgttttctgagcacccctttagccagccccatgaagaaggccattgaaaacatgcaaggttacttgggagaagttggtcgcttcaccaagcttgacccacaagacgattggcttcccatcaccgagtcaaggaagggaaacgcatactacgctgcgtttcacgttctttcttcagggatcggatttcaggctcttgttcttccattagccttcaccactcttggctggacttggggagtcatatgtctctgtgtggcttttacatggcagctctacacgttgtggttactgattcagcttcacgaatcggactcagggttgcgccatagcaggtacctcagacttgctatggcagcattcgattggttaaatatataa

SEQ ID NO: 4517 - DNA, 2091 bp, Glycine max
  Peptide Sequence Number=SeqID_121295
atggccttcgccaccagcgccttggtttgttcaaacttgctcggaaggaaggttctagtcacaagcaaatcatccactccactaccatttcttttcaagagaagcatcttaaaagctcagaattcagagcaagtcaaatccgcatcttcacgggctgctctagctgcacttatcgtctcctccgcgagcctctctgtgaccccagaagccctagccgctgataacttgacccctccccccgtgattgaagcgcaacagagccaaccctcatcccctttctcacagaacctcctcctcactgcgcctaagccccaatcctcttccgacctccccgaaggcaccaattggcgctacagcgacttcttaaacgccgtcaagaagggtaaggtcgagcgagtcaggttcagcaaagacggttctgccctccaactaaccgcggttgacggccgtcgcgcctccgttattgtccccaatgacccggacctcatcgacatcctcgccatgaacggcgtcgacatttccgtcgcggaaggcgaatcccccaacagcttgttcaacatcgttggcaacttgctcttccccttgctcgcgttcgcgggtttgttcttcctcttccggagagctcaaggcgggcccggtgggcctggcgggatgggtgggcccatggactttggacggaacaagtccaagttccaggaagtccccgaaaccggtgtgagcttcgctgacgttgcgggcgcggaccaagcgaagcttgagctccaagaggttgttgatttcttgaagaatcccgataagtacaccgcgttgggcgcgaagattccgaaggggtgtcttttggtggggccaccgggaaccggaaagacccttctggcgagggcggtggcgggagaagctggggtgccgtttttctcgtgcgcggcttcggagttcgtggagcttttcgtgggggttggtgcttcgagggtgagggatttgtttgagaaggcgaaggggaaggcgccgtgcattgttttcattgatgagattgacgccgttgggaggcagagaggggcggggctaggaggtggaaatgatgagagggaacaaactattaatcagcttcttactgagatggatgggttttctggtaattctggtgttattgttttggctgccactaacagaccggatgttcttgattcggcgttgttgaggcctggccggttcgataggcaagttactgtggatagacctgatgttgccggcagagttaaaatccttcaggtgcattctagaggaaaagcgcttgcaaaggatgttgattttgaaaaaattgctaggagaacccctggattcactggggctgatctgcagaatttgatgaatgaggcggctattcttgcagccaggcgtgacctcaaggaaataagtaaagatgagatatctgatgcgcttgaaaggatcatagctggacccgagaagaaaaatgctgtagtctcagatgagaagaagaaattagtagcctatcatgaggctggccatgctctagtgggtgctttaatgcctgaatatgaccctgtagccaagatatcaattattcctcgtggccaagctggtggtctcacattttttgctcccagtgaagagaggcttgagtctggattgtacagtagaagttaccttgaaaatcagatggctgttgccttgggtggaagggttgccgaagaggttatttttggccaggaaaatgtcaccaccggagcatcaaatgacttcatgcaagtttcacgagtggcaaggcagatggttgagagatttggattcagcaaaaaaattggacaagttgccattggtggacctggtggaaatccattcttgggtcaacagatgtcatcgcaaaaggattactccatggcaactgcggatgtagtggatgcggaagtgagggaactggtagagagagcatattctagggcaacacatattatcacaactcacattgacatccttcacaagcttgctcaacttctcatagaaaaagaaactgtggatggtgaagagttcatgagtctattcattgatggaaaagctgaattatatgttgcataa

SEQ ID NO: 4518 - DNA, 1710 bp, Glycine max
  Peptide Sequence Number=SeqID_121296
atgggttctatcagaggggcggaagcctggttcgtcaagatcgcctacactgtttgcgttcgcgccaacttgctcgaccccttagtgggttatttcagtaatcacctaactccttcgctcgtttacgaggtcgtcgataagttaagcattattccccatttcggcttcaagttcgttgaattcagcagacacaagttgcacatgagtcactcttatttgacttatagtttgctcttgaggtcactctgccgatccaatcttcaccatacggcgaaagtggtgtacgattggatgaggtgtgatggccagattcctgataatcggttgttagggtttttggtttcttcttatgccattgtcggtaggttggatgtttctagggaattgctagctgatgttcagtgcaataatgttggagtcaatgctgttgtgtataatgacttgttcaatgttttgattaggcagaataaggtagttgatgctgttgttttgtttagggagcttatcagattgcggtataagcccgtgacctacacagtcaatattttaatccgagggttgtgcagggtcggagaaattgacgaggcttttaagcttctcaaggatttaaggagttttggttgtttgccggatgtaattacatataatactctcattcatggtttgtgtctgattaatgaggtggatagagctagaagtttgctaagggaagtttgcttgaatggggagtttgcacctgatgttgttagttacaccatgattatttcgggctattgtaagttgagaaagatggaggaggggagtttactttttgatgaaatgattaattctggaactgcacctaatacgttcacgtttaatgctcttattgatggctttggtaagttgggtgacatggcttctgcactagccttgtactcgaaaatgcttgttcaaggttgtctgcctgatgttgctactttcacttctctaattaatgggcattttcgagttaggcaggtgcaccaagcaatggatatgtggcataaaatgaatgaaaaaaatattggcgctagtttatatacatactctgttcttgtcagtggtctttgcaataataacagactacataaagctcgtgacattttgagactgttgaatgagagcgacattgttccacaaccatttatctataatcctgtcattgatggatattgcaaatctggcaatgttgatgaggctaataaaattgtagcagaaatggaggtgaataggtgcaagcctgataagttgacatttaccattcttattattggacattgtatgaaagggagaatgcctgaagcaattggtttctttgataagatgttggctgttggttgtgcaccagatgaaatcactgtaaataatttaagatcctgtcttttgaaggctggaatgcctggtgaagctgcccgcgttaaggaagttcttgctcagaacctgacattgggtactacatcatcaaagaaatcttatcatgaaaccacatattgctatggcaaagtgcaaaccagtggattgacacggcattccaccattatgcctcgagtacttggtgcaggtgtttccagcttgtggatcaatggcatgctatcatcggacagggtgtctcttgtttctggagattatcagtatttacatttgcattgccattccctccaagtttctgctgattatttttggacctga

SEQ ID NO: 4519 - DNA, 963 bp, Glycine max
  Peptide Sequence Number=SeqID_121297
gccgaggagaaattgcgcatgcttcatcagaaaaagtgtaagcagttgagacgtatgaaacaaaaggatgccaatgcacagaaaattgattctgttcaaacttttgttgggattttatctacaaaaatgaaaatttctatacaagtagttgacaagatatccattacaattagtaagttgagggaagaggagctgtggccgcagatcaacagattttttctcaagtttctcggaatgtggaaagacatgcaagaatgttacaaatgccaataccagcaaattgttgaagccaaaactttagatgcctcatcgttaaacacaaagcctggcaatgctcatattgatgcaacaataaaactcaaatctgaggtacagaaatggaatttgagcttcttagattggattcacgcccagaagtctcatgtgaaagccttgaatggttggctagtaagatgtctattatacgaacccgaagaagtacccgatgattcaactcccttctcacctagcaagattggggcaccacctgtgtttgtgatctgtcacaaatggtcgcaggcagtggataatctctcagagaagaatataatcgaagccgtaaatgggttcatgctaagagtgaatgagctctgggaaaagtatattttagaccttcaacaaaaactaacattggacaaagaatttgagagaaaggtaaaaatgttggagagggaagagcaaaagatgcacaaagtgatgcgggctcatgagaaaaagatggttacagttggcagagaagaatctgatgcactgttacgtggagatgctgtgcaccatgctgatgtcgttgacactactaacctacaatcaggtttgaagcagatctttggtgccatggagaagttcactgactccactgttcgcttatatgaagaactttgccaacaaattaagcaagaggagaaaccaacaaaaattaactag

SEQ ID NO: 4520 - DNA, 327 bp, Glycine max
  Peptide Sequence Number=SeqID_121298
atgcaaagaaccctctataaccacagttcgattgcagaaaatctcctgtggtggttttatgcacttgcagtggttaaattcactctactctgcaagacttgttggtacacttttacatttgacaaggtatttaatcatggggcttctcaacaagatgcttttattgagatatcacaactggtacaaagtgcgcttcatgggtacaagttatttgaagacaaactggctccatggcaattggaaccaaagtgtggccctctatcaaagcctagcaagcttaactgcggagctagcattggggtggtttctttgatgctctgcttttag

SEQ ID NO: 4521 - DNA, 369 bp, Glycine max
  Peptide Sequence Number=SeqID_121299
atgaatgaaggagtgagtaaggaatcgagatcgatggtggataatggcctcgagaatctaggattgatcatgacgattagggagggctataacaatggtggggacatagaaaagtatttgaatcatgttatagtagttgaggtggatgttgatgctagttattcagagagagggtcagtggagtgccatgtcgatatggtagtcccaacatattggcctggttccaatacaaaatattttaggcaagtgtttgagttcatcaaattgttggaatcctcacacgtggatggaaacaaagtggcgcttagccttattcaaaggaaaacttacggaagcaaagtggcgcttagccgtataggtcaagcttag

SEQ ID NO: 4522 - DNA, 261 bp, Glycine max
  Peptide Sequence Number=SeqID_121300
atggccatggctttcccacctgccaaattcagtgccggtaaatgtaaagccctacagttaagcttagctcatcagtgggctaagcgcgcatccaccgctaagcgcaacttcagcgcgcttagcgcgacaaaagaatctagcagggcatcagcatcatggccccgcgctaagcgcgagatcagtgcactaagcacagtagatgtcttcagccaggctcagcgcacgactggcgctaagcccgaatccacttactcacactaa

SEQ ID NO: 4523 - DNA, 633 bp, Glycine max
  Peptide Sequence Number=SeqID_121301
atgggcttgggccgcggcccgatctccttcacctctcaactcgcccgcaaactcagcaacacaaagaccacaaacaccttctcttactgtcttctcgactacaccctctcccctccccctactagctacctcaccattggccccacccctaacgacgtcgtttcgcgaaactcattcacttacactccgttactcactaaccctttctctccttccttttactacatttctattcagagtgtttctgttgacggcgttaggttaccgataagtctttctcgccgagcggcttacgggaagatcctcgcggcgttccggcggcgcgtgaggcttccggcggtggagagcgctgccgcgctggggttcgacctttgtgttaatgtttccggcgtggcgaggccgaagctgccgcggctgagattccggctcgccgggaaagcggttctgtcgccgccggtgggtaattattttattgaaccggcggagggagttaagtgtcttgcggttcagccggttcgaccggattcggggttttcggtgattgggaatctgatgcagcaggggtacttgtttgagttcgatttggaccggtcgcggatcgggttcacgcgtcacggatgcgcggttcgttga

SEQ ID NO: 4524 - DNA, 444 bp, Glycine max
  Peptide Sequence Number=SeqID_121302
atgtcttcacacccctctctcttttccctctccttcttcctccttctctccctcccacaacattccttctcctcaacagaggagtatctcaaattacccttactccctcgcacccccctcccctccccctcccacctcctcgccgccgacctccgccgcctctccgccaactcccccctcacctccggcgcccccaccggctccggccagtacttcgcctccctccgcctcggctcccctccccagcgcctcctcctcgtcgccgacaccggcagcgacctaatctgggtcaaatgctccggctgccgccgcaactgctcttccaccgccttcctcccccgccactccgcctccttctccccccatcactgctacgactcaccgtgccaactcgtcccccaccccccgagtcccagaaatcatctctgcaacaatcacacctga

SEQ ID NO: 4525 - DNA, 1677 bp, Glycine max
  Peptide Sequence Number=SeqID_121303
atggttggtcttataatacgtactaatgtcgatcatgaggctcttggcttcatggatgatcttactcatgttgatgctgaccatgaggctcttggcttcacaaacagtcttactcatggtgatgctggccatgaggattttggcttcatggatagtcttactcatgtttaccaacataaagaagatgacttgggtgtcgaagcattgattgttgaagaacaccataagttgaaatgtttcttctctgtatctgcatctaatgatcttcccaacctggaggttttgatcataaaaggagccgctgaattagaagagcttatagaatatgaacaaggaaaaggtgatgagataggaaaggtcaaaattgagcttccaaaactgaaactcttactgtttacttgccttttaaatcttggtcaaaggattgaattactgactgtaaagcacccctttgtccacaattgtccaaaactctatttgacttcaacagttgatattcatgatcaggagttctgtgatattgtttgtaatgaattcaaagatttcgaaaactttccatggtgggaattatatggcttaattaatccaatcatatcatcaattcgagcttctacaataagcggtaccggagagttgctttcatcacaggcattgttcagattcatgaaaaatgagagaaggaatttattgggaatgttcctagttcaaaggagttggtggacggacaatcaactagtggatcatatttttcaaacaaacaaaagccacttggaaaaactgaaagtacctttggaattcctcaggcaatcagtttggacgtttccaatgcatccttgtctagaattcttcgcaaaggtgacacctcttgttctaagttctattagtgattttgggatcctccagcattttatggtaccggtgaagcctccaaagcctgagcaacagcagaaggagcaggatcccacgccagaaaacacttctccatttcaaatgaacacagaagatccttcaacatccaaaagtaaaccatcttcttcacaagtaaatgataaaaatcaatctgtactgcgaagcatagctgaaatgatccaccaacataagcaaattgtaaggggagcaccagtgtctgaaccagatgagttccatcaactaaatagagaaagtgaaaggacatcacaattacaatcatcggagaaaaaaatgtcacatatttcttccccaaacatgacagagaatatggaggaaataggaaaagaaagcattcaagaggagcctgtgtcagaggaaactactgtaaaaacttcatcatctggtgtagatagcattaccttgagtagtggtgtggcaactcacaacgagtccagtggcagggacatacttgcaaaagattcccaggttgttgaacaagatgataagctgaacgaaagcaagacaagaataacaccatgtaaaatgatcaaaatccaagaagggtggaacttgatggataaaaaagagggaatatacattgttcttccagtctttcaagaaggtgaagcgggtgtgggagaagggagggtagagagagaatcgaggcaacaacaacgtacttcatttcaaacctccatccatgctcctaagaagataagtcaaaattgtaagaaagagttgaagaacagcttcattatctatagataa

SEQ ID NO: 4526 - DNA, 543 bp, Glycine max
  Peptide Sequence Number=SeqID_121304
gctgttacttcctggtatttttggcctcctggtattatagaaagccggaatgtttttattaccttctggattggattggacattctgaaagctaaaaaagggatacttttccggaatgtaattttatattttggattgactattctgaaagctataacagaggggcacccagcagcattgctggtgcacccagcaaatttccaaaatggcaaaaatgcccttcagcctttttgtcaaacttcttccgttgacacttgcggaagaagaactgcggaagaaccttcttccgtggaactacacggaagaacttcttccgcaagagtcaacggaagaaggttcttccgtgggttaccacagaagaagtcacacacttcttcctctctccatttctctaactctgaccatgcaattggcgttggtctcattgcattctctgtgaaaatgacaaacaaggccaaaggaaaaggcaaggaggttgccggaaaaggttctactggcaagtgcaagggtgccttcgacgatgacaagaccgatggcggctga

SEQ ID NO: 4527 - DNA, 1110 bp, Glycine max
  Peptide Sequence Number=SeqID_121305
gaattagaagatcaaggccagtgttcctctccaccaatcatcaacaacaacattcaaagctaccaagaacaccttcttcttcaacaacagatgcaacaaaacagtgacatctttggtggtggtggtggttcaaaagggctaatgttcccacctgaagtagtctcttcaatcttacaacaacaaccatggtccattcctccagttccctccttcaatcccaacccggttcactacaacaacacaaacccggttcatcatcatgagcaagcatcatcatttcttgtccctcctcccacaacaacaccttcaccctatgcaagcttcttcagcagcagaagggttgtcccttctcttcattttgcatacgagggtccctcttctcatcatgatcaccaccatttgaggatcatatctgacacccttggacccatggttcaacccggttcagcagcaccctttggactccaagccgagctgggaaggatgactgctcaagaaatcatggaggctaaggctcttgctgcttccaagagtcacagtgaagctgaaagaagacgcagagagagaatcaacaaccatcttgccaagcttcgcagtttgcttcctaacactaccaaaacagataaagcttcattattagcagaagtgattcagcaagtgaaggagctgaagcgccaaacctcactcatagtagaaatgagtacagtgcccaccgaatcagacgagttaacggtggacgcaatcgacgaagacggaaagttcgtgatcaaagcctcactgtgctgcgaagataggtcagatctcttacctgacctaatcaagacgctaaaagcattgagactaagaacccttagggccgaaatcacttcactcggtggacgtgtgaagaacgtgttagtcataaccggtgatgaagaagaaaattcgaacaccaacaatggagaacaaagcatgcaacaacaatattgtattagctcaatacaagaagcacttaaggcagtgatggagaagagtggtggtggggatgaatcagcttctgggaatgttaagcgccaaaggacgactactactaataataaaatcaatatccttgaacaaagctctttatga

SEQ ID NO: 4528 - DNA, 222 bp, Glycine max
  Peptide Sequence Number=SeqID_121306
atgtttcaggccaaagaagagaatgttaaagttgttgatgactcgcttaacgagacaaattggccaagcaagatgcatctgcttagcgaggcatttatctcgcttagtggatgggaagccctagaagaagataagtcagagatctgcatgcccaacgtgcagtcagcccacccagtgaggacattgtctcttttcgcgctcagcgcacctattctcatttag

SEQ ID NO: 4529 - DNA, 2019 bp, Glycine max
  Peptide Sequence Number=SeqID_121307
atggaagaggaagaggatcaattctatgagactcgtgaggaattgtgttctgtctctgatgtgggttcggattgttctgaatcagatgaatctagttctggtaataacggacatgttactaggtaccagggagaagagttgggagatcaaccttgtgggattgaccgaatcactgcaacaagtggggcagtgctgagaacttcttttgctgttgaggagggtcttccctcaacctcaaaccagattgtgttggattccttgtctgatgaggcctccggctcacaagaaaattgcgaaaatttggcatgtatgataaggaatttggatgatggaacacaatatattgtggataagctgggtcaggatggagctcctagcacactgcgggttttgggttcgaaccaattgattagtttagaggagtttcagagaaatattgggccatcatcgtttgttcgcagacatttgcagagagacactgaaaacacaaggttgttgcgagttgggaaaaggaaaatgaagaggggttggctaaggaaactggattctattgcttgttttgttcataatcatgggcttgatgaaactaaatacaaagactgtgattcagtggatagaagtggggtacaaagagttcgagttcattcatataggaagcgggttaaggagctttcctccctttacactgaacaggagtttaaagcacataagggtgttattttgacaatgaagttcagtcttgatggaaaatatctggctagtggtggtgaggatggtatggtacgtgtgtggaaagtggttgaggatgagagatcaaataaagagaagttagttaaaacagagaagttgaggagatcctctgaagcaacctgtgtgattgtcccaccaaagaccttccgcatatcatcaaaacctttgcatgagttccaagggcacagtggtgacattttagaccttgcttggtccaaaagagggtttctactgtcatcctctgttgataagaccgtgcgcctatggcatgtaggaatcgacagatgtcttagagttttctcccacaataattatggtgagcttctattgccttggttgataagtgatttcgataatgttgttacatgtgtcaatttcaatcccgtcaatgataattttttcatcagtggttcaattgatggaaaagtacgcatatgggaagttgttcactgtagggttagtgattacattgatatcagagagatagtcacagcagtgtgcttccgtcctgatggaaagggcacaattgtgggtaccatggcaagcaattgccgtttctatgatatcgtagataatcatctgcaattggatgttcagttgtgtttacgaggcaaaaagaagacatcagggaaaaagatcactggctttcagttttcacctagtgatccaagcaaactattggttgcttctgctgattcacatgtctgtatactttcgggagttgatgtaatctacaaattcaagggtctaagaagtgcaggtcaaatgcatgcttcattcaccactgacgggaaacatatcatctcagttagcgaggattcacatgtatgtatctggaattacaccggccaagataggagtacctccaaagcaaagaaaatttggtcttcagagagttttctctcccacaatgcagccattgctgtaccttggtgtggcattgagtcaatgccaggaacactcttatccccatcgctaggagaggatgtgaatcagaagtgttctctgccttctcctgattgtttcttcttgagtcgtggatttctgtcagagttgatcccaaaggtttctgcgacatggccggaggagacgcttgtggactcatcatgccaaactcaaactgttgtttctcctacaatgtgtaaatcagagtacaagtttttgagaagtgcttgcaagggaatgtctaattcccacttgtggggccaagtaattgtgacagcaggatgggatggatacataagagtgtaccagaattatggattaccc

SEQ ID NO: 4530 - DNA, 159 bp, Glycine max
  Peptide Sequence Number=SeqID_121308
atgtatatcatatcatataccagatttacttctaagggagtgaaactttttacaaaatctggtgaaggaattatgggtcgtcgtaagattgaaatggcagaggtgaaggattccagcgcaaaacaagtcacattttccttttgggcacccaagtgttga

SEQ ID NO: 4531 - DNA, 1851 bp, Glycine max
  Peptide Sequence Number=SeqID_121309
atgggcaaggatggatcaccaaaacattatggtcagtttgattcaaagagaaatcgtctgacatggattttaggagttagtgggctatgcattctatcttacataatgggtgcatggaagaacactccgtcacccaatagccaatctgagatcctctcaaaagtggattgtaatgttgggtcaactacatcaggcatgtcatcttcagcaactaatttaaattttgaaagtcaccatcaaattgacgtcaatgattctggaggggcacaagagttcccaccatgtgacatgtcgtttagtgaatacactccgtgccaagatcccgttagaggtcgcaaatttgaccgaaacatgttgaagtatagggagagacattgccccgccaaggaggaactactaaactgcctcatacctgctccaccaaaatacaagacaccttttaaatggcctcaaagcagagattatgcttggtacgacaatattccacacaaagagcttagcattgagaaagctattcaaaactggattcaagttgaaggtgacagattcaggttccctggaggaggtacaatgtttccacgtggagctgatgcatacattgacgacattaatgagcttattcccctcacaagtggtactatcagaactgcaattgatactggctgtggtgttgcaagttggggtgcttaccttttgaaaagagacatcatagctatgtcctttgcaccaagagatacacatgaagcacaggtccagtttgcattggaaagaggagttccagcaatgattggcatcatggcttcacagaggattccatacccagcaagggcgtttgatatggctcattgttctcgctgcttgataccttggcacaaatttgtggatagagttctgaggccaggtggctattggattctctctggcccacctattagatggaagaaatactggagggggtgggaaaggaccgaagaggatttgaagcaagagcaagatgctattgaggaagtggccaaacgcatatgttggacaaaagtagttgagaaggatgacctctccatttggcaaaagcctaaaaaccacgttggatgtgcacaaactaaacagatttacaaaacaccacacatgtgtcaatccgacaatcctgacatggcttggtaccaaaatatggaaaagtgcataactccattgccagaagttaacagcgcagacaaaatggcaggaggggcactagaaaaatggcctaaacgagcatttgcggtccctcctcgaattagtagtggttcaataccaagcattgatacggagaaatttcaaaaggacaatgaagtatggagggaaaggatagcacattacaagcatctcgttcctctttcccaagggagatatagaaacgtcatggacatgaatgcttatcttggtggatttgcagcagccttaataaaatttccagtatgggttatgaatgttgttcccccaaattcagaccatgacactcttggtgcaatttatgaacgaggttttattggaacttaccatgattggtgtgaagctttctcaacttatccaagaacatatgatctcatccatgctagtaatgtatttggcatatatcaggataggtgcaacattactcagatactactggagatggatagaattttgaggccagaaggtactgttatattcagagagacagtggagcttctggtgaagattaaaagcattactgatggaatgaaatggaaaagcaatataatagatcatgaaagcgggcccttcaaccctgaaaagattcttgttgctgaaaaagcttactggactggcgaagctaaagagaaacaaaactaa

SEQ ID NO: 4532 - DNA, 1428 bp, Glycine max
  Peptide Sequence Number=SeqID_121310
atgttggaaagtggtgcgaaattcccaggaataatagatctcaacaaaaataataacaactactatgatttctctcaaggcttttaccataagcttggggagggtaccaatatgtcaattgacagtgttgggagcttgcagacaagtaacggcggaggatctgttgcgatgtctatcgataatagcagtgtcgggtccaatgattcccatactcgcatgttagaccaccaagggttgcggaggcgtgccaatgataactactctgttgcacatagtgccaatcgtcggggaagagtcacccatgctttgagtgatgatgctttagctcaagctctaatggacaatagttctccgactgaagggcttgacaattttgatgagtggacaattgatttgaggaaactgaatatgggtgagccttttgctcaaggagcttttgggaaactttaccgaggtacttacaatggtgaagatgttgcaatcaaaatcttggagaggcctgaaaatgatccagcaaaggctcaattgatggaacaacagttccagcaggaggtcacaatgttggccacactaaagcattctaacatagttcgtttcattggtgcatgccgcaagccaatggtatggtgcattgtaactgagtatgccaaaggtggttcagttcgacaatttttaatgaagcgtcaaaaccgctcagttcccctcaaattggctgtcaaacaagctttggatgttgcaagggggatggcttatgttcatggccttggatttatccacagggacttgaaatctgataatcttttgatttttggtgacaagtcaattaaaattgctgactttggagttgcccgtattgaggtgcaaactgaaggaatgacacctgagactggaacataccgttggatggctccggcgagccctggtgcagcggtaaagttgtgccttggtgacttgttggtcatgggttcgaatccggaaacagcctctttgcatatgcaaggggagatgatccagcataggccttacacacaaaaagtggatgtatatagctttgggattgttctatgggaactcatcactggtatgcttccatttcagaacatgacagcagtacaggccgcatttgcagttgtcaacagaaatgttcgcccaatcatacctaacgattgcctagcggttctccgtgacatcatgacaagatgctgggatcccaaccctgatgtcaggccaccatttgctgaaattgtaggaatgcttgagaatgcagagaatgagatcatgacaacagttcggaaggctcggttcaggcaacataaaatgagatcatgggcgaaaacttttgctttgtatgtacgcttgcttgcaccaaaactcacaactaccccggggattgacatactgccaggtttggttcaacgtggggcttaa

SEQ ID NO: 4533 - DNA, 3843 bp, Glycine max
  Peptide Sequence Number=SeqID_121311
aacttgtctctgctattactggcgttggtgtttctgccactgaagcttgtgatcagcgggaaccaatgcacggataaatgtggaggggttagtattcaatttccattttatctcagaaacagcaagctaaatcacaccgccgaatatccccctgggttcgatctgctatgtacggaaaacaagaagacgttgatacttgagctgcctaatgttccaacaaaattggcagtcagaaaaattgattacaaatctcagcagattcaaatctacgaccctgcaaattgccttccctctcagctattgcaactcagcagcgcatcaatttctccattccaattcccctcatatgattatgctttcaagactaggcgtaacttttccttcttccgttgcgattcaatgtcgtcgtcgtgtcctattttgttactttcttcttacctggacgttattagattccctgaaatactatcctgcaccaaggtgaaagatgttttgtctgccaactggatggatcaatattcgctttatgacccgaccgtgactatagaatggtcgaaacctgactgcaaacactgtgaaacacaaaaccagaaatgtaaatggaagaatagtaccaaagttgaaactgaatgtttcgtttgctcaacaaacacgactcccacatcaactattgtactcattgctgcaggaggaatagttggtttgatgcttttggtacttacggtcacttgcattgtttgtgtgtatcactattatgagaagaaaggagaagatcaagctagaatagagaaattcttggaggattatagggcaatgaagcccacgagattcacttatgctgacattaagagaatcacaaatgggtttagtgaaagcttaggggaaggagctcacggagtagtgttcaaaggaatgctctctcgagaaattctggttgctgtgaagatactcaacgacacagtgggagatgggaaggatttcataaatgaagtgggaaccatagggaaaattcatcacgttaacgttgttcgcttgcttggattttgtgcggatgggttccatcgcgcactcgtttatgatttcttcccaaacgggtcactacagagattcttggctccaccagacaagaaggatgcttttcttggctgggagaagttgcaacaaattgctcttggtgttgccagaggaattgagtatctccatcttggttgtgatcatagaatacttcactttgacatcaatcctcacaatgttttgctggatgacaacttggtcccaaaaatcactgactttggactttccaaattgtgtcccaaaaatcaaagcacagtgtcaatgactgcagccaggggaactttgggctacattgcccctgaagttttctcaaggaactttggtaacgtgtcttacaagtctgacatctacagttatggaatgttactgctagaaatggttggaggaagaaagaatatagatgctgaggaaagttttcaagttttgtaccctgaatggatccataatttgcttgaaggtagagacgtgcaaattagtgttgaggatgagggagatgttgaaattgcaaagaaactcgccattgtaggactttggtgcattcagtggaatccagtgaaccgtccatcgatgaaaacggtggtacaaatgcttgaaggggttggagatgaattaattgcaccccctactccttttgacatctctggatcttctagaacaaatgatgatgttccaacaagtcgtcagaatttcaagggagaagaaattcccacaaatctgtcagagaaggagaagaaggatttgctcaacaaagcgcatagtgcactgatcctatctatgggtgataaggttatgagagaaatctcaaaggaaaagactgctgctactatttggttaaagttggaaaacctgtatatgaccaaatctttggtcaacaggttgttcttgaagcaaaagttgtataccttgaaaatgccatcaggaaaggcattggaagatcacttgaatgatttcaataagatcttcttaatctggaaaaaaattgaaatcaagcttggtgatgaagatcatgcattgttgttactcaagtcattgccaagtgaatttgatagcctctcggacacactcatatggcagggactcactgtcattggagaaagtttagactactttattctcaaaggaattaaagaggaagtttcagggaagagatccaagtcaaaggagggcaagaagaggaaatgcttcagctgtgggagtgaggaacatctcaagaaggagtgccatgaatataaaaagaaaaagagacatggagatcagaggagtcacaatggtgatgctgctgttgtctcagaagggtatgaaagtgatgaggttatgcgtgtttcagaggtgtcaatcaaaccagaatgggttcttgattcaggatgcacatttcaatgtgtcctaacatggattggttcagctcatatgaggaaagccatggagggcaggaaatattctatagctgtcaacaattttggaggtcatttgccaaattctttgggcaatttatcaacccaacttagtcaactatatcttgggaataatcagatgttcggaaaaattccttccgaaataggaaatctagttaacttatttgtcttgagcatactctataaccattttgaagggattattcctagtgcttttgggaaacttcagaagatgcaagcattagaattgagtggaaacaagctttcaggagttataccaacctccataggacacttcagtcgattgttttatctgggtttgggagaaaatatgttagaaggaaatattcttccaagtataggaacctgccaaaagttgcaatacttaaacctttcacataacaaccttagaggagccatacccttagagatatttaatctttcatctctgactgatgcgttggcagtgtcacaaaactcattgagtggtagtattccaaaagaagtgggtaagctaaagcatattgatttactagatgtttctgagaatcatcagtctggtgacattcctggaactataggagaatgtttaatgttacctctatttgcaaggaatcattccatcctctttggcatcactccaaggtcttcaacgtttagacctgtcccaaaaccacctgtgccaaccgaaggtgtctttcgaaatttggttcaaattttaacatgttccagtacagattacaacgaacatccaagaacattgaatcttgatcaaagattaaatatcatcattgatgttgcttctgctttacattatcttcatcatgaatgtgagcaaccaatcattcattgtgatctaaagccgagcaatgtccttcttgacgatgacatggttgctcatgtgaatgattttggcatagcaagacttctctcaactattaatggtactccttcaaagcaaacaagtacaattggaataaagggaacagttgggaacaagtatgaaatgggttctgatgtgtctataaatggcgacatgtatagctttgggattcttgtgttggaaatgcttactggaagaaaactcacggatgaaatctttgaagatggtcaaaatttgcataactttgtggaaaattcatttcctgataatattttacagattttggacccatcacttgtaccaaatcatggagaagcaaaatttgaagaagaaaacggtgttgaaacacgtgaagaattcaagtcagcggctgagatggacacaaggaataaaagtgaacacttcagcactgctgacatgaaaaaaggaattataacatttaggatagatgatagaattgaaatcaagaaatga

SEQ ID NO: 4534 - DNA, 1548 bp, Glycine max
  Peptide Sequence Number=SeqID_121312
atgatcatcgttatgttcaccgtcgtcaccattaacataatctccgcccttaccagtgatggtagtggtgacaacgatgaaaatcatgttggtggcgataacaatgatcatgaaggcaattacaatggtgatggtggtggaagtaacgatgacaaccatcatgacgatgggcaagcttaccctgcgcattgttatgctctcaaagtggatccctccaatttcgttgggagcaaaatctttactgagaaggaaatgcaacctaaacccaaacccgaacatcccgagagtgcaatggttctcagtttcatcgtcgaaagcagctccgatgatagagatggctgcaagagatggggaactgagggtcttccttgttgccgggttaagatgacaagtgaaggattgcagtctttgtttcccattgaggatatttctgtaatgggactttgggagctattgccacatttgtatagaatcagagtgaaactgaatgaaactgtcaaagctgctgctctatttgaacctcatgttgtattaactattgattctaagggcttttcatttcggttcttgaaacagcttagagctagatatagacaaaagaagttgcattcgccagcacactttcactatgtagctccatcattctgggcatggaaaggaggtgaaacaagactcagaggactagcggaatttgtggatcatttattgtgcatacttccaaatgaggacaaaatctgtagattaaatggattgtgtgcaacatttgttgggcatccagtcctggaagatgttctggaattgaatttgagaaacaattcctcgattcatgaatggaaggctgaaggaaatggtgaagacttccgaattaagcatgcagtgccagcaggagccactatcattagcttgcttcctggaagcagaatgcaagaagtcagtcggatgcttccgatcttttcaaacacagtggaactgatgaaagacatggttccacagttgatgacaatcattcatgttgcacctaatgagcatgtggaaaatttcatagctgatgctgttcacagatggcctgtgccagttgtattgataccaggtggaacaacacaactgagatatgatgcttttagtgcaagtagagctgcgttatgcacatctgggacagttgctgtggagctgcagcttgcacgattaccctgtgttgtggcatatcgtgcccatattttgacagaatggtatatttggtacaaagcgaagatacagtatatatcacttaccaatattcttttggacaaagccattattcctgaagcactctttcaatcttgcaaaccacttaacttagccttgttgctcaaagatttattacatgatgatggttgtcgagaagaacaaataattgcagcccaaaagattctcaagcttctatggccttcagagagaataaagctcaaccttctacaacaaaatttgaaaacttgtgctgattacactccaagtgcagttgcagcattgactatattaaaccatgggaagccaatgactagtatctaa

SEQ ID NO: 4535 - DNA, 1101 bp, Glycine max
  Peptide Sequence Number=SeqID_121313
atggcacttgagctttcttcaccttttctgccattaatgatttttaggttggtgatgctgagcaaaagcgaaagaaaggcatatttggggttaaaggtggtgataaagacaaccttgcaaaaaggaggaaatacagttgccccagaattcatgattgctggtactgacaatactgcatctgaagcaccaatctatcatccgaagcaatctacaatatgctgccttgagtgctctgagaagactccctctggatcctgggaatccagcatttctgcattatgctgtacaaggttctcaaatctcaaaactagagttgactgcaggatttcatttgctgatccagttgctgtgaggcatgcactggaaattgtttctgagatagctacaatggatccttatgctgttgcaatggccttaggaaagcatgtgcagcctggaggggctttacaagatgttctccacttgcatgatgttctcgctagagtttctctagcgaggttatgttgtacaatatcaagggctagagctttagatgagagatcagatattagatctcagttcaattcagtgctctatcagcttctattggatcctagtgaaagagtctgctttgaggcaattttgtgcgtactaggaaaatatgataatgctgagaggactgaggagcgtgcagctgggtggtatcgtttgaccagggaaattctcaagttaccagatgcgtcatcaaaggaaagttctaaagataaacagaagacgaaacgacctcaactgcttattaaacttgtaatgagaaggttagagagttctttccgtagcttttctagacctgtgcttcatgcagcagctagagttgtacaggagatggggaaaagtcgggctgctgcctttgctttgggcatacaagatgttgaagaaggagcacatgtcaatacatttgctgaggctacagattataatgattcagatgaaagcacacatcctgaaagcattcgaagaacttcttcagtatctaatttaaccgctggcagagatactgtctcgggtatgttggcttcattaatggaagtggtacggacaacagttgcctgtgaatgtgtttat

SEQ ID NO: 4536 - DNA, 861 bp, Glycine max
  Peptide Sequence Number=SeqID_121314
atggatctgataacggcggaccctactccggcgccgtcgtcttcgtcgactgcggctgcatcttcggcgccgacggcaccggcatctctgccctcggcgttaggtaagcctccggcggagaagaaatcgaagagagccgcgctgatgcagatccagaacgataccatttctgctgccaaagctgctttgcatccagttaggaccaatatcatgccgcaaaggcaaaagaaaaaaccagtttcctattcacaactcgctagaagtattcacgagctagctgccacttctgatcagaaaagttctcaacggcaattagtgcatcatgtgtttccaaagcttgcagtgtataattctgtggacccttcgttggctccctctcttctcatgcttaatcagcaatgtgaagatagaagtgttctccgatacgtctattactaccttgccagaattttatctgacactggtccccaaggtttgagcacaggtggtgggataccaactcctaactgggatgctctggctgatattgatgcagttggaggtgttactcgagctgatgttgtgccaagaatcgtagagcagcttactgcagcagccacaaatgctgaaactgaatgtgagtggttactcacttttatttttgatggttttaatcattttaagcataaggttgcatacttgcatccttacccttgcatatgcaaagaggctgtttccggattcgaacccatgaccaacaagtcaccaaggcacaactttaccgctgcaccagggctcgccctcattgtggctatgttgtcattaaattgtagtagtagagtacagagatacatgaaatccagagttaatatcatctcttga

SEQ ID NO: 4537 - DNA, 759 bp, Glycine max
  Peptide Sequence Number=SeqID_121315
atgactctattttcagggaaattccacgtgcaggaaataaattacaagaggtacgagatccggttgaccgatgctggtgtggtggaggacattgcttgctcaattcctcgttatttctttaatctctacaatttcacttacatcggtggtcttaactattctgcatatggtccgttaagtttctcggggtatcctcagtatgcggtgtttctaaactgcactaccccagtcaccgatgatcctcgatacgtagctgtgaaggtcaacggtaattgtgattcgagttccgtaggccatatctatgccattctggtcacagacgatgatgatcgctttgggtttacactgacggacatcaaggttgggtgccgattgaaggttgctacatttgcaaactggaaatataataacagggaggttaacgtttcttattctgatatcaacaagtggctgcaccacggaatttggatgtcttggttctttccagttatttgtagggaccgatgcggaaagggtgtgagttgctacatcgatcaaaccacgcgagaaactcgatgtgcagatagctactgccaaatctttggcattcaaacatacaagtgcggaattcgtaatcagattcttgaatatatgcggcaaattcttggctacacagtaggaattgggaagttggtggaatgtaagatggtaatggaactttcaatggataaggcagttgtggaagagtttatggaagaaattaatgctgtaaaactttaa

SEQ ID NO: 4538 - DNA, 1554 bp, Glycine max
  Peptide Sequence Number=SeqID_121316
gcttctccagatatggctgttactcttcttcaaattgcaagaatatttgctaccaaagttcccggaaaggttgatgctgatgtgttgcaactgctctggaagacttgtcttgttggagctggtcctgatggaaaacataaagctttagaagcagtcacaattgtacttgatctaccacctccgcagcctgggtcaatgcttggtcttacttcagtggacagggtgtctgcatctgacccaaagtctgctcttgcattacaaagactagttcaagctgctgtatggtttcttggggaaaatgcaaattatgctgcttctgaatatgcttgggaatctgctaccccgcctggtactgcattgatgatgttagatgctgacaaaatggttgctgctgctagttctcgtaatcctactctagcaggtgccttgacaaggctccagaggtgtgcattcaatggcagctgggagattcgaattattgctgctcaagctcttacaacaatggcaattagatctggtgaacctttcaggttacagatttatgagtttctgcacactttggggcaaggtggtcttcagtcacagttctctgatatgcatcttagtaatggagaagatcaaggagcaagtggtacaggccttggagttttattaagtcctatgataaaggttctggatgagatgtatagagcacaagatgatttgatcaatgccaaactcattgacatctatcgtacacgccacaatattagtgcatctactggtttgagtgatccagctgttgccactggtatatctgaccttgtctatgaatcccaaccaccagctgctgagcctgatacacttgatgatgacctagtaaatgcttgggcagcaaaccttggtgatgatggcttatgggggaacaacgcaccagcaatgaatagggtaaatgaatttctggcaggtgctggaacagatgccccagaagttgatgaagagaatatgatctctaggccttcagttagctatgatgatatgtgggcaaaaacacttctagaatcgtctgagctagaggaagatgatgcaaagtcattgggatcatcatctccagattcaacaggatcagttgaaacttcgatatcatcccactttggaggaatgagctacccttcgctgtttagttcccggccacaaactacggataaggcaccagcaagccgaggctttacgtatgaaggttatggttctccaataagagaagagcctccgtcatactcatcctctgtcatacaaagacacgagtcatttgagaaccccctagcagggaatggatcacatagttttgggtctcaagatgatgagcaagtttcatctgcaaatcctcaacatggaagtgcactttatgacttcacagcaggaggagacgatgaattgagtttaaccgcaggagaagaagttgagattgagtacgaagtagatggctggttttatgagaatcagttgttgatcgcatactttgccgtgcaggttaagaagaaacgccctggtagggatggcaagatggctggactg

SEQ ID NO: 4539 - DNA, 1449 bp, Glycine max
  Peptide Sequence Number=SeqID_121317
atggaccataataacttgtacctctccctccttctcctcttcgtttctttcgtgaccctctccctcttcttcctcttctacaaacacaggtctccattcgtggccccgaacctgccacctggagcaaccggttacccggtgatcggggagagcctggagttcctgtcaacaggatggaagggtcatccggagaagttcatcttcgaccggatgatcaggtactcctcccaactgttcaagacctccatcttcggggaacccgcggtcatattctgtggggccacctgcaacaagttcttgttctctaacgagaacaagcttgttgcagcgtggtggcccaacagcgtcaacaaggtgttcccctccacgcttcagagcaactccaaagaagagtccaaaaagatgaggaagttgctccctcagttcctcaagcccgaggctctccaacgctacgttggcatcatggacaccatcgctcaaaaccacttcgcttccctttgggacaacaagacggaactcaccgtctatcccttggctaagaggtacacgttcttgttggcttgtcgtttgtttatgagcgttgaggatgtgaatcacgtagcaaaatttgagaacccttttcacctgttggcgtctggaatcatatcagtgcctattgatcttcctggaacgccgttcaacaaagcaatcaaggcagcaaacgcaatcaggaaggaactgttaaagatcattagacagaggaaggttgatttagctgaaggaaaagcttcaccaacacaagacattttatctcacatgttgttaacatgcaatgagaatggacaattcatgaatgaattggatattgccgacaagattcttggccttttgattggaggccatgacactgctagtgctgcatgcactttcattgtcaaatatcttgctgaactccctcacatttatgatagtgtctatcaagaacaaatggaaatcgcaaaatcgaaattgcccggagagttattgaattgggatgatatcaacaggatgaagtattcttggaatgtagcttgtgaagtaatgagaatcgctcctccacttcaaggaggttttagggaagctatcaatgactttattttcaatggcttctcaattccaaagggatggaagttgtattggagtgcaaattcaacacataaaaatccggaatactttccagagccagagaaattcgatccaactagattcgaaggacaagggccagctccttttacttttgtaccatttggtggaggaccaaggatgtgccccggaaaagagtatgctcgattggaaatattggttttcatgcacaacctagtgaagaggtttaagtgggaaaaattgattccagatgagaagattatcgttgatcccttgcccgtacctgcaaagaacctcccaattcgtcttcatcctcacaaaccctga

SEQ ID NO: 4540 - DNA, 282 bp, Glycine max
  Peptide Sequence Number=SeqID_121318
atgatccaaactaattatggtgtggacaagctgaagcctaagtttaatcgtctaagacaaatgcatcgtgatttttcaactttgctagcccgtaccggagtcacttgggaaatggaatccaacaaagtgaatgcccctgatgaagtatgggacgaattgattaaggaaggcattacaagaatttcaagaaacatggttttgagtatgactatgatatcctcggtggcatattcaattcaagcacagcaactgggaatacatccatgtttaatgaatgaataa

SEQ ID NO: 4541 - DNA, 444 bp, Glycine max
  Peptide Sequence Number=SeqID_121319
atggaaggtgatttccttacaaaggggattcatattaatgttttcgatgatgagaaggatgatatcaaagggcttaggcacaaaaggaaggaaatattttcttcaggtgagcgtcgccgtaaagagggaaaaacttctaacaaagagatgttagacaaaattgtaagcatatggagtgattcaatgagccaaaggacaacaacttcaagagctagagaagagcgatataagggaaagacttctcaagcttctcaagctactagtccaataagtgatccttattcagcaaaggcatgcatggaactattggacaacatgcaagatgttcccacttcagcttactttaagttgatggagaagtttacaagtgagcattggaggcaaatgttcatagtgatggatgcagagcgaaggaagcaattgatagaatctcttaccgagtag

SEQ ID NO: 4542 - DNA, 459 bp, Glycine max
  Peptide Sequence Number=SeqID_121320
atgaatgaatgggaagaggatccatccagaattgttgtaaaaaggatatttattttgaccccacttttggttttgtatcaagttgatgttatgagcaagcttaggcatcccaatcttatgacactcataggggcctgtccagattcatgggctcttgtctatgagtatttacccaatggaagccttgaaaatcgtcttgcctgcaagaataacaccccttcgttttcatgcaagctcgaattcgcattgctactgaaactgctgctgctcttacaactgcttctatggatgagctattgtggggtgctacatacttggcttcacaaggctgctaagaacccaatgtacctaaactacattaagattaatggacagacacttggggctgcagattctgacaatacctttggatgggataacaagcatgttggagcaaggataatgctttctaaggtctaa

SEQ ID NO: 4543 - DNA, 360 bp, Glycine max
  Peptide Sequence Number=SeqID_121321
atgtcggagccaatttggtccgatggtggtgattgcaatgtgctgctgtgtgtagctgtgcggctaggtcgcggcagagagtgggtcgcggttgcggcagagagtgggtctcgagcgtcgagctcgaggtcggcgtgcgtgaggactgagaagcaagcactgaggcggcgatggagacacgaactcacggagaaggagcggtacctgaggcggaaagtggttgagtgggtcgatgagatgttctctgttttttgtcaaagaaggagagaagcgtgttgttggactagcggcctcaataacttaagagggataggcttagaatgcaaaagaagcaacaatcaatttaagaatgttctttaa

SEQ ID NO: 4544 - DNA, 201 bp, Glycine max
  Peptide Sequence Number=SeqID_121322
atgcctaaatctatacactggacttatgctgtcacagcccaaacatcatggttggtggacaaaagtagaattgcaaccaaaataaaatgtgcatcaggagcttgtgatcatggaaaggttatatggaaaagcaatcctaccaaggcttgcccaaattgtcaacatgctattgacaacggtgataaattgcatgcattttag

SEQ ID NO: 4545 - DNA, 393 bp, Glycine max
  Peptide Sequence Number=SeqID_121323
atgactactgtcatagaaaaattgggcatatgcccaattaagattgagaggaaccctcctgagtccaagctcactcaactgggtgttaggcaatggcccaaaattaacaaccctgaaaaagtcgccgccatagataactggtttggtgatgtgaaaaagttgcaatatacaggctttttatcttggaaatggggttgccctccaagtaagttcccatggacatatgaagccaaagagacttgctatcttctggaaggaaaagtgaaggtctttcctagtgggtcgaatgagtcagttgaaattgctgctggtgacttggttgtgtttcccaaagggatgagttgcacttgggatgtgtctgttggtgttgacaagcactataattttgaataa

SEQ ID NO: 4546 - DNA, 156 bp, Glycine max
  Peptide Sequence Number=SeqID_121324
atgaacaaaggaacctgctgcagactaatgtacttcctttttctatctggactgacaaagaagttgcaagaagaagttgatgagttctcaaatacttactacttggaccttcatgttggagacatgaagcaggaaatagcatttgctactagctag

SEQ ID NO: 4547 - DNA, 570 bp, Glycine max
  Peptide Sequence Number=SeqID_121325
atggggatttgctttagcattgaagaccaaaaccacctttccatctccgattccaacgcgaagcctaaacctgcagtaggtcatgaatctggcgctccattggcttccatgaacatcaaagatctccgcgaaggtgctggatacagcaatgtggatatttttacctacgaggagcttaggctcgcgacgaagcactttcggcccgatttcatcttgggagaaggaggcttcggagttgtatataaaggcgtcatagaccatagcgtgaggtcgggttacaagtccactgaagtcgccattaaggaacttaatcgcgaaggatttcaaggcgatagggaatggctcgcggaagttaactatttaggtcaattcagtcacccaaatctggtgaagctcattggatattgctgtgaggacgaccaccggttattggtctatgaatacatggcaagtgggagcttggagaaacatctttttcgcagcaggaagccttctttgagcttcaaaatggtgtacagtgtactccaccttcctgtcctccctctctgcccatctctcccttttatgtag

SEQ ID NO: 4548 - DNA, 255 bp, Glycine max
  Peptide Sequence Number=SeqID_121326
atgacttacatgtacgacgacctaagacgcgtattccacgggcaaacggcgcgaggtcagtatgagggagacagtcttcacgacgcgagctccactgcttcacgccgagggcttagtgatgggtcacagacttctcttcgacagggcttagtgatgatgggtcacaaatttctctttcaacacttggtgaagacaggggatgctggtgaagacgaaaggggacgctgggtgaagactggaaagggatggctgtaa

SEQ ID NO: 4549 - DNA, 1157 bp, Glycine max
  Peptide Sequence Number=SeqID_121327
cacaagagtggcctggcttgccaaaaggtgtcaaatttgatccatctgatcaggagatcatttggcacttgcttgcaaaagttggggtaggagattcaaaatctcatcccttcattgatgaatttattactactcttgaagtggatgatggaatttgttatactcatcctcaaaatttacctggtgttaggcaagatggaagtgcttcccacttcttccatagagcaatcaaggcttacaacacgggcacccgaaagcgccgaaaaatactagggcaagattttggtgatgtccgctggcacaagactggaaggactaaaccagttgtcttgagtggggttcaaaaaggctgtaaaaagattatggttctgtatgtgagcaatgtaagaggaggaaaagctgagaaaactaattgggttatgcatcaatatcacctaggaacagaagaggatgaaaaggatggggagtacattatctctaaagtgttttaccagcagcagcaagtcaaattgggtgataaaaatgaccaagatgttcctgaagcctctgaaatcactggaccccacccaggtctgtctgtgggagaagaagggactattgagaaagtggatccagtcactccgaaattggtgactcctgagcctccttgtaatggaaggtggtgtgcagatctagacctaggacaagaaacacataatgttcctcagcctcctcggatggattgtttagatgaaattcaagctgattgccaagtacttgcaaatgaatcatccatggtagaaactcaacacaatgaagggatggatgataaagaaaataatgcggaggatggccaaaaatggtgggacagtgagtcacagaatctgttggattcacaacaactggtcgaggcactgtcgctgtgtgacgatctactccaaagccagtctcccagtagagatggaaaacatgaagatcacaagaaccaacccggtctttctgtttatgctcagttaggaccagaacatctgaagaaggatattgaagagtgtcaaaatcttgcccttaatcctgcaaatatagagaacgatacaccttcagagtttcaactaagtcagctggaatttggttcacaggacagctttatttcctggggctacagcaaggcagtgaactaa

SEQ ID NO: 4550 - DNA, 273 bp, Glycine max
  Peptide Sequence Number=SeqID_121328
atgaagattgctttacatgctgcaaggggactcgcttttcttcatggtgcagaaaggcctattatatatcgtgatttcaagacttcaaatatcttgctagatgcggatttcaacgcgaagctttcagactttggccttgcaaaggatggtccgatgggggaccaaacccatgtttcaacacgagtaatgggcacatatggatatgctgctcctgagtatgtcatgactgagtgtgagggggtgacccttggcaacaaggttgctgccttgtga

SEQ ID NO: 4551 - DNA, 267 bp, Glycine max
  Peptide Sequence Number=SeqID_121329
atggaggagatgattgtgttcagagaaaggatgtgtaaagaacccttgaagaagctagtggagcaagaggcgaagattgagagtggtcgaagccgtgatagatctagagctgacaggccatctcaatcgaagttcatccactacactccattgatgaagagtcgaggccgagcactaaaggaagcatgtagtacaatgacccctcacgtgatcaagatcgagaatgagaaaagagtcgggagcatagtcagactcaggagacaatga

SEQ ID NO: 4552 - DNA, 147 bp, Glycine max
  Peptide Sequence Number=SeqID_121330
atgaagatggatagtgcttccatgacaggctccaagagaaggatatcatccaatagaggaattggaggagtcctcagagagcaaagggcaaggctatacattataagaagattgtttgactatgctgatcagcttgctagtggttag

SEQ ID NO: 4553 - DNA, 498 bp, Glycine max
  Peptide Sequence Number=SeqID_121331
atgtctttctttggtgggggttttgagtgctcctgcataggcaggatgctctcgctggagattcatccaatagggaaaagttataatgatgatccatttccccatcacagtcgctccaacgccgccaatgatcatgtttccatcgttctcgctggtgatgaggccgccactattggtggcatggctcatcctaatgcaggtattgcaacccttattggaggtgtcactactattgaaggaggtcttcttcctagttctagtgtttgtcttaaccctatggaggatgagatcgagtcccctctaccaaatcctccctataatgttatagacttggactcggaggccactacctcccaagtgattccttgtcgtccctttgttcctcctcctcctctcccttggaagcctattaaggctaaaaagaagtatcctcccataactctttcaggttactcctgggttcatgaggaggttggatcctacacaagtagttcctaa

SEQ ID NO: 4554 - DNA, 1155 bp, Glycine max
  Peptide Sequence Number=SeqID_121332
atggaagtcaaagctttcattgcatttcattcaccggaaacaaatggaaactttagacaaaacatgccaccccagttctgtttgcaatctggagctatgagttcgtcttcggcagatgtttttccagcaattcaggaagttatgctggagttccgtgctggcaaaatgtttcttgaggaaaaaagggttgttcccgatacacggaaaggacttgttcgaattgctaggggtgaggagggattagtacattttcagtggcttgatcgcacacaaaatgttgttgaagatgtatcctttgttttccctcctcaattttgtacacttggtcatcatcatttaagtggatgcacaattaggggaaagggaccccaacttatccggagtttggccaagaaggttaatcaaacatctggaagggtttacatactgaagtttaatagcgatgacaggaagttcttcttctggatgcaggaatcaaatgctgatggtgattcacaactgtgtagctcagtgaatgattacattaatagaccattaggtacaggtgcttgtacctgtacagagttgcttggtgaagaggagcctgatggatcccttccacttcaaatttctgaagatatgacagaggatgacatctcgtccagagctgcaaacttaggtatcccaaacttgggtgtggaagcaactagtgatgtaacatcttctggtccggttaaattggaagatctccaaagaatattgagtaacattggacctgcagatagtattgttgatcctgatggaggcttgggactcggagatatattgaagcctgatctaataatgccattgatggacatgttacctttggagcagcgtttagctccctacttacctgagggtaaatggtctccagaagagatattggagttgttgcagagcccacctttccgtcagcaagtagattcgtttacttatgtacttcgaacgggacagatagacttgtctcaatttggaattgatccaagtaaatacaagttcacagttttgtcttttcttgaggctcttgaggattctgtttccaagtcggttgagtctgaagaggctaggcaagatgatcaggatttgagatctcaatcttgtaaccgtcatgacccaatggatgaatctcagtag

SEQ ID NO: 4555 - DNA, 135 bp, Glycine max
  Peptide Sequence Number=SeqID_121333
atggcactccaacttagggctaaaaccaaactacaaatgacgacgaggtttacaggagcaaaggtggatccggtcggtgtttccagatgtgtgtttgctttgagcagaattggcgaaggcaattatgtggcttaa

SEQ ID NO: 4556 - DNA, 177 bp, Glycine max
  Peptide Sequence Number=SeqID_121334
atgttggagattgtattgatttttggtcatcctcttgttcttgattatctagataaccctactagaattgaccgggtccttattgaaaaagaccttcttgctgatgcatactcagattgtcctgaggcctctattctggacgagaaagagtttctcctactgaagggacaggtctag

SEQ ID NO: 4557 - DNA, 819 bp, Glycine max
  Peptide Sequence Number=SeqID_121335
atggcaactataggaattggagtaggagtgacaaagcttcaacaaccccacagaccaaagtctaagtccttgtttcttggacagaggcttagaattagtcccttttggggggagcctcaatgcagtgaaagaagactattcggtgtctcaaacccaccaagagtggttcaagtttttgcactagggggtggtgaatggcttgacacagttcataatctctttgtgggtgttggggttggacttccttgcagtgtgatgcagtgtggtgatgtgatctatcggagcactcttcctaagtccaatggcttgacactcactgtccctggggtgattctggctttggggactctttcttatctttgggccacacctggtgtggcacctggtttctttgacatgtttgttcttgcttttgttgagaggctcttcagacccacttacaagaaggcatgtggtatcagggggtttacaacaagtcatgctgctcgacaatttttatacaatattgtttatagagttgttgatttaatgattttagtagttgttactgagaagttgggggaggggtcatttggagttgtttatagagtgtcactggccaacaaaccctcttcaaaggaaggtgacttagtcttgaagaaagcaactgaatatggtgctgtagaaatttggatgaacgagcgtagctcttcaaagaaagccgctgaatactggcttatatggcggtttgaaggggatgccaccctagctgacttgatgcagagtagagactttccatataatgttggtactctatttaataggcttggttgtacttga

SEQ ID NO: 4558 - DNA, 231 bp, Glycine max
  Peptide Sequence Number=SeqID_121336
atggttcgagtacttgtggcaacctcaattagagaagctgctgctggtgctgaagatgatgccttgataaagctcatggatgccacatgtagacgtgctactgctcctccagcaccccctgatggtttatgtctagttgatgtagggtataatgtagaaatgctattggtcatttcaccttttatcaaatcaatgagtaatgataaacatattgctagggttcttcattga

SEQ ID NO: 4559 - DNA, 540 bp, Glycine max
  Peptide Sequence Number=SeqID_121337
atggtgaagcaaggtccatgttcacattgcaaaatcaattttactccactttggcgtaatggaccagttgataaaccggtgttgtgtaatgcttgtggaacaagatacaaaaaaggagaccttgacaattatctcccgaaaaatgtccatcctcaattgcaccacaataactttaaaaatgtaaatggtgaaagtcatttcaatgctgaggagtcactttcaaaccatattccacctataactacaagtaatggagacaactataagtcatcttcagatgttcatcatatatcagcacaagattttgagaaaaagatcccttcaaggaaacggtcatcagtggtgtacaagccgatgacaccaatggagaagtttcaaaagcagcttctgagtttgtatagaagtgaaaggcaaccagaagagagtttgttggtggataacgtaaacaacttcatacctgaaaatgagataggacttggagccattcttcttaagacggatgatgctgcttctacagatccgggatcagccaacagataa

SEQ ID NO: 4560 - DNA, 1182 bp, Glycine max
  Peptide Sequence Number=SeqID_121338
atgacactaaagcatagcatcaatgttctaaataatgagcatgcagtgattatgattgcagcagtagtattattcatccttcacagaagaagaaatcaagggtcagcaacgtccgtggagaatccaccctctgggtgtaacaaaggacgtttgagggaagtgggtagtgaaagtatgaggtcaacaagatcaataagctccaaccacagcagaagaggggaccacacgaagctatcttttctgagagatgataggcagaggtttgatttgcatgagttgctgagagcctctgcagagattttgggcagtggctgttttagctcttcttacaaggctgctttgttgaatggcccaacaatagtggtgaagaggttcaagcagatgaacaatgtggggaaggaagagtttcaagagcacatgagaaggctagggaggttgagccatcctaacttgcttcctcctctggcttactattatagaaaggaggagaagctcgtcgtcactgactatgttcagaatggcagcctagctgttcgccttcacggacaccaatccattggagaaccaagccttgattggccaatccggttgaagatagtgaaaggcatagcaaaaggtcttgaatatctatacaaggacatgccaagcctaattgcaccccatggaaatctcaagtcctctaatgttctcttgactgaatcattcgagccactcctcacagactatggcttagtcccagtgataaaccaggatctggctcaggacatcatggtgatatacaagtctcctgagtacttgcaacaaggaagaattacaaagaagactgatgtgtggtgccttggaatactaattcttgagattctaactgggaagttccctgctaacttcttgcaacaaggtaaagggagtgaggtgagtttggcaagttggattcattcagttgtcccagaagagtggacaagtgctgtgtttgatcaagaaatgggggcaacaaagaacagtgagggagagatggggaagcttctcaagattgccttgaattgttgtgaaggggatgtggataagaggtgggatttgaaagaagcagttgagaaaatccaggaggtcaagcagagggatcatgatcaagagaatttttttacttcttatgctagtgaagcagacatgaagtcttcaacttga

SEQ ID NO: 4561 - DNA, 993 bp, Glycine max
  Peptide Sequence Number=SeqID_121339
atgtcaaggttgattcaagagaagaagctgggtgcaggacgtgttgtggcagtggcaattgaaaacaacaaaacaagccaatatgcagcgaaatgggcagttgacaatcttcttcccaaagaccaagctctcctattgctccatgttaggcaaagagtatcttccattcctacgccaacgggaaaccttgtatcccttgaaggcaacgatgatgtggccagagcatacatgcaacaaatggacaacgaatccaaggagcttttcgcttcatttcgtgtcttctgcaatagaaagagcatacaatgcaaagaaatcttattggaggacatggatataagtaagggattaatagaaggtatttctaagtattccgtggagcttctggtactcggggcagcttcaaggagtggtcttgtcagaagatttaggacatctgatgttccaagtcttgtgtccaaaggggcaccaccattctgcactgtgtacattattgccaaaggaaaaatctcatctgtgaaaactgcaactgctccactaactgctaaacctccagcccgtaacaatacaatgcagccgcagcagtctctccaaactcctgagagaatggatacacaaataacacgtaaccccatcccaccacgaccatcatcagagaagccatcatacattgtccgccagctatcatcagatgaagacgaaatcatatcaccattcaccagatctggtagaggaaattacatatcatacgagtcctcaattcccgactctgatatttcattcgtgagcagtggaaggccaagtgttgataggatgttcccttcaatgtatgatgatatggactctggaactaatcggctttcaacaggctcagattttgatgtcagaagctttggttcttcattctcaggagccaagtcaatagatcatggtgactattcattcagttcacaagacagtgggacatcgatgtcatcgtcaatgttttcagcttcg

SEQ ID NO: 4562 - DNA, 474 bp, Glycine max
  Peptide Sequence Number=SeqID_121340
atggcctgctcgctaagcgcatcgtattcactggctaagcgcgagatgtcgccgctaagcccatttcgatgcggcctaaattgggaacactgcctgcatcctctctctctcaccaaattcatgcattcttgcattcattcttttcacatcttctacaaatcttcagcacacaacaatccaaacggactcgctaagcgcgcctaccgcactgagcgagttcatcttttgaggatgaacactcatctccctgatgagttgtctatggctaagcagggcttattcgctaagcccgggttaattaggcaagtttgtgaagtgctgattttcaccttctcgctaagtcaagatgttggcttagcgagccatccgctgagcgcaacactcctcggcttagggcgaggaagaatctggaagaaggatgagctgtgcatttgtgttaagcgaggggtcatccagcgaagcgcaccgctttaa

SEQ ID NO: 4563 - DNA, 330 bp, Glycine max
  Peptide Sequence Number=SeqID_121341
atggttccagtcatgtggttgcaccggataaacatggctcggctaaagccaatgaaggcccatagtggtgacgggtactattcacgcatgaataaagaatgctttgaggtggaagaaaaaggaaaggtcgatgcaacaattataaacatccagaagaggactgggctttgtgagcctcagtctgcgagcttggtgctgcaaatggaggccagactcattgccatgcgttgggatcaggggctgtttggctgctgtttagcgcgacaaaaggatgtgcgtgagagttcattggtggttctttcaagaatcaagacgtcgtcaatggcttag

SEQ ID NO: 4564 - DNA, 447 bp, Glycine max
  Peptide Sequence Number=SeqID_121342
atggtctttgctaagacccgtcattgtatccgaaatggtatcacatggctggcacgtgcttgttactttctcttactttggtgtgccctatcacttctttgctcgaaatttcgactcaattactcttactttggcgccctagctaggtacatagaccatcgtctccgacaaacaccatcgtctacgttgcgtcttgttcagtttgcagccaccgccgataaaggtaaggctgcatttaggccgttagttgctggtggtggtctacatcgtcttaaagctgcgtcctatataagtggggtttatgtgggcctcgttgatgaagctgacttgtggccagcgagtgaacgacctttggaaacaacctcctgccatccttcatcagtggtgtcatcctatgccagattatcactttcattgagcattgtttggtctaagttagtacactga

SEQ ID NO: 4565 - DNA, 195 bp, Glycine max
  Peptide Sequence Number=SeqID_121343
atggagaagaaggggagaagaagaagaatggggctgaatgacgctaaggcctgtgtgcggaaggctgaggaagttataggccttcttttatgcttctttgctcattgccatatgaaggctttctccttgcctgaaggacagtctaacgacggtgttgaaggttacaaggctttgcccatggaagagttgggatag

SEQ ID NO: 4566 - DNA, 285 bp, Glycine max
  Peptide Sequence Number=SeqID_121344
atggcttctcttgtgtatttttggttcacttttgcggctatcatgatgatcttgttggcgggatcagtgctgggaagaatgaacattaaggttgggacaaggttgaagagtgacagggagaggttcccatcgaacaacgtgctgctgatgcttgcgggtgtaatgatgcaatcctaccccgcaagggcattagatagaaaactccaagtagattgggctagagatgcaagagaaggccctagggttcttatgagccttagggtagatttcgggcccatggactaa

SEQ ID NO: 4567 - DNA, 255 bp, Glycine max
  Peptide Sequence Number=SeqID_121345
atggagatttatttcgattctaatcctaatgcttttttgtcaggagtgtcttcaaatctaaataaatactttcccatgttgtggataatgggagcatatatcaagatgcctggagagtggaatattatttgtataatgccaatgttcctccaagcatactttggaggatctgtagagagtgtatccctaattcaaagggtgatgaaaccgtgttcaactgagtcaaatgttgaagaggaagctcacgaatgctga

SEQ ID NO: 4568 - DNA, 1011 bp, Glycine max
  Peptide Sequence Number=SeqID_121346
atggctactcaaccgttacccttctcatcagcttcttctatagtaccaagtagtaacaatcctcacaatgatgagctacgcttcttgagcgacccgaaattcgagcgccatggcgaaatcttgttgctggtttttgttcttcttttcagtgtctttcttctgtctccaactcggatagaagttgcaagctattcaactctcactgaattgctgggccgatatgtttttgacctactaaatagattggaaaaagttcttaatggtgttattgatgaaagacaaggagcattccttaatggtagaaatctcatgcatggtgtgatggtggttaatgaggtcattgatgaagctaaaaggaagaagaagaattgtcctatatttatgaacatgcttcaaatgcttggacttagtggcatgatgaaagaggttatggcaaaaaatatgttcacaagctatcttataagggaaaaacaagtcaaggttaatttgctccaatatgtggacgacatcctattcttgggaaaagctaccttgaggaatgcattgaccataaagagcatgaagaggcgttttgaacttgtctctggcttgaaggtaaatttttacaaaagttgctttgaggctttgggagtggagagagataaagtatgttgtccgaatgaacatggtggtcttggcatcaaacaagttaagttgtataatgttgctttgatggccaaatggaggttgactttgtttggaggcagggattctttgtgggtagaagtccttaagtctaagtatggagaagaaacacttgctagtaaattccctagattgttcattatttccaatcaacaaaatgaacttctagggaatgtgggtcaatggaaggaaggggagtgggagtggacacttagttggagacaaaacatgtttgaatgggagaaatcccaattagaggaactacaacttttaaccaatactaatttggtaaaagattgtggtgatggatggtggtgtgaagaggag

SEQ ID NO: 4569 - DNA, 485 bp, Glycine max
  Peptide Sequence Number=SeqID_121347
atggtggaacacgacacccgccgcaccaccattgaccgcctggaagaagctatcgccgccctctccgagagacactcagaccttgccaacaaggttgaagccatgtgcgaatgtctttcgcacctcaccactccctcgccgtcggtaacacagccttcctatccctctagaccgtcggtcaagctcgatgtccctcgttttgacggctatgatccactaggttggatcttcaaaatctcacaatttttcgagtatcaagggaccccgaaagaagaacgcatcatggtggcgtccttctacctcgacggcccagcattgagttggtttcaatggatgttccgaaatggatttattacgtcatggccagcactgctccaagcaatcgaggctcgttttgctccttctttctacgatgatccacgaggaacgctattcaagctagtccaacgaagctcagtcacggagtacctcaccgaattcgagag

SEQ ID NO: 4570 - DNA, 534 bp, Glycine max
  Peptide Sequence Number=SeqID_121348
atggccaaccaaaccttcacaaacttactgaccaatgacaagcaatttgctgctcttcaattgcctcctaaggccccaactagcaataaaaataagcccaatgtctctgaaggccatgaaattctatttcaggcaagaaatgtgatgaaaacagatgagaacccttctttggtgtttcatggggatgaacaagttctccagcatccaaattctccaaacaaagtcgaggatttggcccaagccacaaaccctaaaacagaggctcaattgaaacgggtgtattctgcgaaatatcgactccgaaagcaagccaggttacaaaatctgaaaaacctagctgagtcccttgaagcggaagtttcaatgaatcaatctcagctgcatttctggcaaactatccgcgacaaactagttgaagagaatgaaatgatgagagcacaatacgacattgctagtaatttggttgctgaaaaggaagctgtgaattgcgctctgatggaagagatacagaggttgaggaacagcttggtttag

SEQ ID NO: 4571 - DNA, 1869 bp, Glycine max
  Peptide Sequence Number=SeqID_121349
atgtgcattgactatagggcgttgaatgcaatcaccattcgggatagattcccactgccaacgatagacgaactcctcgacgagttagggaaggcatcgtggttctccaagctagatttatggcaaggttttcaccagatattggtggttgaagaagatatcccgaagacatcctttcgcactcaccacggtcactacgagtatcgggtgatgccgtttgggctctgcaacgcaccatcgacgttccaagcagccatgaacgccttgctccgcccattcttgaggaagtttgcggtcgtcttcttcgacgacattctgatctacagcacaaccttcaacgatcaccttcatcatctcgaatgcgttttcagttctttcctacaagctcgctactacctgaagcaatccaagtgcctaattggtcaacgccagcttgactatctgggccacgtcatctccggcagcggtgtcagacctaaccctactaagattcaggcgatcgttgagtgggctatgccacgatctccgaaagatctccatgccttcctcggccttacggggttctaccggaagttcatacgaggatacgccaccatggcaacaccattaacaaaacttctttactctctatcctacttcggagttaaaaaaaccttgcatcgccttcaatctaacttccaatggcgaaacatgcttcaagatattaagacatccattcgaaactgcacagtgtgtcaacaaatcaaacacctcacgcgtaagaatgttggcctattgcaacctattctgatacccaccggagtttgggaggatctctccatggacttcgtcacgcacctccccacctcacatggcttcacgacggttatggtcgtagtggaccgcttctctaagggcgtccacttcggtgatctacatactcattttacggccttcaaggtagctactcttttcatggacaccgtgtgtaaactccatggcttcctacgcagcatcatttttgatcgagaccctatcttcatcagttccttttggagggagctcttcaagatgagtgggatgacgctgcgaatgagcactgcctaccatcctcaaacggatggtcagacagagcacacgggcaccggtatgactccctacgaggtcatctacgacaagcctcttccccctctgtccaactacctacaaggatcctctcgcaatgacgcggttgatgcagaacttagcacgagagaagagattcatacggcccttcgacgaaaacttctcaaagcccaggaggccatgaagcacttcgcggaccagaaacgtcgcgacgtcgcctatgaggtcgaccaactggtgtacgttaaactcagacctcacagacaatcttcgcttcgccaccagcccttaactaaattagctaaacactactttggcccctttcgagttctggagcatatcggcaacgtcgcgtaccgcttgcagctacctgagggatccaaaatacattcggtgtttcactgttctctgctccgcccgcatcatggtcccttagacctacaccacacccctcttccaccagatgcgcgtgaccaccatccactactcgaacccatcgccatccttgactcgggctttgacccctcaactcaaccacccacacgaatggtactagtgcagtggatggggttggccccagaggactcgacatgggagaaatggacagatgtttgcaatgcccaccatcttgagcacaaggtggttttcccaggggcggatgatgttagcagcagcaacatgaacgaagctccacctcctgcaacacatgagccacgaccacgaaggagtatcacgagaccaaggcacctggaggagtacgtatag

SEQ ID NO: 4572 - DNA, 1041 bp, Glycine max
  Peptide Sequence Number=SeqID_121350
atgggagaaagcagtggctcacaatgttccaagacaagtccttctaacattgatgaagatgacgagggtgaaagtgaggccaatgaagatcaaagtaagcaaaacaacaacggaggaagctcaagtaacagcacagtggaagagaatgagaagaagataaggccttatgttagatccaagatgccaaggcttcggtggacacctgatcttcatcttcgctttattcatgcggttcaacgacttggaggacaagagagagcaacaccaaaattggttcttcaattgatgaacatcaaaagtttaagtattgcccatgtcaagagtcatttacagatgtttaggagcaaaaaggtggatgaccgaaatcaagtatttgcggatcataacagtcttgttgaaaccggagacaaaaatatttataatcttagccaactttcaatgctccaagggtataatccgagtcaaagttcatccttcagctacacaaacaattatccaagttatggattcggggatgcttcttttggtgtctacgagaaactgctacaaagacctttcgattggtctaatgcaatttcttctcgggaaggttcatccatttttggtgaacaaagcaaaatccgtgaaccgaaagatgagtttctctcatttggtgctcatgatcactctctaagcacacccacaagattaagccacgttgatcacacgccaccaatcaatattatgcaacaaatagcacaaaatctcatgcctataaacccaacaacaaatcaaccagaattgaagacactgaaaaggaaggcttcagatcatacaacccttgatttggatctgtcactaaaactaaactcaaagattaatgatgctgaagaaggaacattaaataaccatgaagttgatagcacaaacctatcactctcattgtgctctcaattatcctcatcatctaatcctagcagcaggttgatcaaggaagcacaacaagatcgatgtgatgaacaagggaaaataatggccagtactctagatctgactatatga

SEQ ID NO: 4573 - DNA, 288 bp, Glycine max
  Peptide Sequence Number=SeqID_121351
atgccgaaaaatgcgaggtataattggccagtgagagcttgtcattataccatggtaaaggtgtactccaaactaaaatgttgtaagactactaagttcttggagctccaatggcagctgataagtgtgttatgtatgttgagaagaccttgttggcttatgcttgggtgtagtttccacaccagggtgggtgttagagatgcttcgagtttaggacctttacttctatacgtacttgttttgggacctagaggatactgcagaactccaaatgaagagtatgagtag

SEQ ID NO: 4574 - DNA, 408 bp, Glycine max
  Peptide Sequence Number=SeqID_121352
atgtggatcacggagtcgcttcgcgggcggttgcggcattctcttccgttgcggaatgccggcgcctcgcggaacgttggaagctcgccggtcgccggaaaatgcgcgtccacggcggcgaaaaacagcaccaccaacactagtgagagtgagagtgagagtgtcggtggcatggtgacgaaaggggagaatcgaaaaaaccagacagcgaagagtgttggagatttagttgggttgtgggcccggatcgaacaacatggtaggaagccaggctggaaagacgcgttttttatagcttcgacatgtaggcgttgttgttattattactacgtcgttttcatggtcaccgttggatctatatcgcgatcagaaataaacggttgtgatttgatggaggaaggtaagtaa

SEQ ID NO: 4575 - DNA, 174 bp, Glycine max
  Peptide Sequence Number=SeqID_121353
atgggagtatggtgtgggcttcttcaagtgcagatgatacgttgtcttgagacgttcttggtgttcttgaacttattgttgaaagcaagaacatcaaagtgtgcccatgaagatgataaggacattaaaaattcattaaaatgcatgtgcatggcacatgaccccatggagtaa

SEQ ID NO: 4576 - DNA, 1719 bp, Glycine max
  Peptide Sequence Number=SeqID_121354
atggaagtcacactttcagcgtgcaagtccattagctcgccttctgttcccgtcgcagctttatttgcggggaaagcaggaactaagagttcgcaatgcagttttttagctggagcaaacaaagtgaggtttcctaggcaagtcggtcaagttagccacgttcgcaaacagcgccaaacgcgtcactgtggtgctctccacgcgacttgcagcggtgacaagatcctgatcgcgaatagaggcgagattgcggttcgcgttattcgaaccgctcatgaattggggattccgtgtgtggctgtgtactccaccattgataaggacgcccttcatgtcaaactggctgatgaagctgtatgcatcggcgaagcgccgagtagccagtcgtacttgctgatcccgaatgttctgtcggctgctattagccgcagatgcacgatgttgcatcctggctatggttttcttgcggagaatgctgtgtttgttgaaatgtgcagggaacatggaatcaactttattgggcccaaccctgacagtattcgggttatgggtgacaaagcaactgccagagagacaatgaagaaagcaggtgttcccaccgttccaggaagtgatggccttttacagagcacagaagaagctattaggctggcaaatgagattggtttccctgtgatgatcaaggcaacagctggtggtggaggacgtggcatgcgtcttgctaaagaacctgatgagtttgtgaagttgttacagcaagctaagagtgaggcagctgctgcatttggcaatgacggggtttatttggagaagtacattcaaaacccaaggcacattgagttccaggttcttgcagataaatatggtaatgttgttcactttggagaacgtgattgcagcattcagaggcgtaatcagaaactgcttgaagaagcaccatctcctgccctgacccctgagttgcgaaaggcaatgggagatgcagcagttgctgctgctgcatctattggttacataggtgttggaacgattgagtttcttttggatgaaagaggttccttttactttatggagatgaacacacgtatccaggttgagcatcctgtgacagaaatgatttcctcaacagatttgatagaagagcaaattcgtgtagctatgggagaaaaacttcgatacaaacaggaggatattgtcctcagaggacattctattgaatgccgtatcaatgcagaagatgcttttaagggatttagaccagggccagcatacttgccatctggaggtccatttgttagaatggatagccatgtttatcctgattatgtggttcctccaagctatgactcccttcttggaaagctgattgtatgggctccaacaagagaaaaagcaattgaacgcatgaaaagggcacttgatgacactattatcacaggagttcctactacaattgattatcataaacttatccttgacatagaggatttcagaaatggaaaggttgatactgcttttattccaaaacacgaggaagagttggcaatgaagtgtctgtccctggctagtgaagagctagcacacagcgacacttggatgatgggtggtattgaaaaaggtcagatggtcatgacacttgagtttggtgcaagagcgctccctccgcagaagatggtactcgctaacagggtgaacgaactagctggttcaactgcctga

SEQ ID NO: 4577 - DNA, 831 bp, Glycine max
  Peptide Sequence Number=SeqID_121355
atggttctcctccttggagcatgcccagagtttgggtgcttagtgtatgagtacatggctaatggaagtttggatgattgcctcttccggagaggcaacaaaccagctcttccttggcaactaagattccgaattgctgcagagattgccaccgggctccttttcctacaccagacgaagcccgaacccctggtgcatcgcgacttaaaacccggaaacattttgcttgaccgtaactatgtgagcaagatcagtgatgtgggattggcaaggcttgtccctcctacagttgcagacacagtgacacagtatcgcatgacatcaactgctggaactttctgttacattgaccctgagtatcagcaaacgggcatgctgggaatcaaatctgatatttattcactggggatcatgcttctacagatgataacagccaagccaccaatgggactgactcaccatgttggaagagctattgagaaggggacttttgcggatatgctcgacccagccgttgaggactggccagttgaacatgccttgcattttgccaagcttgcattggcgtgtgcagaaatgagaagaaaagatagacctgatcttggaaaagttgtattgcctgagctcaacaaactcagagattttgctgaagaaaacatgcccatgatgatgatgttcggtatgtccactggattcactcccagaaacaactacaattactcaagctccaccttttcctcagttcaagactccatgagtgaatcccagtcaatgtcagggatgtctggatatgaaagccgctcaagctcatcgtcaccggggagaatgtaa

SEQ ID NO: 4578 - DNA, 350 bp, Glycine max
  Peptide Sequence Number=SeqID_121356
aatgtgcggaggaggtagcgggagggaggaagattcggaatggtgtagcagttcttcttgccggaggagattgggaagaaacggagggtcttctcgtgcccgtggcggaagcgcagcggctccgacacgattccggtggcgccgccgctgaagtagcggtcggagagccacgtcgtgttgaactggtcggtggagttcgtgggacttccacagtcgatgtggtgggtggaaggtataatgagagcgagggactactaagaagtgagaaaaattggcaattaggggatcctaatcgtgttaattatacaaaattggtgaggtttggctctttagttactctacgtgagtga

SEQ ID NO: 4579 - DNA, 507 bp, Glycine max
  Peptide Sequence Number=SeqID_121357
atgaatgcaaagagaagaaaatatatgttcggtgtgcttccaaagagaaaaatactgatgcggcatggaaagtcacaggggaaccaggacacggcgacatatatcactacacccgaccacaacatttggtcaacaacacgaggcatggctaaggtcattcgtatcgacaagcacttccgtcgcgtgatgggtagtgacggctgctcccttgactggcggatacagttctacgtgtccccttacgcccattcccgatcgatgctccacgaacttatacagtgtttcttgaagaagaggattaacggcgtgaggaaagagttggttttgatcgacgtatgtaaacccctaaagaaagtgaaaagaatcaaaaagtctggaggtattttagttgaggttaacttcaagtatgaacgtttgggaatcttttgttacgtatgtggaatgatgtggcatgttgaagaatccggccagaaattcttggccatgaaagaggatgatggagcttga

SEQ ID NO: 4580 - DNA, 507 bp, Glycine max
  Peptide Sequence Number=SeqID_121358
atggcatccctgacagagaaacgaggtgtgactcctaggacatcctcaaacatatctcttccctttcttcactcctttggtgcatctttggggatttcaatgacctcctctctcaagatgacaaaattggctacaatgaacattcaaattggctcattcaaggattctgagaagcctttgttgatttttccaaattttcgtgtcttcaataccattgcctccaaatttgaccattcttccattcttctcaaacttcaccatttcacaaacaaaacctaccaaaagcaattttgctttaaaaattcctggttctcccaccatgatcttccacaaactgttgaacaaggatggtcaaatcccatacacaatgacctcatttcaaaactcaacaattgcttatttgagattaatactcggggatgtcaaattccaactgaatttgttagcaaattgatatacatcaaagaaagatggaaattctacgtgagtttcatgatgaggagttaa

SEQ ID NO: 4581 - DNA, 129 bp, Glycine max
  Peptide Sequence Number=SeqID_121359
atgagtgagataggaagatttggaggtttgggaatggaggaacgtcgcaaggaggaaggggctgcgcagggatttatggaaaatgtgatatttataaagcaggacacgtggccatctgttctattgtaa

SEQ ID NO: 4582 - DNA, 1001 bp, Glycine max
  Peptide Sequence Number=SeqID_121360
ttgagctctttgccgccgatccagcctcctatgacgccgccgcaatcggtaaaaacgacagcgtcttagtcaactatggtagactctcctgcggctccaagcagtgggggccgggattctccaacgactccgaccggttcggccggtcgtggcagtccgattcggactttcgaaccggccggagcaaggtccgcgccatgtcgacgcggagtcgcatcagcgggaccgaacagaagccgaattacttcccggagaagctgtaccagactgcggcgacggcggaggagggcggtggtgttctggagtacgaattgagcgtggacgcgaagcttgattacttggtgtggcttcattttgcagaaattgaagagagggtgagaagggtgggagaaagagtgtttgatgtgtatatcaacgatgataatttaactagggttgatatatacaagcaagttgggggttttgctgcgtttacatggcatcacactgtgaagaatttgagtagcagcgtgttgagtgtgaagctcgtgggtgtggtgggtgcgcctctgatttgtgggattgagaattacgctttggtgccgagtgatccttccactgttccggaacaagtggttgccatgaaagcattgaaagattcgctgcgggtacccgaaagaatgggttggaatggtgatccttgtgctcctactaattgggatgcttgggagggagttacctgccgtacgagtaagaataatactgctctggtgatcagtcaaattgatttgggcagtcaaggcttgaaagggtccataagtgatcaaattagtcttttgtcagatttggtaagcctgaatttgagttctaatttgttggtgggtgaaataccttctggacttggtcaaaaatccttgatacacctgtaccaatttggtgctactataagggacttgtccaacaatcagttaacaggccccataccagatagtatggcctcttcaagtttgcagcttgtgtaa

SEQ ID NO: 4583 - DNA, 1575 bp, Glycine max
  Peptide Sequence Number=SeqID_121361
atgccaagtagccagaaaaattttcattactctcatctatctcagcaacctgccttgctgtctgaaatgtctggccatgttggacttccccctacagttacaaccaatccactttctgcttctggtggaagtatactgactggcgtggggcaatcggtaattactgatgatgttccatcttgttccacttcaccttccacaaataaccgtgccagtgtacttcctccggtggtaagttcccagatccataggagcacaacaataggggatgacatggctcagtctgctgtcacgatctcgggtgcaagtaccctagaaaccatgtcatctaatgcaaacattgtccagccgaagtatgaagtaaaggcttctttaaatatttcaaaaaatcagaatcaagggaatgttgcccctcagacatacttgaatggtgttgttcagacagactatttggattcatcatcttctacaacatcactttaccattttcggagtgatactcatatgcatcagaataccaacccattttcttacaatccacagttggtttattgtagagacaatagtcaaaatgttgaagttcaggctgatgctaggaacaatgttctgattggcaataacgttaatggccaaatgggaatgccatcgaatctagattctcttttaaccaaaggcacagtggggctggggaaggagttgtctaataaatttgcctccggaggcttgcttagagacttagaaaataacaaaggtgttccgccagaaatttcatcttcaatggtttcacagacatttgaagtccctgatatgagcttcaattcaattgattctacaatagatggtagtagcttcttgaataggggtccatgggatctgccaccaccacctccaccacaacaacaacaggttcaacggattagaacatacaccaaggtatataaacgtggagctgtgggaaggtccatagacataacacgatattcaggttacgaggaccttaaacaggatctggctcttaggtttggtattgagggacagctggaggatctacaaaggattggttggaaacttgtatatgtagatcacgagaatgatgttttacttgtgggagatgacccttgggaggagtttgttaactgtgtccgctgcattaaaatactttctcctcaagaagttcaacaaatgagcttggatggagattttggcaatggtggccttccatatccagcaggcagcagctctgatggacatattcatcagtgttgtccaaaaggttgtggggtcggtcggcagatgattttgtcctgctgcagcaggctgggtaatatttgcggttataacttattaggagaaatttgtctctgccatgtacaggcgaatttgaagagccaaaagaagaaaaaggtggaaaaatttgctgccctcaatctacgacttacatttaaggttgttaacctggtgatgaatgagatacttggaccacacgcacatggcacatcccaacaaagatgtgttaagccatatgcatgtgatgacgttgaaaagttgagcagaagttctcttggcagcgtttga

SEQ ID NO: 4584 - DNA, 225 bp, Glycine max
  Peptide Sequence Number=SeqID_121362
atgtttggggagagaacaagcgcgatgtcacctttggagctcgctgtaggagaggcggtggccggtggcggagtcgataatggcagtggaggagtccgaaaacagcaagttgcagcggaggcagaggatgaaggaggcgacagatatggaagcgttgggaagagggaggcggagcgggggattaaggctgtggaaggttctggaatcgcggagaagataagataa

SEQ ID NO: 4585 - DNA, 864 bp, Glycine max
  Peptide Sequence Number=SeqID_121363
atgggtacaatcataggtgtcagtgatctggattctgtgagatggaaaaattcactatggcgtaatttgcaggttggttgggatgaatcaactgctgaggaaaggcaaagtagggtctcagtctgggaaattgaacctgtgactactccatatttcatctgcccgcctcctttcttcagatccaagatacctagactactgggaatgccagatgatgagcctgatttcaacaaccttttcaagagtacagttccctggcttggtgatgatatgtgcgtaaagggtccccaagctctccctggcttgagcttagttcaatggatgaacatacagcaaaatcctgctcttgctagctcattgcagccaaattgtgggccttccatgtctggattggttctgcaaaatcttcctggtgcagatattgcaaatccgctggggttttctacctcacaaatctctcaatcaaacaatgtatctgtcgatgctcagaatatacttcagacttcccagcaactcgatcacattcagaagccaccatgcccatccagtgcattgggagcagtcacacagccgctgcagcagttgggtgatatcactcaacaaccaaggaacttgacaaatcaaactttaccacacgatcaagctcacacccaacttctgaatccccagagagttgtccaaactaacaatattcatcaacagcaacaatcgtccattcaaaagcaacaactgcttagaagcttgtctcagaaccgagctcagaagcatcaacaaactacattgggtttgaatgaacggcaaattgtgtttcaatcccctatgcccgatcattttaatcaacaattacaaatgtctgacaatcag

SEQ ID NO: 4586 - DNA, 180 bp, Glycine max
  Peptide Sequence Number=SeqID_121364
atgaatctgaggttcgttttcaaaaaactcgacgcggcaagcctagatctaaactcaaaacggacagaatcctacccttttctttcgtgtttggctgggctaaaatggttttgggctggtggtggcctgagggaggctgtgttggtggtttgtggtgacttggctattccggcattctga

SEQ ID NO: 4587 - DNA, 960 bp, Glycine max
  Peptide Sequence Number=SeqID_121365
atgaaggcgcaaccaccagacggtgccgccgccgtcgcacccaacgccggcgaaggaggagagaagaaaaccataaacgctgagctatggcaagcttgtgcggggccgcttctcaacctgccttcgcctggaactcacgtcgtttacttccctcaaggccacagcgaacaggtagcagcgtctttgaagaaagacgtggatgctcaagtcccgaactataccaatctcccctccaagataccctgtcttcttcacaatgtcacgctgcatgcagatccagacacggatgaagtatatgctcagatgacacttcagccggttccttcttttgacacggatgcgttgttaagatcggatatctttctcaggtcgagtaagccacaacctgagtttttctgtaaacaactgacggcaagtgatacgagtacccatggaggtttctctgtaccccgccgtgctgcagagaagattttccctcctcttgattactctgtgcaacctcctgcccaagaacttgtagcccgggatttgcatgataatgtttggagattccgccatatatatcgtggacaaccaaaacgacacttgcttacgactggatggagtctatttatcggtggaaaaaggcttttagctggtgactctgttttgtttgtaagagatgaaaagcagcagcttcttttgggtataagacgagctaataggcaaccctccaatttatcatcttcggtactatcaagtgatagtatgcacattggagttcttgctgcagctgctcaagctgttgcaaacaatagtcccttcaccgtgttctataatcctagggctagtccctcagaatttgttattcctttagccaagtactccaaggcagtgtatagccaccatatatcacctggtatgcgcttccgaatgatgtttgaaactgaagactcaggaacaagaaggaaatggaaatag

SEQ ID NO: 4588 - DNA, 414 bp, Glycine max
  Peptide Sequence Number=SeqID_121366
atgaaaccgtgtttaagattttatctcttggagcgtgatactgccttcaatcacatactccaacaatcacaagttaggcctctaccaagtccacacgatcatctcacgatcgagaaagggaaagcaatgctagttgcgcctttgggaaggtctttcacggttagggtttttcatgcacacaaaggtggcaaaatatgttgggttaacattcatgaatggtatgccaaggaaaggttagagtcacattgcgagaagtttcgcgctgatgctaaaggtttaaagtttgggaaggtttgggatagggagagtaggagtatggtggggtcgcaaatgggttgcgaaggtaagcatgatatcggtactctgttgcacacaatagaagttgccatggatggtatgagaaggaaaggttga

SEQ ID NO: 4589 - DNA, 402 bp, Glycine max
  misc_feature (271)..(271): n is a, c, g, or t
  Peptide Sequence Number=SeqID_121367
atgagaagacattgccacaaagacgataactttaaaagagaaagtgaggagggaaattacatcaaaaaaatatttgaaatcccaatgcaaagatcggagaagatacaatttaataacaattttaacatgtttggtgggtctcataatttattctcctatttcgcttctacgcatatttacaaggataaagtgatccaattggctagaccaaatgttgttcattgtggtggaaagcgtaaagtagcaatatttgcaagtgatcacagtgaanatttgcataagaaagccaagcaagaatggagttgggagttgtgtcacattactacaacaagtaaaaaatgcttgattgatcatattcagggaaaaaagcatatagctgagacatccatgggaactaaatga

SEQ ID NO: 4590 - DNA, 186 bp, Glycine max
  Peptide Sequence Number=SeqID_121368
atggcgatcaatcaaacgctggaattcgttgaattcggacgaaagttaagtgttgtggcggtctgtgaagaaagtgtgaaaggagaaaaatggaagggaaagagaagagtgattggatatagatcccactctatcagatcaacggcaattacttcctctacctcccatattgattcatgcatctaa

SEQ ID NO: 4591 - DNA, 393 bp, Glycine max
  Peptide Sequence Number=SeqID_121369
atggagcacagatatgcttatccctggtggaaagaaaaaataattaattctgatttgaaaagaaaagatggtttatgccctctaacacctgaggagaccgcccttacacttaaggctcttgacattgatcagaacattcaaaactacactacagctgggaaaatatattcaggggaaaggagaatggcaagtcttgcaaaggagtacccaaaattggtaaacatcaatactcaaggcagagaagaaacaattaagaagctgaaaattcttgctaagcactgcaaactacagcctctcttgcaaatgctttatagacagcatccaaagtgggaaaaacttgacttgctcagaatagagaggcagctaggaaaagcaggcttaggaaaaaggtaa

SEQ ID NO: 4592 - DNA, 351 bp, Glycine max
  Peptide Sequence Number=SeqID_121370
atggaagactatgatagttacatagcacagagtgatagaggtgaaaatggagtgatagtggcatcgcgtgctttcccgcacgacgaatttcgcccccgtggtggaaaagtactgtcgcgagttgctgctgttgcggctgcaagaaatggttcttcgacttcaagttacgatatagctgtgacgaggaatgttaagaaaaagcaaaagcgtaagggtcttcgggaactgtttacaaccgattacattgtgaacagcgtgttacggaaggatggtcctacacttggtcaggaatttgattttcttccttcagatagttgtggaaccatggtattagataggggcaaaaggtag

SEQ ID NO: 4593 - DNA, 626 bp, Glycine max
  Peptide Sequence Number=SeqID_121371
atgccgcctcttattccgcctcctttgtctagtggcgacgaggttttcgatgatgtcatcaatcagatgatccaaactctggttcagttgatgagaactctggagaaaattccagaagagaaagtgagtggtattagaataataccgaatggagaaatagcattgaggaaaatgtcgatgataatcagctcaataatacagcaaatgagtggcctaacaacggtttgggaaaacaaggatggagaaaactctcgtctgcaagaatctcatgaagtgtggcaagaagatggtggcttccaagaggctgtggaaaattggttgggaggaccttctgatcatgaaagtgctccagttggtagaattcgtggattttattttcttgaagatgacaacgtgtacagtgttgaactcagggaacttcttaataggcaaggtcatgctaacattaactgggaattgcaagaaacaactatttcttctgcctcagtagagcaggaccttgagcagcatagtagggatcaaattgttggtcaggaggaggttactgttagtccacttaacctgccctctttacctataccacctcctttgcctatttgggacctgcaccaccatcgtgacaactg

SEQ ID NO: 4594 - DNA, 132 bp, Glycine max
  Peptide Sequence Number=SeqID_121372
atgaagctcctctactatgatgatgtgacgccagctgattatgaccctcctttcttcaagggatgcactaatgaagaagcaactatgacgtgtctacatgttgggttctccactccattggatcagatttaa

SEQ ID NO: 4595 - DNA, 1758 bp, Glycine max
  Peptide Sequence Number=SeqID_121373
atgaattgggttcgcggagagtctctcggcagtggcagtttcgccaccgtcaacatagccataccgacaaacacttccactcagtttctttcttccaccgccgtcaaatcctcccatgttcaaacctcgtctatgctgaaaaacgagaaggaaatactcgatcgccttggagcttccccttatgtcattaactgtttcggcgacgatcacacggtagaaaacggagaagagtattacaacattttcctcgaatacgccgcaggtggttctctcgctgatcaggtaaaaaaacacggagggaggctcccggagtcttacgttcggcgttgtacgaggtcgctcgtcgaaggtctaaaacatattcacgacaacggttatgttcactgcgatgtgaagcttcaaaacattctcgttttccagaatggggatgttaaaatcgcggattttgggcttgcaaaggagaaaggggagaaaccggggaaattggagtgcaggggaacaccgctgtttatgtctccggaatcggtgaacgacaatgagtatgaatctccggcggatatatgggcccttggctgcgccgtcgtggagatggtgacgggaaaacccgcatgggatgttcgcgggtcgaatatctggtcgttgttgattcgaattggagcgggagaagaattgccgaagattccagaagagttatcagaagagggaaaagattttcttttgaagtgtttcgttaaggatccaatgaagaggtggagcgctgagatgcttttgaatcaccctttcgtcaacggtgaaaccgtttcgtttcagaaagttaatgagccgttgccgttaccgtcgccgtcaccgtctccgaggacacactttgatttaactcactgggcttccaccttaacggcgtcgcttccgtcttccccggattctgatgagtggcgtatgtgggaattcgggtcgtcgtgttcgccggagaatagactccggcggcttgtaaccgttcagacgccggcgaattggtcagaatcggatggctggacaagcattagcattacagattggaagtcgcttgagaagatgtcttgcaaaccatttaagccttccattttgcatttggcaatatcaaaagatgcaccccagttatatcgcgaagaagagttgattcaattaaagaatttcagcaatctactttcaagtgttgaatcgaagccaaagactcacaatactggtcagatgatgaccagaaaaagacaaattgaagagatgcctaaagaggaaagagtcacgccagcaatgattaaaaaaccaagaagcataatcttggtacagaacagaccatcaccagatttgcctgcagaattcaagaatcgagtctctgagttgagtggtcatgatcttaaatttctcatgcacaagagactcttctgctcagatgtgaagccgaatagcaaccgtttgtcaatgcccataaatgaaattaagtgtgaattcctcaccgaagctgagattactaaattggatgaaagagatggtccgaatggtaaaggacgacttgttggtgtggaggtgactgtgctggacccatgcctgagagaatttactttaccgttgaagaagtggagcatgcaaaggactgacacctacaacctcgtaacaaattggaatagcatcgtatctactaataagtttgaagaagatcaagaactccaaatttggtcttttagggttgggaacaagctttatcttatactaaacaaactgtga

SEQ ID NO: 4596 - DNA, 1203 bp, Glycine max
  Peptide Sequence Number=SeqID_121374
atgaggttcaagcggttcatggacttgtccgaatcagcgacctcctatgactcgggggctctgaaatcctcagcagagctctccatggagaaactgcaaagagaagaaagggatttgtggaggcaccactactccgacttccgcaattgctcctacgactacaaggctattgggagagaggccatagcgagagaaaaccctgtcgtgaaggccacgaagatcgtcaagggttcgttgccccgttgcagcctggtgaacaacgatcgcttccgcttcaacctcggtgtagctctcgccgttggctcaatccagttgcatctcatcatcctggagcttctcaacatgaatgactttggcgtcgtagtggacagggcgtcgacggcgctgaatctattgtcggtggcgctggaactcctcttcgaggagtgcgtggacggagcaggaagagaagcgaatgaagactcatgcgaaccgatgctgcaaggattgatttcctcgtcgatgaacaattacagcaacactgcgttcgtgaaggctttcgtagggaagattctttgggatctatcgttgagagagaccgtgaagagagtgttggaaaaggtgttcaggatgagcttgaatacagtgaatgagtcattggaggattattcgagtccaatgttcagaggggatcagaacgagacggagactattcaaaggctgaatctgcacaaggcttcaacaaataggaagcatcttctgtggctggtggaaaggatgattgagcttagggttgtcgatgtcgcagtcagggaatggagcgagcaagttgacttcactgttgatttgcttgccaatgctgtctctgttggcaccattcttgcttctagacaagtaatgaatgaactttattattctacaagcgagaagcaagctcgtagaagattagctgctgatactggtttcaggtgctatgaagaacttgttaaagttggtggtgacttgagtgaaattcaaatggatgggcataatgagcatggacttgattcgttacctcaagaggagtttctgagccttttaggtagtgcaaggactagcccaccagttcatcaatttctcgttaacactcttggagaagtgggtgttaagcgtatttcaaatgttctctccggtgcaggcaaagaacttgaacgtattgtcttggaccacctccaggtgcaataa

SEQ ID NO: 4597 - DNA, 327 bp, Glycine max
  Peptide Sequence Number=SeqID_121375
atggggtatgctcatgagcctgaaatctatcctaaggctcatgagaaccctagggccttctcttgtatctttggcccaatcttcttggagtcttctatccaatgccattgggaggtgggaggactcgaagatagcctgcccggcggcgtccgagtcagtgacgcgggcgaggaggccacgggacttcttgaagcagggggtggggaggttgtcgcacaagggccgaacaaggaggaggatgaaggagccgtgatcgtgagatcggagcttcacgagcatctggagaaggatctgaacgaaaattcgcatccaagaaggaaaacctaa

SEQ ID NO: 4598 - DNA, 249 bp, Glycine max
  Peptide Sequence Number=SeqID_121376
atgtcacatttttatgatgtctatattttcagaatgaatggtggccaatggtcaacttcaagcagacattatcttcttgatttgttgagagtaactcctcgtgatgccaactatattggacctggttcccgattttgtatcttgagaccagaattaattactgcctattgccaggcccaagcagcagaggcattgaaatctaaggagaagaattttcaagaggcagacaatttggccactgaatcctga

SEQ ID NO: 4599 - DNA, 294 bp, Glycine max
  Peptide Sequence Number=SeqID_121377
atggtgtggcgtctcctctctctctcttccttctgtattctgctgccattcatcttccaagaagcaaaagaatccattgatgaagaagatcttaggcctacaagctccaatggagcttacatcaccaccattgttatgctgccctcggccaggcagctcgacgtgctagcgcatgctaagggcttcgtcgaggacgtggacaagttcatagaggccatggattggatctccggtggcgggttcctctgtagggaggaggctgagctcggcgagggctgggtggagttgcattga

SEQ ID NO: 4600 - DNA, 864 bp, Glycine max
  Peptide Sequence Number=SeqID_121378
atggcgttatccctactaatccactgttctcccaccgttaaccctctccgacgatccccaaaacccaccctccgccgcgtcaaccaccgcgtctgcgtggccagcgccgccactcccctcctccaagttaatgacttgagggccaagattgtcgaatccaacgtcgacattctccacggcgtcaacctcaccgtcaaccaaggagaggtccacgccatcatgggaaaaaacggttccggcaaaagcacttttgccaaggttcttgtggggcacccagattatgaagtaaccggaggcagtgttgttttcaaaggtgagaatttgcttgagatggaacctgaagaaaggtctcttgcgggtctcttcatgagttttcaatcccctgttgaaatccccggtgtttccaatgatctatttctcgccatggcctacaatgctcgaatgaaaaaacttggtcgagaagaggttggaccaatcgagtttttaccttacctgatggagaagcttcagcttgttaacatgaaggctgactttctcaataggaatgtgaccaagggttcagtggcggtgaacgcaagcgcaatgaaatcttgcagcttgcgggatgttgcgaatgcagttaataggattctcaccccagaaaagtccttgttgatgataactcattatagacggattctggatcttttgaatcctacacatgtccatgttatggtgctagtcctatcaattcaagtgaaggatgagcttgaagaagtagatttcctaaagaaagacaaagggaaaattgcaaggacaggcgacatatcagtggtagaagctattgagtcagatggatatgaagcagtctctgctttaacataa

SEQ ID NO: 4601 - DNA, 294 bp, Glycine max
  Peptide Sequence Number=SeqID_121379
atggatgttgaggtagagattgatcgcttgccaattgacctgttggcttatatttttgttctgttcacttccttcactgatttggcacaggcaagtggtgtttgcaagaaatggaaacaaggggtgaaggagtctcttgctcggagacacaatctcagctttgccggttggaagatggatgacgactccacttctcgccttgtttttcatgcctacaacctcactaaactagacatgtatgctgttgtaacaatagtttatgacaaatcgaaaaaattactggctgagtcgtga

SEQ ID NO: 4602 - DNA, 3000 bp, Glycine max
  Peptide Sequence Number=SeqID_121380
atgacagtttggagggaaacaaatcctgatgctggagaccttccatttggttttggcgtttctggccaagaagttcctctaatctcaaattctataggacagaaaccagtccgtaagaacaacaggtcatggaaaaccgtaaacaggaatggaatgccaaaaaataaaacgcagaataagagaaataagtcgcaggacaagaggaaacttaccatgcaaagaagagtgggggaattgaacctaaatgtgactcagaatcagtcaccaaaggaaaaatgtgaactagctttggatagtgcaatatctgaggagggggttgatcgattttcaatgttatttgatgatgaagagctagagctgagggagttacaagaaggaaccaatctgtttatgtgttctgatcatcttgctggcagtggaatggttggctgctcactttgtaaagatgtgctagtgaagtttccggcagatattgtcaagatgaagaaacctatccatttgcaaccttgggactcgtctccggaaattgtgaagaaattatttaagtattatatggtgacagacccaaaatccagcatagcttcttgtggattgcatactggtcaatgcagaggaaaggttgccatgctagaaaaaatctcaaccttcccatcaccatctcattctctgcctccttttgaaagttccattgcagccatggataaaaaggttttccacttcatttatacatatgctataattgttgatatttgcccgttcactcttgatgagtttgttcaagcatttcatgataaggactcaatgttacttggcaagattcatgtggcccttctcacacttcttctatccgacattgaagtggagattactaatgggttttcacctcatttaaataaatcgtgtaactttcttgcattgcttcactcggttgaaagtcaagaatattccctggacttctggagaagatctttaaattctcttacttggattgaaatactccgtcaagtgctggttgcttctggatttggttcaaaacaaggttccttacgtagagaggtccttaacaaggaattgaatcttcttgtaaactatggtctatgccctggcaccttgaagagtgagttgtttaacatcttgtcagagagaggaaacattggatgcaaagtagctgagatggcaaagtcaatgcagattgctgaattaaaccttgcgagcacaacagagggactcgagtctttaatatgttccacgctttcaagtgatattactttatttgaaaagatttcatcaactgcataccgattgcgtatgagcagtgttacgaaggatggtgacgaatctgattcagatacagaggactctggtagtgttgatgatgaatttaatgttgctgatacatgtagcagtggtgatgattttgaaagtgattcaataaactccagtaaaagaaaattgaagcgtgcaaacagtcataaaaataatatgctgaaagtatacactgaaattgatgagagccatccaggagaagcgtggttattaggactgatggagagtgaatattcagacttgaacattgaagaaaaattgaatgcattggcatctttaactgatcttgtttcatctggatctagcatcaggatgaaggattcaaccaaagttacagctgattgcaattctggcatccaattacgagggtctggagctaaaataaagagatcagcagtaaagaaacctgggccactttggaaccagaaagtacacttgaattctgatccctgtgcagttgattcctcatcattaatctcaagattccatactcatgaagcttcctttggaaagggaaaagtttcctttatttcacaccccattcaatcagtgtttttgggatctgatcgtcggtacaatagatactggcttttcttgggtccttgtaatgtagatgatccaggccacaggaggatatactttgaatcttctgaagatggtcactgggaggttattgatactgaggaggccttgtgtgccttgttgtcagttctggatgatagaggaaaaagggaggctcttcttattgaatctttggaaaggagacggacatcactatgcagatctatgtccaggattaatgctaatagtactggaatgggttctatgtcacattctgatcaatctgaactggatatggtcaaagatgacagttattctcccgcatctgatgtagacaacctgaacctgactgagactgcagaagactcgctgccgtctgctggggctgtggtaattgaagctggaaagaaaggagaggaacaaattcaaaaatggatccgtgttcaagaatatgattcttggatttggaattccttttatttagatctcaatgttgtaaaatatggtaaaaggtcttatctggactctcttgccagatgtaagagttgtcatgatctatactggagagatgagagacactgtaaaatttgccatatgacatttgagcttgattttgatctagaagaaagatatgcaatccacatagccacatgcagggagaaagaagacagcaatacatttcctgatcataaagtgctatcatcacagattcaatcactgaaagctgcagtttatgctattgagtctgttatgcctgaagatgccatggttggtgcttggaggaaatctgctcataagctatgggtaaaacggctcagacgcacctcaactttagtggagcttttgcaggttcttactgattttgttggtgccatcaataaggattggttgtatcaatgcaaatttctggatggggtggttgaagaaatcattgcatcttttgcatctatgccccatacaccatctgcccttgctctgtggtcaacatggtgcttggcgataggtgcacttttacgtttgttgaagggcatgcgaattgaaatgaaggaactacctgttccgctccttgatcagagattcatgtgctggcttcacttggttctgaatttctag

SEQ ID NO: 4603 - DNA, 117 bp, Glycine max
  Peptide Sequence Number=SeqID_121381
atggacgaatgtgagggagagtacgctgatatcgatgatcccatggatttcattggcaaagagtttctacaattgttgtgcaagaacaatgattttggttgctttgtgaatcaatag

SEQ ID NO: 4604 - DNA, 324 bp, Glycine max
  Peptide Sequence Number=SeqID_121382
atgggcagcgagggcgtgccgtcgatggtggtggaggtcatgtcgatggccaccgtcgagctcactgacgcctccagctggtggcacaaaattgatgactctccagcgtggcaggatcgtatttcctacactctcgttgtactctacggttcaactggcttggatacaattgagagtggtctttcaccttatcaatattttggtgaatggggttcggtgtgtagtttttatcttctatcagaacgtgcagaggttgaagctagaggtgaaaattctactgtttacaaagttgatgtatgtgatcaactattgaatgatgtttga

SEQ ID NO: 4605 - DNA, 644 bp, Glycine max
  Peptide Sequence Number=SeqID_121383
atggtgaatcaagggcaatggaggtcccatcctggaaaccagtttaacaaggaccaaggtgaaccatctaacaggcctcagaaccaagagattagcctttatgaaagaacaaccaagttggaggagactttggcgcaatttatgcagatcacaatgtcaaaccataagagcaccgagtctggcatcaaaaaccttgaaatctacgtgggccaattggcaaaacagatagttgacaattcttctagcacttttggagcaaacactaagaagaatccaaaagaagaatgcaaggctatcatgacccgaagcagaaaggcaaccatgatggaaaatgaggggacgattagtgataacaaaaaaagaggaaaaagaaaaagaaaaaaaaatgagaaaaatagagaaaaagagggagaaagaaagaccaagagtgagcttgcacgtgaaaagaagaaagaggttgttccatgctcagggaaagaagttccatatcctttggtaccatcaaagaaggataaggagcgacacttagctcgattcattgacatcttaaagaaattgaagatagccattccgtttggagaagccctacagcagatgccactttattcaaagtttctgaatgatctgttaaccaagaggagcaa

SEQ ID NO: 4606 - DNA, 213 bp, Glycine max
  Peptide Sequence Number=SeqID_121384
atgaaggttgtaacagatggagtctcgctaagcgaggcatatgcgcttatgagccttcagaatcagaaagccctttttaaggctgaagttggaaaaaaggaagaagtagaatatgagagagagcgtgagagactcagcagaggcgaaaaaaagagcaagagacccaaagccctcaactttcaagaggattctaggtttaggagtgatttctag

SEQ ID NO: 4607 - DNA, 1044 bp, Glycine max
  Peptide Sequence Number=SeqID_121385
atggcctcaaggaagaggaaatctaccgcctcccggacccaggagccttatgacaccaccagtttcatctctgaggctgcctatgagagatactcacaacacattcactcccggaacatccttctagagaggaacattaatttatttgttacagaatacgacgagtttcgcagggagctcgtgaggaggaactggcacagggccttgacccagcatcctgatggtcacatagatgtggccctggtcaaggaattctactcgaacctctatgatctcgaagaaaaatctccgaggcagccaggggagagatacatagcatatactaggttctacaatacgcgcccagaccctcaggagcttgtctccaagctctatattccagggcgtagctttgttcttaacgctgatggagcgccctggaagctcttgaggaaggatctgaccactctggcatggatatggatgtgggctcattcatctctggacagattcattgcttatcactgccctatcactcctccaggcttggattttcgacacttatcactaccctatgcatcacctagggagttgttcaagatttgtcgacattcgagtcatggctcggggaccatcaaatcttctgctcctttctcctcaactccagtccattctacttctgcttctccagctccagctcccactccagcttcagtacttgtcagcacctctgctcaaagctcagacattatagtgccgatgctacaaagcctccaccagggcttatgcctggtggcttggccaagagtccagccttctcctttggggggaggtgaggcttctacaacccaggagcctcagccacagttacagccgggggtcatgcaagaggccacaccagagactactccacaggatgaagaaggcaccgaagtcacggactatgcagctgacatggcagcagcgcagagcacctgggatccctggcccgatatagctcaggagacatctcagccagcccaggatgctccctcctcaccccaggatgagcatgcaccagcgtag

SEQ ID NO: 4608 - DNA, 2709 bp, Glycine max
  Peptide Sequence Number=SeqID_121386
atgcaacacaaaatcttcgccacaatgcgtagcttgaagatcatggatggttgcaagggcactcaggtctacgccatcaacccctccggcgccggtggcgccgacggcccaaccggcggtggaatcggcgagaagcttctccaacagctccacgaccacatcaaaggccaaaccctaagaaccaaatcggttcggaacttgcaagctacgaaccatacgacgccgtcggaggttgtcctctccgacggctcgctccttccttatggcctctccatgacggaccttctggagcccaaaattgagccttccttgatgtcggtggacttcgtcgaaactctcgccggagtccaccgccgcacaggggactgcccccagttcgaccgctccgaggtctacctggagcaatgcgcggtgtttcaggggctggccgatccgaagctcttccgccgcagcctccgtgccgcccggcagcacgccgtccacgtgcacgccaaggtcgtgcttgcggcgtggttgcgccacgagcggcgcgaggacgagctcatcggctcatcctcgagcgactgcagtgggaggaaccttgagtgcccccgcgccacgctgactccgggctatgacccagagtcggtgtttgattcctgcgcgtgcacgcgtgcacacgcagggaatcgtgatattgatgatgatgcaatgacaatagtggttgatgagcaatgctccacctcggaggaggaggaggaggaggaggaggaggatggtgacatgtctttttttgttggtgatgatgagattaagtgtaataggttcaatatagcctcactttcaaggccctttaagacaatgttgtatggtggattcgtagagtcattgaaggagaagataaatttttcagggaattgtttttctgttgaggcattgagggctgctgatgtgttcagtaggactaagaggttgagccatttggagcccagggttgttttagagttgctatctttggcgaaccggttttgttgcgatgagatgaagaacgcttgtgatgtgcatttggcgtcgctggtttgtgacatagatgatgccttgttgcttgtggagtatggattggaggagactgcatatctgcttgtggcggcttgcttgcaggtgtttctccgggagcttcccggttcattgcagagttcgagtgttgtgaagatgttttgtagtccagagggtagggataggctggctctggcagggcacgtgtcgtttgtgttgtattattttttgagtcagattgccatggaggaagagatgaggtcgaacaccactgtgatgctgttggagaggttagtggagtgcgcaaccgatggttgggagaagcaaattgcgtttcacctattgggtgttgttatgcttgagagaaaagaatataaggatgcacaacattggtttcaggcagcggtagatgcagggcatgtttattctttagtgggagttgcaagggcaaaatataagcgtggtcacacgtattcagcatataagttgatgaactcacttatttctgatcataaaccggttgggtggatgtatcaggaaaggtctttgtattgtgttgggaaggagaaattgatggacttgatgtctgcaactgagttagatccaactctttcctttccttataaattccgggctgtttcttttctgcaggaaaacaagattggacctgccattgcagaaatcaacaaaataatcggtttcagggtttctccagactgcctagaattgagagcttggttcttgattgccatggaagattatgaaggagccctcagggatgtccgggcaattttgacgttggatccaaattatatgatgttctatgggcatatgcatggtgatcagttggtagaacttctccaacctgctgttcagcagtggagtcaggctgattgctggatgcagttgtatgaccgatggtcctctgttgatgatattggttctttggctgttgtacaccagatgttagcaaatgacccggggaaaagtcttttacattttcggcaatctctccttctgctacggttgaattgtccaaagtctgcaatgcgtagtttgcggctggctagaaattattctacttctgatcatgaaaggcttgtctatgaaggatggatactgtatgacactggccatcgtgaagaagcattagcaaaggctgaggaatctatttctattcaaagatcatttgaagcttactttctcaaagcttatgcattagctgactcaaatcttgattcagagtcttcaaagtatgtgatcagtctcttggaggaagctcttagatgcccttcagatggtcttcggaaaggacaagcactgaataatttagggagtgtctacgtagactgtgataaactggaccttgctgctgactgctacatgaatgcactcaacatcaagcatactcgagcacatcaggggttggcacgtgtatatcatcttaaaaatcaccgcaaagcagcatatgatgagatgacaaagctaatagaaaaggcacggggtaatgcatcagcttatgagaagcgttcagaatattgtgaccgtgacatggcaaagagtgatcttggtatggcatcacaattggatcctctaaggacttatccttacagatacagggcagcaggacttagaaatgtttctataaactggtttgccagcataacttcatag

SEQ ID NO: 4609 - DNA, 498 bp, Glycine max
  Peptide Sequence Number=SeqID_121387
atggagcataaggcatattgggctttaaaatttttgaactttgatgaggttgcaccaagggaacagaggaagatacaactactggaactggaagaaataagattgactgcatatgagtcttcaaggctgtacaaagaaagagtgaaggtttaccatgataaaaagctactcaagaaggactttcgaccaagacaacaaatggtgttaatcaattcaagattgaagttgtttccaggaaaactcaaatctaaatggtctggaccatttacaatcaaggaagtcagaccatatggggcagtagagttgtttgatcctcagtcaaagactccagatagaacttgggtggtgaatgcgaatgattcttcatacgatgagcgagtcactactcgcgctaagcgcaccaacccctactcattggctgatggggtctcgttgagccagactctagcactaagcccaaaaacctctatggaattttatcttttggaattgggctaa

SEQ ID NO: 4610 - DNA, 313 bp, Glycine max
  Peptide Sequence Number=SeqID_121388
atggataggaaacgtcctagaaagttaaacttgaatgcacccctattgtcaacgaggcgtctcggtagtccaaatgttgcagatacttcttgctcatcatattcagttggtccaatccaaaatacaagtgaaagggttccattttcttgggagaaagcacctggcaagccaaaagaaactgagaggagtgataacacacaagatggcaacacacctcgcctaagactaccacccggccattggcttcctccgaaagaagcagctcaagaagatgttgatcgtggtgacgatgcatttcatgatcagggagatg

SEQ ID NO: 4611 - DNA, 425 bp, Glycine max
  Peptide Sequence Number=SeqID_121389
aggcgttagattatgtccaaaagaagtcagagaatgctcatagtaacaccaatgatggattgaggttaaagcttgcagagtctaatggataccaatctcctacttacatgatcaatcgctttcttcccgatgccactgctttggctgcatcatctgctttgcatttttctactaactttgaagagaaaggttgtgatacatgtaactatcaagagtgttatacaaggcattcatatgcttcttctccaaagggttgtggcttggaacttctcttcccgtggcgtatgaagcataaactttgttctatgaagagccctgtgttgccatgttctactaatctgcataagcatcagcgcaactccaaacagaagaaacaccgttcatcaacaacctacattccttgtacaaacatgaaagatatttga

SEQ ID NO: 4612 - DNA, 450 bp, Glycine max
  Peptide Sequence Number=SeqID_121390
atgtacaagaagatggaaataccaagagaaaggccaaaatcgtgctcatgttcactagttgtttttcaggagaatagacataaatttgggggcatgcctacttatgaactatgttcagcatcgataagaacgcgaagatggtcactctctgatcctcggagtgagcctgtggaacgacaacccaagctggtggatgacttgaaagaggtactcattggaggaaaattgaagcaaaaaactaagtttggtcgattagtgccgttgattgtggatgaagaattgattagatgtttagtatgcaataaagatatctttagctggaaagtgcgagtcatgttgagaataaaccccaagttcatttcccacaaactctctttgaactttgaagcaaggcctgtggcccagaaatggagaaagtttggggacgacaagagaagaccaataaaataa

SEQ ID NO: 4613 - DNA, 348 bp, Glycine max
  Peptide Sequence Number=SeqID_121391
atgttggtggcgactccgcgcatctttcctcctttgggaagcgcacctgtgagcctcgccctcgctcgcccgcgatgggcacgttgcgacatctatgcacatgcgccacttattgcttctcttcttaaccatgatagcattctccaaccaagtcggatactagacctctctgatgtagaagcaagcttcatgatgatgaaccaagcaattttgatgataccaaaagcccaagtgattgattcaagattgattcaagacttcaagatcaagcatcaagaatccaatccaagattcaagattcaagggaagaaatcaagaagcgacaagtcaagacttcatatagggtaa

SEQ ID NO: 4614 - DNA, 2034 bp, Glycine max
  Peptide Sequence Number=SeqID_121392
atggctccaaaaaatctctttggtctcctcatctttctcattctccttgttacttgcactgctttttccttccaattccatggcttccataatagtgaaagaaatctcacccgtgaaggggattcaaatgtcacaccccaaggtatacttcagctcaccaaaagagaaaacaacattgttggccatgcattttataacaaacccatcaaaatattagagaaaacaaattcttcagtgccccaaacaaaattttcctcctttagtacatgctttgttttctcaattgtgtcaccaaactctggccttggtggctttggtcttgccttcaccatagctcccacaacacaattcccagaggctgaaggtggccattttcttggtcttttcaacaactccaatgatatgaacacctcaaatcatatcttggtggttgaatttgacacagtgaatggctacaaagataacactgacactgtaggaaaccatgttggggtaaacataaatggcatgcaatcaaagatagctgagcctgcagcatactttgaagaaggcatggatgcaaaaaaggaagagttcagcatggagaaggaagatgctgtttgtgcttggattgaatatgatggtgaaacagaaatcttgaatgtcacaatagcccctttaaaggtatcaaaaccaagcaagccacttatatcccaggccattcatgacatcaagtttgttatgaaggaaaccatgttttttggtttctctgcatcaacaggtaagaggaaagcaagctctcattatattcttgggtggagtgtttcagtgaatgggggaattgcccctccactaaatttttcactccttccaaagccaccaccaaaggagaaagatgcatcatcttttccttgggtcaaggttgcagttgccatgttgtctgctttgacatttaccttgttgtgcctgttgtttattgtgacacgctacaagagatacatgatgtttgaaacccttgaggactgggagcttgattgtcctcataggttcagatatagagatcttcacatagcaacaaagggtttcatagagagccagctaattggagttggaggctttggtgctgtgtacaaaggtgtgttacctagcacaggaactgaagttgctgtcaaaagaatcatgagaagtccaatgcaagggatgagggaatttgcagctgagattgaaagcttaggaagattgaggcacaagaatttggtcaaccttcaagggtggtgcaagcacaagaatgatctaatcctaatttatgactacattccaaatggtagtcttgactctctcctattcaacgataacattgctttggattgggatcagagattcaatatcatcaaaggtgtagctgcagggttgttgtatcttcatgaagagtgggagcaagttgtgatccatagagatgtgaaatcaagcaatattctaatagatggcgagttcaatgctcgtttgggtgattttggactagctaggctttatagccatgatcaagtgtcacacacaacaagtgttgttggcaccattgggtatattgcaccagagttaactagaacaggaaaagcctctgcaagctctgatgtgtatgcatttggggtcctacttcttgaagtggttgctggcacaagacctgttggctcttcaggccagtttttgttggtggattgggttcttgagaattgccaactgggtcagattcttgaagtggttgatcctaagctaggttctgcttatgatgaggaggaaatggagttggtgctgaaattgggtctcttgtgttcacaatacaaagctgagtatagaccttctatgaaacaagtggctaggtacctaaactttgatgactctcttcctgatatctctgattggagatactatgattctcaaagcagcacaaatagcttaagtttcttagaagccatgtctacgggaaagattgcatcttcatacagtttatcttccattggcagcagaagtacactgccaataaaaaccggtagatag

SEQ ID NO: 4615 - DNA, 222 bp, Glycine max
  Peptide Sequence Number=SeqID_121393
atggcattgactctacgtgtcaacatctctgagaggctgataggaatattgggtactggcttgaacttcgggcgcgctcgcggcgactgcgaggatcgattctattctccggcgaaggctcgccgagcgcttcacaccatggagaatgacaagcttcgtagggtccacagtgatgtcaccgcatctcgctccgtcagagacaaatcgggtcgggtcggatga

SEQ ID NO: 4616 - DNA, 537 bp, Glycine max
  Peptide Sequence Number=SeqID_121394
atgagattacttcaaccctttcctgtccctatgtcaccatggacagacctttcaatggacttcatcactacccttccaccatcacaagggtacagtgtgattctagtcgttgttgaccgtttcacaaaaggaactcactttggtgctctaacctcttatttctcttctcataagctactcactaagtgcggcacgaatttacgaatgagcacctcgtatcattcccaaactaatcgcctgaatgaggttctcaactatacgctggagcaataccttcattgcttcatccatgaagcgcttaccaagtggttctcttacctttccctggtagaatggtattacaacacttctgtttattccttcataggcgtcacatcatttgaagccacttatgacaagccacctcctgcaattcctcagtacttattgggttcctccaacatggatgtcgtcgattacctcttgtcgtctcaacaggatctttgcaatattctccactatcgccttttaaagacccaaagagccatgaagatctag

SEQ ID NO: 4617 - DNA, 159 bp, Glycine max
  Peptide Sequence Number=SeqID_121395
atggtccttgactgtcacgacattcagtactcagtaatcaacatagaatcgttagctaccgaccttcttcttcaccaacagcacaggggaggaaaaagggttgtggctaatttggatgagaccagcgggtgtgaaaaaggtgagaataacattggatga

SEQ ID NO: 4618 - DNA, 744 bp, Glycine max
  Peptide Sequence Number=SeqID_121396
atggtagaatggcttatccctaccaccacacggtccttaagaggcttcttgggacttaccgggttttactgcaagttcatccgacaatatgcttccatcacagctctattaagaacactgcttcaaaaggataattttcattggactaatgacccatctgctgcttttattcgtctcaaacaagccatgacgcaggcaccaatgctggcattatcggattttgctactccttttacactcgagactgatgcttttggccatgctatgggcacagtcctcatccaacatggacacccactagcatttttcagtaaggtcttctgtccatgccttcaaagatcttcaacttatgttagggaacttcacgccatcaccacgactattcgtaaatggcgacaatatttgctaggacactcattcatcatccttacataccataagagtcttaaggacctcatgcgccaatacaagtctagcaagtccaatgtcatcgtagatgctttatctcgtctttcgttgatacccacagcctcatactttttcctatcgatacctcatttcaccttcctcgacgacctctatgactccttgaccagtagcagtctattccaaaaacaacacgagttggtcatgacatcccttgactcccatcctgaattcaccatgctactcccctcggaggtcacatgggtttcgcgaagacattacaccgtatccaacaaaacatctactggttcaccatga

SEQ ID NO: 4619 - DNA, 357 bp, Glycine max
  Peptide Sequence Number=SeqID_121397
atggagatacttgcacaagcttcttatggtgaggtcataaacaacataggagaacagagcagagaaaagacctgcatgggccaactacgagaccgtgacaccactctaaacggtgcatttgaggcgacgtacaatgaaatggcttctcgtcacagggtgttagtagttaaagcgttagaaaaatcaaagaagtctcgtgagaaagcttctcaaagaacctttgttaaccgttggatcttctcgaaatttggtcttcagcttcaaaagacacttgtccatgatcttaccgttgggatcttcgagaagatatctggagtgtgcgcgaagcttccgttcctgagagcatttctcacttga

SEQ ID NO: 4620 - DNA, 198 bp, Glycine max
  Peptide Sequence Number=SeqID_121398
atgctccaatcatgtgagatcgacacaggcttaaaggagcactcaaattggatgatccccaaggcttacactccgaagagtccgtcagggccactccctcctgattcagtgattaactcgtcgggttcctacagtgaatcacatcacaactcatcgcacattaactcattgcccttaaagggtcttgcagttgtgtga

SEQ ID NO: 4621 - DNA, 792 bp, Glycine max
  Peptide Sequence Number=SeqID_121399
atggtttttccaaaactagttatcaccattgcattgatattagtccttttcctcttcatatgtgaatctcagggtgcatcttatgcttctgcttcacataatgctggtcatggtgctgacattaatacatcacttgcacatcagaaagttaatctatcagtgtattatgatagtctttgcaaaacttgtgcaaaattcattattgaggatctgagggatatctttggcaacaacctcatcagcattgtcaatcttcagctagtgccttgggccaatgcttacgtcaataataccaacaaatccatatcatgtcagaatggaccagatgaatgcgagctaaattcattggaatcatgtgcccttaatctttggtctaaagtggacatacaatatcaatttgttaactgctttgagtttctggcaattaaaggaacgattaaggaatggaaggaagaatgtttaaaccaattgggtttgcctaaggagccttttctgaattgcttcaacatgggaaatgggacagagccgttgaaaaccgctgaaccaccagttctcacggttttacaccggtttcctgtccggttcgaggggttatccgaaccggatgacaaactgctagggaaaacttatattaatcaaatcgcacaacttgacccacctccttcatttgtgccatgggtggtggtgaataatcagcctgttgaaaaagactatgcaaattttgcacattatgtttgcaaggcttacagaggcgttgtggttccaggggtctgcaatactcttttgaaatga

SEQ ID NO: 4622 - DNA, 1572 bp, Glycine max
  Peptide Sequence Number=SeqID_121400
atgatgcaccctgaaattctcgaatcctcatcatggtcttcaatctacgaagtcaatagctcaactattggtcatcaatttgagcactatggctttgaagttgatgcccatgtgggtgtatcagtattcaattccttgttcaacactccagagaacacttcctcggaaacttccataaacactttaccttcaatcatgttcacaaatgaatatgatcattttttacactaccaaattgaaaaagacacccttcaactcccaaaattgatggacgtctatggtttgtctatggattgtgatgattttgatcccatcttaagggatcatcaagaaagtgaaggagattggagtcctaccccatctttggactcagatttatcatcaaatcaaaaagcacttaccttgcctcaacaaggcatggaaattgaaaaccaagtgagtcttccacacatgttggaggcccttggagaagccatatatcaagggaagaaagcactaaaagaagtgatcttgagatgcatgaggcagaaagttagtccactttatgaacctcttgagcgtgttgctttctatttgtgccaagacatggaaacaagacaagatgatttttatctcaaacaagaggcttccaagaactttgaggcagcgtttaaggccttctaccaaggcctcccacatggaaaagttgctcactttgtggctaatttggcaattcttgaggccttgccccatgattctgaagtcatacacatagtggattttgacatgggagaagggtctcaatggcctccattgattgagtccattgcaacccttcgcaaaacattgaagttgacagcaatcaaacggggagaggaaggttccgaggttgtttcctctccatggaaatttgaggaaattaaaagggtgcttcatgagcatgctagatctcgtgatttgaagttgatggtggaggagaaggaaatggaggaagtggttagtgagcttaagaaaattaacaaaagtgttggaagtggaaagagagatttttatgccttcaattgcatggtgggtcttcctcacatggggagagggagtagtagaaggcatgccacggagtttctaaatttgatcaagagttgtggaagcaggggaattgtcacttttggagatgcaagagtttgtgagaagttggaaaatgacttggaattcgtgtcattctttgagaggcatttgttgcattacaaggccttgttggagtcaattgaatcacatttcccaaaccatttcacagatgcaagaagtgccatggagtgcctatttgtggcaccaaatatctcttcccttgcttggttgcaaaagtgggaagagatcaaagaggagtcggagtcctattttcaggcagatattggcttagagggtttgagattgagcaatgcaattttaatggaagtcggagagatgttgagtggaagtgaacaaggttcatatcaagccaggattgaaggacagaatgacaatcaattgactttggaatggaaaggaacccctctagtaagagtttcaacttggagaaagatcaaaggccaatga

SEQ ID NO: 4623 - DNA, 216 bp, Glycine max
  Peptide Sequence Number=SeqID_121401
atgtcatcatcttcttcctcttctccaacggaaaccaccaccacctcccaacatgccatccaaccaccaccactgcaccatgggaacaatgggtgcaccacgggaacaataggtggtccttcttactatgtttcatcattgccctacattgtggttggagaagaggaagaaggtgatgacgtggcactgatatggaagcctgtgcttgcatggtaa

SEQ ID NO: 4624 - DNA, 465 bp, Glycine max
  Peptide Sequence Number=SeqID_121402
atggagttggttaaagttttgacaattttcacatctattgatttctcatccaaccattttgaaggacctataccaaaagatttaatgaatttcaaaacaatttgtgtcctcaactcgtcaaacaatgctttgtctggtgaaatttcatcatcgatagttaacctaaaagaacttgagtccttagacctttcacaaaactctttgagtggagaaattactatgcaacttgcaagtttgtcattcctttcttatttaaacctctccttcaatcatttggtgggaaagattcctacaggtaacgacaggctatacagcattgactggaaaaaaaatgatgggaaagagttaagggtaatgccacaacaagaatgtgcaaggttaacttgtacaattgattggaatttaatcactgtcgaattaggaatgatttttggccatggaattgtttttgcacactactcttga

SEQ ID NO: 4625 - DNA, 579 bp, Glycine max
  Peptide Sequence Number=SeqID_121403
atgaagctgatcgctgattccaaatgccgggatgccatgtttaacagaggggattgggtcatggtcaaactccgaccttatcgccagtccatagtcacgggggtgagaggcggatattcgaaattggctaagcggttctatggcccattccaaatcgtggagcgtattggcccgatggcttacaagctgctattactggaaggagcatgcatacaccctgtttttcattgctcattgcttaagccttttcatgacactccgggtggggaccctcaattaccattaccctctaccgtcgtagctaatcagccccttattgctagtttagccattttggatactcgacactcttctgattcaactgcctccaaatgggaagtgctagtccaatgggatgggttgtttcttgatgacacctcttgggaggattgggagcagctgcgttctgactatcaccttgaggataaggtgttttcgaaagcggaaggggatgatagcaatcagggggtgcaagcagcaacaagaaacaggcccaagaggaacactacagtaccaacgtacctgagagattttgtctga

SEQ ID NO: 4626 - DNA, 255 bp, Glycine max
  Peptide Sequence Number=SeqID_121404
atggagttgaatgatttactgaagaaggcaatggggtgcccattttgcaacagggtagctcccattccaatgttggaggtgtccgtttcaaccgtaaagggaagctcaaagtcgggcattgtgggctttaggggaccattgaaacgagtcaagtgttgttgccttaatgaggggtgctacaatcaaagcatacccgcgaatgaatcagcggtagaagcccgccagacccaagaaactgtggagggctctggttga

SEQ ID NO: 4627 - DNA, 399 bp, Glycine max
  Peptide Sequence Number=SeqID_121405
atgaagatgagaccttacctgacaaacaacagttccatcaggtgcaatccaagcattgccccaagggaccaatctgagcacaatagggacataaactttcataatagagtgacacggttaccttttcatttggagcacctgaagaagaaggtgccaccaagagcaagagcaagagcaagagtggaaggagaaggaagcaacagaagaagaatgaacgaggaggaaaagaatgaagaaaaggaggcattttcatctttgtgctttggaaatggtagagaagaatcaaagagtttgattactagttgtgtgattcataggctgttgaaggaaggtatcttcttccctctcattgtctcaacttgctcctgcaaagtgccaatgtcacttttgatcttttga

SEQ ID NO: 4628 - DNA, 141 bp, Glycine max
  Peptide Sequence Number=SeqID_121406
ggtggtggtgacaaggactacaaggaggtacccccacctcctttgtttaaacctgcagggggacacatcaaccaagctgtgaccttcaatagatcttattacaaggtaatcagttcaatggaaaaatggttgagtcattag

SEQ ID NO: 4629 - DNA, 264 bp, Glycine max
  Peptide Sequence Number=SeqID_121407
atgtcttccgctcccttccatcgccgcattgccctggccacctgcgtggtgctgtcggctgtgccgctgtcttcggcgctggcgcaacagccgccgcgtggcgagcaggcgcgggcggagatgatggagcggggcgagcgtggcaaccgtggcgacgagcggtcgctgtccgatgccgtgcgccgcgtgcagcgcaccaccggcggccacatcctcggcgccgagcgcgtgccgttcgatggtcgtgatatcaacacgggtgaa

SEQ ID NO: 4630 - DNA, 255 bp, Glycine max
  Peptide Sequence Number=SeqID_121408
atgtggttgcagtcacggaagcgcagcccagtttgcgacaaagacgaactcaggcagaaggagaaagaagaagaacgccctgggagtcttaaggcgaaccacaatgcacttccaaaatcgattccgaccctttccgagactctttcctttcctagttttcttcgacctgcgaaagacatacctcaatcgataagtggcaaagacgaactccacaaacacgaactccacaatatggttacaatcacggaagcgtag

SEQ ID NO: 4631 - DNA, 327 bp, Glycine max
  Peptide Sequence Number=SeqID_121409
atggggacaaatcaaaccggcaagaggttttaccaagtcaaggttaaaggcctagataccaccagcatcaaggaattagggcggttgatggaaccactccaaatgcaagccttccgcaagacttacggaatgatcttagatttgaccatagcagaggtatccatagaggccactgcgtcactcacccaatactacgaccagcctttgagatgcttcacgttcggagacttccaattggtaccgaccattgaagaatttgaggagattctaggatgtcctctcgggggaagaaaaccatatcttttctccgggtgtctcccctcttag

SEQ ID NO: 4632 - DNA, 315 bp, Glycine max
  Peptide Sequence Number=SeqID_121410
atgccaatctccccctgcagatgtatcgggatcgcgcccacaagacgcccagtgggcccgaagaagtccaacagggccctggggtttccagctctggttacgggcctctgtcagtcctacagggtgcccgttcccccagcgaggtcatgccatcgtgacataggaatcgcacccataaagacacccagtggacccggagaagtccaacagggccctggggtttccagctctggttacgggcctctggatcgtgcctgcaagacacccagtggacccgaagaagtccaacagggtcttggagttgtcaagctctaa

SEQ ID NO: 4633 - DNA, 207 bp, Glycine max
  Peptide Sequence Number=SeqID_121411
atggttgataacgaagagcgtttcgctggtgccgaacgcagagagagggaagcgacacccggtctacgcccacagtcaaactcccgcgcaatatttgatcctgcctttcctttgggcgctggcccaataacacacagcatgagatgggcctttattttcgcacctcacactataatcttcccactccctgactttgttttgttatga

SEQ ID NO: 4634 - DNA, 848 bp, Glycine max
  Peptide Sequence Number=SeqID_121412
atggatcaagaagataaggaaatgataaatgactcctttgagtatggtttcaaagattctttggaagtcatatgtggagtaattttgatattacccacagagcatgttgaagactatcaaaataggaatctactaagcgattatgctagggaagattatttcgatgatccttctctaagcctaaaggcagtttgggttacagaagtttcttgttttactccccatcgaaatgttgcagttttcgatccccctactgatgacatgagatgtcacatgaaaccactccacttgacaaatatgctagaagaccaaatcattaacaagattttggtcgatgtaggggttgcattcaacatcttacctagatctatgttacgaaggcttggtaggactgtagaagatttgatacctcataatatagtggtgtcagatttctgtgggaagccctcagattctgaagggatacatggagttggagaagtttcatcaatggttcatcaaaagctcttcttttggaatgatgatgcaaacttggagatggttgaagctgaccattcatcctatggaatatatgttgcctttgcaagtgaaggtgatcaagcaatggcaataactgctccattcgaagtcaaagattcattctatgtgaacaagtcagtcacaacttcatcaaaagcatatgcgaactttatagctcgcttatcggcttatatagctgatggtaagaaacaaatggctactacgaccatcaaagtaaagaaggagaagatggatactgatctgcctagactcggtagagaattggtggaacatagattgtctatccgtgaagggaaaaagccagtgaa

SEQ ID NO: 4635 - DNA, 681 bp, Glycine max
  Peptide Sequence Number=SeqID_121413
atgcctttgctaatattgaagaagcacaaaacattgccaacaccaatagaggggacgatgaagtcgaacaaaggcattcagttaattctcattccagggcatgaagaaaaatttaggaagtcgagggcagtaaggaagcaatacgcggcattgcaaattcaaaaggtaaaaggtggttttccaaaggttgagaggcgtgagaagtggtgcagttgtggtttactagttttgaaaattatgggaaatttatggatgatggagattgaaggtatcgatttggagaattggaaggccgaatgtggctacaagggcatgcgtcaactttatggagccactccaaaatcgaaggaccatggtgttttcttccatgggcttggcgagagtgtgttcgagcacaaggaaagcaaaggaaaatatgccacttccacaaaaatatggaaagacacggattgggtcttaccattgatgggcccgcagaggaagatgacaatgaagagtagcttaagactacgaaaacatggaatcatgctatcaaatgtgattacaactttggcaatgccaaagaacgtgatacaagccttggtggggtttcttaagcaaacaagaacgacattgatcttcgggggggggggggggtggcatgaaccccaaatgggccaagagggaaaaaaccacccctag

SEQ ID NO: 4636 - DNA, 225 bp, Glycine max
  Peptide Sequence Number=SeqID_121414
atggaaatagaagtttttattacagcagtgcatagttggcgagagaaaaagcaggaaagcttgaactcccattcaatggggtttggcacacatccaacttgtcttgctggagtcagcgagagagagagacagttttgctttgctgagttgctgccaactcccattcaatgctcctatctttcacaaccgattacgcgcgccttgttcttcacgctttacttttag

SEQ ID NO: 4637 - DNA, 1026 bp, Glycine max
  Peptide Sequence Number=SeqID_121415
atggaagcttcagctttgagtcaacgcatcatggaaggaagtcaatggaaactggcactcctcctgaattttcatccctctcatttgagaatgacaggcattcatcttctacatcctgtaaagaagattgaagttggaactgaagcaaacaatggaaataagtggaaactggaggaagaaaggagaatggaaaaggcaaggcttgctgaggaaacagaacaaggtcaaaatggtagtggctatattggtgggaccagaagagagatcacgaacctcacaaaggctcccccaagcttgcctaagaggacatggacatggcaacagagggttcaggtgcccgtaaaaggggcagatcggtgtgtgcactttggtcttcccaaattgatccaggtgacgatggtttaccacgacggatatggtggtgtcgaaattcctccgacaaaaccgcttgctccgcaaatcgtcactagagcggttacctctggcaagaactcttgctccgatactggtcgtgacttcatcagagcaagttttgctgccaacttcttcgctagatacaatgacaacatggtttctgcgttttggtgctccatcgttgtcgttgcggaagccataggtgatcttcgagatgcgtttgttgcgtttccacggtaccgaacaagcttagcaatcggttttgggtgctctcgagatcaatcccaagggatagagctagatgtacataagaaaaatctagaggctgcaacggaaagaggtgggaagcagccatgggagacagctgcttgtcccttacacgtaatccttgaggtagctaggtctcttggtgatccttatgagtctgctagtgggtgccgtgatattggagttgctatcagaggtaactaccaatggcaaagcgtgggcttttgtggcggcgcaatgaccatgctagagaggaaattggccactgagcaacgtaggtgtgcacgccttgctttgcatggtgaagttattaacttcaatggaatccatgggaaagccaagtaa

SEQ ID NO: 4638 - DNA, 758 bp, Glycine max
  Peptide Sequence Number=SeqID_121416
atggcttcatccactcagccacatggaacaccaattagcattgcctttgcctttgcatcactttcttctcgtgcaatgatctttcttttgaaagcgtccttgaaccatggtttgaagtccctctttaaccttgaggacaaggttgattttccagcgaagggattgtcccttgctttcatttggaatggaataaaagtgatccaaaggttcgtggccacggttgaactagacaacaacaaggtgttgatattggatattagggtaccaatcacaccatttatggggttaagtaaacataggacgtgtgttaatgctatgtcatggtccccagattttggacgacatttgtgctctattagtgatgatgcaagggtcttcatttgggaggtgatggacacggggttccgttcagggaatggttgtgatgtggagccagttatgtggcaaatactggcatgtgcaatatataacaattggtggccaatgttatcagctctgatgtatgtgctggttcctatgccttgcttattctttggaggtggatccactcaatttctaatgagccgtgatggtggtggttggatagatgctgcaaaatttttgactggagcatcagctgttgggagcatagccattcctataatcctcaagcacgctcatatgattgagacaggcgcgatgctcattgaacttgtatcgttcttcatttttatatgtactgttttatgtttccaccaagccggccttgatgatgattg

SEQ ID NO: 4639 - DNA, 1056 bp, Glycine max
  Peptide Sequence Number=SeqID_121417
atgcagagtagcaggatagaggactggggtaggcgattcatgagactatatccacagtacacatcatgggacaactcaaaagatcctgaacggcccctggtgataggctatgtatctcctgattattttactcattctgtgtcatatttcatagagacaccccttgtctatcatgactactccaatttcaaagtgattgtttattcagcagttgtcaaggcagattcaaaaaccattagatttagagagaaagttttaaataagggaggtatctggaaagatatttatggaattgatgaaaagagggttgccaacatggttagagaagatcaagttgatattttggtagaacttacgggacatactgcaagcaataaattgggaatgatggcatgtcgacctgcaccgattcaggtgacttggattggttatcccaatacaacaggattgcctacaattgattatagaatcactgattcactggcagaccctcctgaaacaaagcagaagcatgttgaggagttagttagattgccagaatgcttcctttgttacaccccttccccggaggctggccctatttgtccaactcctgctctttccaatggttttgtcacatttggtagtttcaacaatcttgccaagattacaccaaaggtattgcaggtttgggcaaggatactgtgtgcaattccgaattcccgccttgtggtaaaatgtaaacctttttgcagtgacagtgtgcgacagagattcctttcaacactagagcagttaggtttagaaccactacgtgttgatcttctgccccttattcttcttaaccatgatcatatgcaagcctattctctgatggacatcagtttggatacatttccatatgctggaacaacaacaacatgtgaatctttatacatgggagttccatgtgtcactatggctggatcagtacatgcacacaacgttggtgttagtcttcttagcaaagttgagatggggaacagaatggaaaacaagtccaagagtactactcctcttggcagggtactgtcctaa

SEQ ID NO: 4640 - DNA, 1476 bp, Glycine max
  Peptide Sequence Number=SeqID_121418
atggcaggggcggatattaatagtgacgggaacgggagtgaaagggagttagcgggaaacagctataacggttttgcggaagctccagaggcttctgttagtgctagtggttgtgaaggaaacgacagcgtttcctacgcgaacgtcctgcgttcgaggaacaagtttgttgatgctctttctatctacgagcgtgtgttggagagtgatggtgcgaatgtagaggcgctgattggaaaaggaatatgccttcagatgcagaataagggaaggcttgcgtacgagagtttttctgaggctatcaaggtggatcctcaaaatgcttgcgctctcacgcattgcggtattctgcataaggacgagggtcgccttgtggaggctgctgagccttacccttgcatatgcaaagaggttgtttccggattcgaacccatgaccaacaagtcaccaaggcacaactttaccgctgcaccagggctcgccctcagagctttacaagtggatccttcatacaaagcagctgctgaatgccttgccattgttttaacagatattggtaccaacataaagctggcagggaacactcaggatggaattcaaaaatattttgaagccctcaaagtagatccgcactatgctcctgcatactataatcttggtgtggtctattctgaaatgatgcaatatgacacggccctcagtttctatgaaaaggctgcatcagagaggcctatctatgctgaagcatattgcaatatgggtgtgatttttaaaaatcgtggtgatttggaatcggctataacttgttatgagaggtgtttaactgtttcacctaacttcgagattgcaaagaataacatggctatagcattgacagatttgggaacaaagggggacatcaaccaaggtgtgactttgtataagaaagctttgtattacaactggcattacgctgatgccatgtataatcttggggttgcttatggtgagatgcttaagtttgatatggccattgtattctatgaacttgcctttcacttcaatccgcattgtgcggaagcctgtaacaatctcggagttatatataaagatcgtgaaaaccttgataaagctgtagaatgctaccagcttgctttgtcaatcaaacctaatttttcccagtcattaaataaccttggtgttgtatacactgtccagggtaaagtggatgctgctgcaagtatgattgagaaagctattattgcaaatccaacatatgcagaggcatacaacaacctaggttgtgctaatttaggaatggcaacttactggcataattttagactaggagttctttatagggatgctggtgatatagctcgagcaattaatgcttatgagcaatgccttaagattgatcctgattctagaaatgctggccagagtgtagaggctatgttttcttgctggagagtgaccttccagtttgggatctaa

SEQ ID NO: 4641 - DNA, 144 bp, Glycine max
  Peptide Sequence Number=SeqID_121419
atgaggctggcattggaacccatagacaaggaagatgacaacgctagagacgaagaggttggtactaacaatgactgggaaggttatgagggagaacgagatgttgccgatgaagcaattgtgagagaggttgagggtgattga

SEQ ID NO: 4642 - DNA, 162 bp, Glycine max
  Peptide Sequence Number=SeqID_121420
atggctattgttgacgatgttgttccttataagtttggtgagaaatcatcaaagtgcttaagttcaactggatttcaggatgtaacttttaaagcttataacgggcttggacactacaccattccagaagagatggatgagatttgcttagatttctgttga

SEQ ID NO: 4643 - DNA, 1233 bp, Glycine max
  Peptide Sequence Number=SeqID_121421
atgccggagattttagacggtgcaattcggcgagccgttgtcatcggaaacggcttcgccggcgctgagaatcagtgcattggtttggtccgtgctctcggtttctccaaccgccactccttatatcgcgtgacgaggcctcgaggaggaatcaatcggtggcttaaatggcttccggtttctatccacaaaaggttagactccgttatcagaatgatctgtggcaaatcgcgttttcaaacgcctcataaaatcggcatttctaacgtgttggatgctgatgctcaccacattgccaccatggcccgtgaaacgtttcataaggatggacccttgttggtgattgcatctgggcgagacaccatttctgttgccagctccattaaacggttagctccagaaaatgtttttcttgttcagatacaacatccaagatttcaactgaataggtttgatcttgtgattactccgcgtcatgattattttccgctgactcctcatgcccaacggcaaataccttggtttcttcgaaggtgggtgactccatgggaacctcctggccacaatgtggtcctcactgtgggagcgcttcatcaagctgattccgctgctcttagggttgcagcttctgcctggcataacgagttagcaactctgccaaagcccttgcttgtggttaatgttgggggacctactggtaattgtccctatgatgtggatcttgtaaagaagttagtggttatgcttcagaatgttctatggagctgtgggagtatcaggatatctttctcaagaagaactcctgagaagatctccaaaattttggtcaaagaatttgccacaaatccaaaggtccaaatatgggatggtgaaggttcaaatccacatatgggacatctggcctgggctgatgcctttgttatcactgctgattcagttagtatgttgagtgaggcctgcagtactgggaagcctgtgtatgtaattggagcagaacggtgtacatggaagtttgctgacttccaaaattctttgcagaagcaaggggttgctcgaccattcactgggaatgagaatgtgagttgccaactgtgctgtaatgttatgtgttgggttttatcggatatagaagtctcttctttgctaccagactgtgttcctgtagttgttgctgaagctgccagtcaagtggttgctgctcttgctcagcgaggatggactatccgtgcataa

SEQ ID NO: 4644 - DNA, 519 bp, Glycine max
  Peptide Sequence Number=SeqID_121422
atggcagaaaaagcccacttatggtttgggctttgggtgtacattgagccggtttactctatgaatgaatatggcgatgcaatacacacgctcacttgttttccttcgtctctgcaattgaattccatggcggccgtaagaaaaataattgaggtcaatagaaataaaatcttgtcgccatctcttctctcttttcgccggggaattgcttacaagctttttgttggaggattgtccttctacaccacagagaatgcattatcagaggcattctccaattacgggcaagttattgaagccaaaattgtaacagatagggtgtcagacagatctaagggatttgggtttgtcacctttgcttctcaagacgaggctgagaatgccatagaagatatgaaaggaaagacattaaatggacgtgttatctttgttgattatgcaaagcccaatatcaacactcgtggtgaaattccaattgccagaggacctcctgagccaacatcaacaccagatacttga

SEQ ID NO: 4645 - DNA, 1008 bp, Glycine max
  Peptide Sequence Number=SeqID_121423
atggcttgcactgataaaacggccaccgtcaccgacgaagctagcggcggcggagccactacaatcttcgccgtgcaccccgacataatccaaacccacatcctcacgtgcctggacggtcgcgcactcgcctccgtcgccagcacgtgctctcaactccacgcgctctcagaccacgagcctctctgggagaacatttgccactccacgtggccctccacgaactcgccacgcgtccgccacgtcatatccacgttcccatgcgcgtctcgctcctttttctccgactcgtttccttccttcgccgcgcgcgaaggttcgaacatcgatcgcgcgccggagctgatttccgcggtggacatcttccaccggcggcgggtggtgctgtcgagagtggtggagacggagacggagtccggctggttccggtgctcgccgtttagaatcgatgttcttgatcagaaggaggcggtggcgacggcgatggagtatccactgagcgatggagcatgtgagattctcggtgaggatttgaggttgagttggatagtggtgaatccgaagggaaagcgtgcggtgaatgtgtcaagtggaacggcggtgtcggtggagcggcactggctgagcggggaggtgaaggtgcggttcgcgacggtggtggacggcggtgagagggggacgccggcggaggtggcgctgtgcagcgtgactgtgacattcgggaatgagatgcaggtgagggaagcgtgtctacagatggaggacatggatggaatgttcctgaatggtagggagagtttggggattttgaagcgggcgttggagggtaaaaggggaacattactgaaggacggaaaggaagaaggaaggagtagatacttggaattcatgaacagaaagatggagagaaaagaaaagaaacaaagagatgagaggaggttggatatgctctgcttggctctcgcggttttgtcctttgcggctttttcaacactctttctcttctga

SEQ ID NO: 4646 - DNA, 747 bp, Glycine max
  Peptide Sequence Number=SeqID_121424
atggggaatggctatagaaggagggtttcccctattacactagagatgttcagagtcttggatttggtgattatggacaaaggtgcccgttatagagatgatgttggagttgttcagatggtccaggatatctggcaaggaactcaacttctagctattgatgccactgccgccatgggtttacttagaagtgtcctgataggggatgaattgactgagaaagagaagaaaacactgaaaagaaccttgactgacatggcttctattgttcccattggagttttaatgcttcttccattaaatttgttcatctactgtatatgtgtttggggagcatcaacactccccaaaaaatgctatatatctgtgtaccaagggaagatggacaacgttgatttcctacaggttactgcagttgggcatgcagccatgttggctgctatcaagagatatgtaccagctcttagagctgccaggctttatgccgcaagctgggttcgtgacattggtcctgaccttcggcctgatgattataagaaggatgatgacatgactgatgaaacaaatggtgaaaagaaaacaactaaaggaaaagaatcctcaacactggaggaccttgctgtagctgcaagagggggaatggagactctcagaccggctttgcagcgtgtgtacatgaccagagcatctgcatacagagatgctcttaaaagtttcatagaagggtatcaagagggtgttcagcaa

SEQ ID NO: 4647 - DNA, 1062 bp, Glycine max
  Peptide Sequence Number=SeqID_121425
atgagcacggagataactggtaatttgaaggacatgctggttgatgtactttctataagccgagcttacgatactataaagtatgttggtctgcacagagaatttcttgttcattttggtcctcaagccgcagcatgtggagaaaaagttgagcaaggttcagaaggggttgctttctgggttaatattgctcagaggcagctgcagcaagctattgataaggagagaatatggtcaagactgacaacatctgaaagtatagaggttttggagaaggatttagctatatttgggttttttgttgctttaggcagaagtacacagtcttttctttcagcaaatggtttcaatacgctagatgacccaattgaagatttcataaggtatcttattggaggaagtattttatattaccctcaactctcatccataagttcatatcaactgtatgtggaggtggtttgtgaagagttgggttggcttcctttttatcccggaatcatcagcactacaaaacagttacatatgcataaaaataaacaagaatgtcctccaaatgatgaagtagcgcctcaagcactagatgtttgttctcattggatggagagctttataaagtatagtacatggctggagagcccttctaatgtaaaagcagctaaatttttatcaaaagggcacaagaagttggtggagtgcatggaagagcttgggatgataaaggataagacattggaggttaataccaaggaatctgttgagagacaaagatctacacttcactcaactgcaaaagtatcggattcttttaatgaggctttgaaaaaagttgaagaagctatgctaagactggagaatttgcttcaagaattgtataaagaagctgaattcctggaggcatcctttagagcaaaagctgattctctgccacagggagttaatgttgatcagtcccacactcgagttggtaaaaatgatgagtatgttaaaaggaaaaacagaaagaatgctactatgaataggagcaaaaggagcaaaatgattagtgttaatttgccttga

SEQ ID NO: 4648 - DNA, 561 bp, Glycine max
  Peptide Sequence Number=SeqID_121426
gaaggtgaggatgacgtcaagtccttatgccctgggcgacacacgtgctacaatggacgagacaaaggatcgcgatctcgcaagggtgagctaactccaaaacccatcctcagttcggattgtaggctgcaactcgcctgcatgaagtcggaatcgctagtaatcgccggtcagccatacgacggtgaattcgttcccgggccttgtacacaccgcccgtcacactatgggagctggcaaagggaggttctctatggtagtgccatagctgcaatggattattttgctgatgaaattggagttttgtctcctagtcaactacaagttgaagaattgtatgctggtgaggtgggctatctatctgcatcaataagaacagtagctgatgctagagtgggtgacactgttactcactatggcagaaaggctgacaattcactccctggatatgaggaagccactcctatggtgtcctgtggcttatttcctgttgatgctgaccaattccctgatctgtgtgatgcacttgagaagttgcaactcaatgatgctgcacttaag

SEQ ID NO: 4649 - DNA, 597 bp, Glycine max
  Peptide Sequence Number=SeqID_121427
atgaaatttattgctgaaaatagggcatcaatcacgtatgaattaccattagcagagatggttggtgatttctttgaccagttgaagtcgagaagtaagggttatgctagcatggagtatacctttgtcgggtacactgaaagtaatttaattaaacttgacatacggataaatggtgactgtgtggagccattggctacaattgtgcacaataataagattcacgacgtagtggaagataagaaaggtagaacagtggcaactttgtttgggacgtgggataagagcttgcattacgtaattggagggaattctaggaaaggaaaagggtcctcctatgtgtcaacaaaaccacatgttttgtggaagcggagcctaacaccagagtaccagacaagatataatgaaatgcagcaacaggcacgaaaggtacaagagaagggttggaaaccaaggtggtttgccaaggaaaaaggcagcaactcttaccgttatgttggagggtactgggagaccagggaaaaggggaacttggaatcttgtcctgacatttttggccaagtctcaacacatactaattttaacccaacttcataa

SEQ ID NO: 4650 - DNA, 666 bp, Glycine max
  Peptide Sequence Number=SeqID_121428
atggattattttgctaatgaaattggagttttgtctcctagtcaactacaagttgaagaattgtatgctggtgtgattcatgacttagtggaagataagaaaggtagaacagtggcaactctgtttgggacgtgggaagagagcttgcattacgtaattggagggaattctgggaaaggaaaagagtcctcctatgtgtcatcaaaaccacatgttttgtggaagcggagcccaacaccagagtaccagacaagatataacctcacacaatttgctatgacactaaatgaaatcacacctggattaaaggagaagttgccaccaacagattcaagactaagacctgatcaaaggtgtttggagaatggacagcatgaaatgaccaattttggaaagttgcggttggaacaaagtcagcggcatgaaaggtgtaagagaagggttggaaaccaaggtggtttgccaaggaaaaaggcagcaactcttaccgttattttggagggtactgggagaccagggaaaaggggaactgggaatcttgtcttgacatttttggccaagtctcaacccatactgattttaacccaacttcataaattctcaacactgttacctacctactccccctactaccacaccccttttgatcatagcatatattcataa

SEQ ID NO: 4651 - DNA, 741 bp, Glycine max
  Peptide Sequence Number=SeqID_121429
atggttaatggtactttcatgtactttgtaatacgggttgtggtggggaggcattatataagcgcaggtgctctggtatattggcttcaaatggctttgggttctgcggccatgacagattatccaacaccttccgttttcctagctcctttgcctgcttatccagtgagaaagatgtgcgaggcgattgataacttatccgctgtaaatgaaacgttcactaaattgtatgcagcagctaatatcttctacaactatactgggactgccacatgtttttttttggataatactactgctcctctcgggggatgggattggcaggcatgtacggagttgataatgcccttgggtgcgaacaatgaggggagcatgtttcccccttacaaatggaagctcagagacgtagagttttactgcaaacgtgtctatcacatacagccaagacctcattggattaccactgagtttggtggccatgacattaagagggttctaaaaaggtctgggagcaacattatcttctttaatggtttaagagacccttggagcggtggaggggtgttgaagaatatttcagaaactatagttgctatagtagcaaaagaaggagctcatcatgtggacctaaggttctcaactacggaagatccagaatggctaaaggatataaggaaacgagagataaaaatcatagcaaactggatctctcaatattatcaagacctactaaatcaatga

SEQ ID NO: 4652 - DNA, 513 bp, Glycine max
  Peptide Sequence Number=SeqID_121430
agctatcagacttttcaacaaagatatctcatcaatgatacctattggggtggtgccaagaacaatgctccaatctttgtctacatgggaaatgaaggggacatagaatggttcgcacaaaacacaggcttcatgttcgaaacagcaccttatttcaaagcccttttggtttttatagagcatagatactatggaaaatcatttccatttgggggaaacgaggaggttgcagatgcaaataccactacagttggatatatgagctccacacaggcattggctgattatgccactctcatcattgatctcaagaataatttatcagcaacagattcccctgttgttgtcgttggaggatcctatggaggaatgctggctgcatggtttagaatgaagtatcctcatgttgccattggagccttggcatcctctgctccaatcctccaatttctggatttggtttcaccctatacctacactgatatcatcactcaagactataaggtcgcctag

SEQ ID NO: 4653 - DNA, 885 bp, Glycine max
  Peptide Sequence Number=SeqID_121431
atggcaacgagcttccagtttatcatatgcttttgtttattttctctgttgcgtttcaccgtcacttttgcccatgtcattccaagattcccttcttcaatgctccatccagcgctagatcttggctctagttctgcccaaaatgggctttacacaacaaagttcttcacccaaatactgggtcacttcagttataatccccagagctatcaaacttttcaacaaagatatctcatcaatgatacctattggggtggtgccaagaacaatgctccaatctttgtctacatgggaaatgaaggggacatagaatggattgcacagatcacaggcttcatgtttgacacagcaccttatttcaaggcccttttagtttttatagagcatagatactatggaaaatcatttccatttgggggaaacgaggaggttgcaaatgcaaatagcagcacacttggatacttgagctccacacaggcattagctgattatgccactctcatcattgatttgaagaagaatttatcagcaacagattcccctgtcattgttattggaggatcctatggaggaatgctggctgcatggttcagattaaagtatccgcatgttgccattggagccttgtcatcctcagccccaatcctccaatttctggatttggtttcaccttatacctggactaacatcttcactcaagactttaagggtgttgaagaatatttcagaaactatagttgctatagtagcaaaagaaggagctcatcatgtggacctaaggttctcaactacggaagatccaaaatggctaaaggatataaggaaacgagagataaaaatcatagcaaaaattggacctctcaatattatcaagacctatactaa

SEQ ID NO: 4654 - DNA, 1191 bp, Glycine max
  Peptide Sequence Number=SeqID_121432
atggcaattggctttcagttcataataatcacactcttctctctattttcggctccctcactcacttttgcttttgtccctatccttcccagatttccttcttcagcagttagtgcagagctgaagcaacgctctcattcttcccaaaatgggctttacagaacaaaattcttcacccaaatactcgaccacttcaattttaatccccaaagcaatcacacttttcaacaaaggtatctcatcaacgataccttttggggtggtgccaagaacaatgctccaatctttgtctacactggcaatgaagggaacatagaatggttcacgcagaacacaggctttatgttcgaaaatgctccttcttttcaagcccttttggttttcatcgagcatagattttatggaaaatcaataccatttgggggaaacaagacggttgcatatgcaaatactagcacacttgggtatttgagctcaacacaggcattagctgattatgctactctcatcattgatttgaagaagaatttgtcagcaactgattctcctgttgtggttttcggaggatcctatggaggaatgttggctgcttggttcaggatgaagtatccacacgttgcaattggagctctagcatcctcagctccaattctccatttcatgggtttggtttcgccagatatcttcaacaacatcatcacacaagacttcaggagcgagagtgagaattgttacaaagtgataaaagggtcttgggatctgatagacgacacggccaataaacccggaggaatggaactgctgcggaaaacattcagaatatgcaagagcgatgattttgggcctggttctttggaaggttggcttcgggcggcgtggatttatacagccatgacagattacccgacaccatccaatttcctgaatcccttgccagcatatccggtgaaaaagatgtgcgaggccattgacagctcagtaacgggaaataatagattagccaagttgcatgcagcagccagtgtctactacaactatacaggcaaagcaagatgtttcgatttggatgacaattctgatcctcatgatcttggaggatggcaatggcagattgttagtgcctcattttccattacccaaccagacatcatcaacttagagcttccagggtcttgcattgtccaacattga

SEQ ID NO: 4655 - DNA, 1566 bp, Glycine max
  Peptide Sequence Number=SeqID_121433
atgtcagtctcatggaggtattctaatctaattccaatactcatacacggcctttatactttgaggacgattttctctattggaatggacaaattgcatactattaagattgaaactagatcccgagcacagacccctgcttcatctgctgttgcagttaaagcacgtttaaaagatgttagtaatgctttaatgacatccaaagagctacttagaattataaaccgcatgtggggtcatgaagatcgtccttcatctagtatgtctcttatctcagctctgcatactgagctggagagggctcgcctacaggtcaatcaacttatccaggaacagcgctcagatcagaatgagataaattatttgatgaagtgttttgctgaagaaaaggctgcttggaaaaaaaaggaggaagaaattgttgaggctgcaattgaatctgttgctggtgaactcgatgtagagaggaaactcaggagacgattagaaagcttgaacaagaagcttgggagagaactggctgacaccaaaacatcccttcttaaggtggtgaaagagcttgaaagtgagaagagagcaagagaaattattgagcaagtatgtgatgagttagcaagagatgctgatgaagataagtctgatattgagaaacaaaagagagtgtctacaaaagtttgtgaagaggtagagaaagaaaaggaaataatgcaattgactgataggttacgcgaggagagagctcaaaagaaactctctgaggcaaaatatcagcttgaggaaaagaatgcagctgttgataagctcaggaatcaacttgaagcttttctaggaggcaaacaagttagagaaaagagtcgcagttccactcacttgagtgatgaagaaattgctgcttatctcagcagaagccgattaggttcccatctcattgaagataaagaagatgacaggggagaggttgacaatggagtagaatgtgaggaggaatctgctgaaagtgatctgcattctatagagttaaatatggacaacaacaacaagagttataagtggacctaccctcctgaaagcagatttgatacaagaagatatccaattgaggaagaagtgaaaggtagtaggaggtctacctctgggaaagcttcaaggaaaagcacatcactgcaaaggagtatatcagatggaatggaatggggagtccaagctgataagattcaaaattcaggagatgggatagattgggaaagcttttatgaactggaaaagcaagctcaaggaaaaggttatgcagatgaaatgcaaggctataaatcagtgaaaggtctaagggatcagatactggctggttctaggcttgcatcttccagaggttatgccagtccaactagacaattttcccagccatggccatcacgagatcttgcaaataacttccaggaaagacctgctacagcacagggcaatggtctaaaatcaaggttaggggaagccaggggtgagggccagaatgtaaggaagtccaaaaggtccatacccgtttgcttctgctaccatgatggctggtaa

SEQ ID NO: 4656 - DNA, 153 bp, Glycine max
  Peptide Sequence Number=SeqID_121434
atgactattttggctcacattccattccatggcaagaacggtgttgccaatgtgacaacattggttgtagagcatgatgtggttgaccgtcaacttgagtctcaagagcttggatacatagtgattgtggtcgagaacggtgtcaacgcatga

SEQ ID NO: 4657 - DNA, 481 bp, Glycine max
  Peptide Sequence Number=SeqID_121435
atggggaggcaaggaaccagaacgcatggacctgggaactctttctctggttctgagttccttcttggacctgacgctggggctgggcgaaggaatctcgttcatctcccagagcgttgcggcgagcttcctggcggagaccggagcttggcggggcttgttaccggtctgcgacggcgggtatttgggggaggccaatgcccggagcggagatctcgagctcatgagcttccacgtgggcacgggcgtactggatccgcccctctttccgacgagaatagtcctcttgaagcggtagttgtggagcacggaggaggaggaggaggccgaggaggaacagcctcgttttcggatcttcccaggaatcatgtccatggtggttgggtttgggttttggctcagcatgagtatgagaaagaagagaaagagaaagggaatgtattagcgaagattgggtggagtggtattatagggacaccat

SEQ ID NO: 4658 - DNA, 177 bp, Glycine max
  Peptide Sequence Number=SeqID_121436
atggcaacttcaacctctgcactcaataaaaggagtctgactcctttagttactagaggtccagtagggcacagacacatgaaacttgtgcgacccacactaagtaggatagagccagatatatcagatttatggttggaaggaaaagttgcattgatcacaggaggagctagctag

SEQ ID NO: 4659 - DNA, 1167 bp, Glycine max
  Peptide Sequence Number=SeqID_121437
atgcaacttaaggcattcccttgttatccgataaggcttgaagaaacattcaagggtgctctccacacacacttcaatgactatgagcacttacctttccaagcatgcaggttagaaggcaaggtggcactaataaccggtggagccagtggcatcggcgaagccaccgcaaggcttttcctttgccacggtgccaaggtcatcatcgctgacatccaagacaacctcggacactccctctgccaaaacctcaactcctccgacaacaacatttcctacgttcactgcgacgtcaccaacgataacgacgtccaaaacgccgtcaacgccgccgtctcgcgtcacggcaagctcgacatcctgttcagtaacgccggcactgttggccgtgtgagcccttccatcacggcgtttgacaacgctgacttgaagagggttttcgaggtgaatgtcttcggtgctttctacgccgccaaacacgcggctaaggtaatgattcctgaaaagagagggagcattgtgctcacctcaagtgttgcttcggtgactcacgcggtttcgccgcatgcatacactgcgtcgaagcacgcggtggtgggtctgatgaagaacctgtgcgtggaactggggaatcatggaatcagagttaactgtgtttcaccgtacgcggtggccactcctctgatgacacgtggaaccaggatgaagaaggagatggtagagaaagtgtattctgaggcggggaacctgaagggagtggttttgaaggaagaggatttggcagaagcagctctgtttctggctagtgatgagtcaaagtacgtgagtggggttaacctagttgtggatggaggttacagtgtcaccaatgtttctgttaaagaagctgtgagaaagttttctgctgaaggcctgaagggggataaagttggttgtgcctcagctcggaggttgattcgtgagattaggaagcttatgggaattggtaaaaaagatcagattggagcatattttcagagaaggaacagatgtacatataagctgactgattttgcttgtggtttggatggggattttttgatgatggagcttcaaccttctttcttgagtcagttgttgattagtgatgctttgggagtttcaactcctggtttagtggctgtctag

SEQ ID NO: 4660 - DNA, 387 bp, Glycine max
  Peptide Sequence Number=SeqID_121438
atggtacacctactaaaaatcaccaaaaactacatgttaaatttggaaaaacaacaaccacctaatgggataggaaagccacattgtcagaatgcttgttttcaaggagaagtcacgcatctagaggccgtaggtttggcggttgttggtgccgacgatgcgctaatggttgacattggcacacaaccctcacaagtagaagagaagaagcctcgcgatatcgaaatggttgtggagttggtcggaagctttgaaagttgctattgctattggaaatggaaacaccatttgagtttggatttggggcacagtgggggcttgctcgaatcttctgccatagaagagtcaaaaaactccccttgggatgctacgaaatatgaaatttag

SEQ ID NO: 4661 - DNA, 1386 bp, Glycine max
  Peptide Sequence Number=SeqID_121439
atgggcaacgctcagtcaccttccaacaatgatcctcgatatgtttcagcaaccagagcttttactcaaaaggaacttgaagacttgaggtctcggttcaacaatctggctaatcaatcccagagcaacgggaaatacatccctccctccgtttttcagtcatattttggatttcatggccctcttggggagaggatgtttgatttagttactcaggagcgcaaggatcagaagctaacctttgaagacctcgtggttgctaaagctacttatgagaaagggacaaaagatgaaattgaagaattcatctttcgcttattagatgtatctggagataattttgtagggaggtctgatttggaaactgttatgattgccatttttaatgatatattacgcataaaaggttctgatgatagatcaagttcacatgaggatattgtcaacatatttctgaatgctgcaaatttctccaagcaagatggagggggcactgaggggacaatgtcttttgaagatttcagaagctggtgtactcatctcccctctgtgaggaagcttcttggaagcctgcttttgccacctgattcaggtgaagtagttgacgccatgattaggaggattaactttatgtgccttcaaaaaatcatgtgggatgacaaaaatgctatggagctagacactttaggatttcaaatctggtgcacaggacgacctggttatcagattcctaaactattgacttcgaaggctattgattctaacattatacttttgagaaaggaatatacttggcatattggaggcgcactctctcaccaagacctggaagattggaatcttttgtatcatagttctgttaatggtcttagttttaatacattcctgggcaacatttcaaaccatgcaggcccaactgtgttaattattaaggataaagaaggttatatatatggagggtatgcttctcaaccatgggagcgtcatgctgatttttacggagacctgaaatgtttcctttttcaactaaatccagtggcatctatattcaggccaactggagcaaacaataacctacaatggtgcgctatcaacttcagttcagaggacattccaaatggcattggttttgggggacgagtgaatcacttgggtttgttcatatcagcaaactttgatcaaggacatacattttcgtgtaccacgtttggtagcccttgcctctccaagactaaccgtatattaccagaagtaatagaatgctggggagtcactcaagatgcgacacaagacaagaatgatgctgtcaagggcactattctggagaggttcaaggaagatcgcaacatgctcaaaatggtaggcctagcaaattccagcgagtaa

SEQ ID NO: 4662 - DNA, 441 bp, Glycine max
  Peptide Sequence Number=SeqID_121440
atgacaatcccaaatcaagaacccccaaaatcacacatcacaaagccaaatcacgaatcaagaacccccaaatcacatatcacaaccccaaatcataaatccatcttaggttatgatggtttcgaaaagggagaggttcttgaggatgttggtagtgacagagattggagttggcggtggcgaagggaggtcgggcatatctcattgcaaagcttgttggcgttggttatgatgagaacaagatcacaggaagagaagtgcgtaacagacacactcccaaacatacaaataatatgttttcaacttcgtctaccaactggtgctaattgcacattagtttcaggtggtggaagtcatattcaacacttgaaaaagcttgaatatttaagttcggctgtcatgcttgttattgcgagtgggaacaatacttttatccattag

SEQ ID NO: 4663 - DNA, 312 bp, Glycine max
  Peptide Sequence Number=SeqID_121441
atgaccgtgaaggcaaatggagacatcactagtgaatctgaaatcgatgaagaagaagaaaaagaagtggaagaagagcttgaagaggaagctatgcagggtgatatgttaatggtgagaaggttgttgggaagtcagatgcagccactagacgacacccaaagagaaactattttccacactaggaagtcgtaccaatgttgcaagtatcaggttgaggcgtgtctcaccattgggagataccatgatagggtgttgtgtgacatggttccaatggaggcgaatcatatactattaggaagaccatggtag

SEQ ID NO: 4664 - DNA, 558 bp, Glycine max
  Peptide Sequence Number=SeqID_121442
atgcagcgcctggcgccggggctgtcgttccagctgcgctattccgagcgcaaagtggcgctgaacgatctgctggcggggcgcatcgacttcgcgctgggctttaccgaaaccgacggcgaaagctacccggagatcgacgaagtgagctggctggaggatgagtatgtggcgatttgttcacccgccttcagcgtcaaatacggcgaactgacgctggaaaactacctgcgggcgcgccatctggtggtgacgccgtggaacgaacagcgcggcgtcattgactatcagctcgataagctggggctgcagcgcgatatcgccatccgcacgccttcgctgctgggagcgccgttcatcgtcgccgacagcgaactggtgatgagcatgccgcgctacgccgcgcaaaaattgcggcaggcggcggcgctggctatccatcccctgccgtttccggtgccgccgtatcagatcaaaatctacctgcaccgcaaaaacggccggccggaggcctgccgctggttgcggcaacagctgcaggcgctggcggcgctataa

SEQ ID NO: 4665 - DNA, 546 bp, Glycine max
  Peptide Sequence Number=SeqID_121443
atgcgaaaggacgtatcgatgcgtttggtcctcatagaagaagcgtcgaccgacgaccgagaccgagagaacatgtgtgattacggtaatacccttccctattacagcaaatcgctgttgtgccattttctttttcttggttattccaacattaatttttgcaaacacacagcgattcccctctttctgagatatttcgaatttcgatactttgatcagatccacaacactccttcatccatgacgcttggctcttcaggatccagtgtcgtggttccaaggaacttcagattgctggaggagcttgagaagggagaaaaaggaatcggagatggaacagttagctatggaatggatgatggtgacgacatttacatgcgctcttggactggaaccattattggcccctataatactgtacatgaaggaagaatttatcaattgaagttgttttgtgataaagactacccagaaaagcccccaagtgttcggtttcattcacgaatcaatatgacttgtgttaatcatgaaactggagtggtatga

SEQ ID NO: 4666 - DNA, 1074 bp, Glycine max
  Peptide Sequence Number=SeqID_121444
atggcccaatcccatggatccatcctcactcgatcagtgtggtcctccaatctcgaatcggagttcgacttaatccgatccgtcatcgattcgttccctctcatctcgatggacaccgagttccccggtgtcgtcgtgcgtcccgacgccggcgacccctccttccgccaccgccaacccgtcgcgcactacgccgtactcaaagccaacgtcgaccgcctccacctgattcagatcggccttaccctttccgacaacgccggaaaccttcccaccctcggcacctccaacgccttcatctgggaattcaacttcaaagatttcgacgtcgcgcgtgacgcccacgctcacgactctgtggagttgctgcgccgccagggcatcgatttcgagaagaatcgcgatttcgggattgactcgttccggttcgcggagctcatgatgtcgtccggtctggtctgcgacgacgccgttagttgggtgacttttcacagcgcctatgatttcggatatttggtgaaattgatgacacatcgcacattgccagaagaattaagagagtttctgcgtctggtgagggtgtttttcggagacagagtctttgatgtgaagcatttgatgaggttctgctcaaacctgcacggtggattggaccgtgtttgtcagtcgctgaaggtggaacgtgttattggaaaaagtcatcaggctggttctgatagtttgctcactctgcacgcgtttcagaatatcagagagaattactttgacaaggctgacggacttgttcagtacgctggtgtcttttgcaaagtgtcgtgcatctggctatttccagtcaaaagatattatatagttgaagatcacagattgcatgaagtctccagtcttatcaatggaagatggcagaaggtccaaattccgccatataaacacaccatggcagcctatggtggcgccatagctgacctcctttcacaattgtctatagcagttggtaaaaaagccaccatgccattctgccatagcggccaatggcgccaccatttaacaacaacgctcaataaggagagttga

SEQ ID NO: 4667 - DNA, 396 bp, Glycine max
  Peptide Sequence Number=SeqID_121445
atggagatcattgagtcaagaatcatagaccatgaatcgttgatggaatttctcaagaaggggccagaaaaatcagttatcagaattcatggtgaagccatcagaggggaggtactagaacacgatacagaatcagaaccagatactaagatcaacaagtatgaccgaacagtagagatggtcatggttgggaataagggatgtatgcatgattatgaagcagaggcaaccttggatcagggttatatggagtttgactgtgccgtcaccaccactgctgctggacacaagctcgtaagtggtggccactacctgcagagccactatggatgtgcacaagtgagatacgatgtggttttgctggcattctgcctaaggagaatggaagaagggtag

SEQ ID NO: 4668 - DNA, 197 bp, Glycine max
  Peptide Sequence Number=SeqID_121446
atatatccatcagaccacttaactcaaaagacacaggagatcagcgtgaagcttctgcactccgtgatgaactcgatatgctacaagaagagaatgaggttttattagaaaagctaagacaagcagaggaaaaacgccaagaagtggaggccagaacaagggaacttgagaaacaggtagtttttttcctagaatag

SEQ ID NO: 4669 - DNA, 552 bp, Glycine max
  Peptide Sequence Number=SeqID_121447
atgggcgtggacaataatttgcttgccaaacctagaaggcgtgctaattttcggttatgcaatgtgtcatgttacacttctgaagtattggagattcaatctgatgctcctacactgcatgttctgtttgttcctggaaacccaggtgttattttattctacaaggactttgtggaatttctatatgagttgctggagggaactgcttctgtcacagttatgctcactagtcatgtttctctgtggcctaacagctattggccatgtttctcactcaagaaagttctagctgctgctcttagttacctgacagcatcattaggattgttacctgtccaggctttgaggtttcttgtcagaaaatcccttgggaagtcatggtcagccaatgcagttgaggcagcatgctctcacttgtcacaggcaccagattggatatttatgagagaaaggaaggctcaattggcatttttatttggtgttgacgatcactggggaccacttcatttgcttgaagagtctgtgagtgcctccactggagagcatgtgtag

SEQ ID NO: 4670 - DNA, 285 bp, Glycine max
  Peptide Sequence Number=SeqID_121448
atggagatcctaatgaaaatgaaacagaaatgcacatctgcgagagtgagggaaggtacctggtgctggaggtgggaggaggcaacagcaaggagtgagagagggatcgaccagtccaccaagccagacgaggaagcatcggaggaattacagaatatcaacaattttcaaattagttacacgtatatgagtgagggatattgttctaaaagagtaacagccttccttcttgtcattttcgtttcccttgaactatcaaaggagatgatgttgagacaaatttag

SEQ ID NO: 4671 - DNA, 1494 bp, Glycine max
  Peptide Sequence Number=SeqID_121449
atgtatgatagaattgaggaagacatgctatgggatttcggactagatatagtgccgaaatacattggtgaggacatggttctgctcctcggacttatagaagaaaaagcaagacgattgatggaggtggacgaagagggaagggatgctctgttttactcgctagaaaggtggaatccgacggtgagagtaaggaacagacttacatgggtgcaggcgtggggaatacctttgatggcgtgggacgcgcaacacatgaagacaatagtggctggaataggagatgcggtggatgtcgatgatgatgtagaggagttgcggaaaatggaccgggctaggatcctaataaaaacaccgtggccggcgcttattcaacatacagttacagtccatatccaaggggaagaattcatggtgcacataatcgaggaaacaggcgcttactccaacacgtgtcggtgtcggaggggtatagagtacagttcatcggaggatatcctgtcggaagaaagtgaactgggtgcgtcatgtatgatgggagtgtcggaggagatggcagtgcagatagggtcgtcggaggaggagatggtgcgggccatcgcgatacacaaggctccgatggagaagacgagggccaggggagacttgctggagatggcgttggcggcacaaaaggggtcgccggagacgaaggcggtgcgaagtcgggagttggagatggtgacggaggaggaagctgaaattggctccgatgaggcggaactcgaacggttattatccagtgagtgcgccaaacaccatgaccaagtggataatacctacgatacggagaggtcgacatgcatcctgaccacaggtggcgtcaaccaaacagcagagacagctaggggcaacgcaggtggggtagtgacagttttgcctgatttgggagaagaaatagaaaatgggtcaaccacagcaccgttggcagtagacattcacaaaaatggtagggtgcatgcagaggagaccgttgaagtgctggaaccatttttaaaacaaagtgaagtggcacgtgtcaaagaaggagctgaaatatgtgggctgggctttactcctcacacccccattaacccaaaagtacaactccagcaaagttttttgaaaatacaagcagaaaaaacacccattattaatgtgtactcaaaaaagagatggcgcaaaaagcaaacagagccaaaaagcccagacaggtacctgctcaaacatgtggaccaacaaggaagcccacctaaccaggataagaaaaggggagataacttatacgcaaaacagcaacaaaaagaggatgtctacaacacatcagtggagttgaaacaacacaataatattgacaaggaggctgagagactatggcagttggcacaagaaatggggattgcatacccgaaggaacaaacaagtcaagtgcagagattagtacacatggaagaaagggacatcatggagacgtag

SEQ ID NO: 4672 - DNA, 1021 bp, Glycine max
  Peptide Sequence Number=SeqID_121450
atgaaggcccaggccatccagaagcagaatactgccccccacgttttgtctcgtgggggttatgattatttggagcagaagctcctggctgagaagaccaaaaagaagctgcaggaagctgcacagtcaggaagcgttgatggtgtcatcgaccctccactccccggggagatgacgactgaggccgcaaaggaaatcgctgagaagattgatttgtttgaggagcaggccacacagggatcgttcgtcccccatggacgtcaggatgttctcgccgctgctattggacgtccagagcaccctggacgtgtccgtgctgttggagctggtgtcaccatcaagcaatactttggaccggctccacggacgtcccgcagcgtttcctccctgcctcctgacgaattacagcagctgacccagcagatcagggaccaactagaggagtccatcacaaagaaagtgacgaggcaggcacctcctgagcctctggttggtcctggtccctccggtcctcgggtgagcacaaaggggagttgtgttggtccctcaggaaacgatcctgagatgggtgactctgacaggtgcggcttgtacatagaagcagatcctgcccgcctggttgccatggcgagagtttatgagggatcgactcttgttcataacactcctttgttgcctggccaagtaaaggtgagtgtggacgaggttaaagatgcagatgctccagttcctgtacccactgctgaggtttccttagtggggcaggcacttcacaccttccttgcttggccgacacatctgatcaagtctttatcacaccaggtagttgtgtctccgccaaaaccacctccgaagcccgatccggaggtcgatgatccgctttatctgatgacattgaccatcccagagcttttcttgaggccttatcaggttagatgggatgccaccgtgttcgaggtcgttaatccaaatttccacctgtacataaagcacgaagacctctccgaaatcgcacacggtg

SEQ ID NO: 4673 - DNA, 123 bp, Glycine max
  Peptide Sequence Number=SeqID_121451
atggaggaggcacgaagagaagctttggctgcgcagcaacactggtttcgtaggagtaataagccttctggtaatcgattacaggatgttgtaatcgattacaggctgcctgttcttgtgtaa

SEQ ID NO: 4674 - DNA, 507 bp, Glycine max
  Peptide Sequence Number=SeqID_121452
atgaaaattacttcgcatcatataataactcaacgaatctgttcgcttcgtttgttgcacctcactattacgaagagtcctaattggctaatggcaacaaccgtgagtgatgacgaaacatcgcttactggtaccccaattccctgtcttcaacttcgggtgtctctgactctgtcaaacgcggtactcagaaaccaggcgcaggtttattggattctcgtaaaacgacagagaaagaaagacattgtgtcacgcaaccgcaactgccgcaaagtttcagcggagattgttgattcagtaggaatcggaaatgttgggggatttcatcattcgatgtcttatacttcttatatcttcttggatttcagactgattctggggtatgcgtatcctggatttgaatgctacaaaagtgtggagcaaaacaggggtgacaatggggaacttcgattctggtgtcaatactggtacgggaatccacgtttctttggcaataatatgtcataa

SEQ ID NO: 4675 - DNA, 801 bp, Glycine max
  Peptide Sequence Number=SeqID_121453
atgtgggtagctttgacatggcgtatatggcaccataggaacaggttgattttctccaatgaagaattccatggtccagcaatactaaagctgggcttttgtgtggaggtgatttacttttgttggttgtggctgaaaaacatggaaaggattttgaaataccttatcacgtatggaccagcaatactaaagctgggcttttgtgtggagggggataaggtcttttgtgggtgggatttatcatgctcttcatcacagtgttttgtgcattcaacagcaatttccagaatttaccttgaggacaaggttctttttgaaggggagatattgttaggaaagaggatcagggtcagccacgggctgaacaaaaagctttgttattacgtctttttgatggtgtgtatgccttgggacgatccccaagtaattcctgctaatatgacactagaggtgtctgagctttttacaagggagttgacaaggtacattgaagaaacggaagaacttgcaatgaatgctttaaggaataacaggcacatcctggacttgattgtgagggaactattggagaggtcaagaataaccggattgactaactcccccaaatgcttgaagttgttccatagaggcctgggaatggctttatatctcacacctcctcctatacaagagccttttgggcttaaggaggttgaagaaaaattaaaggaaatgtctccagtaatgttcgaggactttgtgaagccattccagataaatccagatgaggtactttcttccctactgcttaatgtggtttag

SEQ ID NO: 4676 - DNA, 288 bp, Glycine max
  Peptide Sequence Number=SeqID_121454
atgcatgaagattgtcgaggtgtctccaaggcttaccagcacaaagaattcatcaaaaatgagatgcatcactggccaattgcagaagaaaatgagcaatttaaatttaatcaacagctccactatgttcctctccctggtgtcaacatctatggagaggagcaggatacaagtcgggtaactgatatcgtagccgatcattatgcggtaatggtcccttctgcattgataaaactacaattattgcatttgtgggaggaaatgaaaagcgtcacagttacaaactga

SEQ ID NO: 4677 - DNA, 276 bp, Glycine max
  Peptide Sequence Number=SeqID_121455
atggagagtgagctggcttggataaaattcatggcggaagtggaggctcttggtgttcagcctttgcagaaggatagatgggtgtctagatgtccgatgtgtatgttggaggaggaagatgcttcccatttattctttaaatgtgataggatcataccaatgtggtgggagtgtctctcatggctaggagtgtctatagtattgccacaaacaccaaacaaatacttcttacggcattcatactgctgtttggaaggtgtggttcagaataggtga

SEQ ID NO: 4678 - DNA, 776 bp, Glycine max
  Peptide Sequence Number=SeqID_121456
aagctctatgaagggattaagatagggaaggatgaggtggacattagcttgctgaggataaattttgctaaaagcaaatttggggcaattggcatctcgcatcattggattgagaatgtgacaaattaccttagttgcaaagtgttggccaatccttttttgtatttgggtatccctattggggcaaacccaaggcataatggtctcgaagaaggtggccatcaaattggggaggctgcagcgatggatattgcaaagttcaattgcaattttcttgggaaatggcgttggaacctttttcatcataagggagaattatgggcgagggttttggattccaaatacgagagctggagaagggaggggggatggttcaaaggtggtatagaatggaaaattggatgtggaacaaagattaaactgtgggaagatgggcctagattcccagaaaagagcttaagggcagtgattttagtggaggatgagctaatcaatgaagatggagaaattacaaggaaaaaaactgagacgggaactgaggaggatgacaatgaggctgtggatttgatcttaggagtagcatggctggctactttgggggaagttaaagtaaactggaaaagtcagacaatgaaatttgtacagcaaggacaagttgtggaggtaaagggtgatccggttttctctgaaccaaaggggttgcctccaaacaaagaggtggaccattgcatccctatgaaggctggaatagatccagtgactatttgtccttactg

SEQ ID NO: 4679 - DNA, 720 bp, Glycine max
  Peptide Sequence Number=SeqID_121457
ggtcattgtagcacttttcacagtactggagaattttaccgatgcagttattggatggtggggacgggatatgtatataatactgtgctgcggccttatgtatcaagccatgaaaatgacattgagaaaaagttccgagagtggcgagctagggcatgggatttggccattttttactggaaaaactgcacagagttggggcaagctacaactttccagattctcgactatttggctgcacagtctaaaaaattctccagcaaatcttactctgagaaaaaagacaagctgggtccaactccaagtgccccaccattatcttcacttcgagaaactctctttgagaacaaccaaaacaaattcccaggccgcaagaacaaagtagaatcgtgtgaacacgtggaccctgagagcgtggagcattcgacggaaaaaccgggtaacggcggggaagaagtggtggtagaagaagccgaggcaggcggcggagaggcggcggaggaagttgggagtggaggcgccgccttgggaggcggacatgggctgaaggtaggcccaggcggcttgcttaacgaggcggttgcggatggaaatttcttggccggagtacacggaggcggtgggggagttcacggcggcgtagggcgaagggagcatgtctcggagggaagtgtaggaggcggagaagggggacataagggatacaagttcgaagcttga

SEQ ID NO: 4680 - DNA, 666 bp, Glycine max
  Peptide Sequence Number=SeqID_121458
atggaagagaccaattccagattcaagaggatttgcgtcttctgtgggagcagttcagggaagaaacctacctatcaggaagctgctgttcaacttggcagggaactggtggaaagaaggattgatttggtctatggaggtggtagcgtggggctgatgggtctcgtttctcaggcagttcatgatggtgggcgccatgttctaggggttatcccaacaagtcttatgccaagagagataacaggtgatcctattggggaagtgagagccgtatctagtatgcaccaaaggaaagccgagatggcccgtcaagccgatgcttttattgccctccccggaggatatggaacccttgaagaattgctggaagtcattacatgggcgcagcttgggatccacagcaaacccgttttccgtttgaatgggagtaaagtgggcctgttgaatgtggatggattttacaattccttgttgtcgttcattgacaaagccgttgatgaaggctttatatcccctaaggcacgtcgcattatcgtgtcagcacccacagccaaacaattgatgctagagctagaggaacatgttcccgagcaagatgagtttgcgtccaagttggtgtgggaagaaagactgaattacgtgactgaatcagaagttgccatgtga

SEQ ID NO: 4681 - DNA, 201 bp, Glycine max
  Peptide Sequence Number=SeqID_121459
atgggagttgtcaatgggagttgtaacttgcactcaaatcgcaagttgcagttgcaactccccttcaggcctgcagctggacaactcgccactacgagtggcgttttccgtgccacgtggcgtttttccagcaaactcgccactaggagtgacagtttgctatattatccatgcaaaggacgtagaaaagaaccccctcat

SEQ ID NO: 4682 - DNA, 643 bp, Glycine max
  Peptide Sequence Number=SeqID_121460
agcttgcagctcgactgtgtatcctgggaggggatttgttcttaatgccgagggtctgccgtggaagctcttgtggaaagatcttaccactctggcccaaacctggagtgttctatcttattctaacttggccccgacatcccatacttctgatcttaatcttgatagggccaagttagtctacgagcttgtaatgaagatgaacatgaacttaggatcacttatttctggtcagatttcactcattgctcagtccaactcctcgttgcttggatttccagctctgattactgccttgtgcaaggcccgaggagtcacctcaaattctcttaccttcaagtcactcagcccaaccattaatttggcttatattaagaataattgctggaacctggatgacccttcggcgaggctcacgggtgcatcttccatgggaggaaaatgcgcagagtcgccaccaacatttattgaaagggaaacgttagaaaaccaaaggaaaccggtcataaagaatattccagattcgagagttatctttacgcttgaggaaggtattagcacctctcacgtcgacaaaagcggggcttttgctcctacgtaccctccatcaaagaagaaatcagacctacgtagttcttcctaa

SEQ ID NO: 4683 - DNA, 582 bp, Glycine max
  Peptide Sequence Number=SeqID_121461
atggcgccgccatggccgccatttaacaacactgctctcaggtcacctctcaggtgcgaccccaccctaggagtttcggccagttctacccatccttgtgggcccacatctccagggcattccaaaattttccagcaagatattattgatgtactagataaacaactgcttgagggtatgggtgtccttctgacagaggaagagcaacaaaaatgtgaacaaaggttatcctttgaaaagaagagactgcttgctgttcatgaagctggtcatgtagtgctagctcacttatttcctcggtttgactggcatgcattttcacagctcctgcctggtggtaaggaaactgcaatatctgtattttatcctcgagaagatatggtagaccaaggctatacaacatttggttacatgatgatgcaaatggtagtagctcatggtggtcgatgtgctgaacgtattatatttggtgatgatataactgatggtggaagtgatgatcttgaaaagataacgaagcgtgactttgtggctcaaattcaaaaatatatgatagatacgtcattaccattcagagtttga

SEQ ID NO: 4684 - DNA, 597 bp, Glycine max
  Peptide Sequence Number=SeqID_121462
atgaaagttcatcccaaattaagcggtggtagagacaggaatgtcaatgtatttgttcaaaggaggcagcatgcctttgagttgagtccacgtacagagtgcggcgtcaaaactgaaattccacctacaccaagtgtcccttcattcaatggctccaatccatcaactaacaacccggcgttcaaagagtactactatctcactcttcgcaaggtcattgttgacggtaacggcggcaccatcgttgacactggatccaccttcacgttcatggaaaggcccgacgctgaggcccaatctggattgagcccctgttttgatatcactggcttcaagaccgtcactttccccgagttgacttttcagttcaaaggcggcgcccaaatgacgcaaccgctggtcaattatttctcgttggtcagagattccgaggtcgtgtgtttgaccgttgtctccaacggaggtatcggtccggcgataacctcaggcccggccatcatcttggggaattatcaacagcagaatttctacattgaatatgatttggagaatgagaggttcgggtttggtcctcgtagtttcaaaaggaaagcttag

SEQ ID NO: 4685 - DNA, 162 bp, Glycine max
  Peptide Sequence Number=SeqID_121463
atgccaacttatggaacacgttgtcacgaggatgggaataaaatttgggatggattggcatttaagatgaatctttgggtgtccggacagtgggctgctgagagggatgttcacaagtccgaaaagtggagaacaatgactgggttgctccaatggactaat

SEQ ID NO: 4686 - DNA, 348 bp, Glycine max
  Peptide Sequence Number=SeqID_121464
atgggtgaaaaggagctgtgggcagttttcaagaaatggggagatgctagggaggtttttattgcaaggaatcggaatagaaatggccgcaggtatggttttgtgagactcaaaggggtggaaaatgcagagactagagagacagctggacaatctatttctgggagggaacaaaagctgataaagactataaaaagcaagccccaatcaaaggaggaggcagctacaacaaaggtgagggatagggacaaagacaaaggaaaaggtgtagcaaaccagagtacaactacaggaggtcaacaacacagtatcagaaatgtgacaggcagcagaacatatgcgaggtga

SEQ ID NO: 4687 - DNA, 684 bp, Glycine max
  Peptide Sequence Number=SeqID_121465
atggccgataagcaaccccacttgaatggtgcttattacggtcccgccattcccccggcggagcaaccacactaccgccctagccgcgaaagaagctgctgttgctgcctcttcggaatcttgtggaagattctggttgcactcattgtcctcgttggcctcgcggtcctcatcttctggctggtggttcaaccccgttccttcaagttccacgtcacgaaagccaacctaacacaatttgattactataccaacaacaacacccttcactacaacatggtcctcaacttcactgcacgcaaccccaacaaaaaactcagcatatactacgacaaagtagaggcattagcattctacgaggatgtcaggttcgccaattacagtgtgataacgcacatgaactccttccgccagtacaagaagaccaccagccacatgagcgccgttttctcggggcagcaagtgttgccgctcgacaacgacctagtctcagagttgaaccaagacaagagtggtggggtgtacgagatcgatgtgaagctctacttcaggattaggttcaggctcggggatgtcaaaacccgtcgcttcaagcccgaggtcaaatgtgatatcagggttcccttgaggaccaatggcagcgtaactttgtttcagaccaccaagtgtgatgtcgattactag

SEQ ID NO: 4688 - DNA, 288 bp, Glycine max
  Peptide Sequence Number=SeqID_121466
atggactggcccgcgaggcccatggtccgcgcggtgttatcaaatggcggcaatggcggcgctatggcggttttgcgtggcgaaaatttgaaaaaactccaccgaatagcggtggcgtggcggttttacaatgacggcgccatggcggtcatggtgcgtggaaacgcaggacagaacgcagcactcgaccaggagcgacaccccgtacgcagtagtcaccgtgcacccagcagcgacgaccccacggcccgcacacccgacccggtagcgacgaggactgacacatga

SEQ ID NO: 4689 - DNA, 654 bp, Glycine max
  Peptide Sequence Number=SeqID_121467
atgggaaagatgaaagtggattcacgtcctgagaccaatgctttggctgtagaagccactacttgtaagagttcaaccattcggaagagctcctccaatctctgtggcagtccagcacatctaaagggcagtaaaaaatttgggcctaaatctggtcctacagctcatgaggcaaaaaagacctccttgtgtaaggaacaagttgatgaactcataaggttgttaaaatctagtacattatctagtattcctagtggttctatggcacaaacagaaataaaaagattagaattgcagatggtagttttttcagcaattgcaggagaagggagtagtatgttatctaaacacattgacttaaaaaatgtgctacatgatcagacttccgggaagatgattggcagtgctaaaatgatggatggtctctactatttcgaggatgctttcgggaataaagtagctcaaggtcttagtggtattagttccacctctgtaagggaccaaataatgctttggcatagtagactaggacatcctagctttcaatatcttagttgtgttcttgccaaaagtcatagaactccttactcctctcagtcttatgtatctaaaccttttcatttgacccatagtgatgtatggggtccatcataa

SEQ ID NO: 4690 - DNA, 459 bp, Glycine max
  Peptide Sequence Number=SeqID_121468
atgcctgatgtcctgaggaagccgcatgatcaaaaactttcatggaagcatgcatgtggaaaatggaagggtttatgtctgtacaacattatgactgcagtgatagctaggttatctctattttcatctattattaggaaggaaaaaactggtgtagaccgtgtatccctcagacaagctatcatatttatctgtgccacaaataggccagatgaattagatcttgagtttgttcgtgctggacgtattgatcgtcgtctgtacattggtttgcctgatgcaaagcagagagttcaaatttttggtgtgcacagttccggaaagcaacttgcagaggatgtggattttgacgagcttgtcttccgtactgttggattctctggagcagatataagaaaccttgtcaacgaatcagcaataatgtcgggaaggccaggtattctttaccttgaaatatga

SEQ ID NO: 4691 - DNA, 438 bp, Glycine max
  Peptide Sequence Number=SeqID_121469
attagagtccacgtatataaccctctcgatgcaaggttcgagaaggtcagcgaggtactttctagcgtagttgagggattgttcgagggcttgtctgacggaggtggagatcaggttgcgaacgatctctggatcgaaactaggaagtggaagaagatgttctccgggcactgggagtgttggaggattgagtggacggcgacgatggagccacgaaggtactccacgtcgagggtgatggccatgtggacaagggaggggtcacagacggaggtgaaaacgaaggaggcgcatttaccgttggcggcattgcggaatggagcagtggggcagagggaggcagaggaggctgtcgagatggtgggaggagcggatgttggtgccatggggacgaagccagagaggagagagaagacgacagagaggaatccatgctaa

SEQ ID NO: 4692 - DNA, 192 bp, Glycine max
  Peptide Sequence Number=SeqID_121470
atgaagccacaccaagaagagacgaaaattgtaaacttgggcgttgactaccaagacatcttcgcttggtcataccatgatatgcccagcttaaaccccgacatggttcagcataggttgcccttgaatcccgtcgctcgatacccggaatggcttgccaacattgtgccagtccctaagaaagatgggaag

SEQ ID NO: 4693 - DNA, 933 bp, Glycine max
  Peptide Sequence Number=SeqID_121471
atggccgataagcaaccccacttgaacggcgcttattacggtcccgccattcctccggcggagcaaccacgctaccgccctcacagtcaccgcggaagaagctgctgttgctgcctcttcggaatcttgtggaagattctggttgcactcattgtcctcgttggcctcgcggtcctcatcttctggctggtggttcaaccccgttccttcaagttccacgtcacggaagccgacctaacacaatttgattactataccaacaacaacacccttcactacaacatggtcctcaacttcactgcacgcaaccccaacaagaagctcaacatatactacgacaaagttgaggcattagcattctacgaggatgtcaggttcgcaagttacgatgtcataacacacatgaactccttccgccagtacaagaagagctccagccccatgagcgccgttttcacagggcaacaattgctgatgctgaacaatgatcaagtctcagagttcaaccaagacaggaatactggtgtttatgacatctatgtgaagctctacttcaggatgaggaaccttgaggtgacatttgaccttgggcttcaagtgacgggatatggagtccccgagcctgaaccgaatcctgaagttgagcttcacatagatgtcataaaccccatcactcttgtcttggttcaacttagaggcttgttcattgttgagcatcaacaatttctgtcccgagaaaacggcgctcatggggctggtgatcttcttgtactggcggaaggagttcatgtcggcttccgtgacgtggaacttgaaggaacggggttgaaccaccagccagaatatgaggattgcgaggccaacggggacgatgagtgcaacgagaatcttccacaagattccgaagaggcagcagcagcagcttgttccatg

SEQ ID NO: 4694 - DNA, 720 bp, Glycine max
  Peptide Sequence Number=SeqID_121472
atggggagcagattcaggcttgctgttgcagaaagggcacaggccgatttagtagagaagttgccactaatgtcagctctccaaacccagaaaaggatgttgtcatgcaccatcactccccgatggaaggttcacattggggctgtttggtgcatagaagaaaaggcgtttgagagcgcgtcagaagtcggatgccaatgtcatgtccactgccatgtagatcggcaaaagacgagtaaggtgatggggtcactggttgaaaatgtcaccgaagcagtggcagtggcagtggcgtgtgatgcttcttgctgtggcattggagctgtcttgatgcaagatcaccaaccaattgcctattttcgtaaggccctgtcccatggtactctatccaaatcagtgtatgaggaggaaattatggctctcgctttgtctggtcaacattggaaacactaccttcttgaacgcagcttcgaagtctatactggtcataaaagtctagcacttgctacaacaacatctcacaacaacagaccagcaatgttggttgtccaaattaatgaggaggtgagtaatgatcctgttctgaaccgcatcaaggagacgctacagctggatccatcttcgatgcatgagtatatacttcgtgagggattgatcttcttcaagggggacattgatgctttcttccagttcagttctgattctcatgatgcttactga

SEQ ID NO: 4695 - DNA, 1395 bp, Glycine max
  Peptide Sequence Number=SeqID_121473
atgtgcactagggccaaatctggcatagtgaagcctagactcaatcccactttactactagcacatgccgaacctaagaatgtcaaaacagcactctctaatcctacttggaagcaagctatgcaggttgaatatgatgctttactttgcaatggtacatggtctttggttgagttacctccttccaggtctgccatcggttgcaagtgggtgtttcgagtaaaagggaatccagatggctctattaataagtacaaggcatggcttgtagccaaaggctttcatcaacaaatggaaaaagactacaatgagactttttctccagttattaaaccagtaactgtaaggatcctactcactttagctgtcaccaacaagtctatcaagtctttagttaccaacctcaattctgaatttgcactcaaggatttgggagatttggattacttccttggtattgaggtgaatcatcgccctaatggctctctcatgctcactcagtccaagtacattcgggatctcttgtcaaagacagctatggatgaagctaactctatttcttctcctatggttggtggctgcaagcttacaaaaacaggttctgaggatttttttgatcctaccttgtatcgttttgtggttggtgctctacattatgctactatcacacatccaaaaattagtttctctgacaataaagttttccaatttatgagtcagccaacagaacaggattgggttgctgtcaagagaatccccgggtatctaaagggcacacttcattttgggctgaaactggaacccaatttttctacaaagcactactctgttcatgccttttgcgatgctgactgggcttcagaccttgatgatcgaagctctacctctggggctgttgtgttcttaggcccaaatcttgtctcttggtccagtactgaggcagagtacaggagtttagccttggcaacagctgaagtaacttggattcagtccctgctgactgaactcaaagttcctcatgctccaccagttattttctgtgataatatgagtactgtgtcccttgctcaaccctctcctacactctcgcaccaaacatatcaagctggatttgttctttgtcagagagaaggtacagtacagagggcagagtacaggagtttagccttggcaacagctgaagtaacttggattcagtccctgctgactgaactcaaagttcctcatgctccaccagttattttctgtgataatatgagtactgtgtcccttgctcaaccctcttctacactctcacaccaaacatatcgagctggatttgttctttgtcagagagaaggttctcagcaaacagtgtcaagttgtccatgttccagcagcagaccagagagctga

SEQ ID NO: 4696 - DNA, 492 bp, Glycine max
  Peptide Sequence Number=SeqID_121474
atgggtaaacccactgaacagcactggatggaagtcaaaagaatacttaggtatcttagaggctctctcaactttggtttgaatatgcaacctaatttctcagtgtcacattactctattcatgcctattgtgatgctgactgggcatctgatccagatgacagaaggtcatcctctagtgctgccatttttattggtcctaatttggtatcttggtggtctaaaaagcaatcagtggtggccagatccagtacgaaggcagagtataggagtttagctcttgctacagctgaggtgagttggattcagtctcttttggttgagctcaaggttcctcatgctcctcctgttatcttctgtgacaacctcagcactgcctccttagcacataatcctgtttcacactccagaactcagcacatcgagcttgatttgttttttgttcaagagaaggttattggcaagcatcttcaagtagttcatgttagttga

SEQ ID NO: 4697 - DNA, 993 bp, Glycine max
  Peptide Sequence Number=SeqID_121475
atggggacgctgtcgaaggcgttgggtagatcggcactgggtgctcttgatggtgtgtttgtcgtctggaaagtttgctggaggggatggcggccgctggaaaatgaagcagagtttgctgtaaaagtgagaatcagaatattaattcttatttccaacactttacaacatatgaaggtagcagccgttgtctttactgaagacttgaaaagattgtatgtgacgatgaaagaaggttttccattggaatttgttgttgatatccctcttgatccgtatatgtttgagattattacaagttccggagttgaagtagatctccttcagaagcgacagatccattatttcatgaaggttgtgattgcattagtacctggaatactgattctctggcttataagggagtctgtaatgcttctacacattactaacaagaggtttctttacaagaagtataatcaactctatgatatggctcatgctgaaaatttcatcatgccagttggagatgttggtgaaacaaaatcaatgtacaaggaagttgtgttggggggtgatgtctgggatcttcttgatgagttaatgatctatatgggaaatcctatgcaattctatgaaagggatgtgcagtttgttcggggtgttctactctctggacctccaggaactggaaaaacactttttgccaggacgcttgcaaaagaaagtggattaccttttgtatttgcttcaggtgcagaattcactgatagtgaaaaaagtggtgcagctaggatcaatgagatgttttccattgctaggagaaatgatgtcctcggccctctaagtgacttggtaaaaatatctggtagtgagttttgcataaattatcttctcttgcataaagtgacaaccaatttcaatttttttcgtggaagaccaataattattcaaattgaaggcaagactaatgcatctgggataattgtcgggactagtgcttctgggacataa

SEQ ID NO: 4698 - DNA, 2658 bp, Glycine max
  Peptide Sequence Number=SeqID_121476
ggcgacgacccatgtggttggaaatacattttctgcgacagcaacaaacgcgtgaaccagattcaacccaagggcttaaacctcagcggtcccttgccgcagaacctgaaccagctcaccatgctcttcaacttgggcctccagaacaacaggctcaacggcccattaccctccttccgcggtctgtcaaagctcaaatacgcctacctcgacaacaacaacttcgactccatcccttcagatttcttcgacggcctccagagtctagaagttttggccttggaccataataacctcaacgccagcaccggcggctggcagttacccgaaactctccaggagtcaacgcagttgaccaatttctcttgtatgggctgcaacctcaccggcccaatacctcaatttctcggctccatgaactcactgtcgtttttgaagctctctaacaactacttaacgggtgacattccccggagtttaaacgactctgcgttgcaggttctgtggctgaacaaccagcagggagagcgtctcagtgggggaattgatgttgtggcttctatggtttctctcacgagtttgtggcttcacggaaacgctttcactgggacgatccccgagaacattggggctttgagctctttgaaggagctcaaccttaatgggaacaacctcgttgggttggttcctcgaggtttgggtgacatgaagctgggcaagctggatttgaacaataaccattttatgggtccgattccggattttaaagcggctactgtgtcgtatgatgttaataatttttgtgtgagcaaaccgggggttccttgcgcgtttgaggtgatggcgttgttagggtttcttggtgggttgaattatcctctgaatttggttgattcgtggactgggaatgatccttgtggggggaattggttggggataaagtgtaatgctgatggaaaggtgattatgattaatttgcctaatttgaatcttagtgggagtttaagtccttctgttgcgaacttgggttctctcgttgagattaggttgggggggaatgatattagtggtgtggtgcctggtaattggactagtttggcatctttgaaatcgttggatctgagtgggaacaacatttatcctccactgcctgactttaagactggattgaaacctgttgttgtggggaatcctctgttaaatggtggagcgaaaactactccttcggggaacaataacccgtcaactggatctgggaatgttgacccttcagggaacactaactcgaattctagttcaagtgattctcatgaaactaagaaatccaaaaggaaacagttggtttcgattgttgctccgattgcgggtgtggcagctgcggcttttctgctcattccgctctatgcatactgtttcaggaggaggaacggtggcttccaggctccaacttcactggtaattcaccctagggatccatcggattcggacagtgctgtgaagattgctgttgctaataataccaatggaagcatttccactttgacagggagtgggtctgggactggaaatctaaggatatcagttcaggttctgaggaaagtgaccgagaactttgcgcctgagaatgagcttggccgtggtggatttggggttgtttataagggggagttggatgatggtactaaaattgcagtgaaacgaatggaagcaggtgtgattagtagtaaggccttggatgaattccagtctgagattgcagttctatcgaaagtccgacaccggcatctggtgtctcttttgggttattctacagagggtaatgaaagaattctagtgtacgagtatatgccacaaggggctctcagtaagcatcttttccattggaagagccatgatctggagcccctctcttggaagaggagactcaatattgccttggatgttgccagagggatggagtatctccatactctggctcaccaaagcttcattcacagagatcttaagccgtcaaatatcttgcttgctgatgatttcaaagcaaaagtctccgattttgggttggtaaaacttgctcctgaaggggaaaaagcatctgtagtgacccggcttgcagggacgtttggatatttggcgccagaatatgcagtgacaggaaaaatcactaccaaagcagatgttttcagttttggggttgtgctaatggagttgttgactggattaatggcacttgatgaggatagacctgaggaaagccaatacttggcagcatggttctggcatataaaatcagataagaagaaactaatggctgctatcgatcctgcccttgatgtaaaagaagaaacatttgagagcgtctccatcattgctgagctagcagggcactgcactgcaagagaaccaagccaacggccagatatgggtcatgccgtgaatgtgttggcaccgcttgtcgaaaaatggaaaccctttgatgatgacaccgaggagtattccggcattgattatagccttccccttaaccagatggtgaagggatggcaagaggcagaaggaaaggacttaagttatatggaccttgaagacagtaagagtagtatccctgcaaggcctactggatttgcagattcttttacttctgctgatggccggtga

SEQ ID NO: 4699 - DNA, 1461 bp, Glycine max
  Peptide Sequence Number=SeqID_121477
atggatatagagtcaacaacccaagcaaacaagggtggatttttatctcatttggggaactgcctccaggatttgccttggaacttcaagtccaaggttatcaacatcacaaggagcataacaaagattggaaaagatgaccccagacgagtaattcactcattaaaagtggcagttgctctcacatcggtgtcattggtttactactcgaggcctctttatgatggcttcggagttgccggaatgtgggctgttctgacagtggtggtagtgtttgaattcagtgtaggtgcaaccctcagcaaaggtttaaatagaggatttgctacattattagctggtgctttaggggttggagggcaacacttagctacagcttttggaggaagagcagaacctattgtccttgggatccttgtcttcattttagcagcaggagctacttttttcagattttttccaaagatcaagcaaagatatgattatgggattgtggtatttatattgacattttgtttggtcgctgtctcgggttatagagtggaagaactcttcgagcttgcccatcagagactttcaacaattttattaggagcagcagcttgcatggtcatctccattttcatttgtccagtatgggcaggtgaagactttcacaagttggtggcttccaatatagaaaagttagcaaattacctacaaggattcgaaaccgaatattttcattgctcagaggatacaaaaaagtgtgagaagtcagttcttgaaggatataaaagtgttcttaattctaaagcaagtgaggagtccttggcaaatttggcaaggtgggaaccaggacatggccgttttcgtcttcgccatccttgggagcagtacttgaagattggagcacttactcgggaatgtgcttacaagattgaaaccattaacaactacctcaacccggaaatccaagtatctttggaattcaagtgtaaagttcaggaaccatgcacaaagatgacctcagagtccaacaaggcattaaaggcaatatcttcatcaatcaaaaaaatgacacacccatcaactgccaaagtccacatagaaaattcaaaaactgcagttgaagacctcaaagttgcccttgaaatcgtttctttggaagatactgatctcctatccataatcccagttgccacagttgcatcaatactcgaagaaatcaccaaatcagtggagaaaatatatgagtctgtttctgagctttctcacttagcccatttcaagagtgttgttgaacccaatgtctcaccagagaagccaccccttcttcatcgaggtatcataaaacctgttgtggatattgataacaccgtcgaccatgttgaaattacaatcccagagataactacagactctccagagaaagaaaaggcaccaacaacaaaaccctcggaacatttaatttgtaaatag

SEQ ID NO: 4700 - DNA, 222 bp, Glycine max
  Peptide Sequence Number=SeqID_121478
atggttaccgctactactgttgtcaccactatcatgatcatcgctatcattgtcattattgctgctacaaccatcgtcgtcataaccaccttcatcgccactgtcgctaacaataatggcgattatgttggtggcgacgacgatggtcatggctatgatcatggtgatgatggtggttgcaacgatggtgatggttgtgatgacgattttgacgtaaattaa

SEQ ID NO: 4701 - DNA, 744 bp, Glycine max
  Peptide Sequence Number=SeqID_121479
atggggatgaaatcctataaggcttctgggtcgaacgacttccagtctatttttaataaaaatgtattgggagatgatgtgtggaagtttatgaaagagactttcgaaacaagtatgttcaatcctttggtggctgaaactttgattatgcttattctgaaatttgatgttcctaagcattttaaggattttagaccgattagtttatttaatttttattccaaggagaggcaaattgataatgctattgtgttgccagaagtcgtccactccatgtccaagtctaggaagaatgctcttttggattttggctttcctggaaggattgtatcattcataatgtgtcgcaacctacctcacgacgggacaacgaaagcaaaattaatagaggtaaaagcccattcgtctcctagggacaaaacgagtgggagttgccaccaacgtttatttaaggaaaacgttagaaaaaccaaaagagattacattcaactcttgaaaaaactaaccaactcttgcacgagggacacaaaacaagagaacaatgtagggaatgatcacggttgctattcggtagtgcctcggcttcgcttttcttccttcttcctcttctttctctctttctctttcttttcccaacttctgaaccctcaaacccctcccccaacatggctatttataggaaaaaaccattttggggcaggggaagctcgcccagacaagctagagctcacccaagcgagctga

SEQ ID NO: 4702 - DNA, 180 bp, Glycine max
  Peptide Sequence Number=SeqID_121480
atggaagaaatatatcttgaggttcatgagaaccctagggccttctttagcagttctagcccaatcctcttggagtcttctatccaatacccttgggaggatccccttccccttgaaaaggatttgacctcaaatctagaggttcttgatactttggacttcttccctcaacacttgtaa

SEQ ID NO: 4703 - DNA, 285 bp, Glycine max
  Peptide Sequence Number=SeqID_121481
atggggtggcattctccaaaagatgatgaagagtggtggggagagtggggttccatgaaaaatgtcactgttatgactggaaagaacatgtccttatctcatcctcccagggatcaaaagtgccaaacagagactggcctctggggagagcctaactctagaccacttcatggaaagactaacgaggaaggaacacaaggtcctaatggaatctctcaaccactgttacagcgtgaagctaacataggtgttcgattagaagcgctattatgttgtgtttgttga

SEQ ID NO: 4704 - DNA, 279 bp, Glycine max
  Peptide Sequence Number=SeqID_121482
atgaaagttctagtgaccaatacatcaacaccctatcatagaggaggtatgatgaatgcatcagggcatgtttatgctatgcgcgataaatgcgtttatctacggacacaagagcttggaagaccatctcttcttaccaacaatgcattgggtatcatggttcatttgcagtcattaccatggtgcccaatgcatgccattaagaagcaccccacgagcccgtcacaagggacaacagcctttgatcaaggtgtcgcccttgctccaatgtatcctcag

SEQ ID NO: 4705 - DNA, 204 bp, Glycine max
  Peptide Sequence Number=SeqID_121483
atggattttgtaggggagtcggttatggttgagtgggcattctctgttggatgggcgccagactgggaggagatccgacagtggccaagtaattgtactggggtgggggatattgctgcggttacggcatgggcatctccctcctttttcttagctccacctatactggtcctcttattgccaacacttgttgaagcggcataa

SEQ ID NO: 4706 - DNA, 2310 bp, Glycine max
  Peptide Sequence Number=SeqID_121484
atgttaggtagagaagatgacaaaaggaagagtggtgagggggctggaaaagaaacaacaggtgtatccccttactatatgcatccaccagacaatccagggaagttgatcacacctatacagctgaaaggagacaactatgaagaatgggcaagggcaatacgaaatgccttgcgagcaaagaagaaactagcatttgtggacaggactataaccgagacaaaggatgactcaactgatattgaagattggtggatggtgaactccatgctagtggcatggatcctgaacaccatagagccaagtctgcgctcaaccattacttatatggagagtgtcagaaatttgtgggaggattttcaacaaaggttctccattggaaatggggcacgtgtctatcagctcaagacagatctagctgggtgcaagcaaatgggacaaacagttgttgtatactatgtaaaggtgaaggtgatgtgggatgaactgataagttatgaaccaactccaacatgtaagtgtggtggatgcaaatgtaacattgcgaaagaattagaaaaaaagagagaggaagagaaggtccaccaattcttgatgagactggatgatgcaatatatgggaccatatgttccaacattttgagtatggatcctctaccaaacttgagtcgagcatatgcaataatcgtacaggaagaacgacacataaatatagccagaagcaaggaagaacgaggtgatgcagtgggctttgtcatgcaggtgggcactgaagtaaaagcagttgttgttcgaactaaagaaaaggggacgacatgtaaccactacaggaagactggacatgatgccaaggactattttcaagtcattggttatccggattggtgggaagataagccccgctcaacaagaaaaagtgtaggatgtggatggggaaattcatatgttggacgaggaagaggtgtgattaaactactgagtgaagtgcggaatattatgttgtgtccagtgggacttcccgatggaaaacaaaccaatgttgtaaaggaaggaataatgcatctaggagaaaatatttatctgcgaaatgtgctatatgttcctaatatgaattgcaccctcatatatgttgctaaacttatgcgagatttgagttgcactgttacttttactaataagctatgtgtgatgcatgaccaagctttgaggactttgattggactaggtgaagagtgtgatggggtttttctgtttcaaactacaataccagtacatgcaaataaagcaaagacaatgaatgttagcaagctatggcatgaaagattaggacacccatccaaacgaattcttacctacctacctgaggcaaatggtggtgatccaattgatttttgtgatatttgttataaagctaagcaaactcgtgatatgtttcaagaaagtcaaaataaagcttataaaagtttttccttgatacattgtgacttgtggggaccttataaggtgcccgcatcttgtggtgcaagttattttttgacaattttcaatgacttttctcgtgttgtgtgggtttacctattgcttgaaaagcgtgaagtagcacaaaccgttaaaaaatttcgtgcaatgattgagcgtcaatttgaaaaacaagttaaagatccgacaaacaacaaggaattagaatcacacttgatagattgtgcattctttgacgaccccaatgaaaatcaaagggacaaagagagtgaggagtggattacaaatgtaacagcgagggggagactgggcagttatgagcatgaaagagaagaacaaggatgtggaattgaagtgaccataagtgaggaaaacagtgatggcagtggacaagaaaagggtgtcgctgaacaagaggaacgacttggtagaggacaacgccaacataagccctcggtgctattacaagactacgtgacttacactgcatggtgtccgaaaggctccactcacactcaaacaccatccgagtcaaagccctcaggtaaaactccttatcccatagcaaattatgtaacatgtgctaagttttctcctcgatatcgttcattcttaactgcaataacaatggggcatgaacccacaagtttttcagttgctgtgaaggataaaagatggagagaagcaatgaagaaggaattagaagctcttgaaagcaatataacatggactttggagaccttgccccctgggaaaaaggcaattgggtgcaaatgggcgtataaaatcaaataccattctgatggatctatagaatgctataaagcatga

SEQ ID NO: 4707 - DNA, 714 bp, Glycine max
  Peptide Sequence Number=SeqID_121485
atggaaactgaaaagtctaatgtttcaaaggctgaagaatttaaactccttgccaatgaagtgttcaatgctcgaaaatactcccaagccattgatctatatacacaagcaattgagctgaacagtcaaaatgcagtttacttttctaatcgtgcctttgcccatcttcggcttgaggaatatggtagtgcaatacaagatgccacaaaggctattgaaattgatcctaaatattcgaaggcgaggcgctgctcatcttggactggggaaattcaaggaagcactgaaagattttcagcagcaagcaggactaacatcttccacccggaagatctaaatacagccaatagggctacgtatctcacagctgatcagagggcagaggtcaagaaaatgtgtccaaatgatcctgatgcaacaaagaaattgaaggaatgtgaaaaagcagttatgaaacttaaatttgaagaagcaattgctgcaccagagtctgaaaggcgttcaatagctgaatccatagatttccgtacgatagggccgcaattcttcggtgtcaaccgaagtggccatagcagcagtgacagtagcagttatggcagcagcggtgatgttgttcaggacatcaaagaccacaatagtagttgcaattgtggttggtttgctgttgctccttggggcttattggtggagtggccacaatactggtacatttag

SEQ ID NO: 4708 - DNA, 867 bp, Glycine max
  Peptide Sequence Number=SeqID_121486
atgaggaagactgcaaccagaacttgggataaggttgaggctttggtcatagatgaaattagcgtggtggattcaaagctatttgatggcctagagtttgttgccagaaagttgaaggatttgtcctctgttggtgagactgagaagtcaacggttggtgagaagtcaacggttggtgagaagtcaacggttgataagaagttgaagtcggagccgaagagtgtgaacgagaaaaggcttaaaagcttgcaaaaggaatgttttgtttatagagccattgatagcggtgacgattgttggaagaagcagtttgagcatggggtaacacctgatgtggttaccatttgcgaaggtgccaggaatattcagaattcaagaattgattattcttgtcccctaaaggccaacattgaatcttccattctgcaaaagcgctcctgcactacccctgcttcaaacgaaatcattgaggtgaggaggaaggagtggttgagctcctcacagtggctgaagtgctctttgcgaactcgacgaatgatgatcccgcgacggtcagaggacacgtgggggttgctgttagcaaggagggaaacaaccacaatgggaagcgaactcgacaaggttgtggggggcgactgtatgggtgcgaaaaatggaggtgatggcggaggtggcggcagaggttgcgacggaggcggcatggctggcggaggtggcatgatcgtggttgcgataagcgtgggtgatggagtcggcttgagcggcagaggtggcggcggaggcaacgacagagtcagtggcggagtccatggcagaggcagtaatggtgcaggacttggtggtatgggtgcggagcatgaagactga

SEQ ID NO: 4709 - DNA, 618 bp, Glycine max
  Peptide Sequence Number=SeqID_121487
atggcaacagtgcgaactcttctggcagtagcagcagcaaaacaatgggagttgcatcaaatggatgttcataatgcattcttgcatggcgacttggatgaagaggtgttcatgcaactcccaccaaggttttcaacaacagataagtctaaacctcactctgactactctttgttcacatatgcagacagtggaatgcaacttagtgtgctagtatatgttgatgacttggtcattgccagcaatgattctcgagctgtgactcagcttaagaaatatctaaacatgtgtttttacatgaaggatctaggaactcttaaatacttcctaggtattgaggttgctcatgggcttgaaggaatttttctctgtcagcgaaagtatgcactagacattgttactgaagttgatttgcttggggcaaagccagcagtgtctttaatggaacagaatcatcgattaacacacccacaagaagaccattgggaggcagcattacgagtcgtacattatcttaaaggcaaccctggtcaaggcatccttctacgagctgatagtgacctacacttaacaacatattgcgactcagattgggctagttgtcctcttacacgatga

SEQ ID NO: 4710 - DNA, 324 bp, Glycine max
  Peptide Sequence Number=SeqID_121488
atgtcaatgacccggcaagcagtttgccggtcatatccgcctggtcaatgcagaccatgtggcaggcattatgactggagtaatcaaacttccagtcgtcaacaagggtaccctcaaaaggaatcagaccagtgttttgaaacacttgatagcaatcaaatgtttccccatcaaagaattctagatgaaaacagtgtagaggatgacaaggatggtggaattggtgtcggggatgctccggtggctctgggacgtgatgttctatgtgccgcagcggaggtggataaacccttgcgcttcttggatgattctaccatttggtga

SEQ ID NO: 4711 - DNA, 99 bp, Glycine max
  Peptide Sequence Number=SeqID_121489
atggtagcggtggaggatgatggcaagattgcatgccaggctttatggaaggaatgtgagcggaaaggtagcaccggaggcaagcttggtcaaaagtag

SEQ ID NO: 4712 - DNA, 891 bp, Glycine max
  Peptide Sequence Number=SeqID_121490
atggatgaaattgaagttccaaagtatttcatctgccctatatcccttcaaatcatgaaagacccggtaaccactataacaggtatcacatacgaccgagacagcattgaacactggctattcaccaacaaaagcaccacatgcccaatcacaagacaacctctccctaaacactctgacctaaccccaaatcacacccttctccgcctaatccaattttggtgcacccaaaattgtattcatagggttcccacacctaagccaccacttaacaagttacaagtcctcaagcttctcaaagatatcaaggaccccaacttgcaactcaaaacgatcaaggaattgaaattgctagcaactcgaaacgagagaaataatattaacaaatgtttgttacttcaggctggtgtcccaaaggccatgatcttattcatgttgacttgttttagaaaaagtcaatttgataaggctctagaagaagctttaagtttattgcaacttgttgatgtgccagaagaggaaataaagcttcttctagcagagaaaaatgatcaaatattggattccctaacgcgggttttgggctctgatgagatggagaattcaattgctgtgaagtcccatgcattgatgttactcaacacattcatgcaagaagctagctccagcgtaatggaaagtgggactaaccaacaagacacgaaggctgcttttcatgccatgttaatcgcttgccactgggggagaaacaggatcatgatggttgaaagtggtgcagtttttgagctcatagagattgaattattgacgcctgaaaagagaaccacggaactcacgatggagatactgtttcgtctgtgttcttgtgctgaggtgtcattgctttgttga

SEQ ID NO: 4713 - DNA, 2220 bp, Glycine max
  Peptide Sequence Number=SeqID_121491
atggaagtgagagcagtggacccttatacaactaatccaggtccaattgatggttcggttctgtatgaccaagacaagcatgtctccactgcagtttgggatggacaggagcgtggtgcccttagatgtcatgaacatacttcaaagcttgatcagtggacacttactcataagcagattgaattggtagacaacgctggatttggatacttaaggtcaatcccagctattagtctagacaatccacttatctcagctctagttgaaaggtggagaagagaaacaaacacatttcacttgaatgttggtgaaatgacagtaacccttaaagatgttgcactcttgcttgggctggcaattgatggagaacctgtaattggtattacctatactgcatgcggttcagtgtgtgaaaagtatcttggtagatcaccagaatctggttacacaagtggtggaatggtgaagctaagttggttgaaagagtacttttctcgctgtcctgaagatgctccaattgaagtgattgagcaacatactcgtgcttatcttctttatcttgtaggtagcaccatattctcaacaactacagggaacaaagtccctgtaatgtatttgccattatttgagaattttgatagatgtgggcagtatgcctggggtgctgcagcattggcattcttgtatagagcactgggtaatgcctcactaaaaactcaaagtaccattagtggctgtttaacactacttcagtgttggagttactttcacctaaatattggacgaccaaagctcaatcttgagctgatgcatgatcgatttccctttgtgcttagatggaaaggaaaacaaagtggccctactgcaaatcgtgatgtagttttctatcggaaggctctggattccctaaaaccatgtgatgtggagtggctaccataccgaaacatggacagcatggtaattccagaacatatcaaaagcactttaattcttgggaggtcaaagacaatgctgatttgctttgacaaggcagaaagacatcttccaaatcgatgcttaaggcaatatggcatgcttcaatcaattccggatgatgtggagcgttgggagaggaagagtagaggagttgacggtggggttgatttgtcagggaaaatggaatctgagcttaatgactggatggaccgtcaggtgagtattgttgatggggatgagggtgtagatgaaagtgagtacatggagtggtatttgagaatcactcgtaagttcattggaaggcctatttctctgtcgtccgagtttcagagaacgaatgctggtctcagggatattgcacacatagcggataccttttcaacaaaagggctagatccacaacaaattgaatcaatatcaaggataagatatattgcacatgaatgtttgagagaccaatttggtggtccagtcatggcgtcagggagcacccaagttgaactagggaaaagggtcagaggtaaggagagggttagaagaaaaggaggaacaggtaaacgactgcgaaaggatggtgtggttcaatataatgccgttagtgaggatgaacaagcccagtactatggcactgctattgaggttggccaattacatctaagtcatattgaaagagagctgaatcatgcacaattatgtactgtagacaatgaagtcagtgttgtccagttgattcatgcaaatgctgatggtgagaatatgcagctctgtgatccacacattgaggttgatgaatcagatctaggctatgcagcaggtgaagaaaataatgaggacccagatgatgtggctgctgaatttagccatgaagaactaaagcacagagctggtgaagaaataaagcaagagcttaaccatttgactggagaggaaaacattgaggaactgaatgcagccaatgagattcattttgtgcaaccttcagagctttgtgatgttagtcacgatatcgattcaacgcttgcagatgctgctgctgaggtcaatcactcgcaacttggtgactcaagtgtgatcaatccacaacaaagcagtccaactgacaatcttgttaattctcagctttctcacattaaccctgaaagtgaacttccttctgctaaaggagcaatggaagtgtctcaacattcttctattgaaactcgcgaggatatttcacagaatggtgattgtactgttgctgtatag

SEQ ID NO: 4714 - DNA, 399 bp, Glycine max
  Peptide Sequence Number=SeqID_121492
atggggttaacttgggccacccccaaacccaaaggaagcccctttgtgaattccacacccaccctttttgcgtgttgttgccctcaaacaaattacaaagctgtgctaagtgctaaatcaagcgacgacgacggtggaagtcgtatcgtgttctcctccattcactccatgcagatctcttgtcaccttcttcctgtgcctcttctctatcatctttctctccctggtgggggtcccaaattcgtgtgggactcaagcacttcttctcttgctgtggaatggaaagggaagggaagggaagggaaggttcaaggaggagttgtggtgcttgtttggttcaggaggttgaaatgggatggtagaaagatgaaagtgttaaaattctggactagcagttga

SEQ ID NO: 4715 - DNA, 690 bp, Glycine max
  Peptide Sequence Number=SeqID_121493
atgatgatgatggatccgccgatgacgccgctggggcaaatgctattggaggagatcactcccgtcgtcatgctcctctcaactccttccgtcgaacaagtttccctcaagaacggtctctccttcctccagacgctaacgccgttctgctccttcaacaacatcgacgttcctgttaggaccgccagtgaccaaccttatcgccttcacaagttcaaattgcgtttgttctacgcttccgatgtgaggaagcctgatttgaaggtagctaaagagcaagtgaagcaagttatcacagaggcaggggagaaagagttttctgagtcgtgttcagatgtgtcagaaattaatcatgaactttcgtcgagttccgaataccaacatacaccatcctggtttcggtttctcaataaagaacttgttcgtgtggcttccttttcagaccatgaagcatttgaccatcctgtgatatgtcttgttgctgtttcatcaaaggatgaacagcctattagcagatttgttgacctttgtaatgccaacaagcttccttcccttcttaatgatggtgcaatggatccaaaaatttcaaagcattacttgttagtgcatgataatcaagatggccctgcagacaggatacaaatgtccttttggcaaggtttcaggcttcatgttgctctgtctgtttga

SEQ ID NO: 4716 - DNA, 1623 bp, Glycine max
  Peptide Sequence Number=SeqID_121494
atggcttttgttgtagactttcttgatatcaggagtacatttggtgcaagtgactgttcattgctttgcattaattcttccctggatgctccaatcaaacatcaagataatccttgggcttcatatataactgatgcctcacctactcatagtcaagattttggttgctttctcaacattgatgatatcaacgaggtttctgccacacgaaaagggtttaaaaaccaaataaaaaatttatggtggagaaaagggaaagaagatggtgcagattctctcaatggtcccacgtatgactttaattccattgaatcccagattcgagttttgggtgattatgctttcatgttacgagattatgaacttgccttgtcaaattatcgcctaatttccacagattacaagattgataaagcctggaagcgttatgctggtgtgcaggaaatgatgggacttacatacttcatattggatcaatcaagaaaggaagctgagtattgcatggaaaatgcttttaacacatatttagatatcctacattctgctgtgatgcttgaacaagcatcatactgctacttgttgtctaaaccctccatgttacacaaatatggatttcatctagtgctttctggtgagcagtataaaaagtgtgatcagatcaaacatgcaattcgaacatacagaagtgctctttctgtttttagaggaactacttggagttatataaatgatcatgttcatttccatataggacagtggtatgcttctcttgggatgtatgatgtggctgtcaagcatatgatggaaatcttggcctgtagtcaccagtccaagacaacacaggaattattcctgggcgactttcttcaaattgtcgagaaaactggacggacgtttgaggtaacaaaacttcaattgcctgtaatcaacatctcttcactgaagatcatcttcgaagattaccgaacttttggaacatcttcagctgctaatactagagaaggcttgtggcactctttggaggaagaaatgctaccatcattctcttctgccaagacaaattggttggagttgcaatcaaagcttatctcaaaaaagcacagtcaatcgaatgtttgtgttgcaggcgaagctgtgaatgtgaatattgaatttaaaaatcctctgcaaatctcaattcccatatctggtgttacacttgtatgcaagtattctgccagtactggtgatattagatcagatgagaatgagtcaagtgtggagaaagataatgaggttgaccactttaggaatatgagctccgacaattcctcatttatggtgtccgaggttgatttcttactaggaggcggtgaaacaaccatgttgaaaacaaacaccacacctaacagcagtgctggcaaagagcacctatgtcctttcctggcaaattcacagctccaggcaatcatcccacattcccactcaacaatagtggttttggggctaggctgctctatgccattatccgggatttataactatgctactaacctgttgtcagcagtttcccagatgttggaaagccaccttaattgtagcctcaaggaggtgtgtttagtccaacatcgattggagatatga

SEQ ID NO: 4717 - DNA, 270 bp, Glycine max
  Peptide Sequence Number=SeqID_121495
atgaagatgttcgttgaccctaagaatgcaaacacagctacattgactgaagttgcggagacattacagtatatggtgtcaccacaagggaggaacacatggacagttgatgatttcgtgccctatgtggataaaataatcattctatccgaagagcaagagagaatcattgagtgtgtgtcacatggtccagcaccagagcatgaatttgcgccacaagagtttcatattcttccgtcaagtgttgaaactcaaggcataggcagatga

SEQ ID NO: 4718 - DNA, 312 bp, Glycine max
  Peptide Sequence Number=SeqID_121496
atgtatcgtgacataaatgaaactaggcttccttgtattgacaacaagcggaaaaatgaaaacgaaaagctatcaaagaaaacggaatggggttgcgataagagtatatacggaggttggattaaagaggtggggataaggggaataatagtagaacatgagtttccatcatgcttatctgaggttagcataagtcatgcctcacctgcagaattaatgggtgtgtatgcgggagagaaaagaatgagagggggagtgtcagaagtaagggggagaggaaacagaataagtgaggggaaggtggtagaatag

SEQ ID NO: 4719 - DNA, 231 bp, Glycine max
  Peptide Sequence Number=SeqID_121497
atggcacatcaaatgcacatgatgatggaaattggttacatggcaattatagctttgctaggtatgagtgaggaatctagggctcttatttgtcaagagtttattcggaaacttcaaacatggtaccttcattatgttgacctcttctacacagaagaaggactctttgtcaatagtgacccaatagcacccatgagaagtggatgtccgttcctgacatgggttatgtaa

SEQ ID NO: 4720 - DNA, 327 bp, Glycine max
  Peptide Sequence Number=SeqID_121498
atggctcttcctcggaaccctactttccctctttctcttcttcttctcctcgtctttctgttatcagcaacatcagcgcaacaacaacaagaagaagagttcacagaggagttgctgatgaagcccttgcccgatcgcaaggtcctcgcgcatttccacttccaaagtgaagctcctctcgccgccgatgagtcctccttcgctcgtcaccaccacctcttccccaaatctatttctcagctgataaattcagatgttcgagaagatttcagaattgattctgagtttaagcaacttgaacttggagtagcttgtacgttggattaa

SEQ ID NO: 4721 - DNA, 639 bp, Glycine max
  Peptide Sequence Number=SeqID_121499
atggccctccttactttgcatcgaaatttagttttctctcataaacttagaagaatgaggacaaggatcaaactagaccacatggccatagcagtcatagggaaagaagaaggtattcaaggttactggaagggtaacctccctcaggtgatccgtgttgtaccttacagtgctgtccagctttttgcttatgagatttataagaaaatattcaggggagagaatggcaggctatctgttgcgggaagacttgcagcaggtgcttttgctggaatgacatccacttttataacttacccattagacgttctaagattgcgattagctgttgaacctggttattggaccatgtcagagctgtcctttcggcatctctcgctacacttacatgctatcctctggacacagcgaagacagatgcaattgaagggcacaccttataagacagtattagatgctctttcagctgcagtaattaagtcaccatattggtgctttgaatttatactcctttacactttgtttggaacggttgaaactagattctggaaggacaccaggacggattatagagggacagaaaaaacatgtgatatgttccttccatctgtttggagcactttaaaaagtgaagagtga

SEQ ID NO: 4722 - DNA, 273 bp, Glycine max
  Peptide Sequence Number=SeqID_121500
atgctttacatggactgggcattgtataggacttacagattagatgttgcctgccctttttatctagaaagcaaatgcagcaggattgttgctgatggggaagaggaggatactggagctatggtgaagtcaacaactccccatatgttctacaagactcttagagcttcagacaccagcactcatggtggattctcacttccccatcgagcagctgaagattgttttccttccctgataagtatgaattacgatgcattgattttcgtctaa

SEQ ID NO: 4723 - DNA, 753 bp, Glycine max
  Peptide Sequence Number=SeqID_121501
atggataagtggcaaagacgatctccacaaacacgatctccacaatgtggttgcagtcacggaagcgcaagccagtttgacacaaagacgatctcaggcagaaggagaaagaagaagaacgatagggttcaaatagatgcaaagaaatgctactacaatagccctgacttattaagcaccttcaaaagtaaaagttgcaaatgtggggacatgttggcgaaacccatctctcctcgaagctgtgatgtcttaaatggttttgttaagagtagtgccacttttgtgatcacggatgatcggaaacttgtgccagactcaacaagaagcagcaacagcagcaacgtgagttcacttccttccaacagcttcaccatcaccgacccctccatcccgggacaccccatcgtcttcgccaacccaagcttcctcaagctcacgggctactccctccgcgaagtcctaggctggcccgcagccatcttctcgggcccattaacatcccaaaaatttgtaatcgaaattcatgaaatcgttagagaggagggaaacgcgcaggtcattttgctcaactaccacatagatgatatgccattttggatgcttttttgtgtttcccctgttttcagcagtgacggtggcgccgtcgtgcactttgttgttgtacaggtaccgcttcagaaaaaggaagggtccggagtgagggatttcgggtttgggttcgggcccattcgtgcactttgttgctcaacatga

SEQ ID NO: 4724 - DNA, 222 bp, Glycine max
  Peptide Sequence Number=SeqID_121502
atgaatgaagaaaatgaagaagaacctggtgtgcatcaacacgttgattgttcaaatgccttcaatacttctcaggctcgatctgtcgcttatgatattggttttgtggcggggattatgaggtcagacacaaatactagtattagaggaatgacctcgtttgttttatttgatggtgaaaggagtggccagtataaggacaagaagaaagatttagtatga

SEQ ID NO: 4725 - DNA, 180 bp, Glycine max
  Peptide Sequence Number=SeqID_121503
atggagaaaatggtggaagagagaagagaattccctaaggaagagttctcaggctttggtggacttgagcctgcgtacttgcgctttgctcgcttagctcgagtgcctgtttccacacttagcgcgcgctgtgcgcttagcacgggcggtgcgttaagcgcgcctttggactgggcctga

SEQ ID NO: 4726 - DNA, 264 bp, Glycine max
  Peptide Sequence Number=SeqID_121504
atgaaaacacatattctactcatagtgcctatcagttgttatgggaggggggggcagctggaagtaaggaggattggtggatggtataaaggtcaagagatggcaaagttggtgaatggctgtagtatggtccatttggcagatacgaaacagaattatattctccaatgcacctttcaatgccaacaagctgctcaaggatgctatattcttaatctggacttggctaagaaacttggagaaagattttacaattcactttaa

SEQ ID NO: 4727 - DNA, 183 bp, Glycine max
  Peptide Sequence Number=SeqID_121505
atgggttttgctgaagttgaaggttgggcacctccaaatgcttgcaaactagaagtggttggtggaggtagagttggtgaaggagacatatgcacatctatcactattgaatcatcttttcaaacttctaaagttcaaccttggatggatgtgaaagagatgatgatttttcaagaatcttaa

SEQ ID NO: 4728 - DNA, 187 bp, Glycine max
  Peptide Sequence Number=SeqID_121506
atggtttcaaatgatgacgttagttcacaatttccacaattttctacccaaattgggttagacgagatcgtcattgacgaaataggaagatcgttgacaaaaaggaagtctcaagtcgcctttgcagttaaagaagatacacacctcattagttcatggcttaacatcttaactgatccaattgttg

SEQ ID NO: 4729 - DNA, 123 bp, Glycine max
  Peptide Sequence Number=SeqID_121507
atggaatcgaaaagcgaaagaggttgtagagaagagaagtcattgttgttagattatgtgagagagacctctcttcgtggattaagtctagggttgcttattttgagaagtaacttcaagtaa

SEQ ID NO: 4730 - DNA, 230 bp, Glycine max
  Peptide Sequence Number=SeqID_121508
attccattttgagagagttgaaaaaacactatcttgttgaaaggttctatacatctgccctttctcaaggcatttttttagacaaggactccgttttttccttttttcggatggtatattcatatctgaaagaggttgacaataagttttttcaaaatggactatttgtccctctgttagaggtgtccagaaatgtctgcgatcgagtaaatagctccacgaacgaatag

SEQ ID NO: 4731 - DNA, 132 bp, Glycine max
  Peptide Sequence Number=SeqID_121509
atggcgcgaccacactgttcttgttcgctctatcatctccttctcgcactcgcggtcgcattctcgcaatcactctcatgctgtcattctcattctctcactctcgcgctctcactcacacactcacaaaag

SEQ ID NO: 4732 - DNA, 600 bp, Glycine max
  Peptide Sequence Number=SeqID_121510
atgccttttacaaagtttgaaccacacaaggacaatcctttccttgtgttcagaaatccttacaacttaagagaccctcgtcctttgtctttaccccctggctgcattccaattggctgcaaattggtgtttagagtaaaagaaaatccaaaaagcacggtcaacaggcatagaccccaccttgttgccaagggctttaaccaacagtttggcagtgattatactgagaccttttcaccagttagcaaacctgttactgttcgtctcattctcactttggcaaacactcatggctggcccctaaagcaactcgatttcaacaatgctttccttaatgagatccttgaggagaaagtctatatgaccagcctcctggctttgaatctcatgacaactacagtagttcagttttgccaagcaagtgcgatctgtctgtttatctactctaaagggactgcaactgcctatgtgttagtatatgttgatgacatcgtccatactggtagcaattctgcagtctgcactttggcagaccctagtctctcagttcaacactgtcttttccctcaaagatcttggcaacccagactactttcttag

SEQ ID NO: 4733 - DNA, 627 bp, Glycine max
  Peptide Sequence Number=SeqID_121511
atgttttccagatacaactatcagttactcccagggcagagggtactcttgaaattcttggtgttaggtggaaactgtctgagcatacccaagcttcagggttccattcaccctctacctggaaaggcgtatgctggagatttacgacaacttgttttggaattgaggaatccatcagactttcctgttaagagagagctttggttaggatatcagaatattggtctgaagaacgagcatgaaaaacttgaagttgctttgcgagaaccttctgcgtacaaagaagtcaagctccacgttcttggtgcaggtatgcaaaactggattgtgagcaagaaatacggtgtcagtgctcaaattgtcacaatagacctgaggtgtggagtgctgcactacaagtttggacagcagtgtttgcatccacgtgatttcagcagtggcatgagccaagctttgatattcaacctcagtgctggatcgggcaatgacagtctgctttttggaccaccaggatatgaggttagggtcaagaaacacacaggtcccagaggtagaatgtcagtcatatgggtcagatgcccaatcagcatcacagaagacagtgagggacaaagaaacacgcattga

SEQ ID NO: 4734 - DNA, 1404 bp, Glycine max
  Peptide Sequence Number=SeqID_121512
atgaagataagtcatcctagattcctgataattgggaagcaggaaaataggaagtcagagtttcctgcgtgcttaagaaagagaacagatgcagtactaagtgatgtgtatgctaatcctaacatcatgtctgacacagtctttttgtttccagagggcacatcagttcaaggtgaagcacccttcttgtggcctctttggtttagggctgctgttcctggtgatatatcactttacatgagcatatattatgagatgggagatgcatcaagtgtcatcaaatatcgtactcttcgcttgcattacaatctgcaggtattaccatcgttggatgtctcatttcaaataagtccttctcgattaagattacaagaatttctcgttcaattggatgttgttaacaagactagctcagaaagtttccaagtttatcagttgtcgtcagttggtcaccgctgggaaatctcgttacttcaagctcctgatactatttttccttcacaatcattgaaggctggccaagcaatatcttgtttctttacactaaagttagctgaatttattgtttgccctcagaattcttcgaggttttcgacattggaggacaacatatctacattgcctgtcagaagtgatgtaagattggtaccccaaagcagtgaggatttagtttacgatataaacagtgcacctttgttcaatttccaccattatgaaagattgcagcagaaagttacatatgagggtgacttaaatactgttgattttgtattgatctctcggccattcaagagtaatgacgatcctggtttttccaatcctcctcatgttatgtctcatcatgcgtgtcacttcagtactgctagcacgggccctatttcatggctagtggatggacctcaaaccttacatcatgacttctctgcatcattctgtgaaataagtctgaagatgcatatttacaattcttctggttccactgtttttgtacgcattgacaccttagattctgctggtaatggtgggcacatgaacagtgtaaatgtggttcaatcagcaactagtgataaccgagcagggtggcatgatattacaccagtgaatgaactcaaagtcacatcaaatgttcttggaacccaaccaggaaaggcactatcattggaaagtgtgccttcatatatttggtctggatcaagctcaaccaatctccacattgatgctatgtcctcagcagaaattcctcttcagatctgtgtgttttccccagggacatatgacctgtcaaattatgttttgaattggaaacatccatccaatggtcagggagacagtgatgaaacgaagcagcattcaggcaagtgccagggctataaatactatcttaccgtgcttcagtccacttga

SEQ ID NO: 4735 - DNA, 555 bp, Glycine max
  Peptide Sequence Number=SeqID_121513
atgaacgacttgttatcaggtttgttctcaaagggaaaacaagaagagcatgtgattgagataacagaaggtggtggcataatggagttggagaagttcttggaagaagtggaatcagtgaaggaggacttgaaggagctagagcgtctccacctaagccttgatgctacaaaccaaaacggaaaagcgcttcacagcccaaagggcgttagggagctacggtctcgcatggacctggacgtggctctctctctcaccaaagccaagcacgtcaagggtcgcttggcggctctccaccgtgccaaccaagccaccctctccttgcccgattgcgggcccggttcatactccgaccggacccgaaccgcgctggtgggggccttgaccaagaaccttagacagtccatggcgagtttcaataagctgagggagcagatatcgtacgagtacagagacaccgtgcaacgtagatactacgctgtcactggagagaaccctgatcaagaaaccatcgacctcctcatctctacggtttttgagaagttttatgggtaa

SEQ ID NO: 4736 - DNA, 1110 bp, Glycine max
  Peptide Sequence Number=SeqID_121514
atgcaaactgtttatcttaaagagcacgaaggaaatgcgcacaattttgtgggcacgttgtcttctgcagcttcagcaccctggtggagtgcttttggatctcaatctgttcatcagggagagtcttgtggccaagtgaaacccttttcattggagctgccaaactgcatagaccaacttgctgccactaagccactagcaagaggagctgaccaagtgttgggtaaagggcacataactcagtttacaatctttccagacgtttcttcttcagatgattgtaaaatgtcagatgatgcgcaaaagcttcagacaaccatgtcactgcagtcatcgcttactgatccacagtctcgttttgagatagggtttagtctgcccacgatatgtgcaaaatatccttatacggatcaattttatggactcttctcagcttatgcacctcaaatttcgggacgtataatgctgccacttaacatgacatctgatgatgaaccaatttacgtaaatgctaagcagtaccatggaatcattagacgtcggcagtcccgtgccaaagctgtacttgatcacaaattgactaaacgtcgcaagccctatatgcacgaatcacgccatctccatgcaatgcggcgaccaagaggatgtgggggtcgcttcttgaacactaagaattctgttgacggaaatggtaaaattggaaatgaagtgcataaaactgttggtgaacaattgcagtctagtggctctcagagttctgaattccttcaatctgaggttggaacttttaattcatcaaaagagactaatggaagcagtccaaatatttctggttcagaggtgactagcatgtattcgcggggaggtcttgacagcttttctctcaatcatcttggatctgctgtccactcttttgcagacatgatagatggtgggcgcggtatgatcatacccaccaaatgggttgcagcagcagggtgggcttgctgtagcattgcaccaggcccatcctcgatgaggccagatgaagaagcttcgtttcagttgcgtgtgctgactgtgacaagtttcgctcggcaactcatccttggcttgatgtacttgcagtaa

SEQ ID NO: 4737 - DNA, 353 bp, Glycine max
  Peptide Sequence Number=SeqID_121515
gtgagagcgaaacattcttacagaaagccatccaacagcaagggagagccagtgtcatggacacaatccaagagattcgagagaggcacggcacgatgaaagagatagagagaagcctacacgagctgcaccaagtgttcatggacatggcagtgttgatccaacaccagggtgaacacttggatgacatagagagccacgtggaactcgcaaactccttcgtgagcaaaggggtacagcatttgcaggtcgtgaggaatcatcagaagaacacccgtaacttcacttgtttcgccgttctgctcttcatcatcgtgttggtcataattctccctattgttttcagaaattga

SEQ ID NO: 4738 - DNA, 219 bp, Glycine max
  Peptide Sequence Number=SeqID_121516
atgtatggaccaccatgttatgaagagttatggttagatgccattgagatgagtgacctagcccatgtggggcaaggatggggtcgggtgtatccagtttggagtcttcgtgtggctcatgttgatctcatgggttggagtatccttgcaagacttggtaaccttgacgcgctgtcgacagtctcatctcgatcaaagtgtagtaatgggatcatatag

SEQ ID NO: 4739 - DNA, 213 bp, Glycine max
  Peptide Sequence Number=SeqID_121517
atgggtgccaagtacctcgaagtggtcaaacgagggtcgcatcccaacaacggatggttcccggatgaaattaggcgcaaaggagaatctggcagagcatcagtatcaaagtcgcgccttaagcgcgagattagtgcactaagcgcagcaggtgcctttagccaggctaagcgcgagactggcgctaagcccaattccccttactcacgctaa

SEQ ID NO: 4740 - DNA, 432 bp, Glycine max
  Peptide Sequence Number=SeqID_121518
atgccgcaaaaaattgatttcaacctgatctatgcgctgaatctgctgctggaagaagggagcgtgagcggcgccgccgaaaagatgaatctgagcgcgccagcgatgagccgcattctggggcgcatccgccggcagttcgacgacccgatcatggtcagagccggtaagcatctggtgccgacgccgcgtgcgctggagttgaaacgccagctcggcgagatcatcgagcaggccgccgcgctgatcgcgccgaatgaatccttcgagcccggcaagctgaccagaaccttcaccattcgcgccaacgacatttttatcggcgcgctggcaggcggcttgctggagacgctgcgggacatggcgccgctgagcggcctgaagtttatcgccgaaagcgacggcgaggatgacgcgctgcgcagcggcaag

SEQ ID NO: 4741 - DNA, 709 bp, Glycine max
  Peptide Sequence Number=SeqID_121519
atggctcgccagcgccggcgaaatcaacggccgaacctggctggggttgttcggcgtgtttttggcggtgatggccagcggcgtgggggaaaacgccagcaagttcgcgctggcggatatacagggcggcatgctgctgagcttcgatgccggcagctggctgaccacctgttatgtcaccggctttgtgatcggttccgggttcacgccctgtttttggccgaccttttcgctgcgccgggtggcgttgacgatgtgcggcatttacctggccggtggactgctgacgccctggttgggagaacagtatggcgcgctgctggcggtgcgcagcctgcagggcttcgccggcggcgcgttgccgccgatgctgatgacggtggtgttgcgttttatgccgccgctgatcaaggtgctggggctgggcgcctatggctgggtctccgcctggagcgccacgctgggcgccactgccgccgcctttgcctttcactggggctggagcggttacttctattggaacctgccgctgatggcgatcgccgccgtgtgcatcggttacggcctgccgcaggatccgttgcggctggagcgcctgcggcagttcaactggcgcggcctgctgctcggcggcatggcgctcggcatgctgacgatgggcatctcacagggggagcgcctcgactggctgaactcaccgctgatctac

SEQ ID NO: 4742 - DNA, 238 bp, Glycine max
  Peptide Sequence Number=SeqID_121520
ctcccagaggcatcgctccgacgaacatgccttgattccagatctagcacctgatggcgctgttccgaatcacgccggcatcgtcgagtttgtcgtagacgacagaggagcaggaaacgccggcgaaggatgcgaagtgggccgggttgggtattgtgtcggattggctgtaacattgagttccgcaggattaagacacaaagtgttcttcagaatcaaccgacgcttaaaattttga

SEQ ID NO: 4743 - DNA, 210 bp, Glycine max
  Peptide Sequence Number=SeqID_121521
atgtcagctcaagcaacatggctctcaaaattgtttgttggatccaaaagtcaagccaagatgaagagcaaaagggtcatttttgaagaatttcagagtgtcactggctcagccatgcacaatcacaaaccaggggaagcagtgcaagaaccagaggaagaacaacgagcaaggagagaaaagagagacaaagtggagttggagcggtag

SEQ ID NO: 4744 - DNA, 1116 bp, Glycine max
  Peptide Sequence Number=SeqID_121522
atggtggaggatcttaccaccctttgtgatatagacgcatgtgcattcatccttggtccaggggatgatgtgcctaatgtgtggccatcccatgacaaggctaaagagatgctcgataagtttgagaatgctccattgtcgactcgactgaaaaaaaacatcaccccacaggtttatattgagcgagccaataacaaggttgaaaatcaacttgtcgagcttaggaagaagaacgatgagatagacatgtcagatttaatgcatcaaatccatgatgatggtaggtctttgtctgattttgatgctagtgatatatctcgtttactttcgtatgtagaggagaaactgaagggtgttagagtgaaaactggcttttctgagcagcagttgcctcctaaacctccaacaccacaagtttcttgtcctctacagaatgataagattgattcttgggataacatagatgaacaagttctccagcaacaatcattcatcgatgatctgaaagaagatggtaagataaatagtggttttgataacaatctagggagcaacatagggctaccaccaccaaatacacatgttggtgatgttgattttgaacctttcaatcagggttatgttgatatgatgttgcctccagaaaattttggaggcctcgctaacgaaagtggcttagggtttggtgtgttgcctcgagattattttataggtagcaatggtaataatgattcagagcttttgtatggaagctattatagtgaaattggaggcaatgacatatggtcatcttatggaaattttggaggcaaaattgttggaagtgatgatgtgatgttgcctttcaacaataattcccaaggcaacattaatgaaacttgcctgggaattggacaacatgatgaaaatcaaggaggatccattaacaatgtcgggttatggaatcatcaaatcacccttggagccagtaatgatggagttgccttggagagatccaatccaaactttgttggcactaccagtggcgaaaacttgaaccttggatttccttctcatgcaaatctagccagtagtggtgaaagaagtgatattgaattgcaggaattttctccttaa

SEQ ID NO: 4745 - DNA, 303 bp, Glycine max
  Peptide Sequence Number=SeqID_121523
atggacgacgtgacgggccttatcatcggcccgctgttcgtgctggcggaagcctgcttcctggccggcgggctgcgtgaactggcgcggaacatcgaactgcgtgtgggcaaaggaggcatgatattgcctttggcgattggcgctgtggttgagggtttgccaaccacttcccagacaccgctttccgggcatttctgtcctgttgaggcggttaaataccccaagtgcagagtgattcccctcggcgcttatccttcagacgcattaacgccattctccgcacgcatcgccgcgatcgca

SEQ ID NO: 4746 - DNA, 261 bp, Glycine max
  Peptide Sequence Number=SeqID_121524
atgactctgtgggtctcttcatcctcaccgcaaacattcatcgtcttcgtcggagcaacaacacttccctgcatgactcctagtttgcttaaaatgggtcagggttcgggtggttcaggcttaagggttcaacatgaatgttcgagatggcgacggcgtgaagaggtttccgacgccataagggtcgcgaaacgtgtgagagagaaaacaaagggctactgtgtgagagaagagaatttgaaattcttaccaattaggtga

SEQ ID NO: 4747 - DNA, 258 bp, Glycine max
  Peptide Sequence Number=SeqID_121525
atggcactgccgccatgcgtcaccttcatcgcaaccgatttcggcgtctcaaaggagccgtcatttggggtgttggtggcggcaggaggtgcttccggttatttggcgttgctggctccgacggtggtgggttgcccttgcacctcgtcttttacatcttcttttttctttttaaacaagggtattaatgtatttttgcatttttcattgaaggccacttgtcttcaaagaaagaaatgttgcacatgggacccatga

SEQ ID NO: 4748 - DNA, 144 bp, Glycine max
  Peptide Sequence Number=SeqID_121526
atgtgtctaacacatgtctcaagctatgtgttgctgagctctacgagtcgaatattggatcaagataaatccttgaggacaatgtgcctaacacacacctcaagctatgtgttgttgagctctacgagtcaaagattgggttga

SEQ ID NO: 4749 - DNA, 2276 bp, Glycine max
  Peptide Sequence Number=SeqID_121527
agccacccacgctttctctgtctctctcttcttataacaagtctctaactaacggcatattctctttctctctccatgccgcagcgcatgctttgatcgaccaagtcacctctctcgcattcttcgtagttccaagatccgaactccgagattccgactctgagaaaacgagtaatggtggtgaagatgatgaggtggcggccatggccgcctctcctctcgaagaagttccaagtgaggctgctcgtgcggaggctccagggctgcgatctgctgcggaacgctgcacctccgtcgcgagaaactttactaaagaggcggaatttgacgtcgacggcggtggcgccgccgtggttcactgggacgaggagtttccgacgttgtgcaatttgaacggttacaaagacaatgtttttcacccttgggagatcgctttcactctctttaatggattgaatcagaggccgaaaaacaaggttcctgcaattggaaccgcattattgaatattgctgaatttgcatcttcaactgatcaaaatgattttgatttaaacattccactcacactaactggaggttctggggagctttctcctttactctgtatatcaataagcttgacggaggtaagcgtagctcaagaaagcgtggagccaattcagagatctatagtgcctgggccatcgccctccgccaagtcgggagaaacagccttggtagaaaaagatgagctttctgctattaaagctggtattaggaaagtaatgattttgacggagtttgtatcttccaagaaatcaaaaaagggatgtcgtgaggaagaaggaagtgaaggtaggtgctctagaagtgaggatggtgaatacaattatcctttggattctgagtcaattgatgattctgaggaaggtgaaacagatgaggggaaggaggattccagcattaggaagtcattcagttatggaacactggcctctgcaaatgctgggggattttttcattccaatatgagagtaaattgtaatgatgaagactgggtttattacagccatcgaaagtctgatgttgggtgttcacggatggaggattctacaacttcttcttctgatccatatttacaaagttctaagcgcagcatacttccatggaggaagaggaagttgagtttcagatctcctaaagcttataagggagagccgttgctaaagaagtcatatgcagaagaaggtggtgatgacatagattttgatcgccgtcaacttagctccgatgaatccctttctttgacttggtacaagactgaggatgacttgtctgcacatcgatcgtcaatctctgaatttggggatggcagttttgctgtagggagttgggagcagaaagaagtcatgagtcgtgatggtcatatgaagcttcaaacacaggtcttctttgcttcaattgatcaacgcagtgaacgtgcagcaggtgagagtgcatgtacagctcttgttgctgtgattgctgactggtttcaaaataatcgtgatcttatgcccataaagtcgcagtttgatagtctaattagagaaggctcctcagaatggaggaacctatgtgaaaatgatgcctatagagagcggttccctgacaagcattttgacctggaaacagtcattcaagcaaaaatacgtccgcttactgtggctcctgggaagtccttcattggtttttttcatcctgaagggatggatgaaggcagatttgactttctgtatggtgccatgtcttttgataatatttgggatgagattagtcgtgctggacaagagtgccctagcaatgggtgcaaccaggcatatatcttgaaatttgacagcaacacaatgatgtacaaaatgccaaatgttgctcattcatcagataacaagacatccaatgaccagcaaactgtagcagaaatattagatcctaataatagtcaaacccaacaagtaaatagcaaggaggtggattctgttgcaggggaggaagaacagttgaggagtgagacagaagaagttatatgcagagggaaggaagcatgcaaagagtacattaaaagcttcctagctgcaatccctatcagagaattggaagcagatgccaagaaaggcctcatttcttcagcatccctttaccatagactactacaaattgagtttcattacacccaattgttaggtgaaacatcaatggctgaaccagagaccttagctcttgcaataactgaggcttctaccataaccaagctgtaa

SEQ ID NO: 4750 - DNA, 456 bp, Glycine max
  Peptide Sequence Number=SeqID_121528
atggacattacaagtgcctttgcgggtcaagttgctgatttggagggcttgaaagagctgcatttcgatcagaatcgcacttcagaccaaaggagtggagtgtttgatcctatgaagaagctgcaacaagatgttgtgggagaatatagatatgcaaccaaaagagactatcttgggaatgtaatgtcgatgcaggttttcatgcttgagggttgctttttaatggcaagaacatcttggatgaaaccttgcacctcagtgatggaagatgtcacacttgatgaagattcctacctggcagacattgtgggaaacaacatatttgacgatccctttgaggagttgcagctcgacgcaatcatgacactcgaaattgagtttgaggagtgcgagcgaggcgtcgcggagggagaggaggcgttcaaagatggagtgaatggagtccaagagggctag

SEQ ID NO: 4751 - DNA, 282 bp, Glycine max
  Peptide Sequence Number=SeqID_121529
atgccaccgaaggaacatcttgatgagctaaactttgtcctaatagagctaggcgacattgatgtcaagatgaaagatgaagatctggcaatgattttgttagcctttcttcctctctcctatgagaattataagaagaagaagaagaagaagaaaggtaaagatggcaagaagagaaaaattgattctaaggaaatctgcaattactgcaaagaactgggtcattggaagcaagattgtccaaagaaagcaaagaaaaattatgttgttgctcttgtttag

SEQ ID NO: 4752 - DNA, 762 bp, Glycine max
  Peptide Sequence Number=SeqID_121530
atgggagtagttgcattaatgtgcccaacacaagattctttgtttaaggggtttcaaaaagaacttctatgtgcagaatttaaaattccatgttctactttgttgtttgatgatgaagtctctcatgtgaagaaggagaataaagatgaggttccaatggaggaatgcaagactctaattctttcttctaatttgaatgatgagattaattcatattgtacttttatttgtgcatctaaccatgcaaagtcttttgttttgatgcctaaggaagaattgtacatcaaggatcaatgggaaagacaatttggagaagaggtggatgtaaatgaggatcaaggcaaccattgggagaagaagattttgcatcatctcatctctaggtctaatgttttgattgaaatacaacctgtgttaattcttgatttgcatgatacttgtgatatgcttaatgcatatgatttgcatgatattgttttaggtgatggtgccaagtccttgagttttgagattaatgcacattatttagaattgtgtgatcttgaagagtcttcctctatgtgtttccttgtccttgtatttgatctgggaggatggataggtaaagatgacttcaattcgaggtcaaattcattcaaagaaggaggggatgatgaggaccaactcaggagcactgaccttgaagaagagcatggatttgatggaccaatcataatagcatgtgctaagcaaatggtgaataaaggacaatctaaaatgtaa

SEQ ID NO: 4753 - DNA, 462 bp, Glycine max
  Peptide Sequence Number=SeqID_121531
atgccatcaagaaagtacatgcccgacgaaaatgaacccaccaacgagaaccctatgaagaactctcagagggatcattctacactcaaagatgttaacccacgagcgaagatttgtcctgatgctcatcatccaaacctaaaaatgctgcatacatcactcacgacatcctattctgcattctactctcagacttatactattttgggcccaacactaccactaagcctttcagaccttcatggtcttacgcaacatatggatgacaatggggaggacatgtcacatggtggtataggacatgacgctctcactagccatggatacaactcctctctagtcaggaatgccaagtgtggctttgtacctactgtgtgtcatccaccctcacttgagcaaggggatagggacccacctacctccaagaacttgagccctcaacaatggaggaaaagaagatga

SEQ ID NO: 4754 - DNA, 273 bp, Glycine max
  Peptide Sequence Number=SeqID_121532
atgaagacgaatcagaacattagggacatcgggaactttgtgcaaagagagcttgggaaagatgaggacttcaaggagaaagaaggttttttcccaaaagctgcaaatgacgtccttactgagaaggaccaagcacctaagaaagttgaggttccaactaatgagaatctagttccaaagaaggaaagggacaaaaagaaggagatactgacatctcctcttatatggagactgatgaggatgtgttggatcaagtggcctcagaataattaa

SEQ ID NO: 4755 - DNA, 667 bp, Glycine max
  Peptide Sequence Number=SeqID_121533
catattgtcatttttatctgtacgcgttgtggtttgggttcgagggtgttcgaccctcgggattatgattggttccctaagagtagtacgtacacttaagcctcgtctctctttcttgtttgcttgtttgtacccgttcgttgatgtacacgaaagtgagattgtggtgaggaagtggatgatggacagagatacactgggctgtagtgggcgaagaggttcgaagaacctaggggaattaggaagtggtgactacctggcatttggttcccttattcagcatgggggtcagtgtacgatttatccgtatgtagaaatcgctctcgactatcatccacgtgattttgtaagaccatcaagacctaggaggattggtggcaatgattggtcccaatggagtggaggactcacccttgcaaccaccaatttcaaggggaggtcatggagcatcaatagaggatgcttagatggatcagacacaaccattgaagtttataaggatgtgggagatttcaatgataatgaggatctcacgtcgtctgagatcgccttctatcgggaggttatcgatgaagagatacttgagggaaagatgctttcatatgacgaggaatgcaattcctcgggagacgagagtgaccctttcgaagatatgacttcaccctaa

SEQ ID NO: 4756 - DNA, 330 bp, Glycine max
  Peptide Sequence Number=SeqID_121534
atgtacatgcatagtgctccattgtttgtatggtgccagcgacatccaacattgtataaaaacagacattctatagtaacaatatatagcgacagaggaaagttcaaggaaacctcggaaaagaggaagcttcctcgaaggtgcgagctagcaagaaaccaaatggaaaatgcatgtggggtaacatttgcgggtgcaaatatatcagtggctattgggaatgttgaagagggagggttaccagatttggatgggactacaacccaattgatgagtgttttggaggcaagggataataatgtgatagggagcgatggtaccaagctttga

SEQ ID NO: 4757 - DNA, 318 bp, Glycine max
  Peptide Sequence Number=SeqID_121535
atggaggaggacaaactgttacaggtttttggggacaagagggaaacctttgggtggaacattcatgacatgaagggtttggaccccacactttgcatccacaagatcaacactaaagatgggtctctacccaaacatgaaataacaataatcacactagaatggggattgaatagatccattacggtattagcgctgagtcttgaaatgaccattgtctcacacttggaggcgaggcaaggcgggacgctttgttgggagagggaagtaataaaagaacagacaatagcatgtgccccttatctttgccgaaaataa

SEQ ID NO: 4758 - DNA, 378 bp, Glycine max
  Peptide Sequence Number=SeqID_121536
atggcacaaaaactcatactaaataacactcaaaaggtggtttataatagactcacccttagattaggggatgagagagtggtatttaatttatctaatactttgaaacaatcttcctcatttgcttcctgtagttttattgagtctgttgatatagatgatgcaccgatggaaggggcattcctaggtgtggggatgcttgaccctctaaagagagttctcattgatgagtaccttgactgggagttgaaccctgaagtggaggaaatactgatgttcctccactctcaacatggccccggaccacccagttatgaaaggttggaatggggtaatgttccaaagctaaagcctcttattgagaaacctcctgattag

SEQ ID NO: 4759 - DNA, 201 bp, Glycine max
  Peptide Sequence Number=SeqID_121537
atgcatgatctatcgggtcgtctggtcatcgattcaacctctaaatttgtcaggctccctcgttcagtccgcatgatgccgcaaacgaagttttttcctcctccatctctctgtgttctctgtcgtgccaccgccatcctcagcttccattgtcgtcattcagactgtctccaccaccattgtgttgttttcgccatcaag

SEQ ID NO: 4760 - DNA, 1538 bp, Glycine max
  Peptide Sequence Number=SeqID_121538
atgggcgatttcaacctcgccctggtgatcgtggcggtggtggtgtgcgtgatcgtgttcctggtgaacgtgtacctcctcgtgaactaccagcacccggacgacgccaaccaggcctacttccccaaattcgtcgtcgttttgggcctctccgtcgccgctatctccatcctcatgctccccgcggacgtggcgaatcgccaggcgtgccgccacgcgatctacaacggcgcgtgtagcctcactctccccatgaaggacctctggctcgcagtctacatcctcgacgccgtcctcgtcttcttcgtcatccccttcgccatgttcttctacgagggcgaccaggacaagtacgaggagtgtgggaaagaggatcaagagtgctttgttgtggatggtcaccacggctatagtgtgcgccctcgttctggtgcttgtgggggaaaattagaactagagagagagtggggtttatcacattttcagggagttatcgggttgttctttgtagcgatggtagtgattatgggaagtgagatacttggtgtgtttgctacatttgtcaacattgggtggaagtggggaagtgatgcttaccaaagttttgtgctttacaaaggtaatatttttgctgttgctcatactccttttttccccacattgtcctcaaaccagtgctcagcattctctgctagtccttcatcagagaaaacatggaccatgcgtactacctttccagaatatgttgttgcacttgctacaattgttggatctgtgcttttcgctatatttggtggtgttggtattgcctgtcttccattaggacttatattttcatttattcggcgtccaaaggctgttatcactcgctcacagtatatcaaggaagccactgaactgggtaaaaaagctagagaactaaagaaagcagctgaggcactccatcaggaagaaagaagtggttcaaagggtagaaagtttcgtaaaaatgtgaaggaagttgagaaggagttgtttcaattagaagaagatgtaaagcttcttgaagaggtgtatccacaaggggaaaaggctgagacaacatgggcactaacagttcttggttacctggcaaaatttgttttgggaattttagggttgattgtttcagtggcatgggtcgctcatattattatctacctattaattgatcctccactttctcctttcttgaatgaagttttcattaagctagatgatgtctggggtcttcttggcactgctgcatttgcatttttctgcttctaccttctccttgctgtgattgctggtgccatgatgcttggactgagactagttttcattactatacatcccatgaagtggggagcaactctcatgaactcttttctgtttaatgtgggccttattcttctttgttccattagtgtgatccagttctgctccacagcatttgcctactatgctcaagcaactgcagcccaggaaatatttggtcacactttggagtctcttcgaggaattaaatatttgtacaa

SEQ ID NO: 4761 - DNA, 487 bp, Glycine max
  Peptide Sequence Number=SeqID_121539
atgcaaaatcatgagattcatttaggcaagagctattctttagaagattatcaaagggaaccagagttacgaacctactatcaaaaggaggcagaaagaggtttcaatctggacaacttgttaatgcaattcaaggatacaattgaatcaattcaacgagcatttaaaagtacagaaattcaggttggtaagctggtagaagaagtgactcaagctgtgggcagaagagaagaagaatttgtagaggttgaagctcaagaggaaagccctgtaaataagcatgatttaaaagaagaagatgaggagaaagtgcaacaacgggagcaatgctcacaagtacacactcaacaagaaaataatctccaagttaagacatttcctcatcaactgattgtcaaagaagaaaggcatgaagaccatgaggttccaatcattctgggacaaccctgtttgtcaactgctagttgtgtattagacatgggtaaaa

SEQ ID NO: 4762 - DNA, 285 bp, Glycine max
  Peptide Sequence Number=SeqID_121540
atgaagactttcaaagattgtgttgctaaagtgggtggtattaataccaagatgggtttgcgtttagatgttgttactaggtggaattctactttttttatgcttgagattgcacttttgcaccaatgtgcttttattagtcttgaatttgaagatagaggctatctgaattgtcctactaatgaagaatgggataggggaaaagaaaatgaaagtgtggaaattgagaaggatagtgaagctaaatcaaacatggagtcaaatgttgtgattggaaatgcttga

SEQ ID NO: 4763 - DNA, 450 bp, Glycine max
  Peptide Sequence Number=SeqID_121541
atggcgtgtgatcaaacaaaaagattgctctcaactaacatggatgaatctcacaaactagtgaaaagcatgaagtcagtgaacatagggaaaaaagggcttgaaaaatggaattttgatgcagagaacaacagattaacaaaactagatgttgtgtctgagggaatgctgaatcagagaattgagaggcttgagtgggagagaattattgcaaggcaagagattatccatgaagggaatggtgaagagcagttgaggctgttaaaggacatacaaagtcagctccaaataatacaatcaaagacgagaagcttgaaaaccataaaagccactcctaaggatgatgtctctttggcttctctccaagaagcaaaatatgaaatggtgtatcttccttcacctttgacaggagaaaaattgtgcccatttcatgagtgtctttttctttga

SEQ ID NO: 4764 - DNA, 531 bp, Glycine max
  Peptide Sequence Number=SeqID_121542
atgctgagtttgtcgagaccacccaattgtgcacgtaacagcccccctcccataggtgatcagcctgggagcccaaaggtgttccctaccagaaaaatcagcatgcaacagggacagacagatatcctcatagctaggttccctaaccctaactatggtgttaaaacgctaccccacggattcctcgtcgcatcacttgaagattcctttttgtccttgctcatcgattccacacaagcctctcgaaagaaaatgaaaggtcagattagggttttcgttccctaccgaaaccgcaagccaagttggaagattccacttcagttgaagggttcctctctgtgtgggttttcaatggagaacaatgatggtttgtggtggctaatggtggctgtgggtgatggagaaagtgcttggaactttagaaatggctttggaagaaagaaagaagaagaaatgacatttttcctaagctacacaaaaggaaaggctgaagtgcttaaatatgaatgctctcgggaacggaagctttga

SEQ ID NO: 4765 - DNA, 285 bp, Glycine max
  Peptide Sequence Number=SeqID_121543
atgtctccacctacaaattttgtttttgatggacatagatttcacagtgaggagcaccaacgacgttttgagttgataaaagattggtcatttctcaaggaaacaagagtccaactagaagaatacgattatcatgagttcaccgaggagagcactacatggaattggaggcaacttgaagaaccaatgcccaaatatgaacttgaaattgtcttaaaattctatgctaatgcttggcctactgaggagggagttcctgataagcattccaaagaggggggctaa

SEQ ID NO: 4766 - DNA, 522 bp, Glycine max
  Peptide Sequence Number=SeqID_121544
atgagaacaagagagggtacatctcttgtggatcagttcaagtggagggtacatccacttggttattcaaagagaacaagggagggtacatcccttgtggatctttggcttgtaaaggattttacaaggttgaaagaaatctcaagaaccgcaggttgcttggggactagatgtaggcacggccacttgatccaacacaagtcagaatgtccagacattgataagatagatcacaagaaaagactaaagctaaagaccacaaagcttcaccttgaaaatgaggaaatttgcaaagaaatatctaatctattggaataccttgaaaagttgaaaaatcaagtggaaggcttacaaaatgagtataccacactcaataaacttcatgattgcctaaataaggaaaggtgtaatctatcgaaagaatgttcacaagtccataagaattatcaaaacttggaggcaccaggaaaaaaagtgaaagggaagtgcgcttgttgttttggctcaaaatttgttctataa

SEQ ID NO: 4767 - DNA, 1392 bp, Glycine max
  Peptide Sequence Number=SeqID_121545
atgactttgacagtcataagcactgatgggaatacatcaccttccgcaattacagtaacagtgcttgaaagtggaacacttaaggatcttattggggccttaagtgcttcttgttctctgagagatgatgaaaccctcttggtggctgagatatacaggaataaaatttttcgagtatttgaggatccatctgatttgttagttgaaattagagatcaggacaaacttgtcgcttaccgaatgcagaagtgtaatgagcctagtcccttggttgtttttctgcatgaacatttggcggaaaattttgggaaggagaggttagaaaacaggttgtttggtattccccttgttacaaggtggtccagtatttcctgtggatatgatgatgttgaaagggagtttctgaagttaatcaatccatttctgatgcgcactgaaggtgtattagatgagtatgataagaatgatggtgttaaaaaaagagtaagtgaacatgatgaattgggtgatgctactaactctgcagcaatagtaaatgatgcagactcaaacagtggaacagaggatgacattcattcttcaactgactttgaattctacttgcaaggattagagagggccaagataatagtgaacaaaccattaccacaagtcacaatgtcgtctggaaggctgcctgcggtagttgtcttgtggtcagataagatgcttaaaatgtatgatacatacctgcttgattcattgcctgaggttttcaagccccagctatttgccaagagaatgcaagaatcagtttctatttacaagtgccttgaagctttcttgaaagaggaacctcttgggccagaagacatgtggtactgtcctaactgcaaaaatcctcagcaagcatctaagaaactagatctttggagattgcctgaaattcttgttgttcatttgaagaggttctcattcagccgatacttcaagaacaagctggaaacatttgttgatttcccaattaatgatctggacttgtcaacatatgtagcccacgggaataaccagtcttccaaccgctatgtgctatatgcaattagttgtcattatggagggttaggaggaggtcactatacagcatttgtccgttatggctatgataaatggtatgattttgatgacagcagggtcgaatctattagtgaggacatgataaagactcctgctgcttatcaacatgggatgcttgaggcttttcagaccttttgcctatacatgcagttgtctgatttcctcaaaattgctgctttaagcgggtaccagttgggttttactgagacaagtgaagagaaatgcaaagaatttaagattgtacagcttttagaagctacaggcaaaaaaagagggtag

SEQ ID NO: 4768 - DNA, 495 bp, Glycine max
  Peptide Sequence Number=SeqID_121546
atggctaaaatctggtcaaacatggaacccatccatagacaacatgagggtacgaccagaaccactcgtccatcacctgtgccaactgaacataagcaatcaatcacttctagtgatccatatgacaaggcaccaaagctcactttgcctgcaacaatctttaacatggacccttcaaaggagaatcctactcctcaaacattatggtccaacgaggtgcaaatttggactcttcacaccagattcattccctcttatcctgcctacttaagaccctccagaaaagatctagacatgataggaggcatcttaaagttgatatatatatcgtaccaggcaactgcttatccccttggactccacatcagcagatgcattgatatcaagacagtgcctaatagagtctgcctaagacttcccatctatgatgaaaggaagaagagcttcaagctctacttcaatgaagatactcatagcaaaaaacagaagatctag

SEQ ID NO: 4769 - DNA, 438 bp, Glycine max
  Peptide Sequence Number=SeqID_121547
atgatgttaggacctcgtggaatcacacagtgtggtatgaaaccaacagaactagccattcaggtattgcgtccaacaaaagtttgccactttgatgatgcaaatgcctgctttgtgaagaaccttaaggatgacttcctgaagcatctgttctggctacccactatattctgccatcatgtttttgacatctgcaagatgacaatggagaaattagaagctagtgtccaacaccttcatagattgcaacaagctaagaggccaactatgaagcaacttggcaaatcatgcttgaaaaagaaacctactctaatcaactttgctcctccagaggtagtgatcaaagctgaagtgaaggagaagattggactggctatggatagctttattgagaagcaaaaggctaagaatgatgagtttagatgtgtaacaccctga

SEQ ID NO: 4770 - DNA, 1854 bp, Glycine max
  Peptide Sequence Number=SeqID_121548
atggtgaaaaaaggaaacattgtgcagtatagggaaaggttggacaacacccttgccttaccagatctgactaatgaacagacactcaaaacgcttgtcaaaagtcaactccaacgttcttcagaagtggaaatcgagggatgtaatgagaaagaagtagaaaccaagactacagagctatgcaactttcttgatatgttgagaagtgcttctggagacaatggcggaggatctggtagtacatcacacactgattggaaattaaaacaggataatgaagagtttcgtgttatgtatcgtgaaggaccagagggaactcccattcatacattgctagttgaaggctatgtagatggacctctagatctttctttatgcctatcgtgggagacccctctctacaagaaatggtggcctcagtttactattcccagtttcaaaattttagtatctgatcgtttgcagagggtccaaattggggaacaaatatcactagttaggatgaaggttccatggccgctggctacaagggaggctatagtgcattattatctgtttgagtactatcaagatgacttagtagttattcttttgaatacggttcatgagtcaaaaattgatgatttaaacaaggatgcaattcctgaagcaaaggatgtcgtgagaattgatttggtgggaggctatgctatgcaaaaggtgacatcagaaagaagttattttcggataatagcaaatttggatttaaagctagattttgtacctccaaccctcctaaatttcatttcaaggcagctcatcggcagtggtttcaggctttatcagaaggctgtgacttctatgatgggcaatgataaagataaagacttcagcaaggccttggaggactcattgtatgttagaattcgtgaagctctattaagcactaggaaatcaaaggctatggatggtgaagagcttaagcaagatgcaagcattgttcctacagaagaacttgttcaaagtgaggacggggcaaaagatgtatcctgtgatgatagcagcaaccaatgcgcaaataattacaatggagagactttagatgcaggtagtgaagagattgtacaaattgatgaggatgtcaataaggtacttggcgttccaattgaggaaggtgattcgttgagtgtactgatggaaaaggaaaatggtgagattgtagatgcagataacgaagagattgtagaaacagttagtgaagagattgttgagactgagaaagatgtcaacaaagtgcatggcattccagttgaggaagatgatacaaagagtgtactgaaggacagaatgaatgtatatatacgctcagacgtgagaaatgctatagaaacaatagagagggttatttcagtagttagaaaatgtggatttcatcccctcgggtccactttaaactctgctggtgaagagttcccctgcatggaaaaaggtggcacagttgattcagattctgcaaaagttattgaagtatgtttgaaaaatgaggatagtgccaaagtatcaagcagcaatgtagtggaggaaaatttagaagaacctgggacgatacaaagcttcaggcacacaggaacaaatcctaacttaaaggaagtaaactataagaaaatagtaccggcttcaccagagcagaatctttcaataccaattgaaacaagccaggctgattcatattctttgaaaaatgggacaattctggaccaaacaatatgtgataacaagcaattaaacagtgacgcagtccaagatatgacttcatatgacctgaaaaagtcaaccagggagatgaagtatcgatactgttgttttatgcattag

SEQ ID NO: 4771 - DNA, 1720 bp, Glycine max
  Peptide Sequence Number=SeqID_121549
atgggaaacaattgtgtcggatcaaaaacctcaaatgatgcactatttccctatgttcttccgggttcattctggtggcttcatcaaactagtgtcacagaaatttctgatgcaccttcactcgtgactaaaattcaagacacaaattttctagagaatgttcaagaaaacccaccacaagtagtgaaaattaaccacgaggagatgaagctgaaaccaacagttccaaaacatgacaaagagactaatatgccttcagaggaacaaacaaggcacatgcagaaaatgcctcacaaagttaagaggctaccaatagggcttcaagcagagtcaattttgaagagaaaaaatggtaactttaaggagtactataacttgggacaagagcttgggaagggtcaatatggaacaacattcctatgtaccgagaaagccacagggaaaaactatgcatgcaagtccattccaaaagtgaaattggttatggatgatgatgtggaggatgtgaggagggagattgagataatgcatcacttaaaagggtgtcctaatgtgatatcaatcaaaggggcttatgaggatggtgttgctgtttatgttgtgatggaattgtgtgaagggggtgaactgtttgataggattgtggaaaaggggcattacacagagagaaaagcagcaaaacttgcaaggactatcgttagtgttatagaggggtgtcactcccttggagtgatgcatcgggatcttaagcctgagaattttcttttcgttgatgggaatgaagagtccacccttaaagcgatagattttggattgtctgttttcttcaaaccaggagaagtttttaaggacgtggttggaagtccttattatatcgcacctgaagttctacgtaggcattatggtccagaagctgatgtgtggagtgcaggtgtgatcatatacattctcttatgcggaacacctccattttggggtgaatcggagcaagagatatttgaagaagttttgcatggtgatcttgatttctcttcagatccttggtttgatatctctgaaagtgctaaagacttggttaagaaaatgcttgttagagatcctagaaaacggataacaacacatgaagttcttcgtcacccttggattcaggttgatggagttgctccagacaagcctcttgattctgcagttttgagtcgcctgaagcagttttctgtaacaaacaaactaaaaaaaatggctcttagagttattgcagagaatctctctgaagaagaaatctatgaattgaaagtaatgtttaagatgatagacacggacaacagtggtcaaattactttagaaaaactcaaggctggattgaaaatgcttggtgcaaatctcagtgaaccagaaattttggatctaatgcaagctgcagatgttgataacagtggcacaattgactatggagaattcatagctgcaacattgcatttaaacaaagttgacagagaagatcatttagttgcagctttttcattttttgatagaagtggaagtggctacatcactcaagatgagcttcaagaagcttgcgaagaatttggcattgagaatgtctgcttggaggaaatgatccaagaagctgatcggaataatgatggccgaatagactacaacgaattcgtggctatgatgcagagaggcaatgcagatttaagtaaaaacggtttaaagg

SEQ ID NO: 4772 - DNA, 606 bp, Glycine max
  Peptide Sequence Number=SeqID_121550
atgcctttatcgagagatggcatagtgagaccttctccttcctccttccaccttccagttggagagatgaccatcatccttaatgatgtgtcacgtctgttaaatccttttatcattgagtgtttcattgatcgcacaaacatgagctacaccatggcaaatattagaggaagtagatgccgtgacgttatcaggcaacaaagtggctctgagttggttaaagagcctataccacacctatgctgcaatgagtcaaatgagtgggctagcaaggcgtatttgctgcattttttttacaataccatatttgctcaaaagagctcgacgcatgtatttgagcatctgctaaccattcttgctagtgagaaggtgctgaaatatgactgggagaagccacttgcggctaggtggttgccattgaggggtactgacaaggttgctagggccaacacattgttggatcggttggagatgactgatgttgtgtggtccccatatgcatcacatagagaactcaaatctttcaatgaccaaacattgtactctagctaccttagtgttggcatatacatgtggtcgtatctatcagaaagggttttgaggtag

SEQ ID NO: 4773 - DNA, 207 bp, Glycine max
  Peptide Sequence Number=SeqID_121551
atggaagaggactctagggaagccaagaggaggactgaacaggaagcacagagaagaaatgatgcaaatatgaaggccagaatagaggcagaagagaaggatcgagcattttctacgttggcttataacgataaccggtttagaaaatacaccatattggagattgaagcaaccatagaaaagttctaccaattacaaaattggtga

SEQ ID NO: 4774 - DNA, 108 bp, Glycine max
  Peptide Sequence Number=SeqID_121552
atgcccaatcaagagcattgcctatgtagaagctggattgctctgacattgctgcaagatgaatttcgcattctggaagcaaaactaatcacgcagcagaatatgtag

SEQ ID NO: 4775 - DNA, 453 bp, Glycine max
  Peptide Sequence Number=SeqID_121553
atggggttaattagacaagctttgaaaagtgctatttttcaccttctcgctaagccaacccgctggcttagcgagcgtccgctaagcgcaacactcttggggtttctagagagagaaaggtccaagttccagagagttttgagagattttgctgtgaaaagatctcaaagaccagagcttgaagcaggagccgggtcattcaacaatggaaactggtctgactctaaagtccttgatagtacagggctaagttgtcgtactatcacgaggaatcgggatagtttatacacctgttcatatttacacttacctttacacaccagacacctatttgctgaaatagcctaccaaataacacaagtcccccgagtgttcaatactcggttcttaccgttttatactacttgtgcgatccgatgcacttgccggaagccgaacagtaatcaattatag

SEQ ID NO: 4776 - DNA, 243 bp, Glycine max
  Peptide Sequence Number=SeqID_121554
atggcaatctttcttgtgatattgaatagtgagccatgggctttgttttgtcgacatcaggaagttaggcaaagggaccctctatctggttgttcaagagaccatggtaatggtctcccacctctggttctggacaggggggaaaagatagagcttctggttgacaaaactgaaaatcttcatcaccagggttttgaaggtcttgaactttggattatctctttcatgcttcaagatcattag

SEQ ID NO: 4777 - DNA, 117 bp, Glycine max
  Peptide Sequence Number=SeqID_121555
atggcaactccgtcgcacataaccccaacctctccacacatgcaccccgagcgtggtttagagcctaacccacatatcttgccccccgctattcctacttctaccaagaacatatag

SEQ ID NO: 4778 - DNA, 939 bp, Glycine max
  Peptide Sequence Number=SeqID_121556
atggaatctgaaaacagggttgctgtggaggtagagaaacgtattattggggtaacaaccaaggtggagaatataaagaaagaagtagaaaatgactgtaatggcgcagaaattcagactaagaatgaagtttctaaacccacagtggatgctaaaggccccatttctgctggtgacaaagttgtaattgaagcctctaaaacttctgcaaataaaaattcaaaaggtgccaaggaaactggtggtagagcaagtgttgcttccaggagcaacaaatatgccaaagacaaacccattttgaagggtccaatttcaatatctcaaaaactaaggccatccctttcacaaagcctttctttcccagccaaatcagctggtgaagatgctatgcagaaaagcattgatgggtatcttgtgaagccaaaagttagacatattcaaggtaatgggatcagaggtgagggccacattcgtcatttaaacaagtcaacaaactctgaagtcaactccctggcaaaaaccaacactggcatgcctgctttgaaacgctctgcgtttggtaggtccactacagttactgcattcaccaagagccaaacttctgaggcatcgttacccgttgatcaggtgtcaagcacagcaaaaactgcaaaagcaaataaagaggatgatgattctcattccacaacttcaagtgctaccccttgtctgagaagcaatggaagtggattttcctttagattggaagaaagagctgagaagcggaaggagtttttctcaaaaattatagccaaggaagcagagaaaactaacctacaagttaaatcaaaggaaaaccaagaggcagagatcaagctattgaggaagagcatggcattcaaagcaactccaatgccaagtttctataaggaaccacctcccaaagttgagctgaagaag

SEQ ID NO: 4779 - DNA, 306 bp, Glycine max
  Peptide Sequence Number=SeqID_121557
atggtggcgatgatactgtggcaggaaggaaaggaagtagttgtgggattaattatttgccgaataagacagagcagccaatggtcttgcattgctgggcctaagctggtgccggaaaccattactcttaaagttgaccctaacttttatagatctaacaaattctactctcttttccaaatttctttcccgattaaactatggagtgagaaaaattacagcactttcaaatttcaatacgaagttaattttctttcttgcacccaagatttattcctttactctcgcgtaagaaaagtcctttag

SEQ ID NO: 4780 - DNA, 1015 bp, Glycine max
  Peptide Sequence Number=SeqID_121558
gtttgcaccatcatctgatccatcattgactatcaagttttatgagagaactcctgagcagcaagcatcattgggataccttgttgattccactcacattgaaggaattcatgatgaaacaccagaaggaggagaagctgtgactgctgatcaagtgaggagagaacctcatgggtcaataggggcaacagctggtcatcgagccattgcacagagtaacagttcagaaattgctgaagccttatttcgatatactgcaccagaagaggtgatgacatttccatcttcttgtggtgcttgtgctgctagttatattccttacttccaagaagtaatagttatggcatccacatgtgattcctgtggttaccgcaactctgagttgaaacctggtggccgaattcctgaaaaaggaaaaagaattactcttaatgtgaagaatgttaatgacctgagccgtgatgtaataaagtctgatactgcaagtgtaaaagttcctgaacttgacttggagctggcaagcggaacccttggaggaattgttactactgttgaaggtttaattacaaaaattagtgaaagccttgagagggtccatggctttacttttggagatagtcttgatgaacagagaaaaggcaagtggatagactttaaagcaaggctaaacaagcttcttagcttggaagaagcttggactctaattctcgatgatgcattagccaattcttttgtagcacctgcaactgatgatctaaaagaggacaatcaattatcatgggcacgtgtttcaaccttttgcgtgacagtgctaagtaacctgcataattggaatcatgtgacgaatgggtttaatgagctatatttttctgtttggcaattttgtcacgatatctcttcagttgaggaatacgagaggtcatgggaacaaaatgaagaattaggtctgaatgatatagacacctcttctgccgatgttgcttatgaatcaacaaatactactaaaactgagtga

SEQ ID NO: 4781 - DNA, 1221 bp, Glycine max
  Peptide Sequence Number=SeqID_121559
atgaatagttttgggttttccctcccctctgtctctgatgcggtggggagtggggacagggagggtttgtcatttctcaagaaagttgtagagatggaagacaagacagaaagtcatatgagttcagctgcggcctttgttgaaggggggattcaagaatcctgtgatgatgcttgcagcatatgccttgaggagtttggtgcaagtgatccttcgacggtcactacctgcaagcatgagtttcatctgcagtgcattctcgaatggtgtcagagaagctcccagtgtcctatgtgttggcaacctattagcttgaaggatcctactagtcaggaattgtttgaggtagtagagcaggagagaagcttgagggctaccccatcaagaaatgctgctatttttcatcaccctgcctttggagattttgagttgcagcatttacgcatgagtctaaatgatgctgattttgaagagagaattattcaacatttagctgctgctgcagcaatgaggagagctaaccaacttggttggagggaagggcagcgagctcgttcatcagctcatggtcatccacaattcttagtgttctctaatcagcctattgcaccttcatcagttgctggaggagaaaatgacccaactgcaattcctaatagaagtccatctaccccaataacatccgttggaaatgaagcatcgcagcagatcctgcaccttcaaactcaaagttcttcttcagcttctggatctcctgtcatggctacaaatcctcgaggaatttactctaatgaaagaggctctactgcttgttcttcaccagcaaaccaagatagagcagagccatcagagttgcagtcattttctgattctctgcgatccagacttaatgcagtgtccatgagatacaaagagtcaatctcaaaaggcacaaggggatggaaggagaggctgttctctcgtagttcttccatgtcaaaacttggttcagaaacaaggaggagagagataaattctggaattgctagtgtatcccgattgatggaatcccttgaaactagtgaaaataatagagttgtgggtacttctttgtcaaatcatacggagggttgttccataggaggggtgagcaaccagaacaatgttgaagctagaggggagaactcttcacatgatgacaatactccagctgcttgttctgctaactcacatttaaattga

SEQ ID NO: 4782 - DNA, 183 bp, Glycine max
  Peptide Sequence Number=SeqID_121560
atgggaacaccagggataacctcggccttcccacttatgagaaccttcaacaaaattctgtacattagaccacctgctaagaccttgtttaatgagattgttactcttcaggagagagatcgagtcgtcacaacttgtgatcctgtggatcaaccactcatggaaagggggatcatactatga

SEQ ID NO: 4783 - DNA, 168 bp, Glycine max
  Peptide Sequence Number=SeqID_121561
atggcttcacttgaggtggatcttcggtcatcaggtccaatgggattccaagggtttggacatgaactgacagactttgttcacaacaaagctaattttaggtctggtgatgatggcatattgaaggcccctcacgacctgtacacagtgggatctgagagaagatga

SEQ ID NO: 4784 - DNA, 285 bp, Glycine max
  Peptide Sequence Number=SeqID_121562
atgaatatcaaggccattgatctgtggtctgatattcagaaaagggataactggcaagatgttttcttcatcgacagaatacatttttcagttgagggaaacaagatagtgttgaaagagatattgaaggtcctgaaagaagcagaatgggaaccaactgtgcactggaagtcaatgccaaatgagtttgaggaagattcaccctatgatccagttgcacctgatggaagatcaactgttaatctttccaactggtccttccctgacgatgtgaaatgggactaa

SEQ ID NO: 4785 - DNA, 366 bp, Glycine max
  Peptide Sequence Number=SeqID_121563
atggcttgtgcagatgatcaatcaaaatttgatgcacaacagacacaaggtttgcagaagagcctttgtggtcatcctcttttctttggtataacaacgggactgcattctgagattataaattctaggctcttcacaattgtcagaggcaaggtccacaaagctgttgatgcttgcaagaatgttcttagaggattgcatagcaacaaaattacggagagggagttggacaggatttctacatcgattgccctaataaccgatgtagaatgtcagaattcaacttcggtcgctcaaccgtcgttgtgtttcaatgacttcgggctacaacgactcttgataaccgatgtagaaatacgccgataa

SEQ ID NO: 4786 - DNA, 249 bp, Glycine max
  Peptide Sequence Number=SeqID_121564
atgattatgaggatcaaaagaaggacgcagaggagaacggcaaagaaggacacagaggaagattggagttcttttcggagaaagaaaaccaagaaacacatcctgggaaagggaacgctagctccagagaagaaccctcactgtgtcgccgtggtgtttccagagaatgacgcagggggccgtcaatttcttttgccgttgtggtgttgtcagagaagaagctcgtcgaggccgcacgacacagagtga

SEQ ID NO: 4787 - DNA, 255 bp, Glycine max
  Peptide Sequence Number=SeqID_121565
atgtcaggaccattattaaggcctcagtttgttatgttcggttcttccattgttcagtatggtctttatgatgaaggttggatggctgatctttctcacttgtatgctcgcaaggttgatatagttttgcgaggatatgctggttggaattcaaggcgtgctctgcaggttctggataaaatctttcctaagggtacggtgggatggggtgttttaacaaaagaggtcaaaatcagttcgtctaaagtgtggtaa

SEQ ID NO: 4788 - DNA, 639 bp, Glycine max
  Peptide Sequence Number=SeqID_121566
atggcttatgtgattaatttgattcttgataagactctgtcaacttctctaattcaggatgcccctgtacaaccttcattggtcattgcctactttggtggtaatgattcttctactccccactcatcaggcctaggtcctcatgtgcctctccaagaatacattgaaaatttgaggaagattgttaaccatctcaagagcctctcagagaacactcgcattctacttctcagtgctcctcccatcaatgatgcaacaattaccccaaacagtgaacgcagtgatgggaagccatcaaggacaaatgaagcttgtcgaatatattcagaggcatgtttggatgtgtgccgtgagatgaatatcaaggccattgatctgtggtctgctattaagaaaagagataattggcaagatgtctgcttcattgatggaattcacttgtcatccgagggaagcaagatagtgttgaaagagatactgaaggtcctcaaagatgcagaatgggaaccaagtctatattggaaatcaatgccaagtgagtttgatgaagattcaccatatgatccaattgcacctgatggaaagtcaactattaatatttccaactgggccttccctggcaatgacaaatgggagtag

SEQ ID NO: 4789 - DNA, 525 bp, Glycine max
  Peptide Sequence Number=SeqID_121567
atggatattctagcagacaaggcatcttctccttccaatgacatactgccagctcagcttttagtccaatacgaaggtccttacattgagttgttggagggtggtggcaagaagctttgggcattggggccattcaaccctgcaggtattgagaagaagatgcaaaaggaagacactcatgcatggaatggcttgataagcaagagccaaatttggttatatatgtgttttttgggaccacaacaagtttcacagaggagcaaatccaagagattgcaacagtgttggagaaaagcaagcacaagtttatctgggtgttgggagatgctaataaaggaggcatctttaatggaaatgagggaaaaaaggcatgagcttccaaatgagtttgaagagagagttgaaggcatggggctagttgtgagggactgggcaccccaattggaaattcagagccacctttcaacaggagggtttattagtcactgcatgtggatgaaactcttgttaatttggagagcttaa

SEQ ID NO: 4790 - DNA, 330 bp, Glycine max
  Peptide Sequence Number=SeqID_121568
atgttcggtttaggcaaattttggaaattacatggaagtgactttcaggaaaaggcagtttttaaaaaagataaaacttccatcaaccgccaaaaaccacctgttcatcaaccgccaaaaactacctgttctttgatcataaataatcattctggttcagaaagcattacggttgttgagaatgttgtgagaaggttgatggaaacgatggaaggtgatgagatgcgatggagagtaatgaggcttaaaggtgccctccataggtgcatggatgcaagtgtggtttctcgcatggaaattgattctttcactgttcatgttactaaatag

SEQ ID NO: 4791 - DNA, 339 bp, Glycine max
  Peptide Sequence Number=SeqID_121569
atggagaggagtatgattgatgctgccaatggtggagctcttggtgatataacccctgctgaagctaggaatttgattgagaagatggcttccaactcccaacaattcagtgcaagaaatgatgttattgtccttagaggagtccatgaggtggccacagattcatcttcatctacggaaaataaaaagcttgaagggaaacttgatgccttggtcaacctaatcaccatacagatctttgtccttcatggcagcaatctagagccaatgagcaacctgaagcttatgctgcaaacatttataatagacctcctcagcaacaaaaccaacaacagctga

SEQ ID NO: 4792 - DNA, 339 bp, Glycine max
  Peptide Sequence Number=SeqID_121570
atgcaagattcccataaagatatctacctaggagcttacttgaatgatgttttgaatgaattgtatggtaagttctcaagttcatccaagaaaactaattggattgaagttaaaaattgtttacaaaagggaggcattgagtgtgactattatgtcatgtattggataaagaccaaagtcttagggggtatcaagaatgattggatcaagaagttaaaagaagaagatttcaagtgctttggaggaaaattgatgcaaaaacttgaagaaaaagttgaagattgggacagctcgcttagcgcacaagacaggtccaacgcatttcctcgcttagcgtga

SEQ ID NO: 4793 - DNA, 741 bp, Glycine max
  Peptide Sequence Number=SeqID_121571
atgattagcactcagtctggcctcagacgcgagacccccctcgaagacttccatcctcatccgacagctatgactgacacaaatactctacaacaactccaaaatcgcattgcaaagatagagagacaccatgagaaggagctgaaaaagctaaaggctgaccatgatcaactagaggcttgtgtcagatgtcccaaaggtgacaaacactctgctcacatatttcctgagcttacccaaggggaatcacacccccgatgcacagtcaacaatacagatgacttaagtctctcccatatgcatcgtccagtaaggcggattactcgtcgacatctttttctcgactacattatggaggtaggcatacccttagtgtggaaaccacacaacctcgagcggtacgatgagacaacagatctagatgagcatttggatgccttcctaactcagacaaacctcaacactaataacaacatgactctatatcgtgtctttcctacgtccctcaagggggcatcattgacttggtatggtggacccccccgagtccatagacagcttcaataccttcgtcgaatgataaagtcatggatgagttgtgtgaatgagccaagggctacatccagatggaagaaatgtctagattcaggaatgaagtccgagaagtcggacagaagcacaggaagcacaaaggaagcaccaagaccgacttacacaattcggacaagaggcataagctag

SEQ ID NO: 4794 - DNA, 441 bp, Glycine max
  Peptide Sequence Number=SeqID_121572
atgttgtccagtgtcgggtgtggtaacctcaacaagtttgagagaattactggtcaatgtggcttgtcaagtccccaagcttggacaaatgttgttcgggctgcttctgtcaagttatccaagatggacatgtctttagcgtgtcaggcgtgtgcagtgcacacacaatactcttgcatacttgtcattcgcagagtgggcacatattggagtcatggttcatgcgtgaataagggaggtctctctattagtggttccttgtcagaggatactcattgtggtgctttcgacagcgagttttcttcttcgaaaagggtgagggcctcgccccggaccggtgggagcacttctcaccctcacgggaaggcacgacctttcgctgttgctggagagcctgtcccaattactgtgatcttccctccttctatttatagggtgtga

SEQ ID NO: 4795 - DNA, 1179 bp, Glycine max
  Peptide Sequence Number=SeqID_121573
atggccgcaccttccctctcctccgctctcaactccctctcctctctatccctctccacctcctcccgcttctctctcctccctccaccctccctcctctccaaacctctccccctcctcttcgcaaccaccaccctcaaatccaaaccctccgacgacattgacacatcgttcttcgacaacatcaacccgcaagacgacatcacattcaaccctccggagcccccggagggcttcgtggcgcctccgtccttcgacgacggccccctggagactgaggacgaaatcgccgcagcctacgaggagctctacggccccggctacagcggcgtctcggtcctcggcaacgacgtgtacgtgatggacgcgaaggtgaagaaggagaccgggttcgggtccggcgctaagaaggagaaggtgagggatgggttcgaggagagggtggtgcaggtcaggagggtcaccaaggtcgtcaagggagggaagcagctcaggtttcgggccgtcgttgtcgtcggcgacaagaagggctcagtgggcgtcggagttggcaaggccaaggaagtcattgccgcggttcagaagtccgccgtcaatgccaggaggaacatcatcaaggttcctatgactaagtactccacttttccccatagtcgcatagagcccaaagttacagttgcatatggatgtaattgttacgaagtttctaggatttattggcctctacttgagcttttgagtatgaccatggaagtgctgaaaggagcatggattttttactctgagctatccaaacacaccagtagggttttgacacttgtgattggaagagtatttgatcgagtccagttctggaatgccaaaaactcaaaaggacttaaagtgcttagtttcttcctgatgagagttggaacctttactaggagtagaactgacggagattatggagcggcaaaggtgatgcttagacctgcatctccgggtactggagttattgctggtgggtcagtgagaattgttcttgaaatggctggagttgagaatgctttgggaaaacaactagggagtaataatgcactcaacaatgccagagcaaccgttgttgctgtgcagaaaatgaagcagtttcgtgaggttgctgaggagcgtgggattccaatggaagaattgtggaagtaa

SEQ ID NO: 4796 - DNA, 444 bp, Glycine max
  Peptide Sequence Number=SeqID_121574
gcttacacttctaacatacatgagcaagaacaaattaaagcaaagccatgtagaatacagatcttgggatcgacattgagctacgaagtacggacactccagtcccttgccgtgtccggtgtccgacacgcgtccgtgtcagtgtccgacaccgacacaacacccgtactacgttctatattttggacaatacagataaccctaaatctgaaactaccttcactccgctctgccacggctgagaaaatagcgacgcggaagcacgctcgtcttcacgatccggcgcggcgtgtcctgcgattccgctctccgacgagtcggcgcagggtaaagaatcgcgcgattcgtctggaaatcgagattctagcacgattcatcccagatatagagattcaaccacgattctggaacaaaaacgaaacaacctccgattcgtatcggtag

SEQ ID NO: 4797 - DNA, 3045 bp, Glycine max
  Peptide Sequence Number=SeqID_121575
atgacaactaattcatctcttccttctggagttcataaagaaaaacatattctctttgagattggaaactctgaaaggcagctgtgggcattgatccattctaaaggccctgtacactcagatgttcaagtcttgtatcataacatcaggtcaagttatgagagagaaatcctcaataaccacactcattcagaacttcaagaagttgaatattccttgtggaagcttcactataagcatattgatgaatttcgcaaaataataaagaagagctctggtaatgcagagaacaaaaaatcaggaacgtcaaaagatggcgttgtgcagatagacaatgacaatcatatacaagcatttaagtcatttcttttagaagctgctgagttttaccaaactctgattgtaaaactcagaaaacattatggagtcccagaagaggctttgtttcataaaaagggttgtgtttcaacttcttttgaaccggaacccctgcagaaatgtcaatatttatgtcatcgctgcttagtctgcatgggggatctggccaggtataaacaacattttgaaaaccttgatactcaaaagcaaaattggtcagtttctgccacacactacttggaagcaacaaggatttggccagatagtggaaaccctcaaaaccagttggctgtattggcaacatatattggagatgattttctagctttgtaccactgtgtaagaagtttagcagttaaagaaccttttcctgatgcctgggataattttattttactgttggaaaaacttcgcaagctgccatctctaatgatcttgcagaacaggtcatctcatctggaatgtgtttccagtgatgtctgctttgatttcttcaaaccttctcaaaggatcagcaaagagaatggagcacgaccaaatgatgatagctcgaactgcaacatgtttgaaggtgaaagtaatcattttactgacacaaagttatggtctcttatagtcagaacagttagttacctcttcataacatcaagtttggaggaattccccattgcattggcatctactattgaagtgtttgatgaaatgatggagctagaagatataaaactaaagaccgtcttggagtcctatggacaaatggatttggccagaaagggtcctttccgagccttacaaatagtttccatactcatatttaccctaaagaatctgattgataaacatgagaaagatgaatcaaaagacaaaaatgattgtcagcaacttgtgctgattcaactggcattagctgctgcattcattttcatgggccgttttgttgaaagatgccagaagtctagtcctttgaattattgccccttattgccttctgtacttgttttcgtggagtggtgtgcaagcatgcttgatgaaattgaagtatatgcaactgatcaaaagagtgaaacagctatttcttattttttttatgtgcttcttgaacttctaaatgaactaaatgagaatacaaaggaaaccaagaagcttgtagctaatagtacccctctttgggaagactatgaattgaggggctttgtatctatagctttttcacatgtctcattagatttctcagatggatgggaacacattgacaactttgagagtgacactgaattgcgcactcagcgcatgagtgaagcagcaatgaggattgctaacagatctaataatttgcaaaagtggattatatctgatgaattaggaagaaaatttcattctgctagatctgatgataatcatgagaagaaagaaacaggtaacatagagtccactgacaaaaggacaagtggggatgaccctaatcagaaaactcacaaagacaatggagaagatgggaaatgtgatacaagggataatccaagtagttccagcactaatgaagaaccttttgttgtggaagaagaagaagttattctcttcaggcctctagcgaggtatcattcagcaccatcgtacgcacttttttcccctcatgagcagatatcatcaccaaaagacaaggatgataaagtcttaccttctgatgattgtctgcaccgtactacatctctgcctatggcacaaaatccatttcaaattgatccttggggattccaaggtgagattatgaattcaaggatcaacaaatcgttccaagtgcaagaaccttcaatgaaggaatcaaatgcaaacacattttctgaaggtccaatctctgctgggcatccttcactcaatgcatgggtccttgatagaggagggttgagcaccaacaggttgcaccccattgaggaactagcttcttcatacttggctgatctttccatcaatagaactcagaatccagtcatcggtttggtggatgagttttcaaacttcccttcctcttctgctacatatactgctccagttccttctgctccactgttgccagataatgctccttggtataccgatgtcattgtacaatctactatgtctgctccattattgcaagaaaacccatcaccaataaatggttattcagcttggccttctacttatggaccccttggatatgatactagttttctattttattccaatggatacgcgccgccacctggtagaataacttcttcagaatggctgcgttggtacagagagaatcccccacctgagagggtcaacaacaatatgcagcctactcatttgaatgttcctggaaatcatgaaaatttcctccatcatgacacctacaggttcaaccaatttgaccaatggggtaaccctttgtctcctaaccagtacacttatatgaaaccaccaggtccccaaccattgcagccaggttatccctgtgcttttggtgctggtgaacacataaccaatcacttccacaattttcaaagaccaagcccttatgggtgtggttctgtgacagaacagagaaatgagccactgccactgctagaataccttaaggaaagggaatggagactccagcaggatcctaccctcagaggacctacatacatgggaaattga

SEQ ID NO: 4798 - DNA, 1536 bp, Glycine max
  Peptide Sequence Number=SeqID_121576
atggcgaggttgaaggtgttgtcaaccctagacacatcaaggacacaatactaccacttcaaagccatcatcattgcagggatggggctcttcaccgatgcctacgacctcttctcaatcactctcatcatcaagataattggaagggtatattacgaccaccgcgaaggcgaacaccggtacgagaccccgccggaggtcgtctccgccttggttgccgtcgcgctgctgggcaccgccgtcggccagctggtattcggccggcttggagacctcaaggggcggcggcgcgtgtacggattctcccttttgttgatggtcttcagctccttggcttctggcttctccatttgtagaagaaaaacctgcgttctcctcactcttggcttcttcaggtttttcttggggctggggattggaggagactaccctctgtcttctaccataatgtcggagtttgcgaacaagaagacaagagggtcgttcatagcggcggttttttcgatgcaaggcttcggcatattggccagctccaccgtgacgatggcggtgtgctccatattccgtgcagcgtccaagaactccgaggctgacttggcatggaggttgattctcatgctcggttcagttccggcagccatgacttactactggcgcatgatgatgcccgaaaccgccaggtacacagcattagtggagcaaaatgtgatgcaagcagcaaaggacatggagaaagtccttgatgtaacactgagccagattgctgaagaacatccattgccaccaaccccacatccataccctctcctttcaagggaattcttgcgtaggcacggtcgtgacctatttgcatgttcttccacatggttccttgtggacattgtgttctacagccaagttttgttccaaagtgaaatatacaaacgctacctagacaaaaaggaggaagtggatgtgtatcaagagactttccatgttgcatggatccaagccgttattgctgtgtgttccacaatccctggctacttcttctcagtgtacttcattgacaaatggggaagggtcaaaatccaaatgatgggttttttcttcatggcattggcctttttcgccattgggattccctattactctttttggaccaccgaggaccataatatgaataaagggttcatggtgttgtatgggcttgcttttttctttgccaattttgggcccaacactactaccttcatagtcccagctgagctttttccagctaggtttaggtcaacgtgtcatggaatttctggggccgttggcaaggttggggcaattattgggtctgtggggtttctttgggcttcacataaaaagaaggaaaatggataccctaagggaattgggatggaagtgacccttatcatacttggagtggtgtgcttattgggaatgttggtcacctaccttttcactagggaaaccatgggaaggtctttggaagagaatgaggttgagagtgtgaatcatgaagttgaagagcatgataatctttga

SEQ ID NO: 4799 - DNA, 498 bp, Glycine max
  Peptide Sequence Number=SeqID_121577
atggatcttagagcagatttctttggttttcagttagccgattggattagatggaatttggagttaacctcttacgaagtgcagggtatctcttggcctgaattatgggaaaacagccttacgcctggcagggtgtggaggtctaattcgggaccagaatgggtctcacattggctaaagctaggaattgtggtaaggttcaactacaggtggattcttatgttgtggttcaaagtgttttatctcgtggcagagggaatgctagaggttggagtctcatccaagagattagaaattagaaggttattggatcagacttggcaagttgagattattcatgtgtatcgtgaagctaattgttgtgcggataggctagccaatttagcttgtggtttgcaaagccctcttgtgttgtatgagcaagctcctccttgtttgagctctttgcttctttttgatgttaggggagtttctctcccccgttttattcccttgtag

SEQ ID NO: 4800 - DNA, 960 bp, Glycine max
  Peptide Sequence Number=SeqID_121578
atggtgaagaaagtgaggatgccaaggaaggggaaggagaaagatcaaggagaaacctctagggatgggtttgttggagggccaagatttggagtattaggtaatcagattgatgaggagagggcatcgataaatgataatgacaaggctattacaagaaatattggtgggattgtgataatttccaaagttgttgatggaggaaggccgacattggcaggaagagatccaaagattggccacactaaaaaggaatctcagaggggccttgatcaaggtcatccttatgctagaggaagaaataaaggcaacatgtctagatgctctattagacgtggggagaatattaatggtgttgttaaagacatggaatgtgttgctgagacactatccttatcaaatggtgtgttcttcggggctagaggctttttagggggcatttgtgtggctaggagaatggataaagtgaatgtcattatcaatttgaagcatttacactttattcatcttcgtgttagatttgaaaaccaagattggtggtggttttctttggtgtatgctagccccattaaaggtgttcgaggggagcttaggaattaccttcataatatctctacttctaatcctgataggtggtggatgatggcagatgatttcaatgatatacttattcaagaggagaagaaaggtggagctcctacttatcgtcttgacaaagccttctgcaatgctcattggcatatggcttttccaactgcttctattaaggttttgactagagtgtccttctctgatcaccatcctattctagtttctatgaatgatggttgcaatttttccaataaaagtatgtttagatttgagtgtgcttggattgcgtaccccttcttcaaggaccttattactgaaagttggaagaaccaagatgatttagtaaatgatactactgtatctccttag

SEQ ID NO: 4801 - DNA, 1137 bp, Glycine max
  Peptide Sequence Number=SeqID_121579
atgaagcttgcttctacaagcttgtattcgaggtgttcaacaaggtccaaagcgaagtggcttcatgatagggataagatcactagatactgtcacttgaagactagtcgaaggagaaggaaaaaagctatccatatgcttagaaatgatgatggcgtttggattgaggatgagcataaagttcacaaattggtaaattcttaccatcaaaatctatttgtatctcaccatattgataaggagatggctcttggcccagatgggtaccttgttggattttatcaaaattcatggaatatcatccaaaaaaactttctcaagactatgaataggttatggatctccccttcagaagttctaaagatcaataagactgatatttgtcttattcttaaggagatgctttgctctatgaataatatgaaagggaaaaagagtttatttggtatcaaagtggatcttgccaaagcttatgataggatgagttgggaatttgttaatgaagttttgattgaagctggttttcctctagagttaatcaatgtcattatgattggcattagctctgttaacactaatggtgtttggaatcctatgagagttggtaggacatggccttttgtgtcccacttgatgtttgccgataatttattattgtttggggaagctactatttaccaaatgaacatcgttatggatgtgcttaacaagtttaaagaagcttcttccttgggcaattatctaggagtccctttgcttgggaagtctccaagaagagtggatttcaatcatttggtggataagaggactatgatgcttcctaaaggaaatgatggagctgccatgtgtaatttggatttgattaattatgcttgccttatgaagttgtgctgggccattaggaatggtaataattctctttggattgaagttctcaaagggaagtataccaagagatggagtgtgaatatgaatttagaggctaaaacttatgattctcctttatggaaatggattgatgaaaatactagactgaaagatgttgttagtgttgctccttctcagttgcaaggtttaaaggtcttgatgagaattatccctattcttcctccttctccttttgctgaagcagattga

SEQ ID NO: 4802 - DNA, 2358 bp, Glycine max
  Peptide Sequence Number=SeqID_121580
atggagagtagcgaggaagaagaagatttcccttccattgagagcatcattccccaatccaaggttgactctctctatcagtctcagaccgaaaaggggattaggaagctttgctgcgagctcctagatttgaaagatgctgtggagaacttgtgcggcaatatgcactccaagttcttggctttcttgaggatatctgaagaggccgtggaagtaaagcatgaattgattgagctgcaaaagcatatctcagcacaaggtattcttgttcaggatttaatgactggtgtctgccgtgaattggatgagtggaatcagtcaagcaatgatgtttctgaaattcagcaagaacctgaactacctgaactccttgagcccttaccaaatgagagaaatgacaagaaaatattattcttggaaaccattgatgtacttttggctgagcataagtttgaagaaacattagaagcattagaagcattagaagcattagatgctgaagaaaagaattctgcagagttgaaaggctcagggaataactcttcagatgatgtttcctcgtacaagtctgccttgttggaaagaaaggcaatgcttgaagaccagctggttggaattgctgaacaaccttctgttagtttccctgagctgaaaacagccttaaatggtttaacaaaacttggaaaaggtcctctagcacatcaactaatgctgaagttttatcagtctcacctccaaaagagaattgaggctttgcttccctcaagttctctctgtcctgaaacatttccttctacattatctaagattgtgttttctgtaatttcactgacaataaaggaatctgctttgatttttggagataatcctgtttataccaacagaattgttcagtgggcagaatgggaaattgaatattttgtacgagtggtgaaagagaatgcaccctcatctgagactgtttctgccttacgtgctgctagcatcggcattcaggctagtctgaactactgctcaatcttggaatcgcaaggattgaaattatctaaattactgttggtgcttctgcgtccttctattgaagaagttttagaatcaaattttagacgtgctagaagagtagtacttgacatggcagaatctgctgaatgttgcccattgtcaccacagtttgcatcttcactttctgcaattgcaagttcatctaatagcatgcttgttgagagtggaatgcgatttatgcacatagttgaagagatattggaacagctaacgccaatggctagtttgcattttggaggaaatgtactgaatagaatcttacaactatttgataaatacatggatgctcttatcagagcactaccaggtccttctgatgatgacaatcttccagaactgaaagaggtcgtgcttttcagagctgagactgactcagaacaacttgcaatattgggaatagcatttacaatattggatgaactgttaccaaatgctgtgttatcaaggtggatgctgcaaagtgaaagcaaggccaaggaaccaaatagtggagtgacagagaatgtatcattcaatacaaatgctactgtagaattgaaggagtggaggaaacatcttcagcattcttttgacaaacttcgggatcacttctgtcggcaatacattgttactttcatctattcaagagagggaaaaacacggttgaatgcacatatttacttgagtgataacagagatgatctttactgggattctggcccactgccttcgcttccatttcaggcattatttgcaaagctgcagcaattagcaactgtggctggagatgtattacttgggaaagagaaaatacagaaaatgttgctagctaggttaacagagactgttgtcatgtggttgtctgatgaacaagagttctggggtgtattagaggataaatcagctcctctgaagccacttggtttgcagcagttaattcttgatatgcacttcactgttgaaattgcgcgctttgcggggtatccgtctcgacacatccatcagatagcatcagctatcactgcacgtgccatccggaccttctctgctaggggcatagatccacaaagtgcacttcctgaggatgaatggtttgtggaaactgcaaagtcagcaataaacaagctcttgcttggggtatcagggtctgaggcatccgacaccgatgaagatcacatcattgatcatcatgatgaagttgtctcagactctgatactgtttcatccctgtcttctatggaatcaaccgagtcttttgcttccgctagcatggccgaacttgatagcccctctaacttgtctgacccagataattga

SEQ ID NO: 4803 - DNA, 297 bp, Glycine max
  Peptide Sequence Number=SeqID_121581
atggcatacaatgatataaatgcatggcaaaacttaatcgtgagaaacttagaaagaactgcaatactgaggcagaatacagctgggttcttcggcatcccatcgccttcctcaatgcttgcaacatttgtcagtcttagcattttaggttgctgttgttgtttgcaattgaaaacactgcaactgacgtggttgatgctaaatcgacaagtggtaaaagcggaatctgctaccattaagatacctgaactggattttgagattccaccagaggctcagcgtggtagtctgtcaacg

SEQ ID NO: 4804 - DNA, 561 bp, Glycine max
  Peptide Sequence Number=SeqID_121582
atggagtggattgttatgtttaagcaacttgttacgggaagcgttttaggtctggcactgctgagcggcggcgcgcaggcgattgagggcagtgttgacgtgggtgagcacagcaccaacctgaaccttggcctcggcaccgcttcaccgggtctgtttctgaaaggcaactggctgcgcagcgatcacgacggcagcacctacggccttggtatgggttataacctggatgtgggtgatttccgcgtggcgccgacggcgaaagcgctgttcacccatccggaagatggccgtgatggcttcaccgtggcgctgggtgccggtgcgcagtacaacttcaacagcatgtggggcctgtacggcgaatattactatgcgccggaagcgttctccgatcgcctggacagctataaagaagcctcaggcggcctgagctttacgccgatttcgctgctgaacctgcgtgttggctatcagtacattgagctgaacaacaaaggcgaccgcaaagataacgtgctggtcgacggcccgtacgtcggtgcgtcgctgcgcttctga

SEQ ID NO: 4805 - DNA, 168 bp, Glycine max
  Peptide Sequence Number=SeqID_121583
atgtcattgccactagaagaaccttggaagttcgaaattcaattcgataaggatgagcaaagggaggaatcgagtagaatgaggtgcatagtagtgcagtggtgttgggtgaagggcaatgatcgatgcaagttgtccatggcagggaaggaaggtgttgagacataa

SEQ ID NO: 4806 - DNA, 585 bp, Glycine max
  Peptide Sequence Number=SeqID_121584
atgacaaacgccctcgccttcagagggctacacgccctctccttccgtggactacacgtcctcaccatcagacggctacacgccctagcctttagaggactacacgtcctcaccttcagagggctacacgtcctcaccttcagagggctacacgccctcacctatagaggactgcacgggctgcacgtcctcaccttcggagggctgcacgccctcgcctttagaggactacacctcctcacctttagggagctgcatgccctcgccttcagaggactacacatcctcacctacagagggctacatgccctcgccttcagaggactacatgtcctcgccttcagagggctacacgccctcgccttcagaggaatacacttccttgtcttaagagggctgcgcgcccttgcctttagaggactacacgtcctcgccgtcagagggttgcacgccctctccttcaaagggcgacacgtcctcaacttcagagggctgcactccctcacctttagagggatacacgtcctcactttcagtgggctccacatccgcaccttaagagaatttaaggtcctctgcccttaa

SEQ ID NO: 4807 - DNA, 336 bp, Glycine max
  Peptide Sequence Number=SeqID_121585
atgaacttcaaaccctggctctctttcctcctcttggccctggccttggccatggtggctgaggcttctagtgttcatcatgaatatggctttcatggtgctgctgtggtccatgatctcattggagatgacaatgagatgttgcttgattcagagaccaatcgtcgaacgctcgctggccggcaacagtacattagctatggtgccctaaatgccaacaatgtgccatgtggtaaccgtggaagatcctactacaattgccagcagaggggtcgtgccaacccttacaatcgtggttgcacgcaaatcacacattgtgctagagacaccagctag

SEQ ID NO: 4808 - DNA, 861 bp, Glycine max
  Peptide Sequence Number=SeqID_121586
gaaagaacgtgctttacggcgcccttaccgaatgcgtgccaaagctaaagtgatgagtgaaatagaggaggtgcaagagcagatgaaggccaacatggaggccatgaaagagcaaatggccacaatgatggaagccatgatgagtatgaaaaaaattatggaggtcaacatggctacagtcattaccgcaagtactgccactgaggtggacccaactcacccatccggccttaatcaaataaatcatacaaccatagatatggtaggtcagggaggcaaagcgttgagaagtgaggatggcccccattttgtgcaagttcagaacaagcattccttcccaccatatggcttgcctcccaactatacaccacccaatgttgcatacattccggatgagaatgtcgataactctgcttccatacccatcgagacccaacaacctcagtttgatcatgcacatgtctctcaacccatgggggagatacatgaatatcacccacaaccacaacccttgcatcttgtgttggaacgactgcctcttgccatggtggaaagggagaaatttgatcatataaaggaaaggctgagggctgttgaaggaggcggagattatgcctttgctgacatggcagaattgtgcctagttcccgacatcgttatccctttgaagttcaaggtgccggatttcgataaatacaaggggactacttgccccacgaatcacctgaagattcgtcactttggtatactaatttggaaccttcctgagtccattcttggaaaggacctaatggttgccttcattaggcagtatcagtacaattctaatatggctccagatagaatgcaactacagaacag

SEQ ID NO: 4809 - DNA, 1623 bp, Glycine max
  Peptide Sequence Number=SeqID_121587
atggcttctatcaaacaaggtgatcaaagcattatcaattacttcacaaaattgagaattatttgggatgaattggaaagttacaggcctgatccaacatgttcatgtgatccaaagtgtatatgtgatgctcttactagtatgatagaaagaaagcaacaagatcgtataatgcaattttcaaacatatccaaggttttctcatatgttgttcagcaggaaagacaaatcaatagcaatgaattaataggaagcattagtctgatcaatgcagcaggcaacaattcatcaaattctaggccttcatatacctattgtggaaaagataatcacattattgatagatgctataggaagaatggtccacctcaaaatgatccttcaaaaaggggaaaaggaaactttggagcaaaaggaaacaaggtctgcacaaattgtggtctttctaaccatactatagatgactgctacaagaaacatgggtacccaccaggacacaaattttacaaggtacaaaatccaaacatcaacaatgtcaatactagaagggaagaaggtgatggttcaccctcagatcgaaatcaagagacacaaaataaagatgtaagattaactactcaacaatataaagccttgatgtcattgctgcaacagcaagctccagctcaaagcaattcacaaataaatcagattggtacagtcactaacaaaggtagtatattacttgttacttgtagtgttagcaagactagccaagatgaatggatccttgattatggagccacagatcatgatatgaaccagcagaagattagtacagttgagatggtggaaggactctacagactcaagatgattcctatcaagtctaagtacaagtctgattttgttggttctagcatttccaatttttttgccttttcatataagcaatttgtgtgtgaaacttgtcatcattcaaagcaaaaaagattatcctttcctagtagtgaatcacattcttcttgtgcttttgctcttatacatgttgatatctgggatccttgcaattcaaaagctaagacacaatctcatctaaaaaattttgttgccaatgttgaaaggcagtttgagacaaaagtaaaagtgattaggaatgtgatcttttatgaggattgttttcctttcattggtcaagacaaacctgatgctatcactatccttcctattccttcttctcatgccattgatcaacctaatggtgtctcatcagaattaccagttgatcatatcatgcatgtaccaaataatgttgattctgatcccttaaccttagagcaatcccctaatacaaccagaagatctctgagacagacacacagactaagtaagtataaggacttccatgtttcatacctattttcaactatagctagttattctacagcttctaaggatcctatttgggtagaggcaatgaatgtagagattaaggctttagaacttaatgatacttggattttaactgatatgcctcaacataagaatgttattggttgtaagagggtgtataagatcaagtacaaatcagatgggtcagtggagagacataaggccaggttagtggccaagggctacacttaa

SEQ ID NO: 4810 - DNA, 753 bp, Glycine max
  Peptide Sequence Number=SeqID_121588
atgcctgcatctcttgttggcaccttcccctcactcggaaagacaacaaaaagggtcaagattccttacccattcttctactctttctttgacagctcgcccaacccaacactgcttttcttttgccatcccataggaggaagaagaaccggaacctggggacgcggcggcggtggtggtggtggggaagaggggcaaaagacgaggcttttcgtcgcgaggagtggacgcgggagaagggtgcaagaagaaccctttctccttgatggctttctcttcagtagcttcggctgtgtccataaccataccggcgccgttttcgttgagggaacgggaacggttgaaggggtcgggtatgaggggcgtgacggggctgagaacgagcgcggggaagtcgaggatgctgggagagagaacctcgtggtgtttcctcggcgagaaagacgaaacgacgacgttgttgagagggttgatgctgagattcttgctgagcgagttcagaggccgaggctgaggcttgttttgcggaggtggtgtcggcttggacaaaggttgtcgggtacgggttggcggattcggatctggtcacgggcttcggagggtacgatgatgtcggagattgagcagccgccgcggtcggagtcagagaactcaaactgtggcgtggcgaaggaacaagactcacgccgccgcggtggtggtggtgctcttggtggtacctcggagagtccatggttgacggggagatattaa

SEQ ID NO: 4811 - DNA, 186 bp, Glycine max
  Peptide Sequence Number=SeqID_121589
atgcagtcggataaaaattccaaggaaaataggaacgtgttgagcaacattaagacgaagaaacacaatgtgcagtgttggaaggaggcacttcatgaggctgttggcatagaggttgttctcctaaactctctcatttctacgatattcacgggttcaagtcaaactgtgatccaatccaattaa

SEQ ID NO: 4812 - DNA, 162 bp, Glycine max
  Peptide Sequence Number=SeqID_121590
atggaatttgatccttcagatgaagaagaaggacgaggaggagaggtagggattaggaaagtgaatgataatagcattaacattttgacatataaaaacaaattcggaccttctcctctgcaagaccttaacttggaaggatcaatcaagacatctgtctaa

SEQ ID NO: 4813 - DNA, 714 bp, Glycine max
  Peptide Sequence Number=SeqID_121591
atggcgctgcaccggttactgaagaggaaaggaggcgtcgatgaacttaacgacgatttccctctcgcttctccggcaaccaagattcgccgtctcgttagtacttcctctctctattcttcgccatcaacaaccaaccaaacttgtttgtcattatttactaatcgattccgtttgttaccgtttcaggacgctgagttgccgccaattttggaagaggacgaaccgttacctaacgaggagagagctctcgttctcttcaagcctctcgtccattccccttcctctttctctctcactctcgattctgaccttatgaaaggaattaggaacaatcaatatctgtggtccaaacaatgtgagcgcgtgacagagttagaatcacgtgaggaggaaaatgatgatgaattggctcttgtgccttgggtaccttcaccttcttaccagttctccgctgttgatgattctctcaacacaaatgtcgagttgatggaagctgatgaaatgggagaaggagaaggtgtgggatccatgatgatggatattgaacaagaagatgacactgacactgacactgacactgacgctaaaacttcaacatcaagcattcactacccaacgacacacgatggaataacagaggggttccagcaacactgcttgttaccaaagcttcctcacaacacctcaactcccattacatggacccgctga

SEQ ID NO: 4814 - DNA, 1317 bp, Glycine max
  Peptide Sequence Number=SeqID_121592
atgtcgtcgtcgtccatgaagaagaattgggttcgcggagagtctcttggtagtggcagcgccgccaccgtcaacatagtcataccaacaaacccttccacgcacaattttccttcacccaccgccgtcaaatcctcccttttcctaacctcgtattcgctcaaaaccgagaaggacgtcctcgacattcttggaccttccccaaacatcattaaatgttacggcaacgattgcactgtcgaaaacggcaagagatactacaacgtttttctcgaatacgccgcgggcggttccctcgccgatcaactcaaaaagtacggcgggaggttcccggaggcttgcgttcgacaatgcacaaaatccatcttggagggtctgaagcacattcactccaagggctacgtccactgcgatgtgaagcctcagaacattcttgtcttcgacaatggtgttgttaagatcgcggatttggggctggccaagaggagaggggagataaatagagagtacgtgtgcaggggcacgccgatgtatatgtcaccggaatcgctgaccgataacgtgtacgagtcgccggtagatatatgggctttgggctgcaccatcgtggagatgatcacaggagaacacgcgtggtacgttggaagctgcgagaatacttggacgttgatgaatcgaattgggataggagaagaattgcccaagattccacaagagttatcacaacaagggaaggattttcttggcaagtgtcttgttaaggatccaaacaagaggtggactgctcacatgcttttgaatcaccctttcatcaagaacccattgccccagccgttaccaagaaaaactgatagacctgcatgcatgccaaaagggataccttgcactcatcaggctaaaatgggagaaggaaaagattttcttgacaagtgtcccggtaaggatccaaagaaggggttgactgctgagatgcctttgaaccaccctttcgtcaggaagccattgccgcccacgttaccaagccatgttgttgctacccttcttcatggttctttgaccaggttgtgtgagacaaagtggtggaacaacctatgccaacatgggacaagaagaaaaaccaagcagatcaagagttcttgtgttgtgtttcatgacatggagggtgtgcaactatcttccataattggaaaggacagcaacattaatcatccaaggattttcagctacgctgagctctacataggatcaaggggtttctctgaggaggaggttctaggaagtggagggtttggcaaagtgtacagagctgttaattaa

SEQ ID NO: 4815 - DNA, 1014 bp, Glycine max
  Peptide Sequence Number=SeqID_121593
atgcctctctttgataacaatctctgggatggagctaatgcatttggtgctccaatagaaggtgacttgctgacaacaggagcccctctaagcagcccaccattgattgacttgatcagtaacgatcctatactttgtggagtgaagcttatagctgaagcctgggatgctggtggcctctatcaagttggcactttccctcactggggtatttggtcagaatggaatgggaagtatagagacacggtgcgccagtttatcaagggtacagatggctttgctggagcttttgctgaatgcctttgtgggagtcctaatttatatcagggttatcttccgtctcatggaggaggaagaaaaccatggcatagtattaactttatatgtgctcatgatgggttcactctagctgatttggtgacctataacaacaagaataatttgtcaaatggagaagacaataatgatggagaaaatcataataatagctggaactgcggacaggttatagaattttggctggttgggtacctagcggttagccagatctttggtttgctgattcaggagggggagtttgtcagtacctcagtgaagaaattgaggaaaccacaaatgcgaaatttttttctttctctcatggtttcccagcttaattacttccgatgggacaaaaaggaagaatcctcatcagacttcttcagattttgtcgccttatgactaagttccaccgagttaccttgccggattgtcctggatacagatgggagcctcttgtagacaccagcaagccttcaccatatgattttctcactcctgacctccctggaagagatattgcaatacaacagtatgctcagtttctggacgccaatatgtatcccatgcttagttattcttccattatcctcttgcgcattccagatgaaaatcctgcttccttgttattatcagctatatatataatcctgttcctagtatgctggaaaagaaatcgtttgatcagtaaataa

SEQ ID NO: 4816 - DNA, 384 bp, Glycine max
  Peptide Sequence Number=SeqID_121594
atggacggaggtagaggcacatgcccaagatttgcaatggttgaaggtgcaggagtagtggttggaggaggcgaaagtggttggacagagggaggcaacctctgttgtattagcatgtttatgttaaagagcacaaagtcgttgaaggacttgagtgagaactctagtgtgttcttgatcggtagattgatttccatgcttttagcaaggaacctttctttcatagttttttcccaggttggcttgttgaaaatgcaacaattcttgtattctctcttcggatacacccgtaggagcaaagacagtcaagagagttatctcacgaagagtgttgaaagtattgactgtggccaaggcatcttcaatgatgggttgaggttgtga

SEQ ID NO: 4817 - DNA, 369 bp, Glycine max
  Peptide Sequence Number=SeqID_121595
atgctgcaaaacgaattcaattggagcttgacatggctctatttggataaacttcttcataaacacttatcgaaaaagaaaataataaggagaacctttcagaccactactacttcaatgggcccaacctctactcatgcaacctccagtgcaggaactttgactgtggagagtgtgcagcaactggtactatctgctctttctgccttggcattcgagttccctgaacatttgaacaatgttcgcacttacaatgacaccaaaatattcaaattgttgatggcattagggaaagtgatagcgagggagcctaaagtgggcagactattgcctcttcagttttctctaccaagtcttttttgcttgtag

SEQ ID NO: 4818 - DNA, 204 bp, Glycine max
  Peptide Sequence Number=SeqID_121596
atggggacaatttctagttcttgctattcgtggttttctggttttgatcccgattcttgtttgttgtttggcaaaaactatggagccttgaagtttcaattcaagatgtttgtgaaaggaaaaggcttgtggggccatctagatgggacttcaactgctccagcagacaatacactagaggcatggcagatcaaggatgcctag

SEQ ID NO: 4819 - DNA, 435 bp, Glycine max
  Peptide Sequence Number=SeqID_121597
atgcagaccaaagattataagcttgtttaccgaccaaaggttctagaatacaacgagagtggggaaccaaaagcaaccagaatattgttggcactttcagggttgaagcaagctttgatgaataaccctggatataacaagcgagttgcagagtgtcgagaggctgcacaaattcttcttgaagctgttgccaaatgccaaactttacacttacaaaagggtgtcaataaactgagcaagaggatggaagtgatgaggctgagccttgacgcaatggtaaggttgctgccttgtgacctaaaagtcacgagttcaaatcctagaacagtctttctgtttgtgggggcaaggctgcatacatttaccttacccaaaccccactacgttggagcattgtgtactgggtcgcttagtttattaaaggatgcatggtag

SEQ ID NO: 4820 - DNA, 1056 bp, Glycine max
  Peptide Sequence Number=SeqID_121598
atgggtccaatgttgatgatggagtggaatggaatccagaatctcatgtgggagaggaagtatccagtggcaatgatgttaacaaattccatggttgtgaaatatgtggtagcccaagtaccacaagatgttcacgatgcaaagccgtcaaatactgtgaagtgcttgattatggactggaaatggcataaagatcactgcattgcaagagacgtggattcagctccaatagaaagatctcgtagagatgttggatttctaaagaattcttatgaagaggaagagagtattcgttcatcttgtcccctttctttggagtttcatccggaagaaagcacaagcttcaagtctccaattgaagtatcacaggatcctaccaacaaagtgttatatcttgaggacgaagtagccaagtctaggaatgagattttattactacagtcagaacttgacgagtggaagaatcgagcgaatttcgcaagagaaaaattccgaagcctcaagagagaatcaaattaccagttgcttgtgttgaagaatgaaaaggaatcaatagcagaggctgaaactagagctcgcaatgtgattcacagtttacataaaaagctaaaccacttgcagaatgtagtgcaagaaagcattgcagagaagagaaagctagaagaagatatacaaagtttagagagtgaatgtgctgacctgaagaaacaactgcaagaagagcataaatatgctcaacgccttacaatggaatctgacaagagtcgtgaggctgcaaaaatagctatgagagaagttgaagcagttagacaagagttacaagaagagcgagaacatgctcaacgacttaaggagaattttcatagagatgttatattttctgaatccagagctacctttgctgaggcaaaactcagtgatctttataggaaaatcagaatgtcagattataaggagtataaggtgattgtcaactgtcataaccaaaatggggatcttgaatacctatgcatcttatgccttggagtccaaggaactcgggaatccaaggtgtaa

SEQ ID NO: 4821 - DNA, 600 bp, Glycine max
  Peptide Sequence Number=SeqID_121599
atggtggacctaaattggctttttgttttacttggtttgggagaaaagggagcacccatttctgataacaccaaagcttggcatcagatattgttgctgacaattgtgattggaatctggtggctattgtgtcattttgcagatgatagagaagtcaatcccaatatcaacgaggttgatgacgagctgggggagatggagcaccccaatgatgaactagaccatttttttgatgaggatgatcaccgggcagccgtcgtggtcggtgatgaagctcgtgggagacacggtggttgttccatctgtggggattttagcaccacaaggtgtgctcgctgcaaggctgctagatactgctcagggaaatgccaaattatacattggaggttggggcataaatatgaatgttctgaatcagggactgcagcagatgaagcgagaccaactcatgatcatggaacctccaagcttgtcgagaagtcggaaatgggtctagcaaatgaaaacaaaggaatgaaaggggaaaacaacgatagattaacaaccaaaatatggggatcctacaaaaagaaatggtggattataaaaaggatgaattag

SEQ ID NO: 4822 - DNA, 1533 bp, Glycine max
  Peptide Sequence Number=SeqID_121600
atgaccccaaagaagagcgaaactattaggattcttgttatcaacaacattgaggaagcaaagaaggtatttctagaagactggttcattcctgggaagtgggtgaactttcagagtctaatggaaaagggttttgctatcaaagatagaaaaggaaaaggcggagaaggaacaaaaatgcaagatggagttagcattcaaggaaccatcaatggaaaaaagtactgcgaacctcacatatatgtgaagacttatccacaaccttctattcaacatagtgattcccaaattgggatcaagagactatcattcaaggacaaattccatgcaaaggacaagaagaatcttattccttatgggatgtttttcactcaaatcataaggaatcgtggtatggatgtctctgtgttagaaccatctgtaggtgtcgtacagctaaaaagtgcaatctttgttaagatggggatagttgacaatttcccaaaatatactaagaagcatgccaaaagaaatgtcaagaaagagcttaaggaggaatcacagtctgtggcaagacagatggaaggggatgttatagaagaagaagttggcatcattgcctctgtggaagctctatctatggaagagcataagaaaaagttggttgaagatgcaaggttgggtgccttggcaggaatggtttctgaagaaattctaaaagatgttattctggagtctctaaagaccttgtttgttgaggaatctgttatagaagcttctctaaatgaatctgaggataacaacattgagatagacattggtattgcacttgtcagacctagaccagtgtctaaagctaacaaaagggcagtccctgcctctaccatcaccttcaagagtgttcctgttgagcatgatgtcaatattagatactaccctggctttagaggacatatagtgcgggagtggcaaacttgcaataaagaaggttttccaagtactgatgctttcttttatccatcttatgataccttgcctaaagaagaagagtatgcctttggcacctacagcaatagggaactagtaatcaagaagttccctccaagacaaactactgctccaaaccctaccagtctaatctttgagcatcgacctcaaaacaaaaaggctacatctaatgaaatttctttctctactcccttggatctacaacaatttatgggacttctatgtaccttcaatgttgttcttccatgggattgcaccaagtctagagagacttttcagatggaggatattcagttggaggcacctgaagaaagtctgaattttcaagattgggaacacccagactatggccttgagttaagaatggatatatttgcctatagagaggagatcatatcaaggaaagcttcttttcgaagaattcaaaggcacaacacttactttctaggccttattcatctgtcatctgattttgacgattttggtgatgagtttcttaggaagcttgatgaagaagttgctaaacaaaagggggaggaaaagtaa

SEQ ID NO: 4823 - DNA, 354 bp, Glycine max
  Peptide Sequence Number=SeqID_121601
atgggtactccgaaacatttttcgttctgtcgtttccttttctacggctctatattttcctctgaaccttttcttacttgctttcctaaagcttccttccaagcccttggttgtgaaccactgattcaactgtatgagatccttttgagggctcccggtgtattgggagcgcgcttcagtggtgctgggtttagagggtgttgccttgcatttgtggaggctgaccttgcaactgaagctgcatcatttgtcaggagtgaatatctcaaggtacagccagagttagcaagccaaataagcaaagacactgcagttttgatatgtgaatctggtgattgtgcacgtgtaatttaa

SEQ ID NO: 4824 - DNA, 1464 bp, Glycine max
  Peptide Sequence Number=SeqID_121602
atgggttccaatcccttgtctgcattgacttcaacaaagcccacaccaatcccaacccaagaccacgacgaccaagactctccttcatcaaaatgtcttctttccttcaacaccgactcttgttcttcaaccccatcttcctcttcccacaaagccctcttcatcactctcatcctcatcacctctattgccttatcaacatccttcgccttcgcctttctctacttctcttcaaaaccaccaccttctcctctcctcgtggctcgtcctctgtccaaactcaaacgccccgtcgtcctcttagtctcctccgacggcttccgattcggttaccaattcaaaaccccaacaccccacatttcccgtttgatcgctaacggaaccgaagccgaagccggtttgattcccgtttttccctctctcactttccccaaccactactccatcgccactggcctctaccctgcttaccacggcatcattaataaccacttcaccgatccactctctggggaacccttttacatgggtaacagccatgaccccaagtggtggctcggggaacccttgtgggaaactgtggtaaaaaacggcttaaaggctgcaacttatttctggcctggttctgaggtaaataagggtccttggtcttgtcctttcaattattgcaggcactataattcttctgttgcgtttgaggatagggttgatgcggttttggggtactttgatttgcctagtgatcagattcctgatttcatgactctttactttgaggaccctgatcatcagggtcataaggttggtgctgatgatcctcagatcactgaggctgttgctaggattgatagaatgatggggaggttgattaggggtttggaggaaagaggggtttttgaggatgttagtgttattatggttggtgatcatggaatggttggtacttgtgataagaagttgatcttccttgatgatttggctccttggattgatgttcctaaagattgggttgtgacgcatactcctgtgcttgcaattcgtccaccttctggtaatgatccggctgatgttgtcgctaagatgaatgaagggttgagctcggggaaggttgacaatgggaagtttttgagggtgtatttgaaggaggatctgcctagtcggcttcattatgccgcgagtgatcggattgcgccgataattgggttgattgaggaaggtttcaaggttgagcagaagagaaccaagcgccaagagtgtggcggttcgcacggttatgacaatgcggttttctccatgaggactatttttattggacatggtcctcgatttgctagagggaggaagataccgtcgtttgagaatgttgagatttataatttgattacttctattctcaagataaagggagcacctaataatggctctgcctcatttgctgagtccgttctactatctgctgcataa

SEQ ID NO: 4825 - DNA, 867 bp, Glycine max
  Peptide Sequence Number=SeqID_121603
atgggagagtttgaagggcagattgtacacacttgcaagtataagagtggaaacaagttttgtgggaagaatgttttggtggttggttgtgggaattcaggcatggaggtttgtttggatctctgcaaccacaatgctcgcccttccctagtggttcgagatacggtgcatatcttgccacaacagatgctagggaaatcaacttttggtttatccatgttcttgctcaagtggttccctatacgttttgtggatcaatttttgcttctaatgtcacatctcatgcttggagacacagatcaatttggacttcgccgtccaaaacttggtcctctagagctcaagaacttgtacggaaagacaccagttttggatgttgggacactcactcagatcaaaaatggaaaaattaaggtttgccggggaattaaacgactagcacgcaatgcggtggagtttgttgatggaaaagtagagaactttgatgccatcattctagcaactggttacaaaagcaatgtaccctcttggttaaaggagagattccagcaaaagctggacaacactggcttgtttactctcatcattgatggtattaataatggaatatatgttataattggcatattgattgggctagaaatttactatgagcagggcagtgacatgtttagtgagaaagatgggtttccccggaagccattcccaaatggatggaaaggtgaaaatggactctatgcggtgggtttcaccaaacgtggcctgcttggtgcatctattgatgcaaagaggattgctgaagatattgaacatagctggaaagctgaggccacgcatgttttggagttcccttgtccacttgcgtga

SEQ ID NO: 4826 - DNA, 201 bp, Glycine max
  Peptide Sequence Number=SeqID_121604
atggcagatatacagttctatgacgaagatcttggtcagaccttgatatctaattgtggaacaagatgttggggtgcacctgcaagcattatgatgcctaagttagtgtttgagagaaaagagtggaatgagaataagattagagttgagttcatatacccaggctgcaagctaaggttggaacttactcactgcttatga

SEQ ID NO: 4827 - DNA, 426 bp, Glycine max
  Peptide Sequence Number=SeqID_121605
atggaggaagtgctgaaacgacacggctgggagttagcagcaccgtcgtgtttggcgctggacgcggaagaaagatgcgacagaggggctgtggagtgcaagcgggaaagtaccgaatggtcctcgatgttcgatgttcgatgtattggaaaaggagggttcaaattcgaacgcaaggaaaggatggccaagtgccatgcacaatcctgtactggctttacaacatttgatgagaaaaccaaacaccgatttgttgcgcttgttggatttaagactgacattaagctggagagaggttgcctaaacgatgagcagttccagcggattccatttgtaggcattgctcacagcaactgtcaagggacaccagtggagcctgcacaatgttatttcaaggattctagaaggggaaaaatgcatgcatga

SEQ ID NO: 4828 - DNA, 1683 bp, Glycine max
  Peptide Sequence Number=SeqID_121606
atgaggtttacgtcacctgcacttctcagccttctcattctctgccatctgcttctctctcttccctcttttactttctctctcctcgccgatgacgccgacccggagacggagcttctcctcgccggagacaatgcaaccgccttccttaatgcctcgcttgcgagatacgacgatggtagcttcgccaacatgattgatcgggctctcgaaagagagttccccgataatgagcagaacgaaggtactgatcctggtggtttcaacaacagtgttgctgaacagcaggctgttttggaaactgttgccagagttaagcccaagaaaaatgatagcaaagaggaaaagtcatttcagttccatgatgttttcaatttggataatgagaatagggcagaggatatgccaactttaatagatcgaaaggacaatgtctttatcatttccaatctcaagtcaaagtatccagttcttcaattagacttgagattgatatcagatctcgtagttgtcattgtctctgcaacctgtggtggcattgcctttgcttgtgctggacaaccggtgatgactggatatctgctagcaggatcaatcattggacctggaggtttgagttttgttagtgaaatggtccaagttgagacagttgctcaatttggtgtcatctttttgctctttgcattgggcttagagttttcaacaacaaagcttcgagttgttcgggcagtggctattcttggaggcctactccaaattttcttatttatgtgcttgtgtggaataacagcttcattatgtggtggtaaatcatctgaaggaatatttgttggtgcatttctatccatgtcttcaacagctgtggtcttgaaattcttaatggaaaggaatagtgtcaatgcccttcatggtcaggttataattggaaccctgatactgcaggattgtgctgttggattgctctttgcactgattcctgttttgggtggaacatcaggtgttcttcagggagtagtatccatgactaagtcgttggtgatcttaattgcctttttggccattttgacaatattatctcatacttgtgtgccatggctccttaagcttatgatcagcttatcctctcagaccaatgaactttatcaattggcatcagtggcattctgcctacttgttgcttggtgtagcgataagctgggtttaagccttgaactaggttcctttgctgcgggagtgatgatatcaacaacagatcttggtcaacatacacttgaacaagtcgagccaattcgcaacttttttgctgctctgttcttggccagcattgggatgcttatacatgtccatttcctttggaatcatgttgacattttactggcagctgttatattggtgatcattataaaaacaattgtagctacatctgttgtcaaggggtttggatacaataacaagacttcagtactcggaaagttgtatttattgctccttggaacaacagctcttagtctggtgactacacctttgctcttcaagctaattcctgctgttgtgcatcttggggtattgttgcggtggttcccgcctgatagtgcggcagagattgcatttaaaggggacagctttcgagcggacagtgctaagcgtattcctttaatggttcaaggctctcatgattcatga

SEQ ID NO: 4829 - DNA, 1608 bp, Glycine max
  Peptide Sequence Number=SeqID_121607
atggaagagaattctgctctggaacaccattgttactaccctcttcctgcttctgctgcaaaagctgatcatcccaatcataatgatggtgaaaaagaagaaacttgtgcagaggaaggtagctctcaacatcagcctaacacatcacagaattgtgtttcataccaaagcaataagcctcgcctcaacagatatgcacttggtggtgctatcttggcttccacaaactccatcctcttaggctatgatattggggtcatgagtggtgcttctcttttaataaggcaagatctaaagatcacatcagtccaagtagaaatccttgttgggtgcttaaatgtgtgttccctgataggatctcttgcttcaggcaagacctctgattggattgggagaaggtacaccataatggttgctgcagcaacattcctgattggtgctattctgatgggtttggccccttcattcccattcctaatggcaggtcgtgtagttgcaggcattggtgttggttactccctcatgatctcaccagtgtatgtggctgagctctctcctgctctcaccagaggctttctcacatcactccctgaagtcttcatcagtgttggaattctacttggttatgtctccaactatgccttctcaggtctcccaaatggcatcaactggagactcatgcttggccttgcagccttgccatcaattgcagtggcacttggtgtgttggcaatgcccgagtcgcctcgttggcttgtagtgaaaggaaggtttgaggaagcaaagcaggttttgattagaacatcagagaacaaaggagaagctgaattgaggcttgctgagatacaagaagctgctgctgcttctgcttccatcacaaacatggacaaagcaacaacttctgatggttcttttaatggacaaggggtttggaaggagttgcttgttacacctactagccctgtgttgagaattcttgtggttgctattggtgttaacttcttcatgcaggcttctgggaatgatgctgtcatgtattatagcccagaagtgtttaaggaggctgggattaaggatgagaagcagctttttggtgttacaatcatcatgggaatagccaagacttgctttgttttgatatcagccttgttcttggacccggttgggaggaggcccatgttgttgttgggctcatgtggcatggcaatctcattgtttgtgctgggcttgggctgtaccttgcttaagttatctggtgataacaaggatgaatgggtcattgctttgtgtgtggttgctgtctgtgctacagtatcattcttttctattgggcttgggcctacaacttgggtctactcttcagagattttccctttgaggctaagggcccaaggttccagcttggccatttctgtgaaccgtttgatgagtgggattgtgtccatgacattccttagtgtttcagaggcaataacatttggaggcatgttctttgtgctttgtggggtgatggtgtgtgccacacttttcttttatttctttttaccagagaccaaaggcaaaagcttagaagagattgaagctttgtttgaagatcaagcacattga

SEQ ID NO: 4830 - DNA, 267 bp, Glycine max
  Peptide Sequence Number=SeqID_121608
atgcatctacgtgatcaagggaagatccaacagaggattcagctttccacaccaggaagccttcttaacaacaaagagaagaacaagaagaaagattgcaaaaatacaagtggtgaggatgtctccttcacctctaggatctcacaatcactcacagactcatctcaatctcttaaaccggctcctgcttcaagctttggtctctacagatcttcacacagcaaaatttctcaaaactctctagaacttggacccttctctctctag

SEQ ID NO: 4831 - DNA, 340 bp, Glycine max
  Peptide Sequence Number=SeqID_121609
gtgggcaactggggatggtgtgcttatgcctgggcttgtggaaatgggatgtttgctttgcgccatcgcccgatcgccacctagtaccacatatgacggagtggtacctcaggatatgtcgcgggggtcaggagaccttggggacgtcaggtggggtgctattgcccaaaaccaagcttggccaatctcgacccaacccgggcatagtaagccagtgagaacctgtgacgtacctaagcaggcaagctcctggcagtcaaccaataaaggaacaaaagtccacgaagcaaggaggcttgtgtggcggctggctagctatctatcttgggttgttatctga

SEQ ID NO: 4832 - DNA, 430 bp, Glycine max
  Peptide Sequence Number=SeqID_121610
gacgacagaaggtgcaggagacgatgttagtctctgcgcgtcaacgagctcgttttccccctggttgacgaaaggtgcgggtaatcataaggtcaggacgatagaaggtgcaggagacgatgttagtctctgcgcgtcaacgggatcgtttgccccctggttgacgaaaggtgcgggtaaccataagcgaaagaatgtttatgcggataaccacttgggtatctccgcctgccccctaacttcacgggttagtattgacagaaattgtctgtgcggagaattacctatgtatctctgcctgcctcctaactacacggagaaattacttgtgtatctccgcatgtcacctgtcttcacgggtcagtatgacagacagcagggaagacaacgtaaatctccgcgtgtcaacgggctcgttggctgcgattga

SEQ ID NO: 4833 - DNA, 201 bp, Glycine max
  Peptide Sequence Number=SeqID_121611
atgacagacattgtctgtgcggagaattacttgtgtatctccgcacgtcacctagcttcacgggtcagtatgacagacaccgcggaagacgacgtaaatctccgcgtgttaacgggctcgttggccgcgattgacaaagggtgcagaagagaagacgacgttagtctctgcatgctatcgtgctttgagtcttacggatag

SEQ ID NO: 4834 - DNA, 129 bp, Glycine max
  Peptide Sequence Number=SeqID_121612
atgggggagctgatcaacattccaataaggaagccaatgcagagcatgaggaacattagggacatacttctgcttaattcactcatagattcgtgttttatgcccaaacatagggtgggaaaaggatga

SEQ ID NO: 4835 - DNA, 186 bp, Glycine max
  Peptide Sequence Number=SeqID_121613
atggatccaatggatagtgaatgtttatcggttgtgtcatatgacgtggttccttgcatagataggtcagaatacttggctttggaaagaagaggaggcaaggcatttcttcctccccaagttgttgaggatatcctagaggaacagatggtgtggcattctacccatagtgatagttacatgtaa

SEQ ID NO: 4836 - DNA, 426 bp, Glycine max
  Peptide Sequence Number=SeqID_121614
atggagaacatgcctttggttaccaactcagagataagagacaatatgccaaagtgtggaggtgatcatacagactggaacaagggagaagaagaggggctatggtccatatttcaatcattggagaaatggaacccgaaacttgtccctgagggaacttggaaggaagggggacatgatgttattatcatcaacatttactctccttgtgacttggaagcaaagaagaggcaatgggaagctttgaaaagtgtaagggcaactagtagggagtctttatggtttatcattggagattacaattgcattaggaggtcttgtgagagacaaggggagagcttagtagactatggtagtggtgaaaggatggaacttgacaaatttatagttgacatggagttaaaagacatttcattggtgggttga

SEQ ID NO: 4837 - DNA, 946 bp, Glycine max
  Peptide Sequence Number=SeqID_121615
atgtttggtggtaaatgtgagaaaatggtagcagtcacccctcaaacagcgtctaacaaatggacacagacacaacagatagatgatcacaaggcccctatgggaagaatcatggaaaaaccaagccaagatcttcttcagcagcagcaacaagccctaaagtgccctcgctgcgactcttcaaacaccaagttctgctactataacaactatagtttgtcacagcctaggcatttttgcaaagcttgcaagcgttactggacaagaggtggcactctcagaaacgttcctgttggtggtggctgcagaaaaaacaagcgtatgaagcgtccaacaaacggtgattcttcttctgctaactctccttcttcgtccactcctagcgccagttcaaaccctccttcgcagccccacatcgataatattattgtttctggctccgccacaaaccatataaataatatcaaccctttgttttatggtggtgatgtgatgaataatgttcctttcccaaagtttaatcttcttcagtctcagctgaatgctcttgggttaggtttttcatctggggttagagagaatgggtttagcactacttcaaataacaactttttttctgcttataactctatctttggttcttcttcttcctcaacttgtgcaccctcaactcctgttatggcttccttgctgagttccactcttctgcaacaaaattttatgggtggtggtggtggtggggtgaagggtcgtgatcatgatcaaggtgacaatactttccatggcttggcaccgctacaagggttgcgagtggaaggggatagtaataataatattggctcaaaagaagtgaaaggtgaaggacaaaacaggtttgagtggagcaataataataacaacaacaacaacaatggtggtggtggtcaaaaccagatggagcatgtgg

SEQ ID NO: 4838 - DNA, 309 bp, Glycine max
  Peptide Sequence Number=SeqID_121616
atgaagagcagaaaagaaacaatagaaattgaaattgcattaatagataagaagaacagttatattacaagggcattggctgctaggctcccaacagaggggggtttagcctctcatagccatgagagactttatacttcaaaggctaatagaagaaagggatggatgactagtagcactaggaagcttaattttcatgctaacttcgtgcttagcgtcggcttttgcactaagcgcgcctttgggcttcattatgagcttttccgcgcgctaagcttgagctgtgcgctaagtgcgggcacgcgctaa

SEQ ID NO: 4839 - DNA, 474 bp, Glycine max
  Peptide Sequence Number=SeqID_121617
atgccttttccttctgataaggattttcaagggaaaggagtgttggagttctcttcagcttcaaattcattttcagtgcttttgcataatccacaaccaaagtggaccatagacaaagaggactattgttatggtcaagatcaatccattctgagactaatcataggagatgttgaggacccttatgtagggttgaacaagctcttttggggtagctctcaacaaagtgtcgatttcaatgcagggtttggtgttgtggatcaagggttgaatatgataagtgttgttgacccttcagggaacaatacttaccctggtttccctttcattactgagaatataggtggccgcaatgttaaggctggtttcttgtctattggagaatcaatgttttttgtttctggtaacagtcctttgttgttttcaacatctcttggtgggtttaattctcagcagcaacatcaagtggtttga

SEQ ID NO: 4840 - DNA, 962 bp, Glycine max
  Peptide Sequence Number=SeqID_121618
atggaacaagaaggagaaaaagggagagaggagagaagacaagttcaacgtgcagcaacacaacaacctcctcagcagcatcagaaatgtccacgctgcggttccatgaacaccaagttctgctatttcaacaactatagcctctcgcagcctcgtcacttctgcaaaacgtgtaaaaggtactggacacacggtggaaccttcaggaacatacccgttggtggcggttcccgcaaagtgaagcgtggcaaaacaaattcttcatctttttcttcttcttcttcttcatcttccaatttgctcacacagccacagcagaatctgttgatgaggccttcaccaccccttatcactactatggttcagtctactagcccttactatcatcttgctggtggaagtgggtatttgtcttctcttgcaacacttcattctctgaacaacaacacatcacagcctttcaatcagtacctgaaagttggtggtgattttgctggttcttctaattctcctcttgtgtctggcttcaacgctgcttattcgcttccaccgcgattcccccagcaacaatctatgtatcctgcacaacaacaacaacaacagcaacaacgtttgattccatcaaatatggctagcagcggtgctgtttctcattcggctcttcgcacgcaaagcttgatcaacaatgtttcaacaagtacaaaccatagggctagtatttctgatgcttctttgtggagtgctgctactgtcaacaccacttccatcggtggaaactctgatcagaacaatgtcgtcaaaggaggttcttcttctttggtcccaagtcattggcttcatcgccctggtttattgatggaagaggattttgagggcgagcctggtgcagcggtaaagttgtgccttggtgacttgttggtcatgggttcgaatctggaaacagcctatttgcatatgcaagg

SEQ ID NO: 4841 - DNA, 828 bp, Glycine max
  Peptide Sequence Number=SeqID_121619
atgccggagtgcgctgtcatctcagcttcacgagcacacgagacctacgctttggtcttaaaagtgaaggctccaccaccaccacctccttcgcggaacagcgcggtgctgtcccagcgtgcgccaatagatctggtgacggtgctggacataggtggaaacatgactggcgggaatcttcacatgctgaagcgcgcaatgcgtttggttatctcatcgcttggcaccgctgacacgctctccattgttgctttctcagccacctccaaatggctcttacctttgcgaagaatgacaagccaaggtcagcgcgtggttcgtcgcatcgttgaccggcaagtgataggtcaaggctccagcgtaggggatgcgttgaggaaagccaccagagtgttggaagatcacagagaaagaaacccggtggccaacgtcatgctcttatgggacggtcaagaagaaaagctgacaagagctgtctgcaattcggcactgacaccaccatcggcccggcgcttgaaccgcaagaaatcggcgatggaattgctcttcaggaactgttccggcgacccattttcctgcggtgcggaaacggaagaagaagaggctctgagggtagcattgggaaggggagctctggggaacacaaaaagaggggttcggttggaggaagggaagaagaagggtctgattctggtggtaggggaagaagtggaaggagaatcggagacgaatgaagatgaagaagagactattgaaattgaatcaccgaatactgaccctgctacgttcggttattgcaattaccacttaccactcaccgctagtgag

SEQ ID NO: 4842 - DNA, 690 bp, Glycine max
  Peptide Sequence Number=SeqID_121620
atgactcttaagtcaacaaaggcagtattgcagccagcttcaattccggaagatcttgacccattgagatccaaacttttatgggcttcacgtgtacttcctatgccccttgttggccttcttatcattggaggtgtttgtacagatgtgggaagtcaagcatcagaatatcctgaaatagaggcattgtcaaggcttgattttggtgctgccttgaaggtcttcctcgcaaagagacttacatctgagttcacactggtgacagcagatgtagaggagaaatcggttataattggtgagagaaatagagtagcaatagaggccctaagagcagcaatggaaaagggacacaataaaattgcaatactatatgggggtggacacatgccagatcttgggaggagattgagagaggattttgatttagtcccgtctaatgtacagtggataacagcttggtccataacgaaaaaggacctaaatactgattcatttccatttctgaagacaattgctaaggcctcaggctggccattgaaccgctatcagaccttggcattgctcatcttttcatcagtcttagcattggatctgtggttctgggagctcttctttggcactgcagtgaattgggtctctgaacttggctcagaacttcttcagtatgttgataattcacagatgatatga

SEQ ID NO: 4843 - DNA, 438 bp, Glycine max
  Peptide Sequence Number=SeqID_121621
atgtcccccaacccccaacggtcagaggagtggtttgcccttcgcaaggacaagcttactaccggcacatttggcactgcattgggcttctggaaagggagtcgtcgccctgagctctggcaagagaaagtgtttgcatcggaggcacaaattatggaagcaaacaatgccatggcatggggaacactcaaagaagcagtagctgtagaacaatataaaaagatcacaggtgatgaggtgagctcaatggggtttgcagttcatttgaagcagtcttgttactggcttggtgcctcccctgatggtgttcttgggatactggaagtcaactgtccacataacaagggcaaacctgaggctggcttgccttggttgagaatgcctttctactacatgcctcaagtccagggccagatggaaataatggattgtgaatga

SEQ ID NO: 4844 - DNA, 192 bp, Glycine max
  Peptide Sequence Number=SeqID_121622
atggatacttggaaaaatatctgcaatgttattgatgatgataacaacaattataacacggatgatgttagcaatgatggaggtgatgtcactggcagggctactgatggtggttgcgatgtcaagaaagttgttgttgatagtggtgatgttagcactgttagtaatgttggtggtggtgataacttgtaa

SEQ ID NO: 4845 - DNA, 1069 bp, Glycine max
  Peptide Sequence Number=SeqID_121623
atggcgttgaatttctcgcatcgaccgattttttctgaggataatttggtttcgccgatgaggatgggaattccagagaagagtgttgttgacaattgctttgattatgggagagagaggggtggtggtggtgcgaaccacgatgacattctcgatcttttgccttcggatcccttcggcatggacatcagcaccaccgtcacagccatcaccgggtggctcgaggatttggagattgttgattatggtgggtaccgaagggatgagcttggggcgagtgatggcaattaccagctttttgctgggttgaatttcatttggaacaatgctatgaggttccatgcttcttgtgttgaggagaagagagggtttggcgagagttgttctgtgagaaatgatggggctgctgctgcatcgagcaattttgggtttggatctgttaataattatgatgaagtgtcgggtttgcctgctattagcaggtctggtgatgttgtgagacgggttggaggagcaggcaggggtgatgttgcgagaccggatggaggaggaagtgggggtgaggagcttgctcctcacccggccttgagtttttctcttggttacctgggtttgtctgatctgcttgttgttgaaagggtgtgtaaatctttgcattccacggtttgtggggatccgcttttatggaggagtattcatgtggatccgcctttgaatgagaggattaccgatgatgttcttttccaattgaccaacagggctcaaggtcatcttcagtgcttgagcctggtcgagtgtaccaggataacagatgatggtttgaagcgggttcttcaaagcaatcccaagttaaccaagcagatgcttaaaagtgtctttaggacattggttaaggaatcaaacttgagtgttccaggatgcacaagactcagtattgagggtattgtggggattttaaaagcttacaactctatgggtacccaagggttgaagcacttacacataggtggtctttatggtgttacgcaaaagcattttgaagagctgagtttcttgttgggggctgatg

SEQ ID NO: 4846 - DNA, 480 bp, Glycine max
  Peptide Sequence Number=SeqID_121624
atgcgaaagataccgaaagggtgggggaaaagggtcatttcagggggttttctggaccccgtctcgcccaggctagcctttggctcaaaagaacatcaaaggaaacactggattcattcaaacagaggaaaacttgtcaaagcatgttatgttcaagaaatttgccatgtcttcatcttcctcaactcttcctccatctccttgggcagctccttgagcatctacaggtcttgcctcctcctgaaaaataggtatgtctccaggccatgcaacaatggctctaaactactcgggagtaggccaaggccaaatgacacatgtatatgtgcatctggagctccattctttacaagtgggctgagatggactccaaggatggtgactgatgtggaggtagtggtggtgcatttgttgctggctaatgttgttgatcttactctagttgttgtacctgcctcaacatgcaatatttttcaataa

SEQ ID NO: 4847 - DNA, 213 bp, Glycine max
  Peptide Sequence Number=SeqID_121625
atgaaggtgaagggaaggaggcttcgggtggagcgagtttatggatttattcgccaagcttcagggtcatgcataatcctaatggaatttgggatcaaagacgctaatggaagacaagctaaggaagatggatactgctgccaactcagcatattccattctcagacaaaatctctcaagtatatgttggacaagtggcctcaaaaattttaa

SEQ ID NO: 4848 - DNA, 873 bp, Glycine max
  Peptide Sequence Number=SeqID_121626
atgggagttgaatttatcatgaggagtgggggatggtactataaggatcggctgggtcgcactcgaggaccattagaattgattacgcttaaaactgcatggggtgctgggattattgataagaacactttcatttggggagaggatatggatgaatgggcacccatccacatgatttacggaatggagcgtgcaatcgctacttgggaagttagactcgctgcttcagcaacagcattgcttcacaaactacaaaaaggtataccaccgtgggttcctctgaagggattcgaaaagaagacttataagcaacttcaagaagaggctatagaaagcaagagacgtgatttagcagtattggaagctaatgatggtctttggcctggagctaaaattccaagtcatgccctatttctttgggctagtggctctgaattgaccactatattggaacaggatcacatgcccaacaaatacattcccaaatatcttagaaagaagttggctgaaattattccaggtttgaggccatgggaagttctgagtgtagagcaagcaatggatcgattaacatttaacggtgaatggtaccgtgaaccacttggttcattcaccaccggtcccccatacctcgagcactggaatagagatgttatgagattgtataagatattcgatgatcttaacaatgagctgtacgaacatatggagaattcaattgctggttttgataaaattatggagaagatcagggatgattttattgcaagaactgataaactgttggagaagaaagacaaagagaaaagagaagctcgcaagaaagctgggttgcctgagtatcaatggcctgaaaaaccatatgttccttag

SEQ ID NO: 4849 - DNA, 867 bp, Glycine max
  Peptide Sequence Number=SeqID_121627
atggcttccatcaacttcaaccccttcggtggaaactggttctcaaaaccccccaatcccctctctgtcccttccctccccaacaacctcaccgacgcaccctcctcccttcctcccaacttcgccgcaatctccctcccaaaccccttccgccgcaggcccaagcccaagcccaagcccgaagagcccgttgagcccgggcactacgaacaactcgcccggcaggtcctctgggagtgcgagaacctcccggaccaccgccacaccccggaggtcgacaagatcctcgctgacaacgacgccgccttcggcggcaacaacgacgactccgtcttcgtcctccgcgaggacgccacggaagaagaagtccgcgagaacgcggagctcgtggagcggctccgcagcagccccgtggtgcagttcatggcacgcgccgaggagattctggacaagatgaacgagatggagctcaaggagaacgagaggccctaccacaaggaggattgggaggtgtggaagaatgtgccgaatgttattgggcttgatgggaggcccatgcccagaaaagcccagaagacccgcgaggaggctgatgataagttttgggattttgctagacagttcttttttgggctttggaattttagacagaggccctatcctcccgggaagcccattgatgcagcccagtctattgggtataagaaccttgataggcgctactatgactgttggttttgtgtgtatgagttagaactaagccaaaattctaagatggcgttagggggggttgttaatttgtcgcctggaggctggagttgtccacaaatgtccagtcttcagcttgggcttgacggggtgtgttga

SEQ ID NO: 4850 - DNA, 285 bp, Glycine max
  Peptide Sequence Number=SeqID_121628
atgggaaagtggaaggactgcttctacctcaaggatttgtctatctattcaatcaagagtatctttaggaaactcaattcactcttgaggttcagacgtgaagggcacagaaatgggcttgttaatctttacaaggatatggagccttttgaagaaaatgatgatatacaagttatgtggaaaatgattcaagttcaatcatcaactcctcaatgtacctgcaccgtcaaaaggaccaataggtgtttattggaaactatgttttcaaccgacttgaaattttaa

SEQ ID NO: 4851 - DNA, 984 bp, Glycine max
  Peptide Sequence Number=SeqID_121629
attgcttatgaaggactcaagcatagagtgtttgaggtctccttgactgatcttcaaggggatgaggatgatgcattcaagaagattaggttgagagctgaagatgtgcaagggaagaatggaatggatttcacaacagagttgctgaggtcattggtacgaaaatggcaaactcttattgaagcccatgtggataacctgttatgcacaatcaagccagaaactgaacttgaatttgctcctatgatcattgaccctatggtgatatcggcaccagaaactcaatcagcagcagctagcatactagttgcagaaactgaacttgaatttgctgctgttaaggatgaaattgtgaggtctgagagggttgtttgcacacaaaaagcaatggctaagcacatgaacttctacaaaaacttcaaggcatcagggcctcatccaaatccgacagtgcacttgatatcagccttgagacagattcttagaaggactttggattctcctagagtaaggtccacaccaaaaagtccaaccaagactcgcacaaaaattcatggttctgtgcttacaacatctgagagctgtttccctacctctctgaagggttgtgatgaagggaatacttggggtttaagctgtgatgaacctgaagaggatgcggatgcagaactaatgacaagatcaaaggagcctgaggagagggttattcttgtctctaagaaactggaaccagatagcttttttcttgatgctgacaatcagacatctactagaggagaaaataagcttggctttggaagtttcaacttagctggtggtctcaaattgctgaaacagtctctgctagggaagaagttacacatgaggtcaacttactggtcatttaagcttgagaagtaccagttacaacagcaatggcttcgtgaacaagttagagaggttgcagagcagaatgtatcacttcaaagggaagtccctaactag

SEQ ID NO: 4852 - DNA, 618 bp, Glycine max
  Peptide Sequence Number=SeqID_121630
atgaagaacacatgggaacgagttatcaaaagaggaaaagacttaggaaaaataagttgtggtgcggatgagagttatcgccattggcttaaagtaagggttcaaatagtcaaagtacctttttgcaatctgattctagtgattgaaggaatgtttgtgcaagcttctatagatatgagggaagtcaaagagctcaaggaagcattagctaagtttgaagaggaaatgaatatgttgaagctagaattgatggaatcttgccaaatgtgcaagaaaagaaagagacaggcattagcaaataatcaacaattgaaagaagaactgaagagttccaagatagctaaaagacaagcgcaaaggttacttgaagacctccaacaacaatcaaaaagggtagtggcagagtatgaggataggcttgaggatgagaagcaacatagacaagaggctgaacatgcagcggtgacacatcaagatggatggatgaaggagcaacaaaatgcacatgaattgataggatgcattaaaggtcaagaattctacatcaaagaactcaaagtagaaatcgcattttggaaggatgaacttgcaagatcaattaataaggatgatttatag

SEQ ID NO: 4853 - DNA, 1500 bp, Glycine max
  Peptide Sequence Number=SeqID_121631
atggatccaaaggaattgactattaaacttggtcttgaattcaatagtttagaagaggcatatttgttttggacagattatggaggcatgaaaggctttggagttagaaaaaagaattcaagcaatagtaagaaagatggttccattactcattataaatatgtttgttgtaaggagggcgtacgtcaatatgataaaagagatcctaaaacaactaatccagaagctgagacaagaacagggtgtatggcaagtatgaaagttaaacgattcaatgagaaatataaagtgattgaatttttttatgatcataatcacccactccatccaccagaaactgtgcatatgttagcttgtcaacgaagaataactgaaaagcaagcatatgaacttgaagtggcagaagatgtagggattcaacaaaaagtcttatttgatttgatgagtaaatatgtaggaggtagagagaatctagggtatacctggcaagatgcaaagaattatttgaattctaagaggcggcgagatatggcttatggtgaagctgggtgtttgctacaatatttccaacaacaacttatagataatccctcattttttcatgcataccaaattgattcagaagagcaaataacaaatatcttttgggctgatgcaagaatgttatttgactatcaatgctttggtgatgtgatttctttggataccacttattgtacaaatggagatcatcggccccttgcaattttctcaggctttaaccattacagaggaggggtgatatttagggctgcattattgtatgatgagacaattgactcctttaaatggcttcttgaaacatttttgcaagcacatagcaaaaaaagaccacaaactgttttcactgataaagaccaagccatggcaagagcattgcaggaggttatatcagagacaaagcatggtttgtgtacgtggcatataatgaaaaatggaatcaaacatcttggcaatttaatgaaagatgaatcaaatttcttatctgatttcaaaaagtgtatgtataataataaggaagaaactaattttgaagcctcatggagaaccttattattgaaatacaatgtagaagaaaatacgtggttgaactccacctaccaaatcaaagagaaatgggcagcgtgttatatgaagtatgcttttacacttggtatgcgtagtacacaactaagtgaaagcattaattcagatataaagagttgcacaaggcctaatttgaacatcaaccaattcttcaagcaatttgaaaggattgtcaaagaaaaacggtatagtgagttaaagcaagattatgagatgcgtcagaagttgcaaagaatgatcatacaaagttcacctatgattcgacaactttctcaagagtacactcctcccatgttcaatttgtttcaaagggagtgggatctaatagctgccacaaatatcaacaaaaaacaaagaaacggaagctcatggtga

SEQ ID NO: 4854 - DNA, 264 bp, Glycine max
  Peptide Sequence Number=SeqID_121632
atgaggtattcctgcctggatttggcttcccacctaaatcaaaacatcaaagcaagcgtcttcttccacaagctgaatgaagtgtttatgcaagagtggattcaattgaaatcaaaggaaaacttaaactttttatctttgtccacacaagggatatatgaagcaatttcattggagcgcaatagaaaagattctatccgaaattcagatttatccaatggagagtttgataatcaaatcctgatgtcaccattacctacttga

SEQ ID NO: 4855 - DNA, 762 bp, Glycine max
  Peptide Sequence Number=SeqID_121633
atggcatttctcgaccagcaccccggcctcggctaccccgccgcggccgccctgggactgctgctgggcagtttcctgaacgtggtcatcctgcggctgcccaagcggctggagtggcagtggaagcgcgatgcgcgcgaagtcctggaggaaccggacttctacgagcccccgccaccggggatcgtggtggagccgtcgcactgcccgcactgcaagcacaagctgagctggtacgagaacatcccgctgttcagctggatcatccagggcggcaagtgccgccactgcaaggcgccgatctcgctgcagtacccgctggtggaggccctgacctcggtactggtgctggcctgcgtctggcagttcggcttcggctggcagggcttcggggtgcccatccgtgctggaccctgcttcctgatccgcctttgtccggtatccgacctgcgcacgcagctgctgcctcgaccagctcaccctgccgctgatgtggctggggctgataggcagcatcgacaacctgtacatgccggccaagcccgcgctggtgggcgcggcggtgggttacctgtcgctgtggacggtctggtggctgttcaagcagctgaccggcaaggaaggcatgggccacggcgacttcaagctgctggcggcgctgggcgcctggtgcgggctgaagggcatcctgccgatcatcctgttgtcgtcggtgctgggcgccatcatcggctcgatctggctgtacagccgcggtcgtga

SEQ ID NO: 4856 - DNA, 558 bp, Glycine max
  Peptide Sequence Number=SeqID_121634
cgccgcgtcgataccatcgcgctgcatcagccgggcgtgctgcacggcttcgggcgcatccaccagcaacacccggtccagccatgggtaggccttccgcccgcccacctcggtcagcagcggaatggccgcaatcgcataggcgctggtggcctgctcgcactgctgctgcatcagcaggcggatagccgggtgggtgatcgcttccagcgccgtccgctcggccgggtcggcgaacacgtgagcgcgcaggcgggcccggtcaaggctgccgtcggccagcaacatgtcggcgccgaagcgctcggcaatgcgggccagggcggggctgccggcggccaccacggcccgtgcggccagatcggcgtcggccaccacgatccccagcgcctcgaagcgccgggtcacttcgctcttgccggaggcgatgcctccggtcaggccaactacatagcggctcatggggactcccctcagcgcagcccgctcatcaccaggtactgctccaccagcggcgcaccccacatgaagtacagccagccggcgatggccagatag

SEQ ID NO: 4857 - DNA, 159 bp, Glycine max
  Peptide Sequence Number=SeqID_121635
atgagtaacgccacagactccgccggcgagatcccaccggagacgaggtccgccgagagtgacggtggtgggccccggcccacgattaagatcaatgttacgcacggttcctctcaccacgatttacacctcccggcccaatcaacttttgaaatttga

SEQ ID NO: 4858 - DNA, 639 bp, Glycine max
  Peptide Sequence Number=SeqID_121636
atggtaggggcatccgttaattggttcccccgatggaaggaaggaagaaccgaggttttatccttatgtgaggggttctcaaacatccccttgatgggaacaatgggttgtatcaattataatctcatccttgccataagacaacttggctaccccatgagaggagcgtcgtcggaagaaagtatcacgcccttcatcgcacgaggtttcactgaccctaatgcaaggatatttcaaggagtccgaaaggcatggaacgtggtgcaaagaaagcataaggagcttaggggaagcatcaataggatcatcgacagctatcacaagtggttgaaagctcagacgcaagagttagtttggctcccgaatctaaaggcatcaagtgaggaagaggctgaaacccctgaggagagtgaggaggtgcaagccttgaacgcggaacttgaaagggcacaagtagtccaggaaaagttcaagatgacaactatcaaggtccgaaaagaatgtgacaaatcgagagacgttgttggggcctttgccaaagcattggaacgggaaacaaagagggtcccaaaggaagaatggggccgagacaagttccgaggggcattgtgggataacaacagtgagctcaagctttga

SEQ ID NO: 4859 - DNA, 1569 bp, Glycine max
  Peptide Sequence Number=SeqID_121637
atggtgacagataaggttatccttattaagtattgttggcgatttaggaaatctaaggagtgtgcgagtgagaaacttttgactgtaatttgggggacatccgtccaaacaaatttgtaccagagctctgatctgggagctatggttcttgatccaaagttaagccatatacttatgtttattcatatattttggatcagaattggtcaagaggtcctgatggaagataacttggctgatgatgagatagaaattgaattgtctcctatagctgtacaattagcctatgttcagcagcttcttgggcgtaagcaagatgctattgaagcttatacagatgtgattaaacgagatatggctgatgaatcatcaattgcggtggctgtgaacaatcttgtttcactgaaaggtccaaaagatgtttctgatagcctaaggaaacttgatcgattaaaagacaaggagaatcaaagctttcgactagctcctggactagacttgaaactttcagcaaaagaaaaggaagcaatatatgcaaatagggttcttttacttcttcatgccaataagaatgagcaggcacgagaacttgtttctgcattaccagacatgtttccagaaagtgtcataccaatatttctgcaagctgccctcttggttagagagaacaaagctggaagggctgaggaaatactagcacagtttgctagtaagttccctgataagtccaaagttgttcacttagcccgggctcaggtagctgctgctgctggccacccacatattgcggccgattctctgactaagatatcggatatccaacacatgcctgctactgttgccacccttgtgtctttaaaagaacgagctggtgacattgatggtgcagctgctgtgcttgacaatgcaactaaatggtggtccaatgctatgactgaggacaataagctcaatactataacgcaagaggctgctttgttcaagctgaggcatgggaaggaagaggaagctgctcaactctatgagcagctcgtcaaaagccagggtagcatagaagcactagttgggctggtaacaacagttgcccgcatggatgttgctaaggcagagctttatgaaaagcaactgaatgctctacctggtttaaagggaattgatgtggacagcttggagcgtacttctggagtgaaacaagttgatgctcctcgtgttggtgtcgctgaaacatatgaggaaggaaagaataaaacaaaatctaagaaaaagagaaagagaaagccaaggtatcctaaaggttttgaccctgcaaatccaggtcctcccccagatccagaaaggtggcttcccaagagggagagatcaacatataggcccaagaggaaggacaaaagagctgctcaagtgagagggtctcaaggtgctgtagttagagataagcatgatactggtgcctcatctaacagttcaaatctaaaatcaaaccagggaacctccaaaggagctgcgcagaatgcagtttccgagcaaaccaagccttcatccaagtcaagaaagaaatcgaggaattaa

SEQ ID NO: 4860 - DNA, 465 bp, Glycine max
  Peptide Sequence Number=SeqID_121638
atggcttcaaagttgcagaagttgcaggccacagcatctcaagcgtctcaatttgtatgcagtcgtggaactaactactacaagcaattgctggaacagaacaagcaacacattcaggagcctcctacagtagagaaatgcaacctgttggcaaagcaattgttttacactcgccttgctagttttgacccttttatgctcaatgtagtaacatttggattttttggattgccttcaaaagtgcctgctactgaatgtacatcagttgtgttaggtgcaattttattacctgcagcaactgctccagaggaacttgattatgccaagaatttgtggaagaacaggaaagagctaaaggttgaagatgcaggaattgctgctttgtttggcctcgaatgctttgcatggttttgcgctggtgagattgttggcagaggatttactttcaccggttactatgtctga

SEQ ID NO: 4861 - DNA, 256 bp, Glycine max
  Peptide Sequence Number=SeqID_121639
atgattgttaggtctccttatgtggtggctcgtggttcacaggtggctagaatggctagcggtacagcgtgccccgcaggtggagcggggtggccagaatggctagcgggcaggacaagtatcgcagggggagatgtgttgggttacaagtgtgaggtgaagtcccacatcgggtctccttatgtggtggctcgtggtccacaggtgtacccctcgaacctcccaaacaatgattccttcatacttcttccaaagg

SEQ ID NO: 4862 - DNA, 663 bp, Glycine max
  Peptide Sequence Number=SeqID_121640
atggctccgaagcccaaaccggcgccgtcgcagcctgctcctcctcctgccctcgaagatctctttaccacgctcaaccgccacatccaggcttccgcatacgacaatgccgtcaggctcacggatcagattctcgccattgctcccggcgacgaggacgcgctccgatgcaaggtcgtcgcgctgataaaaaatgaccgcgtcgaggacacactctccgccattcggtcctctaagaagcagctcgatgattttcatttcctcaaggcacgtcaattttccgcttttgtttctgctttttcgtcggcatactgcttatacagacaaaacaagttggatgaagctttggagtctttgaaaagacaagagagcaatgatgaaacaatgcttttggaatgtcagatattgtatcgtcttgggaaaatggatgcttgcttagatatctaccgcaagctccaaaattccaagattgataacatggaaataaattctgttgctgctctagttatgtctggcaggtcatctgaagttcaaggaatgctggattcacttcgggttaaggcaacaagcagctttgaattggcatacaacactgcttgttcattaattgcaaggaatgagtacacagatgcagaacaactcttattgtcaggccgaaggtga

SEQ ID NO: 4863 - DNA, 1734 bp, Glycine max
  Peptide Sequence Number=SeqID_121641
atgtttaatcgtagaagctccaagtcctcagagtgcaaaaccgcattgacgcttgcggttccacggataaagcttttgaagaataagagagaagccaatgtgaagcagctccggcgtgaattggcccaattgcttcactctggccacaaccatgctgcaagagtccgggttgaacatgtagtcaaggaagagaagacgatggcagcatatgatcttattaagatatactgtgaccttattgcagcacgcatgccgatgattgaatcacaaagaaactgccccattgatttgaaagaagcaatttcaagcgtaatatttgcatccccaagatgttcagatattcctgagctggtagttgtgaagaagcatattatggctaaatatggacgagagtttgtctcagcagctgttgaattacgccctgactgtggtttggttgaaaaattgtctaccagtgcacccgatggtcctaccaagatcagaatactgactgcaattgctgaggaacataatgtccaatggcaaccgtcattagaagaaaaccatgtgaatgcgtctcaagattttctggctggaccaaatactcttgagaatgggaaacctccacaagtacaactccatgctccacctgttggtgatgaaaaaggacctcctaatttacgtgcttatgcttcttatcaacttaaagagatgcacaatatttcttatgagaagagtgcaagtttaaattcttcaggcactggaagtcaagaaatgaattttggaaacttgtattctgaaaacacgagttcttttcaaatgggtagacagaattggaacattgaattcaaggatgctacctctgctgcacatgcagctgcggaatctgcagaacgtgctagcatggctgcaagagcagctgctgaactttctagccgtggaaagttaacaaggcagtgttcaagtgaatggctgagttcttctgttggtgaattacctcaaaaatatgccttccatgctaccgaacatctttctgctggttatgttaatagcacattccgaagaagcagttttgagatacacaatgaacaagctaatgtaagagaacaacataatcaggtgggatcaaccaatgaacatcgcacgaacagtaatgagaatgtggcgaaactgtaccagtcagcttcattgacatctcataatgcttttcgcgaagataaaccatttggcaatgtttatggagtggctgatatatatccaaatgatgataatcctcaggcaaaccagaaatcaagcacatgggactcaaatgcacacttttattctgatactagtaggtctgaggatggacttcctaaacgaaattcagtcactcttgccggttctgctagtggattgtctagaaggatgttagctccttcaaaaactggtacatgtttaattttgaaggatgattctttgtccaaggcttctaagacttctggtgcaagttctgggcatggatcagcagagcatgcagcatctaagccaaattcagaacctaaaagtgaggaaattataatattatctgcaatggtgcaagcttcctcttctcttactacaacaatgacaccagataaggaagaggcttcaaaatctttaaattctaatcaagatattccctctaaggagaaggccagtcatgttcatccaaagctacctgactatgatacctttgctgcccaatttctgcctcgtaagaagggtcttcaataa

SEQ ID NO: 4864 - DNA, 633 bp, Glycine max
  Peptide Sequence Number=SeqID_121642
atgtccattcgacttacagaaggcaaacacagagatcaagtttccatcgactgcaacgaccaaggagtgtcctttctagtcgcaaggctgagatgcaaactatcatcaattctccagaaccccacgggagcatcgttgaaccctttgttccccgatgaactacagtggaagcctatgaagaacacaacttcaactatagtagccattcaaataaactgttttgcatgcggaggaatagcaataagcgtgtgcatgtctaagtcattattagccttcccagttcccggggcttcactcttcccgcaagaaaacttacctgttttctcagaagttttgttcgtggaaaacgacgccgtttgcagaaggtttgtcttcgaggcctccgagatcgactccctcaaagccatagtgtcctcccacaacgttccaaaccccacgcgcgtggaagttgtcagcgcgttgatctacaagcgcgcggtttccgctctagggttgagtttcaagacgacgtcgttccgcaccgccgtgaacctccgcaatagaacggttccgccgctcccggagaagagcctggggaacttggtttggttcctgttagtgcttaacccttcggaagcggagctgcatgagtag

SEQ ID NO: 4865 - DNA, 2058 bp, Glycine max
  Peptide Sequence Number=SeqID_121643
atggacaatggttgcttctcttctccacgccacgatgcttttccagctggtttgcgagttcttgttgttgatgatgatccaacatggttgaggatccttgaaaagatgctcaagaagtgcttatatgaaggtggagaaattcagccttgtgttgacttttattcattatgcacctttgcacttcgggttcaattacttgcacggataagttgcgctgagcttcaatacttagcctccttaattagagaatggaaatcaaggataaggtttcttctcaattgctacctttatgggtacctttcaagcactcaagctgttcatgaagttggattgggttggactatccaaaagcctgagctcaagaaactgaggctacatcaaattttcatgaaattagcaaattttggaagcaagcacatcttgtgtctcttactgactacatgttgtttagcaacagaggccctgaaaaaacttcgtgaaaggaaagatgcatatgacatagtgatcagcgatgtgaacatgcctgacatggatggtttcaaacttctggagcaagttggacttgagatggatcttcctgttatcatgatgtctgttgatggagaaacaagcagggtgatgaaaggtgttcaacatggagcatgtgattatctccttaagcctataaggatgaaagaactgcgaaacatatggcaacatgtctttagaaaaaggatgcatgaggcaagagattttgaaagtcacgagggttttgactttgagggcattcacttaatgagaaatggatcagatcactctgatgatggtaacctgtttgctgtagaagaaattacctcaattaagaaaagaaaagatgcagataacaaacatgatgacaaagaatttggagatcattctcccatgaagaaagctagagtagtttggtctgtggatcttcatcagaagtttgtcaaagcagtgaatcaaattggatttgataaagttggtcccaagaaaattctagatctgatgaatgttccgtggttgactagagaaaatgttgctagtcacttgcagaaatacaggctctacttgagtaggttgcaaaaggagaatgatcagaaatcttcctcaagtggaataaagcattcggattcaccttcaaaagatccaggaagttttagtattctagacactgcaaacaagcaacaaaatgatgttgccattgacagcttcagttattcagatggaagtttactacttcagatggatgccactagtcatgaaggtaatctcaagggaattgtgtcagagcctacaacagaaaaaagaagaggttccactggtgacattcctgaccccaagatacaaaaaagttcacagaagagcctcaatcaaccttttacatctgtagagtcatcagaagcaaaccatgcagtctttgattgcaccataccaacacagtactcttggagtgagtttccaaaagggccactcaaagaagaacagaagacacttgttcaattagaggatagcctcagccagttgccattgcatggtaatggtacacagcatcacattcacgttgatcagtcacaatcaattgcctcaattaattccaatccctctataacagaagaagaggttgctgccaaattagagaccaaaccgttgtatgctggttacgagagtgattatgtgagtcctgtgagttcaataggatctgcagttgaagtctttcctagtcaatccaaaagccttatggtgaatgatcaatcttcagagcccactttcacctcaaacttgagcttgaaggctcagggatttaatcgagattgcatttctgatctggatttttaccaaagaaacctattattgggtggtgaggtagcttctgcacctttggaggaggacctgaatttctttttgctacaaactgaatgctacaacatgaattttggcctgcagaatatagatatgtcagagtattatgatccaaggcttattgctgaagtccctagccacttttatgattcagcagattattcatcagtagatcaaagtctattcatagcatga

SEQ ID NO: 4866 - DNA, 1539 bp, Glycine max
  Peptide Sequence Number=SeqID_121644
atggaattacttccggctggtacacctccgatctcgaagaaacaaggattccgatccctgaagctcgtcaacgtcgacatggaccaactcctctccgaccaacccgtcggcgtcgactacggcatactcgacaatggccttcgctactacgttcgctgcaattccaaacctcgcatgcgagctgctctcgctctcgccgtcagggccgggtcagttctcgaagaagaggatgaacgcggagttgctcacattgttgagcacctcgctttcagtgccaccaagaaatacaccaatcacgacatcatcaagttcctcgagagtatcggagccgaattcggtgcttgtcagaacgccgtgacctccgccgacgacaccgtttacgagctcctcgttccggtcgacaagccggagctgttgtctcgggccatttcggttttggccgagttcagttcagagattcgagtctcgaaggatgatttggagaaggaaagaggagctgtcatggaagagtacagaggaagcagaaatgccacggggaggctgcaggatgctcattggatattgatgatggaaggttcaaagtatgctgaaaggttgccaattggactagagagagtgattcgaacagtttcttctgagactgtgaaacatttttacaagaagtggtaccatttatgcaatatggcagtgatagcagttggagatttttctgatacacagggtgtagttgagttgataaagactcattttggccagaaaattccagatcctgatcctccacttataccaacaatccaggttccatcacatgatgagccacgtttttcatgttttgttgaatcggaagctgccgggtctgcagtgatgatcagttataagataccaacggatgagcttaaaacagtaaaagactactgtaatttacttgcagaatccatgttcctctatgccttaaaccagaggttctttaaaatagcacgtagaaatgatccaccctatttctcctgttctgctgctgctgatgttctagtccgtccattaaaggccaatataatgacttcatcttgtaaaagaaaaggaactatcgaagcgttggaatcaatgttaatagaggttgcaagggtaagacttcatggcttttcagagcgtgaaatatctgtagttcgtgccctgttgatgtcagagattgaatctgcttatttggagcgtgatcaaattcaatctaccagcttgagagatgaatatttacaacattttctccacaatgaacctgttgttggaattgagtatgaagctcaactccaaaagactcttctaccacatatatcaacattagaggtctctaagtgttcagagaaattaaggacatcgtgtagctgtgtcataaagactattgagccccaaccatttgccgtgcttgatgatctgaaaaatgttgttaagaaagtcaatcttcttgaggaagagggtagaatctctccttgggacgatgaacatgttccagaagaaattgtcactacaaagccaaatatggggtga

SEQ ID NO: 4867 - DNA, 450 bp, Glycine max
  Peptide Sequence Number=SeqID_121645
atgtctatgcaagcaataaagggttgcgttggttgtgccgttggagcttcttcttcgttggaagttcgagcttcttctcctctgttggttgtcgacattgaggacctgcagcttcgttgggttgtttcaccgtcaaggattataggtagatccctgaggagagaggatcatcatgattcagatgatgttctccagcaacgaaggcctacagcatccgaacgtaggcaacgggaagttgcccctattgttgaggatgatcctatggtgactgaagacgtacatgcacatgttgaagaagttgttgatgatgctgagggatttctaggtggaccgcatgacccattgttggatttcccttgcacgccaccctcgtgcttagtgcgagttagtggatttggacttggtgccagtcattcgttgagccgggctaaagacaaccatcgtgcttag

SEQ ID NO: 4868 - DNA, 354 bp, Glycine max
  Peptide Sequence Number=SeqID_121646
atgcctgagttttgcgtgacaggtggtactgggttcatcgcatcttacctggtcaaggccttactagagaagggtcacacagtgaggaccaccgtgagaaacccaggggatgtggagaaggttggttttctgactgaactaagtggagccaaagagagactgaagattttgaaagcagatctattagtggaaggaagctttgatgaggcagtgagaggagttgatggtgtctttcatatggcgtcccctgtgcttattccttatgatgagaacgttcaggggcttccttacaagaaaataaggaggctcatttacaaatgtactacctacgtaaatgtttatattagggcatga

SEQ ID NO: 4869 - DNA, 750 bp, Glycine max
  Peptide Sequence Number=SeqID_121647
atggctggaaagaggagattaggggaagagaattggaggatgaaaaatgttatcttcacagggtattcatatgggggcttatctgaactcccagagaatgagtacttctcttgttcgatgggaccgactattgctggggaaattggtgtgtttggttatagaccatctgtcctaatggatatgcttgctggcaagagagctgaagtcggtaccaagattggtgcatatatgagaactttttatggtgattgttcaccttcagacctagaaactgctttgcagcttgtttatcagctgtttacgacaaatttaacaccaggtgaagaagatgtcaaaatagtcatgcaaatggctgaagaagcagtatctgctcaagatagggatccatatactgcttttacaaaccgtgtaaaggagcttaactatggaaactcttatttcttccggcctattagaaaaagtgacttacaaaaggttgatccacggaaagcttgtgaattcttcagtacatgtttcaaagatccatcagcatttactgttgtgattgttgggaacattgaccccactattgcgatgcccttgatattgcagtacctgggtggaataccaaaacctcctgaacctgttatgcattttaaccgtgatgaactgaaaggattacctttcacttttccgacatcaatccataggtacatcaatgcactgtgtttacaaacaaaaggtgttatgataattgttgtattgtgttga

SEQ ID NO: 4870 - DNA, 303 bp, Glycine max
  Peptide Sequence Number=SeqID_121648
atggaaattgggattgtatggagattgtttgcggctataccaccgctagatgcaaactcacatatgacccttaatgggttgtcatcagcagagccacaacctcccatgcaaagggataggtcttctatgttgacagagctaaggatttttggcataacaagaatggtgttacaaactgagagttcaaactgggtggtagggtttataccactaaacttggattattgtgtagctgataacatgttaaaagagcagaggtggaaagagattgcagcatcacacgtggaggtccggattatttag

SEQ ID NO: 4871 - DNA, 468 bp, Glycine max
  Peptide Sequence Number=SeqID_121649
atggcggatgggcaaacggaggttgtcaataggtgtttggaggactatttgagccgtgtatgggagagaccaccacctatcatcaaggctaatacttctccttctaaagtggaagctgggaatgagatggtagaggaaagagatggtggcttagtggcttataaatggaaattaccaccaagcagcaagatccatccagtgttccatatcagcaaattgaaacaagctcttccaccatgtccagtacagccgctgccagacgatatctctgaggagtgggaattgttaccccaacctttcgaggtccgagattttagatacaacaaagcaggggatttggaggttctaataaagtggcaaaatcagtcaggttttgagaattcatgggactcagcttcaaagatggtagcagtttcccctcaatttcaccttgaggacaaggtggttgcttttggggggaagtattga

SEQ ID NO: 4872 - DNA, 507 bp, Glycine max
  Peptide Sequence Number=SeqID_121650
atggtgaagtcaacaatgcattcaaaaagggataacattgagagaagtttgcaggaattacaagggcatgctgtgcaagaagatgaatggcacaagagcatggatataacgatgcgaggtgttggagcaattgaaggaacagcgcaagggaaccccagagtctcaaatgggatctccgccaaggggagaaggtggagcttcacaattctcaggtttcaaccgactctagcacagaatccgtttgaagagcttttgggtttgaaacaagaaggtattgtgtcagaatacggagattggttcgaagagatttcgggccctctcaagattgggaattccaattacatgaagggaattttcatgaatgggttaaaagaggaaattagggtggaattaaatttgcacccgctgaaaaccttggaggaattaatggatttggcactattgattgaacccagaaacatgatactaaagaaggaagggggcaatgcattttacagtgctggatga

SEQ ID NO: 4873 - DNA, 1128 bp, Glycine max
  Peptide Sequence Number=SeqID_121651
atggcatctacgaagtttgacattgagaaatttactagtaaaaataacttcaatctgtgggggctgaatgtgttcgctctcctcatacaacaagaatttgaattggcattggaaggagaaacaaagttgccaaccgagcttagatctacaccgaagaatgcgataatgaaaaagacacatatgatgatgaagttttgggagaagtctctagagaaaagactgccaacatgctttgggcaaagcttgaaagtcgcctataagaagaagcgtgattttgcaaaggaggcggaattcttaggacatgtggtctcagctagaggagtggctgcagatttaaaaaaagttgcagctatgctgaactggcctggtccaaaagatactaaggctttatgggagtttcttagcttaactggttattaccgaaggtttgttaaaggctatggaataatggctaaacctttgaaggatttgttaaaaaaagtggccttccaatggaacatagaagcagaacaagcatttaaagctttaaaaagttctatggctgcacttccaacatcggctgtacctaacttttctaagcaatttgtggtagaatcggatgcatctagcaaggggataggggcagttttattgccagatggcatacctcttgcctttttcagccaaacgttatcagagagagctcaaaggaaatctgtacatgaaagagaattaatggctatagtattagctgtacaaaagtggaaacattacttgatggggcgacatttcatcatcaaaactgatcaaaggagtttgaaattcttaacagaccaaagtttgttgggagaagagcaacatagatggacttcaaagttattggggtatgattctgagattcaatataaaccagggtatgaaaataaggcagcagatggtctttcacgccaaatgatgtatgcagcattatctcgcgttgaaatgcatgaatggcagaagtgggaggaagagatagccgctgattcagaattacaaaggttaatgcaagcagtaatgagttctcctcaacagcatatggttatcaaattcgagaagggaagttgtactataatgagtaacagaattctaaagagaatatttgagaattga

SEQ ID NO: 4874 - DNA, 636 bp, Glycine max
  Peptide Sequence Number=SeqID_121652
atggcagaagctcaatctatctcttctcctatggcttcaagttgcaagcttactaaaataggttcagatctattttatgatcctaccatggataggtctgtagatactcactggattgcagtaaaaaggatcccaagatatttggaaggtactattcttcatggtcttcatcttaagcctgctgttttgggacatccctacaccattaaagctctttgtgatacagactgggcatctgatatagatgatagaaggtctccttctggtgcagccatctattttgctcctaatctaatctcctggtggtctcgcaagcagcaagttgttgctagatcaagcacagaagcagaatacagaagtttagctcagactactgcagaaatatcttggattcagaccctattgactgaattaagagtcccattgaacactcctattgtcttccgtgataaccaaagtgaagttgccatgcccataatccagttcttcatggaagaacaaaacatgaaaattgatgtcttttttgttcgtgaaaaagtcctgacgaagcaactaattgttcatcatgttcctgctcttgatcaatggcagatgctctcaccaagcctctttctccaaacagatttgtttttctaa

SEQ ID NO: 4875 - DNA, 1734 bp, Glycine max
  Peptide Sequence Number=SeqID_121653
atggcttcaatcgacactttcaatgccgattctatctcgagttataggatgcctacgacgctcaaaggaagattgatgcaagagttttttatgcaaatcaaagcaatttttgactccctcaccttggttggaagtctaatcatgcttcaggagcatgttgacttgattctcgaaggtcttccgtttgattatcactcggttatctcagtcattcaaagcaagtttgaaacgttaccaatcgcggaggtcaaagctctacttttagttcatgaagctcgtctgaacaagttcaacaaacaatcactctttgattctccttcgattaactacacgcaagagcacaacaaatctttcttgtcgcatggatctgatggctacacagtgtcaaacaagtctgttttgcaatcagatcccaagagtttttccaattttcgtggtggttttggccgtggtggtggttttaacaaccatggtggtgaccggcgtggtggcaccggcggcggaggccgagttcgtggtcggtttgctatctttcagtgtcagaacaatttcaattctggttatgggcaaagtaattctaattctgggcagcagaatggtgataatcgtgcttgtaattctgctcctagtgctatgttaactgatgctccttctcaaccaaattcaaattctgttatttggattcctgattcaggtgcttcctgtcattttattggagaatctcagaacattcagcagatagaaccttttgaaggaattgaccggatcttcattggcaatggtcaagatttgaagattacttcctctggttcttcttccttcatttccccttacaattccaaagtgtttttgtctcttaatcgtttcttacatgtcccctacatcactaaaaacctcgttagtgttagtcaatttgctagggacaatggtttttgctttgaatttcactctaattattgtgctgtgaaatcccaggttaccaatgaggtcttcaaggcactttctgcaaactccactgtaaatccatgtaaaaagactgaaatccatggtaaatccataaattatatttctaaagatgttatttttaacgagtccaagtttccatatgctgacttatttaagtctccttctcttagtcagtctgtttctgtttctgttcagcccccttctgtttctgttcagtcagactcagacttacctcaatctgattttgttcagctctcaaattctgttcagtcagacttacctcagtctgtttctgttcagtcctttaatcctgaacagacagatcaacccactgtttataatactgtcttatcatccaattcagaatcctcatcctcaaccactaattccccttctcctcctagaccatccaatattcatcctatgcaaaccagatctaaatctgaaccaaagagtgtgaaacaagctttgccagatcccaattggttttcagccatgaaacaagaatatgaagcattgatgagtaatcacactttggatttagtgcctcttccaccaaacagaaaagcaattgtctgtaaatgggtctttagagtaaaagaaaatgcagatggctcaatcagtaaattcaaagctagattggttgcaaaaggatttaatcaagttcatggttttgatttttctgaaattttctctcctatggtgacatctgttactattagacttagtcttacagaggctctcaccaatcagtgtaaacatgcttag

SEQ ID NO: 4876 - DNA, 699 bp, Glycine max
  Peptide Sequence Number=SeqID_121654
atggctgaagaagcagtatctgctcaagatagggatccatatactgcttttacaaaccgtgtaaaggagcttaactatggaaactcttatttcttccggcctattagaaaaagtgacttacaaaaggttgatccacggaaagcttgtgaattcttcagtacatgtttcaaagatccatcagcatttactgttgtgattgttgggaacattgaccccactattgcgatgcccttgatattgcagtacctgggtggaataccaaaacctcctgaacctgttatgcattttaaccgtgatgaactgaaaggattacctttcacttttccgacatcaatccatagagaagtagttcggagtcccatggtagaagcacagtgcttggtgcagatatgctttcctgtggagctgaagaatgggaccatggtggaagagattcactttgttgggttcttgagcaagcttcttgaaacaaaaataatgcaggttctccgtttcaagcatgggcaggtagatattgctttggatgaaatgttacgtcttcaagaggaagggccttcagaacaggatgtttcaaccatacttgaaattgagcaacgagctcatgagaatggactgcaggaaaattattactggctggataggattttgcacagctatcaatcaagagtctattctggtgacgttggcacttcttttgag

SEQ ID NO: 4877 - DNA, 138 bp, Glycine max
  Peptide Sequence Number=SeqID_121655
atggagtctggtgaggaaccacagccaggccatactatgattttggcaggagttactggcctggcagttttggcattcagtttgtggagacgtgctcaaaataatagcagacatttgcttagcagaggcgcgaattag

SEQ ID NO: 4878 - DNA, 360 bp, Glycine max
  Peptide Sequence Number=SeqID_121656
atggttcccttttgcaaacttattccccaaatggggtccttttggaacaatttccggcatggtgttgttttctacgtgggttgcatgcattttgcatgcaaaacgcaagctcgaatggcgacttcgtgggcagaagacacgtggaagcccaacccgccagtgttgctggcgacttcaggtggaagcgtgtcccgccagctctactggcgacttcgtccctgtgctaaaatcgcagctttgactggcgatttccgaggctaccatgctagggtgcaggacgcacataagccatttccgagggagctccagactgcaactgcaacgcgcagagaagcagggaatcgccagtttgactggtga

SEQ ID NO: 4879 - DNA, 429 bp, Glycine max
  Peptide Sequence Number=SeqID_121657
atgcaacctctagatggatcttactgtgttgttgctaaggaatctgttagcaagcagatctctattgctttccttgaacgtgtcaaggctgattttaagaaaagatatgggggtggaaaagcagatacagccattgccaagagtctgaacaaggagtttggaccagttatgaaggagcacatgaagtatatcatcaatcatgctgaagagattgtaaagctaataaaagtgaaggctcaagtttcagaagttaaaagtatcatgttagaaaatatagacaaggcccttgatagaggagaaaatctaactattcttgcggataagacggaggcattgcgttcacatgctgaggacttcctaaatttcaggctcaagatttcagaaagcaaggaacacaagttcgtcggaagatgtggtatcagaacatga

SEQ ID NO: 4880 - DNA, 318 bp, Glycine max
  Peptide Sequence Number=SeqID_121658
atggctgaggtttgggttttcaagaccggtgtggtgaggctagaagagaaaccatgtggctatgagcacaaggtgatgaagaaggtgctgtttcacactgcaagcaacgaagtcatcacttcctatgcagtgttggagcacaagcttagctcactggggtgggggcgttactacgatgaccctgatttgcttcagttccacaaacgctccaccgtgcacctaatttctctgccaagggatttcaacaagttcagggccacgcacaggtatgacataatcgtcaagaaccagaactgcttccaagttagggacgtgtga

SEQ ID NO: 4881 - DNA, 168 bp, Glycine max
  Peptide Sequence Number=SeqID_121659
atgggagtggaattgcagtcgcttccgccattctcatcagatgaggtttatggagtgtgggatcttcatgcaaatcttccagcacctcatgtactggcagacatgttagtgagtggctttggcagcaacgtcgacgatgcttggcgcgcggaagaagagaaaatctga

SEQ ID NO: 4882 - DNA, 111 bp, Glycine max
  Peptide Sequence Number=SeqID_121660
atggaggtggatgcggtcgtgatgaagttaatggatgatgatgttaaggtggaatgtcaatacttatggagcttttcgaaggttattttgtgtgcacaatgggatcactag

SEQ ID NO: 4883 - DNA, 866 bp, Glycine max
  Peptide Sequence Number=SeqID_121661
atgatgcaatcctaccccgcaagggcattggatagaggactccaagtagattgggccagagatccaagggaaggccctagggttctcatcaggcttagggaagcttctcaaggaggtgatcttagttatgagaggggtgtgtgtagcaaagctctagcttctcaaggaagttttctcaaagaagcttctcatggaagttttctcaagaaagcttctcaaggaagctacctagctcgtcttggtggtgaagctccttcttccatggcttattccctactcaaagatccaacctccatagaagccccacaagcaagcttccatcacttgggaggaatgaaaaaagttatgaaagaagacataaaaggaataagggaaaaagtgatcctgaggcctatcgaagttgaacaaatattttcctacgataatgaagagaggaaggacacagaacgaaatagggactaccccgtagatacttgggagaagatgaaaagaagtagaagtgtggatgagtacttcaaagagatagaggtggccatgataagggccagtgttgttgaagaaagggaggctaccatggtacgtttcctttatggaagactcccgtacacatctcaaggaagcatctctaatgactcatgtccaaattccccaccaacaagtgaaggagaagaagagtatgatgaagcctatgctctagatggagactttgggagttgcactaatgtggcaagcaagaggatggacactaaactcaacctaaagactattgcacatcctaagccatgcaagcttcgatggctaagtgaagagagagagagagagtttttcttggaccaacaagttttgattaattttcccacagggaa

SEQ ID NO: 4884 - DNA, 465 bp, Glycine max
  Peptide Sequence Number=SeqID_121662
atgttgggaaaggaagtcatcatcatctcaaccatgactattgctaaagttattgggtgtgaaccaggaacttcattgaaaggaacaagaacttctacaagaaagctaaaatctagcaatagatttgtaacaagagtattctacacaaggagaaaagccaagtccatcacagtcctggacgatatgaaagaaagggtggacaagtttggagttaccaaaggagctaataaagttgtaaagattcaatttacagcaaaacaacaagaaggactagctcaacaagagagtagaacgaagacaaggcaagagtccaaagcatccagtcctcctgcacctcaagtcaagggtccaaggactactcccacaaggaaaagtccaaggaagtatgttctagagaagaccaccaacaaaagactcagagagctctccgagtctggggttgatgatgatgcccctctcatttag

SEQ ID NO: 4885 - DNA, 423 bp, Glycine max
  Peptide Sequence Number=SeqID_121663
gaatttaaagatgtctttcccaaggagattccttatggattgccaccatcaagaagtatagaacatcaagttgatctctttccagaagcttcatcgcctaacaggccaacttacaacaacaagacccaagagactcggcataaggatgcagaggccaaatttgagtatgtgaaaagattgtttgaccaagtgaaggtgcaaattgcaaagaagaatgaaagctacgccaagcaagccaacaagaaaaggaaggaagtggtacttgaacccgatgatgatcctggacatttgagggcaaatgttttccaagaaggagggaatgatgagaatcttgaaactagccaaatacaggctaaaggtccaagtagagaaggacaaaggcctaagtggagaaggacaaagccctcgagtggagaaggatga

SEQ ID NO: 4886 - DNA, 426 bp, Glycine max
  Peptide Sequence Number=SeqID_121664
atggaggccacggaggaattcttggagacggcctttcaagcattcaaagtggtgagcaacgcttatgtggagtctcccccggtgcaaccgcgctcatcggaagccgcattgatggtagcccgtgtgatgttggggcatggatatgagcccgacatgggtttgggctggaaaaacaatggtgtggcgagcttgatagagttcataggaaaatgcagaaggttcaggctgggaaataaacctacacgcgccgacgtgaggaggttttccctagaaaggaggggaaggagcataggccattcgcatggaccgcaaatgaaaggggttcccttatgtcacatcgacaaaacctttgtcagcgcgggttggatgtgcgaagggcgggtcgccatgatacatgaagagacccctcaagagaaaccaaattag

SEQ ID NO: 4887 - DNA, 345 bp, Glycine max
  Peptide Sequence Number=SeqID_121665
atgacggaactcaatcagacatccgagaaaaaaacttatcaaggtaatccttgtggcgtctaccctgacttatcttccttcaccggaagtggcgtctacccagacttatcttccttaaccggaagtggcgtctacccagacttatcttccttcactggaaggggcgtctaccatgacttatcttccttcactggaagtggcgtcatccaaaccttcgtagcctgtatcaaacgatccactcctactcaggttcacatcattacttttcactcggaggtccaattcaagcgcatcacatatagggatgctcgaaatcgtacaacaaaggctcttggagaaatttga

SEQ ID NO: 4888 - DNA, 288 bp, Glycine max
  Peptide Sequence Number=SeqID_121666
atggcttccagggcttccgtaaaatttatgaaaaccttgagtaagcctatttcacttaatattggtgaaagggaagaggaaaaagaggaaaatcaagccctatatgcttccatgggagtgcaaatagcaattttaggcgagctgggcgtcaacctcctcccccctttttctataaataggcaaagggaggctggtcctaacccctattcccttggctatgcatttcagctgttttgggtgaaaaaaattgtttccgtgaagaaaatccaagccgaggtgcttccgtaa

SEQ ID NO: 4889 - DNA, 189 bp, Glycine max
  Peptide Sequence Number=SeqID_121667
atgctccaaccatatggaatcagcgtaggcttaaaggagcactcaaactcggtgacccccaaggcctacactccgaagagtccgtcagggcctctccctcctgattcagttttaacttgtcaccttttaaggatcttagcattaactcgtcgccctaaaagggacttaacattaactcgtcgcccttaa

SEQ ID NO: 4890 - DNA, 264 bp, Glycine max
  Peptide Sequence Number=SeqID_121668
atggagatgcagaggaagacaaaggagaagaggctctgtagcatagtcatgataggatatgagctcggagcagacgaagctagaggaactggagctatcagtggtgaaggaagagtagaagtagatggagatgaagtagagggagcagtagtatcagggggagttgaagtggatggggccttagatcctctagccctggatttgtgggtccctgggaaagtgatcgaagggtcatccaggttccatcaattcttcataatataa

SEQ ID NO: 4891 - DNA, 262 bp, Glycine max
  Peptide Sequence Number=SeqID_121669
gagaaaacatagagacaatgaaaaaatattgagtctttggttcaacgatcaagctgctaaaatcatgaaaggagtctttgtgctttcttcaagaattgacaaaccattttgtaagtacgatggtttcactacacgaaagtgtgtagcaaaggtttacatcaatattgtggacttatcattggttgaaagtgtgaggattccatacatgaaaaatttacctccatattacattttggatgcatgttgttcggtgtgcatttga

SEQ ID NO: 4892 - DNA, 243 bp, Glycine max
  Peptide Sequence Number=SeqID_121670
atggccaagtttgaccctaagatagtcctagagttctatgctaatgcttggcccacagaggagggagtgcgagacatgcgttcgtggttttggaggaaggccagtagtgtgagtccagccagaggaggaacaaggccgacgggatcgatgaggaagccatttcccaactgttgtgcacaccggggcaggatttcgcccggtccgctgcagggaggcgggtgcggatcatgcgcaccagcatga

SEQ ID NO: 4893 - DNA, 873 bp, Glycine max
  Peptide Sequence Number=SeqID_121671
atgccctcacttcagaggactatgcgtcttcaccttcagagggcttacccactcgccttcaggggacttcacgtcctcccctttagaggactgcacgtcctcggcttcggaggactacatgtcctcacctttagaggactacacgtcctcggtttcagagaactacacgttctcagcattagaggactacacgacctcatcttcagaggactacacgtcctcgtcctaagagggctacacgccctcaccttcgtagggctgcacgccctcacctttagaggactacacgtcctcgaattcatagggctgcacgccctctccttcagaggactatacgtcctccagtttagaggactacatcttctcaccttcagaggactaaatgtcctcggcttcagaggactgcatatccccaccttcagaggactacacgtcctcaccttcagaggattacaggtcctcagcttcagagggccacacgccctcgccttcagaggactacacgtcctcgccacaaagggccacacgccctcgccttcggctgcacgccctcgccttcagaggactacacgtcctccccttcagaggactacgtgtccttaccttcagaggactacatgtccttaccttcagagggctacacgtcctcagcctcagaggactagacgtcctcaccttcagaggactacacgtcctcaccttcaaaggactgcacgccctcgccttctgagggctacacgccctcgccttcagaggactccatgtcctccccttcagaggactgcatctcctcgcctttacagaacgacacgtcctcaccttcgaagggctgcatgccgtcaccttcatagggccacatgccctcacctttag

SEQ ID NO: 4894 - DNA, 3369 bp, Glycine max
  Peptide Sequence Number=SeqID_121672
atggctcacactcttcacaaacccttttccatactattattgttatacttcactttttccttcgcttcacaacactcacaccatggattctcgatcctcgattccgatttcgacgcgctctacggcgactacacgcccccttctccgccgccgccgcctccgttgcctcacccgccctccctcacgtgcctggagggtctcaacgggacgggctccctgaccaccacatgcgatctcaattccagcctaattttcaatagcgacgtgtacatagaagggaacggaagcttgaacatacttcccggcgtgaatttgagttgccccgtgtctggctgcgttattttgattaacgtcagtaacgaatttagtttgcagagtggtgcggcaatagttgcagggacagtgcttgtggcgtcgcggaacgccaccttgtttggcggttccgtaataaacgtgaccggattggccggggcgccaccggcgcagacgagtgggacgccgtcggggacgcagggggcgggcggagggcacggcgggagaggtgccacgtgtgtttcggataatacaaagcttccggacgatgtgtggggtggggatgcgtattcttggtcgtcgttggatgagccgtggagttatgggagtaagggtgggacgactagtaaggaggagaagtatggtggggaaggaggcgggaggattaagtttgcagttgtggactccattgatgtgtctggggatctcttggcaaatggaggggatggagggatgaagggtggaggaggttctggtggcagcatttatgttaaagctcatagaattttgcaactaatcgtgtcctctaccaagtgcagaactggaactggcacaatcagtgccactggaggtggtgggtttgctggcggtggaggaggaagagtttcaattaatgtcttcagcagacatgacaatacaaaattcttcattcatggaggaattagtcttggatgttccagaaatgctggtgctgcagggacatattatgacgctgttcctcggagtcttaccatttgcaatcataacttgtctactcaaactgatactcttctgttagagtttcctaaagtgcctctttggacaaatgtttatgtccagaatcaggccaaagcattgtttcctttatattggagccgtgttcaggttggtggactaattcgcttgacttatggtgctgttctaagctttgggcttgctcattatggttcatcagagtttgagttaatggcggaagagcttttaatgagtgactctgtagtcaaggcaagtagaactattagacttctctttctaagaacaattatatatggagctcttcgtatgtctgtcaagattcacctgatgttgaattcaaagatgcttatagatgccaatggtgatcaaattgttgcaacatccttacttgaagctagcaacttagtagttctcaaggattcttctgttattcattctaatgcaaatttgggagttcacgggcaaggatctttgaacttgtccggagctggaaacttgattgaagcgcaacatctgattttgtcattgttttttagtatcaatgttggccctggatctgttctaagaggacctttagaggcttctggtgatgatatgactccacaactttactgtgaagttgaaaattgccctgtggaattgcttcatccacctgaagattgtaatgttaattcatcactggctttcactcttcagatatgtcgggttgaagatgttattgttgaaggcaccataactggttctgttgtgcactttcactggattagaaatatagatgtttcttattcaggagtaatcagtgtgtctgggctgggctgtactggtgggttaggtagggcaaggtattttgaaaatggtattggtggtggaggtggacatggaggatatggtggggatggatattacaatggcaatttcattgaaggtggttccacatatggggatgttgatttgccgtgtgaacttggaagtggcagtggaaataatagcctagctggtgcaactgctggtggtggcatcattgtgatgggttcactggagcactcactgtcaagtttgactttgaatggctcacttagagccgatggggaaagctttggagatgacccaagagggaaggatggtgggattacttcaagcattggtcctggtggtggttctggtggaactgttcttttgtttattcagactttggcacttggtgactcttctataatctcaactgctggaggacaaggtagtcctagtggtggtgggggtggaggtggcggaagggttcactttcattggtctaatattccagttggagatgaatatgtccctttagcaagtgttaagggaagcattattactggaggaggatttggtggaggtcagggccttcctggaaaaaatggatctatcagtggaactgcttgtcccagagggctttatggtatcttttgtgaggaatgccctgttggtacttataaagatgtcagtgggtctgatagagctctttgtcatgattgtccccctgatgagcttccacatcgtgccatatatatttctgttcgaggtggtgtggcagagactccttgtccatacaagtgcatttctgatagatatcacatgccaaactgctatacagcttttgaagagttggtctacacttttggtgggccatggctcttcggtcttctactcttgggtcttcttatcttgcttgctctagttctcagtgttgcacgaatgaaatatgtagctggcgatgatttaccagctgttacgcctgctcgaaatgacactcgactgaaccactcttttccttttcttgaatcactgaatgagattatggaaacaaacagaagtgaggaatctcagagtcatgtgcacaggttgtatttccatggcccaaatacattcagtgaaccttggcatctacttcattgtcctccagagcaagtaaaagatattgtatatgaagatgccttcaatagatttgtggatgacattaatagtttagctacttatcactggtgggaagggtctatttacagtatcctttgcatcattgcatatccccttgcttggtcatggcttcaaatgtgtcggagaaagaaattacagaaacttagagaatttgttcgatcagagtatgaccatgcatgcttgcgctcttgccgttcacgagcactttatgaagggctgaaggtacttcagagtaaattttatgaatttgttccttaccctaaattgggctcttggcatactaaatttttgtctcagttcattcattactgccctactgaacttaatttacgttatgtttatacaatttaa

SEQ ID NO: 4895 - DNA, 252 bp, Glycine max
  Peptide Sequence Number=SeqID_121673
gagctgtcagaacttaagaaaacacttaatgttgaagtggaccaactcagagcagaatttcaagatctgaggactaccctgcagcagcaacaagaagatgttactgctagcttaagaaacctggggcttcaagatgtctcagatgtcaagcatgctccatcgcaggaaacaaagattgaagaaattgtgaaggaagaacaggtggtggtacctgaagaagataatagcagcaaagatttaaatcaatggtaa

SEQ ID NO: 4896 - DNA, 378 bp, Glycine max
  Peptide Sequence Number=SeqID_121674
atggttcaccatttaagcttggcagggaaatacggcgatgcaagtggccaaaaagaaaatatgaaccaaatgtcgcagtcatttctttcccaattaaaaggagatacatttccggtaggctgcgcctttgataaggcaaatattcatgacaaggacaacccggattccgaataccctgctaacaacactaaaaaggggatctacgccgaaggatgtggactagagaacgtaacgatgtcttgggaacatgatgaatacatgtatatggttgctaaggaaaatagcaccactcttccatctactggattgttcattatcagatttcactctatcatttgtgtatttgtgcacatcttatcttcacagcttttcacataa

SEQ ID NO: 4897 - DNA, 1134 bp, Glycine max
  Peptide Sequence Number=SeqID_121675
gtagctgcaacatctgatctgatgctgggatatctggatttcttccttggtggggatgagaaaagacctgatctgcctcctcgtctttatcaaagatttcccatgtctataatttttgggggagatggaagttacatgagtcctttctctattcacagtgataatattcttactagcatcatgagtcagtctgttccaccaactatatggtatcgattagtggctggtcttaatgctcaactacgattggttcgccgtggacatctaaaaataacttttggtcctgttatcagctggcttgatgtatatgcaaaccctaagttggctacatatggggtacgtgttgatcttgcatggtttcaacctacagcttctggatattgccaatttggacttgtggtatatgctactgagaatgaaagcatgtcctcatcatgcgaaggttatgatgattcaagaataactgaaaaggagacatgtttactttcaagtcccagaaaccctgcgcgctacatgagaagcaatgaacacctgatgatgcctagaaggatatctggtgggatattgcatgccaaaagcctaagaacacttaaagagaagaaaactgtatgctatccgtttgcttttattatttataatacaaagccagtcagtcatcaggatctagttggtctggttatctctataatactcctgggagattttatcttagtattgctcaccttgcttcagatgtactcgctgtctctgttgagcttcttcttagttttatttgtcctccctcttggtgtcctatttccatttccatctggaatcagcgctttgtttagtcaaggacctaggagatcagctgggcttgctcgactgtatgctttgtggaatctaatgtccctagtcaacgtagtagttgccttcttttgtggctttatacattatacagctcgttcacataagctttacaactttcaatcctggaattttagtatggatgaaagtgaatggtggatacttccatctggtctggccctctgcaaaatcattcaagcgcgtcttgttgattgtcatgtggccaaccaggaaatacaagatccctcattgtatagcagtgacactaacgtcttttggaattcttga

SEQ ID NO: 4898 - DNA, 801 bp, Glycine max
  Peptide Sequence Number=SeqID_121676
gtgcaccaagctgtcatgaaggatggcatgcaagttgcaatgaaaattcagtatcctggtgtggcagatagcattgatagtgacattgagaatgtgaagcttcttttaaactacacaaatttaattcctaaaggactttatcttgacagagctataaaggtggccaaagaagaattatctcgcgagtgtgattacaagttggaggcagcgaatcagaagcggttccgagatcttcttactggcacagatggactttatgttccaatagttgtggatgatatttcaagcaaaagagtattaactaccgagcttgttcatgggtgttctttaatgcagactgatcctaattggggtaatttcttatttgatgaagctacaaagacaatcaatctgattgattttggagcagcaccatgtgcaaatggtgatagcgatggggttgttgagatgtccaggagactagggttcctcactggaatggaatcagatgtgatgctagatgcccacgtccaagctgggtttattgtgggtttgccattctcaagacctggtggatttgatttccgatcaaccaacattactcaaagcatttctcatcttggggcaacaatgctcagacacaggctcactcctccacctgatgaagcctatagtctgcacagaaagctttccggtgcttttttggcatgcattaagattggggccgttgtcccatgtagggaactgctgcttgaagtatacaagcatcataagtttggtgaagaaaatgagatattatccactggttcagtgtctgcatag

SEQ ID NO: 4899 - DNA, 294 bp, Glycine max
  Peptide Sequence Number=SeqID_121677
atggatttggctacttcaattgatgagggatatgttcaaaagtttactagagtagtgaaggagtttaatagcataaccccattggtatacttctatatacaaataagagagctttcacaaggggcaagtggtaacgagaaagaacaactcaccagcgaagatggcgttggggtgatactccggcgaaaggcggcgagggagctgaggctagggttccacggcggtggcgagggaggacataagctagcgtggatcactagcctaagtctcctcccggtgcaagacaacttctaa

SEQ ID NO: 4900 - DNA, 894 bp, Glycine max
  Peptide Sequence Number=SeqID_121678
atggcctccttcagggacctcacaaggctcttcaatggcttttccctaatcgccaaccaattcgcgaagcgctctttacctaactccacaacctcagatttccaaaccctaattaagaaagctctcgtctccgccaccgacctctccggcatcaccaaaggaaaggttcgccacttccccgatactcctccctcctctaccgccacacgacgccacgacgctgctgcgtctagttccgttgtttttttctccgacgacattccttcttctcaatcccattctacaccgacaacaaccactacagtaacaaatattgacgatgttgccaagtcttcttccgacgcaaatcacgatgcaaaggaggagaaaagtgaggttgtgacctctgctgaaacggttaatcaagttgaaagtgaggaagtggcaccggcactggcaccttctccgcccccgttgaggaaacgaagaccgagggagaggaaggttcccgcaactccattttctagggctattgggtttgctgggttaggagcaggtcttgcgtgggggacacttcaggaatctgccaagaggcttgcctttggtacgcctactacgcaaggcaatcaatctgcactttccccgtttttgtctgaaaaaaatgccgaacgtttggctcttgcgctatgcagaatgcgtggagcggcgctcaaaattgggcagatgttgagcatacaggatgaatctcttgttcctgctccgatcctggctgcattagaaattgttcgtcaaggtgcagatgtgatgccaaagagccagcttaatcaagttttaaatgctgaattaggtcctggctggtcatcaaaattaattagttttgattatgaacctatagctgctgcaagtattggccag

SEQ ID NO: 4901 - DNA, 363 bp, Glycine max
  Peptide Sequence Number=SeqID_121679
atggcaaatgcgggtactaataccaatggcagtcaattttttatctgcactgtacagggcattatttttgctgatacggaagtgccttatattgacttgcgtttcttgaatcaatttaataactatggggataacattactgcaattgaaactatggaaccacagtcaagaattcataaaagtaaaaggaactatagtgtaattcagactccatggttagacaatcgccatgttgtgtttggacatgtcattgatggaatggatgtagtgaggacacttgaatcgcaggagacaggcaagtttgataaccctcggaagccatgcaaaattgctgattctggggagctgcctatagatagttga

SEQ ID NO: 4902 - DNA, 815 bp, Glycine max
  Peptide Sequence Number=SeqID_121680
aacctcttttgtctgatctacccagtgtcccgcgtccagaggagccaaaatcagtgtatactggtggtgattatagatgtcaaaaggaatcagggaggacccattttgctctagcatttgaacttcctggtggctggcataagttgaaggatgctatggttttgactgttcttcagatgctattgggaggcggtggatcattctcagctggtggacctggtaaagggatgtattcacggctatatcaaaatgttctgaatgaatatccacaagttcatgaaatttcagcattcaacaatatttacaatgacactggcatttttggtatccaagttacaacaggctcagattttgtatcaaaagccattgatatagctgctaatgagattcttgctgttgctactcctggacaagttgaccaggtacagctggatcgagccaaacaggctaccaaatctgcaattttgatgaatttggaatcaagaatggttgtttcagaagatataggaagacaaattttgacatatggtgagaggtatggctcacatttcattttctttggtggtttagtatcttggtgtattgcaattctgttctgcaatgagtataagagtgcggacatgatgctaaaggatgtcttctccctactcaggaaacctgtggaggatttcttgaaggcagtggatgaagtaacctcgaaggatatcacttcaatttcgcgaaagctcatttgttctcctctcacaatggcatcatatggagatgttctctatgttccaagctatgaatcagtgagtctcaaattccgtgcctaa

SEQ ID NO: 4903 - DNA, 717 bp, Glycine max
  Peptide Sequence Number=SeqID_121681
atggcatattggttcaaccttcaacgtaaagatcagggtggtccagaccttgaagatattctagagggcagtgactttttgagcttcatccctgacagatacaaggttcgtttttatctcattgcaaagtctaccctctatgagacgaattggcaaccacatctttggcttaacatcaacagtggcatgttttggggtggtggcggtgacaaaggtggtattgttggtagtggtggtgacgacaatgacatggtggtgaaattgatggtggtgatggaagcaatgtcggtggcaacgatggtgacaatgacgtgcgatgctggtagtgaggtggtcgtggtggtggcaatgacgaaggcagtatttggtggtggcaatgatggtggtggtggcggtggtaagggtggtggtaacaaaaagtatcattgtcgaatgtgggaaatgcctgtgttggtgcagaaaatgttcaagaacacattccaatatgggtttctttccaacggcttcatcacctctatgcacaccccatcctcaactaaggactcttctgacacctcatcatcttccaaagtggtggggtcggatttggaagcacagtataacaaagatctgaacttgaaggagcatggtttgggagtggatagggaatggaaaacgcagtgtgattctggggaaacaggaatggcgcgcattgtttctgtggtgctctcttcttag

SEQ ID NO: 4904 - DNA, 552 bp, Glycine max
  Peptide Sequence Number=SeqID_121682
atgaattcttcaacaccatgttcattattgttcaccctttgcttgatccttataatttcccagtctcctttgccaacaaatgctagagctcatggtcattacatgattggccaaatttgcaagcaattaacaaggcaggaggacaagataaaatgcccgatcattctgagagcaaatcccaaaatcttgcgtgcaaaaaactatcttgaattttcatcagcggtcctggagttagggatgcacaagggaatagaagggcagaagtttcttaagggattggtgaaggcaaaatcttctccggccattgcggaatgtgcaaacttttgttatgatgcggtggttaacggtttcaaaggtgccatgaatgagctgaaagatgatcctatgacggctaactatgatgccggtgttgttagtgatggacctgcaacctgtgagagagcattagctgatgaacatattgttgaccctgcaatttctgctcttaacaaccgtataatgttgcttagcgccattgcatcctacgccatagataaacttattgcaaattaa

SEQ ID NO: 4905 - DNA, 774 bp, Glycine max
  Peptide Sequence Number=SeqID_121683
atgacggcttcaccggacggcagcgtgctgtacattaccaacacgctggacggtggcgtgacaaaagtggacgccagaagcggtaaagtgctgcagcgtctgctgtttggcctgaaaaacgacaaaggcaatccgattggcgcgcgtgaaatcctgctgcatgacggcctgctgtacatcggtgcgattgagaatccggcgatgatttgggtggtcgatgcgaatacgctgcggctgaaaaccaccatcaaaaacgccggcaagtgggtgaccgggttgctctattcagcgtcaaccgaccgtatttacgcggcgaacggcagtggcgaagtgctggtgatcaatccgcgcactcacaaaattgagcagcgctggacgccgggcgatggcaaagagtatctgctgttaaatctggcggaagatgccgccaatggccgcctgtacgtcactgacaattctaagggcaaaaccacgctggtgttcgatgagcgcagcggtaaggtgatcaaacgcctggatgtcggcgattcgcttggcatcaaattcaatgcgaaacgcaacgagatttacatcagccagcgactcggcggcaaagtgctgcagctggacgcgacgacctacgcagtgaaaaatagctggacgctgccgacccaccctaacagcctgctggtgtcgccagatggtcagacgctgtacgtgacggtgaagcaggggctcaataaagatcgctcgccgcaagggccggatagcgtggtgcggattacgctggattaa

SEQ ID NO: 4906 - DNA, 744 bp, Glycine max
  Peptide Sequence Number=SeqID_121684
ctctattcgctggggacgccaaacggccagaaagtgaccattctgctggaagagctgctggcgctcggcgtgcaggaagcggagtatgacgcctggctgatccgcatcggcgacggcgatcagttctccagcggcttcgttgaggttaaccccaactcaaaaattccggcgctgcgcgaccactcgatcacgccgccactgcgcgtgtttgaatccggcaatatcctgctctatctggcagataaattcggccactttattccctctgacgtggcgggccgcactgaaaccctgaactggctgttctggctgcagggatccgcgccctaccttggcggcggtttcggccacttctatcactacgcgccagaaaaaattgaatacgccattaaccgtttcacgctggaggccaaacgtcagcttgatgtgctggatcgccagctggcggaccaccgtttcctcgccggcgacgaatataccattgccgatatcgcgacctggccgtggtacggcaatctggtgctgaacaaccagtacggcggcggggaattcctcgatgtgcagtcgtacaaaaatgtggtgcgctgggcaaaagagattgccgaccgtccggcggtgatccgcgggcgtaaagtgaaccgggcatttggcgccgagccgcaggatcagctgctggaacggcacgatgcgagcgattttgataccaatactgaagacaagcgtcaggcgcgaggcgaacaataa

SEQ ID NO: 4907 - DNA, 450 bp, Glycine max
  Peptide Sequence Number=SeqID_121685
atgatgaaagagaagaaagaattccctaagttagacataggaaaacaacctggaaggaagacatttgtcatcttgggttatgagaagggtgacaaatatagacaatacaaaaaagatacaaagatagtcactaggactaaaaaatgttattgcctttttaggttgaaaggaagaccactaaagactagtgaaggatgggtacttagggttctgtgtgggtctcataatcatgatattgctaagacattggttgactatccatatgtcggtcgactaactctagatgagaagacaatgcttattgatatgacaaaaagtatggtgaagcctaaaaatattcttctaacattgaaagaacacaatgacaaaaatgtcaccaccgtcagacaagtgtatattactagaactacatatcgaagatctcttagaggccctagaatagaaatgtaa

SEQ ID NO: 4908 - DNA, 420 bp, Glycine max
  Peptide Sequence Number=SeqID_121686
atgagtgaagaagaagacaaggtgcaagagcagataaaggccgacatagaggccttgaaagagaaaatggccacaatgatggaggccatgatgagcatgaagaagataatggaggtcaatgcggtggcagttgccgctactagtgtcgttgctaagaaaggcaaagaattgggaagtacaggcggcccccattttgtgcaagttcaaaacaagcatgccttcccgccatatggcttgcctcccaattatacaccacccaatatggtgcacactcctaatgagaatgtcaatgactccactcccatactcattaagagccaacaacctcaatctgatcatgcacctatccctcaacctatgggggcgacacatgaaataccccaccacaatctagccaactttgagccttgtctcgaatac

SEQ ID NO: 4909 - DNA, 1707 bp, Glycine max
  Peptide Sequence Number=SeqID_121687
gtgccagagtttcaaagtgacgatgatgcagtttatcaattggaaaatttgctgaaacagattgggaaaaacccaatactgttggtcctggatgatgttccgtccgaatcagtgtctcttgttgacaaatttgtgttccagatcccaaagtacaagattctagtgacctcaagaatcacaattagaggatttgaccagccatacgtgttgaaatcactcaacgaagtcgatgctataaatttatttcgccactctgcatccctgaatcagagtagctctgacattcctgagaatattgtcaaaaagattgcgagagggtgcagtggttctcccttggcacttatagtgactggcaaatcactaagtcgtgaaccaccgtgggcttggaacaacagggctaagaaactgtccaagggtcaaccaattcttgcttttagtgcagatgtgcttacttgtctccaaaaaagcttcgatgacttggatcctaaggtggctgagtgttttagggacctaagcttattccccgaagcccagaggatacctgctgctgcccttgttgatatatgggcagaactgcgtgatgaagatgatgacagcgcaatggagaatatctatgaactcgtcaaaaggaacatggctgatattgttgtcacaaggtatggcaaatgcttcttgaaagatgacacgaatatttcaagtggcacgattgactataattaccactatgttacacaacatggtcttcttcgggacctagctatccttcaaacgaacaaggaactaatgaagaagaggaatagactgattattgacgtaagtggtaacaatcttcccgattggtggactacacagaatgagtatcacattgcagcccactcactatccatatcaactgatgacacattcacttcagaatggtgcaacttgcaggcatctgaggttgaggttctagtgctgaaccttcgagaaaagaagcggtcgctaccaatgttcatggagaaaatgaataaactaaaagtcctgatagtaacgaattatgagttctatcgcgctgacttggaaaattttgagctgcttgataatctgtctagtctcaaaagaatcagattagagaaggtttcaattcccttcttgagcaacactggagtgcaactgaagaatctacacaagttctcctttttcatgtgcaatgtgaatgaagcattcaaaaatagcaccattcaagtttcaaaagtgttcccaaatttggaggagatgaacattgactactgtgatatggtggaattgccaattgggctctctgatattgtttccctaaagaagctaagtatcacaaactgtcacaaactttctgcacttcctgaaggaattgggaagttggtcaatctggaatcactaaggcttacttcatgtactaaattagaagagttaccagaatcaatcacaagtcttagtaaactgaacttccttgacatctctgactgcgtaagccttagtaagttaccagagaacatgggagagttgcgtagtttagaaaatctcaattgcagaggttgcacaagattgactgatttgccatactcaatcacggagcttgagagcttaagcgctgtggtgtgtgatgaagagactgctgcattatgggaacctttcaaaaccatgcttagagatctaaagcttaaggatgaaaacagggaaggcaagtaa

SEQ ID NO: 4910 - DNA, 387 bp, Glycine max
  Peptide Sequence Number=SeqID_121688
atggcggaaacagaggatagtggcgcttacctccatggtcgacgctccctcgacggtggacggtggttcgtggctcctcttcacggcaacaagaagaacaagaatcaaacgcaagctcctcttcacggcaacaatgaagaagaaggtagcgcgagaaagacaggtctaagaggtcaccaacacaatatgaaaatggctctgaggaagaagaagaatcaaaggttgtgtgaggaagaagaagaatcaaaggggctgtgtgaggaagaagaagaagaagaagaaactgcaacggagagaaagagtaacgggagagagagtcacgcattttttaaaaaaattacccaagggtattacgaccttttcacatcaagtgttgggtgcacctag

SEQ ID NO: 4911 - DNA, 235 bp, Glycine max
  Peptide Sequence Number=SeqID_121689
gtacgagcagttatgcaagtgggatcagcaatctttcattatcagagtaatcaagcacagcggtatctgtagtggcgacagcaaaattctgcaagttgcaagtcgtttccaggatgtcaagacatctcacgtgacatcagctttctgctccccctgtctccatgctcctactactgtgaagcagttcactgcggcatcttctagtagcttacaacaatcatcatcagagcagtag

SEQ ID NO: 4912 - DNA, 309 bp, Glycine max
  Peptide Sequence Number=SeqID_121690
atgcttgtgtatggctggttgtggaaaggagttttctgcctctgccctgttttcttggctgtgttagttcatgatgcttggatattgaattacttggatgttgtggaagcttgggaggatttatggggacccgatgttgagaggaacgaggataagggctacgtgggagtacgtgagctcaatgaaggtgggcaactggggatggtgggtttatgtgtgatttgtggatgtggagaattgatttgcaccatcgcccgactgccacctagtaccacatgtgatgggtaccccataatcctacaagcttga

SEQ ID NO: 4913 - DNA, 147 bp, Glycine max
  Peptide Sequence Number=SeqID_121691
atgggtacaattgatattggacttgtctaccatggagacacgtcttgtgctcttgctggttatttagattttgactatgctgtagatttggatgcaaggagaactatgacaagcttctatggaggtagggtctttgagcttcaataa

SEQ ID NO: 4914 - DNA, 181 bp, Glycine max
  Peptide Sequence Number=SeqID_121692
gagcttggaagatcttgtaaagccagagaaccctcacaacaaaagattgaagtcttacaagagctatgcaggagggggcagtgtcactaacttcatgggtagtaatagtaggccatcaattccttctcatagatctaccagcactaacaccatccctaatcaaactgtgttgtttgcttaa

SEQ ID NO: 4915 - DNA, 2313 bp, Glycine max
  Peptide Sequence Number=SeqID_121693
atggctacactctgttcgagttctgtggatcgtagtagttttactgactggatgagggacaggccagagctctacagcattattcgcagggcgagccctggtgcagcggtaaagttgtgccttggtgacttgttggtcatgggttcgaatccggaaacagcctctttgcatatgcaagggttgttgaggagaaatccaatgggtgcacttggatattccaatttgaagccatctctaaagaagatagctgaatctactgatggtcgtccttctgagatgagtgtggttgctgccttgagaaatggcgaagttcttggcagtcaaactgttttgaaaagtgatcactgtcctggatgtcaacatccaagattacccgagagagtggagggagcaccaaatttcagagaagttcctgggtttccagtttatggggtggcaaatccaactattgatggtattcgatctgtcattcgtaggattggtagctccaaaggtggacgcccagtactttggcataatatgagagaagaacctgttatttacatcaatgggaaaccatttgttcttcgtgaagttgaaagaccatacaaaaacatgctggaatacacgggaattggtcgtgaaagggtagagaaaatggaggctcgattaaaagaagatatcctacgagaagctgaacagtatggcaatgcaataatggttatccatgaaacagatgatgggcatatatatgatgcttgggagcacgctgatggatttccgattaagtatgcacgtgttcccatcactgatggaaaagctcctaaaagctctgactttgacactgtggctttcaatattgcttctgctgctaaggacactgcttttgttttcaattgtcaggtagtttcttcatcctttatctcctcttctgtattctttgtggacatcttcatttatatttctgtctattggttcttctcttgcctagtatttctcttttcgtcttttactgctaatatccctttcatatatcagatgggtaggggcaggacaaccactggcactgtcatagcatgccttgtgaaacttcgaattgattatggaagacctattaaaatattgagagatgatatgacccgtgaagaagcggatgggggtttctcgggtggagatgaagttgggggctatgttactgcattaactcctgatactttgcaaataatgcctgacgagaaacaaagtcatgcttttggtataaatgacattctcttgttatggaagataacagcattttttgataatggggtggagtgccgggaggccttagatgctattattgatagatgttctgcacttcaaaacattcgccaagctgttttggaatatagaaaagtattcaatcagcaacatgttgagcctagggtaaggagggtggcattatatcgtggtgctgagtacttggaacggtacttccgtcttattgcttttgcagcatatcttggaagtgaagcatttgatgggttttgtggacaagcagaatacaaaatggcatttaagaattggatgcatgaaaggccagaggtgcaggctatgaaatggagcatcagattgagaccagggcgattttttactgtccctgaagagttgagagcaccacaagaatctcagcatggagatgcagtaatggaggctttcgtcaaagcccggagtggttctgttcttgggaaaggctacatactgaaaacgtatttctttcctggtcagagaacttctagccacatacaaatacatggtgcaccacacgtttacaaggttgatgaattccctgtgtatagcatggcaactccaaccatctctggtgcgaaggagatactatcctatttgggtgctaagcctaaagcaaatgtctcatctgctcaaaaagtgatattgactgatctgagagaggaagcagttgtctatatcaaaggcactccctttgtcctaagggagttgaacaaacctgttgatacactcaagcatgttggaatcactggtcctgcagtggaacacatggaagcacgattgaaagaagatatactagctgagattagacagtctggtgggctgatgctgtttcatcgtgaagaatatgatccttcaacaaataagtccagcgtcgttggatactgggaaaatattttggcagatgatgtgaaaacacctgcagaagtttattccaccctgaaagatgagggatatgatattatctattcgaggataccattaacaagagagagagatgctttggcctctgacattgatgcaatacagtactgtaaagatgagtaa

SEQ ID NO: 4916 - DNA, 210 bp, Glycine max
  Peptide Sequence Number=SeqID_121694
atgttgagctgtgaaagagaattggcagcaccacaaaatcacatgtatcagcaatgggtctacaccagttctacccccagccactcctccatcactgacagcactggcaacaactccagcgagtccggtctgattgagaaatataatcccaacctactacctagttcagcccatcattgctcaatccaacaggttagtgctctctggtaa

SEQ ID NO: 4917 - DNA, 405 bp, Glycine max
  Peptide Sequence Number=SeqID_121695
atgtcaactcaaagggaaagcacagagagcggagctatgaggaaacgaatgaaacatgaggtggcagaaaaggcgggagatgaagcagaatcaaagactgtagaggaggaagaattcgagaccaacattgctggatctgaagaaatggaactcagtgtctctcttattcttgagaagattgagagttatactcagagggtatctgagctcctagaatcagggaaaacaatgttgaaggagctaagcgatgaatttgaagagaaactgattatgattcacaaggagcaagtggaaaaatggcaagaagaaatcagagaactgcgtgcactcgatgcttcaaatgaggaagccaatgctcttctgcataatgctcgacatcttcttcagcccactcgcgatcattag

SEQ ID NO: 4918 - DNA, 309 bp, Glycine max
  Peptide Sequence Number=SeqID_121696
atgaccaagctcaggtcttgcatccatccatgcagaaaatttcatgttcgcaggagaggtgcagtaaaggaaacgtcaagagaaagagtttacagagaaatgggattaaaaacagcagcaaaacatgtcccccaacaaactcaaatagggtttctcaataaccacaaactagaaccaggtaaggatgggttgaaccctagaatagatccaagggatgtcggtgaacaaaatggtggaagtggcaagaccaagattgacagggtggtgctagctaggccttcacatgctagcaacgacaaaatcatctaa

SEQ ID NO: 4919 - DNA, 291 bp, Glycine max
  Peptide Sequence Number=SeqID_121697
atgcaacaaggacaggcagttatcctcatagctaggttccctgactctaactatggtattaaaacgaacaatggtggtttgtggtggctactggtggctatgggtgacggagaaaaagcatggaacgctggaaatggttttggaagaaagaaaggagaagaaatggcatttttcctaagctacttggactacaaggctcaaaacgcacaagtgagcaatgctctcgggaacggaaacgtcgcgcacactccagaaattttcacaaagatcccaactgtcagatcatggtaa

SEQ ID NO: 4920 - DNA, 192 bp, Glycine max
  Peptide Sequence Number=SeqID_121698
atggccataatgaaggatttggggaaaaaggggaaggaggcagtgaaggaggattggtgggtaacaatgacatttgtggcaatgatgggtggtgacccaattgccagagacaatggaaagggagacaaaattaatctaaggattcacaataattgtacactgtggatcacttgtgatagtggtccaccctaa

SEQ ID NO: 4921 - DNA, 627 bp, Glycine max
  Peptide Sequence Number=SeqID_121699
atgacatcgataccgaaagagccagaggaggtgatgaagcggagaggaggatccgtgttgggaaagaaaaccattctcaagagcgaccatttccccggttgccacaacaagcgcttgcatcctcacatcgatggcgctccaaattaccgtcaagctgagtcgttactcgtgcacggtgttgccatcccaaccaccgatggaattcgaaacgttctcaagcacattggtgctcgagctgagggcaagaaagcgcaagttctttggattaaccttcgtgaggaaccggttgtgtacattaatggacgtccctttgttttgcgtgacgtggagaggccattttccaaccttgaatacacgggaattaatagggaaagagttgaacaaatggaagctcgattgaaagaagacattttgatggaagctgcaagatatgaaaataagatccttgtgactgatgaactgccagatggtcagatggtggaccaatgggaatcagtgtcatgtaattctgtgaagacaccactagaggtgtaccaggaattacaagtggcaggataccttgttgactatgaacgtgttcctataactgatgaaaaatccccaaaggaatgggattttgatattttg

SEQ ID NO: 4922 - DNA, 684 bp, Glycine max
  Peptide Sequence Number=SeqID_121700
atgttgatgttaaggaaagttgcgatccgcactgaacttgcaactgaaaatgggttgtcttatatttccctgaatttggaaaaccacggggctgcattccggttcgcctccgaactgaaagacgaagcgagggtccggttcggagcggaccacgaggtgaagctgggcggatggtttattattattattattgtggggcccaccacggaggttgagccagccgttatggaaggtgttggagtgagagagggcagcggggaggttaatggtgaggtggaggctgcccaaaagcttggcgccgcggaccccgcaggagcggcccattgggccgttgtagacggagagagcgagggtgaggggcttggcggagaggcggcggagggcggcggggtcgaggtggaaggcgggggcggaggtggtggtgtcgggggcagaggcggaggaagagagagggaggagggcggtgtgggaagggaaagtgttgatacggattttgcagaagcagggggtggtggaagggtggacaccggagaggggtgggggtttggccggagaggaagggagcttgagagcgagggattccaccaagaggcgaaggaaggggcaagggtccatgactctggctcagacattgggaacatctacctttgtggactacaaatatggctgtcggcttcgggttaa

SEQ ID NO: 4923 - DNA, 458 bp, Glycine max
  Peptide Sequence Number=SeqID_121701
atgatttctaaggaattaaacttgtggtacaatgccatgaaagatgagatggattctatggtgtctaaccaagtctgggatctcgttgagttgcctgatggtgtaaaagccattggatgtatatgggtctttaaaaccaagaaagactcacaaggcagcattgagagacgtaaggcaagacttgttgccaaaggttttactcaaagagaaggaatcaactatataaagacattttctcttgtatcaaagaaagattttttccgagtaattatgacattaataactcattttgactttgagatacatcaaatggatgtgaaaacgatattccttaatggtcatctagaggaaaaggtttacatgaaacaactagaaggattctcctctagtgataatgaacacttagtttgcaagcttaataaatccatctacggattgaaacaagtctcccgccaatg

SEQ ID NO: 4924 - DNA, 492 bp, Glycine max
  Peptide Sequence Number=SeqID_121702
atggaacgtgagaagcagatgaataatcatctgcttccgcaagaaatcgaagaatttcttgggaatcctgcaagagctactcgttcttttttctctgacagatggtcagaacttcatctgagttcgaatcctactgagaggtctactagagatcagaaattgttgaagaaagaacaaaagaaacatcttgttctttccaggcgatcggaaaataaagaaatagtgaatttattcaagataattatgtacttacaaaataccgtctcaattcatcctatttcatcatatccgggatgtgatatggttccaaagggtgaactggacagttccaataagatttcattcttgaacaaaaatccattttggggtttatttcatctattccatgaccggaacagtgggagatacacgttacaccacgattttgaatcagaagagatatttcaagaaatggcagatctattcactctatcaataaccgagccggatctg

SEQ ID NO: 4925 - DNA, 327 bp, Glycine max
  Peptide Sequence Number=SeqID_121703
atgaaggagaatgtgattggatggcaagaactgaatggaggccaccacctcactgcagctgccatcatcggccatgatggctctgtttgggctcaaagctcttcttttcctcaggcacgtaataactttcttttcattttatttgctcattctaccccgattagacctcaagaaatcactgatatcatgaaagatttcgatgaaccgggtcatcttgctcctacaggtttgcaccttgcaggaaccaaatatatggtcatccaaggagagtcaggagctgtcattcgtggaaagaaggtatcacgtcatgccattttacacttgtaa

SEQ ID NO: 4926 - DNA, 462 bp, Glycine max
  Peptide Sequence Number=SeqID_121704
atgaagaaaaaaatatcttgcagtgtgagtgcaggatggggtggtgatgggttttatcactctcttccgccaataacgaaggcatatggcaccgtttgcctgttggctaccgcaacttaccatcttggattagatcatccagcttacattgcactattgtacgataaagtgttctacggttttcaggcttggaggttgttcactaacttatttttccttggaccgttctctatcaattttgggatccgtctcctaatgatagtaaggtatggtgtccaacttgagaaaggaccatttgaccgacggactgctgatttcttgtggatgatgatatttggtgcctttgcactattgctttattctgtagaatctattctagtggttctggtttatggatctggacaagaagatgacaaaccttctttttggataaaaatggaaaatttgattggtctaatttaa

SEQ ID NO: 4927 - DNA, 246 bp, Glycine max
  Peptide Sequence Number=SeqID_121705
atgtggggtaccgccattgggtgttgcgggatagggggagataggagagagagagggtgtcccgcccttggagctggcgggataggagagagagagggtgaaggtagtcccgcccttggagctggcgggatagggggagagaggagagagggatgggatgccgcaactggctgttgcgggacaggcttgatgagacagcacgaagctttgcatggttcacgtgttcaagctttgtttcagttctga

SEQ ID NO: 4928 - DNA, 183 bp, Glycine max
  Peptide Sequence Number=SeqID_121706
atggcaggagttggtgacagtggtggtgaatatcatcaactggacggagctcaacatttagagggcaatgatggaccgaggcaaaacagaatggaggggcagaacaaaattgagggagtaaaactcaatgtacctcctttcaaaggaaggagtgacccagacactaccaagactgggagatga

SEQ ID NO: 4929 - DNA, 375 bp, Glycine max
  Peptide Sequence Number=SeqID_121707
atggagatgacactagtgagggccaacattgaagaggaaactgaggacacaatgactcgttttctgaatggactaaatcctgacattagagatgttgttgaattacatgagttgaataacagctcacgaggaaaagtgcagcaagaagaaacttacccaatactttcaaccagaactagaccaacagttctaagaaggagggaggcaactaatccagtccatcaacaacgtccccacatggaaaggagattacatattgcttatgaatgtccaaccaggaggaccatgatcatgaaggcatatggaaaaatcaccagtgaatctgaaatcagtgaagaagaagtggaagaaaagcttaaggaggaagctatatag

SEQ ID NO: 4930 - DNA, 123 bp, Glycine max
  Peptide Sequence Number=SeqID_121708
atggcattgaagcgagatgctcatttattgaggatcaaggctcatgcgacttgtggtcgtgaagatgaagtggatcatgatctgtactattgtgaagcggtgtctcatactgtggcaacataa

SEQ ID NO: 4931 - DNA, 233 bp, Glycine max
  Peptide Sequence Number=SeqID_121709
tttctggtgaaaagatgaagaataagaaggttgcagtagttggtgtctcgctaagcgaggcatatgcgcttagcaagcaacatccgctaagcgagacatcagctcatttagcgagtgagaagaatctggaagagaatctgccacgcatgcacgcgcttagtgcgtcatcagctcgctcagcgagttccttcaaggacagaaagtccttaaaagctgaagttggcgaaaaatag

SEQ ID NO: 4932 - DNA, 162 bp, Glycine max
  Peptide Sequence Number=SeqID_121710
atggctggggcttgcaggtgtactgcaggtcctggtggtgttactgtgaagaagaccggtgcggccttgatcattggcatttatgatgaaccaatgactccaggtcaatgcaacatggtagttgaaaggcttggtgattatctcattgaacagggtctctaa

SEQ ID NO: 4933 - DNA, 2556 bp, Glycine max
  Peptide Sequence Number=SeqID_121711
atggctttctttaggaacttttcaaatgatacagtctcacatggtgtcatggaagataaaagccaaggacagaatgctaatagagttcatagatcagtaggtaatgattgtactgatgcaacttctagtgagaaagaatttgatatgaacatggaggcacagtatgagagtgatggcgaaccagatggttccagtagactgcaaactgaggcaacagccgatgatggagatgctgtgaaagaatcaaacttgcagactactggtagtaaaacagctatggtcggaaggtggggttcaacattttggaaggactgtgggcaaatggaccctcaaaatggttctgaatctgggcaggaatcaaaaagtggatcagattatagaaatgcagatgggtctgaagataattcattggatggaagagtggtaagagtagactcagatgatgatgatggacaaaaggaggcaggaaaaggtccaagaggtcactctgatgttcctgctgaagagatgttgtctgatgagtattatgagcaggatggggaagagcaaagtgactcattgcattacggtgggatcaaaaagcccactgaatcgaattcatggccacaacggatgtcaacctctgcaaatagaactttgcataggaattcaaggttttcagatgatgttgaagataatgatggtgaagatgatgatgatggtgataatgataatgatggtgatgatgctgattatgaagaagaggaggaagctgatgaagatgatcctgatgatgcagattttgagcccgccacaagtggtcatgctggaaacaaggataaagattgggaaggtgaaggctcggatgatgatgatgacagtgacggaaatatagttgtctcagatgatgatgaatctttctatgctaaaagacctaaaggaaggcaacgaggtaagattggacaaaacataaaatctaccagagatcgcaaagtgtatgttgcatcaggtcgacaaagaagggttaaatcatcttttgagggcaacgagtcaacaacggaggattccgacagtgatagtgatgaggatttcaaaagcactaaaaagcggagtgttcatgtccgcaagaacaatggtcgctcatctgcagccacaggtttttcttcgcgcaacagtgagattcgcacttctagtaggacagtcaggaaggtatcatatgttgaaagtgaagagagtgaagaagctgatgaagggaaaaagaaaaagtcccaaaaggaagtggaagagatctcagttatgaggtttgctgattgcttgacagagtttatgctaaagatgcaagatgatttcccaatctatctctctggaaggataatagatttgttagagtatggagtggatgaagaaattgaagaggacgatggtgactccattgaaaaggtgctctggcatcagccaaaaggcatggctgaagatgctcaaaggaataatagatcaacagagcctgttttactgagtcacttgtttgattcggaaattgattggaatgagattgaatttttgataaaatggaaaggacagtcacatttgcactgtctgtggaaatcttttgctgagctgcaaaacctcagtggttttaagaaggttttgaattatacaaagaaaataatggaagacatcaggtacaggaggacaatctcaagagaggagattgaggtaaatgatgttagtaaggagatggatttagatattatcaaacagaacagtcaggtggaaagagtaattgcagataggatcagcaaagataattctggcaatgttattccagaatacttggtcaagtggcaaggactatcttatgctgaagcgacttgggaaaaggacattgatattgcttttgctcaacatactattgatgagtataaggctcgtgaggctgctatggcagttcaaggaaagatggtagattctcagcgtaagaagagcaaagcaagtttgcggaagcttgaggaacaacctgaatggttgaagggtggaaagctccgtgattatcaacttgagggtctgaattttcttgttaacagctggagaaatgatacaaatgtcattttagccgatgaaatgggccttgggaaaactgttcagtcagtatcaatgcttggttttctgcagaatgcccagcaaatccatggtccttttcttgtagttgttccattgtccactttatcaaattgggccaaagaattcaggaagtggcttcctgatatgaatattatcatatatgttggtactcgtgcaagtcgagaggtttgtcaacaatatgaattttataatgagaaaaaacctgggaagccaataaaattcaatgcactgttgactacatatgaagtagttttgaaggataaggctgttctctctaagataaaatggaattatctgatggtggatgaggctcataggctaaaaaatagtgaggcacagttgtacacgacactttcagaatttagcaccaagaacaagttgcttatcaccggtactcctctacagaacagtgtggaagaactatggtatcattaa

SEQ ID NO: 4934 - DNA, 210 bp, Glycine max
  Peptide Sequence Number=SeqID_121712
atgatgcaagcaagagcgagcgagcgaacgactctcacctttccacgttcagagagcggaacagagttccggcaatttggttcgaacggaaggaaccgcgccgagcgacggtgcgcaggaatcgcggtagagcgagattcgaaagaagaagaggcggcggcggcggagagattggccgagcgcggcggtggcggtggcggcgggtggtaa

SEQ ID NO: 4935 - DNA, 3144 bp, Glycine max
  Peptide Sequence Number=SeqID_121713
atgaagcaaggagcactctcggtcacgaagtactttacccggctgcgagtcatatgggatgaaatcgaaaactttagaccagacccagcttgttcatgcaatatcagatcgcatgtgcttcttatggatcctctacctgcaatttcaaagattttttcatatgtggtgcagcaagaacgtcaactattaggtaatgtttcttcgaaccttaatctagaacctagagatatatccatcaatgccgcaaaagttgtttatgatttctgcggacgtacgggtcacatggagaacgtctgctataagaaacacgggatgccactcaaccacgatggtaagaacagaaacaataatgtgagatatgggaaaacgtgcactcattgtggcaagcttggacataccattgaagtttgctacaagaaacatgggtacccgccgggatacaaagctttcattggaagatcaagcgtaaataatgtgatagcggtagaggggaaggtcacagatgatcaagaacaacgtcatgaatcccaagagattattagtttttctccagagcagtgcaaagccttactcgctttaatccaacaaccatctgcaggaagcacagcttctaaccacccacaaaccaaacaggttgcctccatatcttctactgatacagtgactaacccaggtataccttcttcccttagaactcaaaaatctacctcctgggtattagactcaggagccacagatcacgtaacatgttccttaagtaaccttcattcttttaatcgaatcgaacctatcatggtgaaactcccaaacggccagcatgtctacgccacccattcaggggtggatacgagcaatcgtgtgaagattggtacagttgaagtgagacatggcctctaccaactcacgtctgaccaaataattcctaataccatatgttccactatcgttcatcctaagtgtaatgttgttcctattgacctttggcactttcgaatgggccatccatcgtctgaaaggctacaatatatttgggggccgtgttcgaaaccctccatgcatggtcatcgatattttctaactatagttgatgatcacacgcgtttcacatgggcaagcttaccacccagcttttggggttatgctttgtctcatgctgcatatctgatcaactgcatacccactccctttttgcataacatatcgccttatgagaaacttcatggacacccacgtgacatatctaatcttcgcgtgtttggctgcttgtgttatatcaacactcttaaagcacatcgtcaaaagctcgatcccagagcgcatccatgcatcttcattggttttaaaacgcatactaagggatatttagtctacgattttcattcgcatagcatcaattgttcacgaaacatcgtattttatgagaatcatttcccacatttccctgaaacatcatctttgaaatctacttttactattccaactccggagtcattctccagcgaccaatatgaaccaccagttgatactatcattactgtacccagaacccaaaacggtcctactcaagctgagccttcttctccacaccttcgtcgatctacacgacaaaaacatgcaccaacttatctacaagattatcatcgaggtctcacttcgtctgctaccagtgcttccactattgctcgttatccactaagctcggtcctatcgtactcacgcctttcaccatctcatcaacactttgtcatgaccatttcctcaaacatagaaccttcttcctatgctgaagcctctcgccatgactgctggattaaggcgatgcaggctgagttacatgctttgcaggaaaacaaaacttggactctcactaaccttcctcctcacaaaactgctataggttgtcgctgggtgtacaaaatcaaataccatgttgatgggtccatcgaaagatataaagtgcgcttagttgcaaaaggttatatgcagatggaaggtttagattaccttgatacgttctctccagtcgcgaagcttaccactgtgcgtcttctactggcattagctgctcttcatcaatggcatctgcggcaacttgatgttaataatgccttcctccatggagaactcgctgaagaagtgtacatgcaaattcctccggggctttcgatcaaggaccctaacctcgtctgtcgtcttcagcgctctttgtatgggctgaaacaagctagtaggcagtggttcaccaggctgtcgagttttctcatttcccatggttttcggcaatccacttctgaccactctcttttcctacgattcactgataatgtaaccacaactcttttggtttatgttgatgacatcatcttgacaagtaacaacattgatgaaattcaaagcattactgcacttcttgatcaaacgttcaaaataaaggatctagggaacttgaaattttttctcgggcttgaaattgctcgtactgcacaaggtattcatctatgtcagcgcaaatataccctggacattcttgctgactcaggtatgcttggttgtcgtccacattctactccaatggactactcaacaaagctacaagctacgtcgggaacacctctaccagcagaaacttcttcttcttatcgaagactagttgggagacttatttatctcaccaacacacgtcctgatattacatacgctgttcaacaactcagtcaatacatggccaaccctactaccagtcatcatcaagctgcatttcgtattttatgctaccttaaggggacaccaggatcgggacttttcttcgcaaccacaggaacacatcagcttcaggctttcagcgattcagattgggcaggttcttcagaggctgagtatcgtgccctagcatccaccacttgtgagttgcaatggttaacgtaccttcttcaagacttttgtgtttcctttatacagccagctaccctttactgcgataaccaatcagctattcaaatcgcgaacaacccagtgttttatgaacgtacgaagcatatcgaaatcgattgccacattgttcgaaacaaaatcaattcaggactcatcaagcttcttcctcgaaccaactcgccgacatcttcaccaaggctttgtctccagtag

SEQ ID NO: 4936 - DNA, 171 bp, Glycine max
  Peptide Sequence Number=SeqID_121714
atgacgccggagaatgaggaggagaaggatcaggaggtccttgatgcagcagggatgaagaggtacaggaatgatggtggcactggtgtcttgttgggcttggatggtggaaccacctccactgtctgcatttgcatgcccatgatacccttttctcactctcagctctaa

SEQ ID NO: 4937 - DNA, 570 bp, Glycine max
  Peptide Sequence Number=SeqID_121715
atgactattttaagtagtcatgtgaccactaaattacctttaatcttgaccgtgcattctgaaattagtgtgctagactttcaagatgctgaacctgatattcttgcacattcttcttcggaaattctggaacgcttcaatcaattctgcgatgatgaaattaaagcactttgcaagaagaaaggtctttatggcgagggagcttacctggttggggttgacagccttggtgtggatgttagagttctttcaggtgcagaagtaaaaactcatcggtttccattcaaagtccagattgattctgtcatggaccctcacctgaacatcctggaagtgggcttctcaattaacggtttagttaggatgaagatgaaaaagagaagggacaagtacaagtctccagggccaccgctgcataaaatgcaacaaaggttttgtattgtcattggttggttgtgggctggggccgccaatgcaaatgcagctgaaaaacagatttggcaactcttgtttcctcgctctcggcgaaagaagaatatgaagaagtggtggagtgccagcatgatttga

SEQ ID NO: 4938 - DNA, 934 bp, Glycine max
  Peptide Sequence Number=SeqID_121716
acacgtcctcgccttcagaggactacacgtcctcgccttcagagggctacacgccctccccatcagagggctacacgtcctcaccttcagaggactacacgtcctcgccttcaaagggttgcccgccctcgccttcagaggactacacgtcctcgccttcagaggactacacgtcctccccatcagagaactgcacgtcctcgccatcagaggactacacatcctcgcctttagaggacttcacgtcgtcaccttcaaagggctacacaccttcgccttcgaagggctacacgccctcaccttcaaagggctacacgtccttgcctttagaggactacacgtcctcgccttcagagggctgcaagacctcacctttagaggactacacgtcctcaccttaagaggactacacgcccttgccttcagaggactagacgtcctcacctttagagggctactcgccctaaccttcaaagggctacatgtcttcgccttcagaggaagggctacttgccctcaccatcagagggctacacgtcctcacgttcagagaactacacgtcctcaccttcaaagggctgcacgcccttgcctttattggactacacgtccacgccttcagaggactacacgtcctcgccttcagaggactacacgtcctccctatcagggaactgcacgtcctcgccatcagaggactacacgccctcgcctacagaggactacacgtccttgccttcatagggctgcacgccctcaccctcaaaggactacacgtcctcgccttctgaggactacacctcctcaccttcagaggactacacatcctcaccttccgagggctacacgcccttgccttcagaggacaacacgtcctcacattcagaggactacacgcccttgccttcagaggactagacgtcctcacctttag

SEQ ID NO: 4939 - DNA, 303 bp, Glycine max
  Peptide Sequence Number=SeqID_121717
atgcttatgttgcttaaggcttggatagttacaatttgtgtttgcttatgctcaattgtcttggataacacaattcaagagagcttaagacttattttgattcaaaaatccagccacaactcagcaccactgtcgcaacgtgcccttcgcgggcgagcgagggcgaggctcacgggtgcgctttccaaaagaggaaagatgcgcgaagtcgccaccaacgtttatttgtggaaaacgtcgggaaaaccgaaggaaaccggtcaaaatgaaaattctaagttcgggagttgtatttacgcttga

SEQ ID NO: 4940 - DNA, 228 bp, Glycine max
  Peptide Sequence Number=SeqID_121718
atgagttgtacaggttcgctaagtgcaccacttcatctctctaagcgcaccgcttcagtttatccgctaagcgagaaaggcgcgctaagccaaaaatcactagcgtgcgctaagcgcacgagcacgaacaaggcgacctatttaagcctaaaattagattttgtgaagggagtttggactgggattcagagctttgcatgtctttctagggtttctagagagagaaag

SEQ ID NO: 4941 - DNA, 728 bp, Glycine max
  Peptide Sequence Number=SeqID_121719
gctcatgaaaacccaagggtcttctcctgcatctctagcccaatcttcttggagtcttctatccaatgcacatggggggtaggattgcatcagttgcaagcctttacaactcaaagaccaaagcacaactttgcgtccaaagagtcatcatccaaagtcattgttgttggtaatgctttagaggaagaatctaacaatgatgactctaatgacagagattatgagctaagtatgatcaccataaagatcaaaaggatgtggaaaagcatgaactcctctaggttcaactatttctccaagagatccttccacaagaaggaggaaagtccagtcatatgctctaagtgcaagaagccaagacacttcaagtcagaatgtcctgaccttgaaaagtcgaaggataagaagaagaaattcttcaataaagtagaaccaactctggatgcaagttccgatgatgaggatcctccgcctgattacactatcaactctaatggtgaagaagaactacctcctgagcttgtaaaactctatgaggagatagaaatcttcaagaataacctaggaaagtttattggtggtcatgaagcctttaaaaaattgttaaggtgtatcatgagactcataaatgcaaggacctccttgaaaaggagaacccatcaaagggtcagtccagtgcttgccagcacccccaagctaacaaggaaaaaggacccaaaaagatttgg

SEQ ID NO: 4942 - DNA, 261 bp, Glycine max
  Peptide Sequence Number=SeqID_121720
atggtaaatcaagaaggtcatagtcaatctataatggttcaggacttcaatgtcacttctaaccacggttgtagtgctccttttcgagcaaatatcattaggaagctatatatagacaaccttgagagctttttagagctgaagaacttaaataacatcactagaatgaattatgatcattgttgctgcttattgatccatgatcattggggtattgatataaggcaaggagcatcttctaaccttgatcatagactttag

SEQ ID NO: 4943 - DNA, 429 bp, Glycine max
  Peptide Sequence Number=SeqID_121721
tctctttctgctgagctttctgcattgagagtggaaagagaaagggaatcaaaattattgaaaaaagagaaccagagcttgaagattcaacttcgagatactgctgaagctgttcaggctgctggagaactacttgttagactaagagaagctgaacacgcagcagctgctgcagaggagaactttgcaaatttgcaacaagataatgaaaatttgaagatgcaaattgcaaagatgaaaagaaaacacaagactgagattaataccatgaagcagtacattacagagagcaaattacctgagtctgcactacaaccactgtatagagaggaggattctgatgtggcacacaatgcaacttcctcctatacatatgacgatcaggcatggagagcagaatttggagcaatatatcaggagcattactaa

SEQ ID NO: 4944 - DNA, 1726 bp, Glycine max
  Peptide Sequence Number=SeqID_121722
gagcaatgatgcaacactgcagacactcagatttggggagcaagtaagatccattagaaatgagcctgttatcaatgtagtaaaggagactgatgctgatttgagtaataatatccgacacttgaaggaagaacttattagagcaaaggatgatgttcatagctcagctgggagtaaagatggatacttccaaggacataatatgcgggaaagcctgaatctgatgagagtcagcttaaaccactctcttctcctatctaacatagataatgatactgatgaacatgtaaatgtcaatgaggatgacataaggaaattacgccagcaaattgatgaattggataattcatctgaagggaatccaaaggacatatctgtcgatgaagattgtgtccagttttattctgatgaggaatattgtgatgcagacaccaatagttgtgatgaagttgaaaaggctgatgtatactgtggaaaaacattgagcaacccctcagtggcaactgaatcttcattcagagatagcatttcactcaattcatgcaatcattctgcaacacttgctggaccacagttgtctgagtctccaaaattcagcaaaactcaaaggagaagtgtggctatttcatcaagttatctgggaagttggaacaatgtagcagagagttcaactttcagtaacaaagtgttaagaaaatcatttaaacagggagatcatgtgcaatcctcattacagtctagcaaggccaagtccttggcagcaagccttcagaagggattacagattattgactatcatcagcagaactcagcattgaacaaatcttcaacttccttctcctttgagcacttaactttgacaccatgtctagacattgacaaggatgactcttatgaccaaacaatacaacagaaaccttccagtgatgaagtaactgctgctttcctttgtgcatcttgctgggcgaaaatatcaaatgaagattccagcaaggcccaggctggaaatcctgatggaatgacagataaaattccaaaacatttggagaatgtaatagcaaaaagcatcatgaaagagaaggagcttgagaatgtttgcaaggagcaagcagctagaattgagcaactaaatcagttggtggagaaattgaaaggagagaaagaactggactccgttactatgtacaactctatgaaagatgaagaaaagcttctaaggggaatttcctcaagtggtcatttaccatgcattatagaggaaaactgtgaagttaaagaagtccaggaagagttagcccaaagtgacgtctcttttgattcaaccgagaaggagtcacttcttaaggaaattcagaatctaaggagtaagctgcaattatgtagtgatgcaccagttaaaaagtctacagaaaaactaaggtcttctttggtgtcaagatccatacaactgcaaaaaagcggtgttttttcttatgataatggcaatgaagacctagagaatgaaagacagagatggacagaaatggaaagtgagtggatctgtcttactgatgaacttagagctgatctcgagtcctaccgccaacttacagagaggttggagatggaattgaaattagagaagaagtcctcagcggagatggatgatgcactaaagagagctgttatgggacatgctagaatggtagaacactatgctgatctacaagaaaaatacgatgacttg

SEQ ID NO: 4945 - DNA, 891 bp, Glycine max
  Peptide Sequence Number=SeqID_121723
atgaccagagtcgaattttcagaacaacagttcatgaaatgggtgaaatttgtaggtggcctcaaacattctgtctttaggacagcaaataataagctttttccttctcacactttgcacgtttctaagaagcatggtaaaggaggtttttcgtcaattcaagcagccattgattcccttccattcatcaatgtagtgagagtggtaattaaggttcatgcaggggtttacactgagaaagtgaacatttctcctttcaaatccttcataacaatacaaggagaaggagcagataagaccattgttcaatggggtgacactgctcaaagccagccattaggaacctatggttctgcaacatttgctgtgaattcagcttatttcatagccaagaacatcacattcaaagcaagtgacaagctccattccaatcttcctctatccaacactgccccaattccagcaccaggagcagttggaaagcagggagtggcattgagaatttcagcagacacagcagtattccaaggttgcaaattcttaggagcacaggacacactctatgatcatattggtaggcattactataaggattgctacattgaaggctctgttgatttcatatttggcaacgctctgtctctctttgagggatgtcacgtgcatgccatagcacaacttacaggggccttaacagcgcaaggaaggagcagtttattagaagacacgggtttctcgtttgttcactgtaaggtcacgggctcaggggcactttaccttggaagggcttggggtcccttttctcgcgttgtctttgcttacacttacatggacaacatcatcattcccaaaggctggtataactggggcgaccctaaccgtgaaatgtaa

SEQ ID NO: 4946 - DNA, 876 bp, Glycine max
  Peptide Sequence Number=SeqID_121724
atgaggcaaaagaccaaaaacgcagattctagtggttttttgggaagcatttcttccaattttctcagatcaatctcttcttcaaatcgcaaacccacttcttcaaaccctaaacccccaaagtctgacactgaaaacactcctccgactacccatccaaacattcccatcaatcttcaccaccaatcaaagcccaacgacccattttctcacagcaactcacatgttgtggtgagaattagacctgaaaatagcaatggaaaagagggagatttgaaaattaagaaggtttcttctgatgccttgtgtgttggggacagaaagtttacgtttgatgaagtttttgatgccaactccaatcaggaagatgtttttcagtcagtgggtgttcccttggttagaaatgctttagctggttacaacactacaattctgtcatatggccagtctggaagtggaaagacttatacaatgtggggtcctccaagtgccatggctgatgagtcctcactttctagtcaacagggaattgttcctcggatcatcagaatgttattttctgagcttgagagagagaggcttgtgtcagatcagaaacagttcaactatcaatgccgttgttcatttcttgagatatacaatgaacaaattgggaatttactcaatcctatccagcagaaccttgagatgaaggatgattccagcaatgccttgtatattgagaatctgattgaggaatacatcactaactatgatgatgtggcacaaattctgaataagggcctttcaaggagaaaaaacgaagcaatgaacttaaattctaatagctcaagatcacatataattttcacatttgtcattgagtctttgtgtaag

SEQ ID NO: 4947 - DNA, 937 bp, Glycine max
  Peptide Sequence Number=SeqID_121725
atgggcagagccataaggtggttgaaggggttgtttgggataaggacagacagagagcgcaaagagaattcaaatcactcagacagagattccagaggtttatgtcataatccaaccacaattccacccaatatttcacctgcagaggccgcttggttgcaatccttctactcagaaactgagaaggagcagaacaagcatgctattgcagttgctgcagccactgcagcagccgcagatgctgcagtgactgcggctcaggctgccgtggcagtggttagactaaccagccacggcaatggcagagacaccatgtttggtggtggtggacaagaaaggttggctgttgtcaagattcaaactttctttagaggatacttggcaaggaaggcactgagagccttaaaaggattggtcaagttacaagcacttgtgagagggtacttggtgcggaagcaagcagcagcaaccctgcatagtatgcaggctctaattagagctcaagcaacagtaaggtctaagaaatctcacggactcagcagcacaaagaatgaagcacatttgtttcaaacacaagcacgaagatccatggagagatttgatgacataaagagtgagtacatagctcccatccacagcagaaggctatcatcttcttttgatgccacaatgaataatgcaaacagtgttgatgggagccccaaaatagtggaagtggacactggcagtggcaggccaaagtcaaggtctcgcaggagcaacacctcaatgtcagattttggcgatgacccatcatttcaggcacttccttctcctcttccatttgctcatttgtccataccaagccacaggaactaccacgactcagaatggggcttaacaagagaagagtgcagattctccacagcgcaaagcactccacgatttaccaactctt

SEQ ID NO: 4948 - DNA, 240 bp, Glycine max
  Peptide Sequence Number=SeqID_121726
atgaatgttgatacttctgggattctaatactggaggaactgcacaagaggttgctctcgcgtggcgtacaattggctatggtgaacccaaggtggctagtgattcacaagctcaaagtggcacattttgtggataaaatcggaaggcagtgggttttccttactgttgctgaagccgtagatgcatttaattataaaaagtgggttatgcttttcttatctaaatatagactttcgtga

SEQ ID NO: 4949 - DNA, 1406 bp, Glycine max
  Peptide Sequence Number=SeqID_121727
atgggaacaaaaacagaggaaggagtagattacacgttgatggagggagcagcagaaaaggagaggctgcagtgttggagcataaggagagaagtgaaagcggtggtggagctggcgtttccgataggaataacggcgttgatattctacgcgcgttccatggtatcgatgctgttcctgggacacctgggagagttagaactggcagcagggtccctaggaatggcgttcgcgaacatcacaggttattcggtgctgtcgggtctagcacttgggatggaaccgatgtgctcgcaagccttcggagcaaaacgcgtgaaggtgttgtcgttgaccctccaccgctgcgtcatgacccaaacatcaccctcatggcccacacctacctcatcttctccctccctgacctcctcacccactccttccttcacccaatccgcatttaccttcgcgcccagggcgtcacccacccggtcaccttagcctccctcgccggaaccctcctccacctccccttcaactacctcctcgtcacgcgcctccgcctcggcctcgccggtgtcgccgctgcctccgccgcttccaacctctccatcctcctcttcctcggagccgccgtttgtttcaccggcctgcactgcgccgccccgagccgagactgtttcagcggctggaagccgctgcttcggctcgccgcgccgagctgcgtctctgtttgcttggagtggtggtggtatgagatcatgatcattctttgcgggattctcgtggaccccaccgctaccgttgcttccatgggaatactcattcaaaccacttcactcatctatgttttcccctcctcgcttggtttcgcggtttccacacgcgtcgggaacgagctcggagcgaatcgtccttctcgagccaaattatccgcggtggtttctgtttttctcgccgcgattatggggttctcggcgatgtttttcgccgtcgggatgcggcggcggtgggggaggatgttcaccgccgacgaggacataataaggatcacgtcgatggcgctgccgatcctcgggatttgtgaactcgggaactgtccgcagacggtggggtgcggcatcgttagagggatggcgcggccgaacacggcggccaatgtgaacctgggcgcgttctatttggtcgggatgcccgtggcggtggggcttgggttctggtttgacgttgggttctgtgggctgtggctgggcctgctctcggcccaggtgtgttgcgcgggacttatgttgtatgtgattgggaccaccgattgggagtttgaagcccatcgggcccagtggctgacgttggtcgaagatggagtgatggacggacagaaacagccgttgacaagcgttgttaccgaggctccctcgacttga

SEQ ID NO: 4950 - DNA, 237 bp, Glycine max
  Peptide Sequence Number=SeqID_121728
atggcacgaaccatcctttcttctatatctgttccttttcttattctgctaatgattgtctttactctcgttgcacagattactccaattagtgcagatgtgaaaatgagaagattgggtcccctcctaagtccacctcctccacctgatcatgcagatggtcctcatcctgttggtcctcatcctgttattcctccaccaactgatggacctggtcgtcctccacccattccctaa

SEQ ID NO: 4951 - DNA, 212 bp, Glycine max
  Peptide Sequence Number=SeqID_121729
atgggctcggtcaagtatgaggtggaaaaattcacaggccaaaatgacttcagggcatggaagatgagagctcttcttattcagcaagagttggtggatgcacttgcaggggaggctaaactggagaaagcaatgtctaatgaggacaagacaacattgatggagaaggcacatagtgcgatcattctcagcctaggagacaaggttctgag

SEQ ID NO: 4952 - DNA, 270 bp, Glycine max
  Peptide Sequence Number=SeqID_121730
atggcgactgtagttgccgctaccagtgtcattgctgaggtggaccccgctccaccatcaggcctcaaccaaataaatcatcccatctcggatatggtagggcaaagaggcaaagaattaggaagtacgggcggcctccattttgtgcaagttcaaaacaagtatgccttgccgccatatggcttgccgcccaattatacaccagccaatgtggtgcacactcctaatgagaatgtcaatgactccactcccatactcattgagagctaa

SEQ ID NO: 4953 - DNA, 726 bp, Glycine max
  Peptide Sequence Number=SeqID_121731
aatttggattcagagtgtttcggcgcttcgctgaaagtcatagaaacatgtgaccagagaagaaaaccatggtcgtcactcctctgtaacgaaatcatcaaggaaatcttgtctcgtcttcccgtcaaacctttgatcaaattcaagtgtgtgtgcaaggaatggaactccttgatttcagaaccctatttcatcaaattgcaccttagcaaatctgctgcaaaggacgatttggaacaccttcaattgataaaaaatgtctgcctcggatccatccctgaaatccacatggaatcgtgtgatgtaagttcgatattccattccctacaaatggaaacgttcttgttcaatttcgcaaacatgtcaggttaccatctggtcggttcatgtaatgggttgcactgtggggttagcgaaataccagaaggatactgtgtttgtttctggaacaaggcgacaagggtgatatccagagaatcgccaacgctgtctttttccccgggcattggtcgtagaataatgtttgggtttggctatgatccgtcaattggcaaatacaaggttgtagcaattgcgttgactatgctctcacttgacgtatctgaaaagactgagaagaaagtttatggcgcgggtgacagtagttggagaaaccttaatggttttcctgttctttggactttacctaaagttggtggagtgtatctgagtggaacccttaattgg

SEQ ID NO: 4954 - DNA, 684 bp, Glycine max
  Peptide Sequence Number=SeqID_121732
atgaatcaaccaagtgctaatcagaatgaggaccttcctcctaaaaagataaaccttaaggaggagactgagatgacttcctctaaattacaaggtctagacaaaccacaagatgctgatgaatctgaagaggatcaaacattagaaggcaattacttgttggctagagataggacaagaagggaaataaaagctcctcaaaggtatggctatgttgacttaattacctttgccttagtgattgctagtgaggttttagaggaggatccaaaaagtgttgatgtttccttagctagacaagaagggcagaagtggctaaaagtcaataagaatcatattggtcatggtgatgaagagattctaatgagtcaacttaagagatttgaggtcaaggctagcaataacaaggataagttagctaaagtgaagtctgaactcgaaaaggaatttgaaatgaaaaacttggggccaggtaaaaggatattgggtatagagataagaaagcacataaaaatgaagcaatttaaattaagtgttgatcaagctcctaagacgcatgaagaagaaatctacatggaaggaatcccttatgcaaatgcagttggatcactaatgtatgccatggttggggacggagtgcaagctagaaaaatatatgtttggggacggagtgcagtgatttag

SEQ ID NO: 4955 - DNA, 117 bp, Glycine max
  Peptide Sequence Number=SeqID_121733
atggcattgttgtatctgtatcagtccttccttgaggtatccagccagcagtttacactttacactgatcatgcggtatggaggataattttttctactgacattggtcatgactaa

SEQ ID NO: 4956 - DNA, 1125 bp, Glycine max
  Peptide Sequence Number=SeqID_121734
atggggtgctgcttccgtggctccacagctataccaccaccacccatggaaacctccatgcctgctgtaagtgttggagaatactcaggactcaaacaagaagttctcatacaaataccagcatgtaaagttcatctgatggatggaggagaagctcttgaactggctcaagggcacttcatgatcatcaaaacctttgaagagaatgtgtctctggccacaatcataaaagtaggagatgatcttcaatggcctttgacaaaagatgagccagtagtgaagttagattctctccattacctgttttccttgcttgtgaaagatggtgagcctctcagctatggtgtgaccttttcagaagctagtttgggaagcttgagtttgctggacatgtttctgaaggaccagtcttgcttttctggcttgaatttgagcaagaagaacaatctagattggagggagtttgctccgaaggttgatgattacaatcattttctggccaaggcaattgcaggagggactggtcagattgtgaagggaatcttcatatgcagcaatgcttacaccaataaggtccagaaaggaggagaaacgatcctaaatagttctgcaggtgagaaaactggtgttgtggccagggaaagtatgagcaacaagactgccagtgcctcaaagaagaacaagattaataaaaacctcaaacgtgtgaggaagctgtctaagatgacagaaaagttaagcaaatctttgcttaatggtgttggtatagttagtggatcagtgatggctcctgtggttaaatcccaaccaggaaaggcattcctaaggatgcttcctggggaggttcttttggcttcccttgatgcagtcaacaaggttttagatgcagctgaagctgctgaaaaacaaactctttctgccacctccaaggctgcatccagagcggtctctaacaggtttggggaaagcgcaggggaaggtactgagcatgtatttgcaactgcgggacatgctgctaacactgcttggaatgtctttaagatacgaaaggccttcactccagcttcttcagcaaccaatggagtactaaaaaatgctgccaagattccaagttttaaacattaa

SEQ ID NO: 4957 - DNA, 1170 bp, Glycine max
  Peptide Sequence Number=SeqID_121735
atgtcttctttggatttgttactgttttctctgagcagggccttttgtagttccatcgccgttttctttcagatccaggtttttgtgtggtacaacaatgtgaccttgttgctcttcagtatctctgtgccaaggtttttctacttggtttgggggtgtttaatttgcttaacgcttgctcttgggtgggcttgtgctgcttatgtcagcgaacttgagcactcctatcaggtcaatcttccaagagtaacagtgattatgcccctaaaagggtttggagaacataatctccataactggaggagtcagataacatctctatatggtggccctatagaatttctttttgtggtagaaagtacagaggatcctgctttccatgctgtatcacgattaatagcagaatttgaggatcatgttgaagctaaggttgttgtatctggtttgtcaacaacttgtagtcaaaaaattcacaatcaattggttggagtggagacaatgcataaagatagcaaatatgtattatttttggatgatgatgttaggttacatcctggatcaatcggagcgctcactcgtgagatggaaaagaaccctgagatatttattcaaactggataccctcttgatctgccatctggaagcctgggaagttactgcatctatgaataccatatgccttgttcaatgggctttgctactggtggaaaaacattctttctgtggggagggtgcatgatggcaatttttcttcagatgcatgctgatgactttaggcaagatcgttatggtgtagtctccggacttaaagatggtggatattcggatgatatgactcttgcagccatatctggtgctcacaaaaggctcattacttctcctcctgttgctgtctttcctcacccccttgccagtgatcttaattttggaagatattggaattacttgaggaaacaaacatttgttttggagtcatatttaacaaatgttaactgggtgatgaaccgtgcattgtttactacccactgctatttgtcatggggatttgtggcaccatattttatggcgatgatccatgttgctgcagcagtaagattttactataaaggattctcacctgaagaaatggcctatacttctggtggtgagaacaatacttttcctttctag

SEQ ID NO: 4958 - DNA, 1513 bp, Glycine max
  Peptide Sequence Number=SeqID_121736
cggtaccgtgaggacagtccaatcaaagggttgcgcgaagcagaggatgaaaaaggaggcgtgatgaatggaggggacaggtggagacgcagcataaggcaggacgagcaactcgaacgattcgactcggagttcgcgtccacgagttccatttcctccacgctcagcaccgacgatttccggaacctcaccagctccggtgacatttcctccatcagcagcggctccggcgagattcctcccgtctcggtcctcgcgccaccttttctccactgcgaggggtccaatgacggcgagacggcggcggcaagggagaagtgcgtgggaaggagtaacaagggagtgagctggggacacacttcggtgatagggagaaggaaagagatggaggacgccgtcgccgttattccgggattcatgtctcgcacgtgtgatcacatcggcggttgtacggctcccggttctagatcctccggtgagatcgctccggttcatttcttcggcgtttacgacggccacggtggctctcagtttgaaagaggtgttgcttgttatggtgactggacacagaaaggaagggaggttacgactggggacaatgacaatgataatagtgttagcaatgacaccagtagagatatcaatggtggctacgatgacaacaatggtggtgatagcgatgtcaatggtgatagtggtagccgtataggtggtggtgacgacaatgatgtgatgttggtgtcaaccgccactggtggtggttgtgtgggcggtgacaaaggtggtattggtattagtggtggtgacaatgactatgctagtggtagtgtggttgtagtgacgatggtggtggcgacgataataacattagttgtagcgatagtggtggctaagttttgtgcgaagcggatgcacgatgttatagcagaggagtgggaccgagaaatggaaggtggcgctcgatggcacagaagatgggaaactgtatttgctaacagttttgagaggactgacaatgaaatcctatcagacgcagttgcgcctgaaatggtaggatctactgcctctgtggtgattctatctggttgccaaattattacatccaactgcggcgactcaagggtagttctttaccgcaggacacaaactatccccttgacagtggatcagaagccggatagacaagatgaacttttgagaattgaaggaggaggaggaagagtcataaactggaatggagctagggtgtttggtgttcttgccatgtccagggccataggtgatcggtacttgagaccctggattattccggtgccagagataactttcacagcaagaaccgatgaggatgagtgcttagttttggctagtgatggactctgggatgtaatgaccaatgaagaggttggagaagtagcacgccacattcttagaaggcgccgcagatcattgtcaatggaggaagcatctcctgcacaagttgttgccgacagcttgactgaaattgcattag

SEQ ID NO: 4959 - DNA, 399 bp, Glycine max
  Peptide Sequence Number=SeqID_121737
atggtctacctattagattttggaaggatagatggtgtaagaaggagagcttgcaacaaaaatatgaaagattgttccttaactggaaacaaaaaggagaaagtgtgggaaagatgggtacatgatgtaatggttgttgggtttgggattttagatgaaggagagagtgggtgtgagtttgctctaggtggttttcctgtcaatgttccggcacacaatgtttttccagtgtcggtgtcagacaatgccgacaaagccttccaacgggagctagagaaggaacaaaccagaagagagattggaggaggaagtccggaaggaaatggcaccggagggagtatttggtatgcgtgtcaatgcaaagacaagacggaatctcagttccggaacgagttttga

SEQ ID NO: 4960 - DNA, 921 bp, Glycine max
  Peptide Sequence Number=SeqID_121738
atggctagtgttgtgacaaagaaagtgaagcttcttgtggcattgcttaccctgcagttgtgctttgcaggatatcacatcgtgtctagacttgcactaaatattggtgtcagccaagtcgtttacccagtttaccgaaatttgattgccgtgcttttgttgagcccatttgcttatgtgttagagaagaatcaaagaccacccctcactttatctttactggctcagttcttcctacttgcattgctggggatcactgcaaaccaagggttttacttgttgggattatactatgcttctccaacttttgcttctgccttgcaaaactcggttcctgcgatcacttttgtcttggccttagctttaaggcttgaggaagtcaacatcagaaggagacatggattggcaaaagttctaggaaccattgccagtgtggggggtgcctcagtaataactctttacaaaggtcctcctcttcttcacctgcagatggaccaaatacaaggagacactttagaagtagatcagtcaacaaaagtgcaaaattggacttggggttgcatatacttgcttggacattgtctatcatgggctggctggatagtttttcagggaattatagcatctggtgttgtcatatctctccaaacatggtgtattcaaaagggtggtcctgtgtttgttgctgtcttccagccagtgcaaactattctagttgctgtcatggcagccctaattcttggtgatcagctataccctggagggcttattggtgcagttctcattgtgcttggtctatacttggtcctttggggcaaaaccaatgaaaaaaaagtgactgagccatcactaacaaaccccttgcttaaggcagaagaagagaataaagaaactgttgcagttccaaaagacataccatga

SEQ ID NO: 4961 - DNA, 693 bp, Glycine max
  Peptide Sequence Number=SeqID_121739
atgaataaatttggtgctgtacttgatgactttggacttgaaacaatgcttgacaagcttatggaaggttttatccgtcctttatctagagtcttctttgcagaagttggcgggtcaaccctggattctcatcatggttttgttgtagaatatggtaaagatagagatgttgacttgggtttccatgtggatgactcagaagtaaccttaaatgtttgtttgggtaagcaattttctggaggggaattgttttttcggggcatacgatgtgagaaacatgtaaatactggaactcattcagaggagatctttgattattctcatgtccttggacgagctgtccttcatcgtggtcgtcatcgccatggagctagagctacaacatctggtaatcgggtcaacctacttctatggtgcagaagttctgtctttagagagatgaaaaggtatcaaaaagatttctccaactggtgtggcgagtgcaatcgtgagaaaaaggaaaggcagcgctccacagttgctgctaccaaattgtttacggagtcaagaaaattggactttgcaagttttcatggcgagaaggcgatggagtatatatggagtggtgaattggtagagctagagccagatgtgacatttgcaagcacgatctctgttatcatgtggctgttgcagtgtgcggtttttgaataa

SEQ ID NO: 4962 - DNA, 1800 bp, Glycine max
  Peptide Sequence Number=SeqID_121740
atggggatccctggattgagcaatcagaataatgggcagcaaagattaggcataactgagcccatttcattggctggaccaactgaggatgatgtgatcaagacgcgtgaacttgagaagtacttgcaaggtgttggattgtacgagagtcaggaggaggctgtgggaagggaggaagtgcttggcaggctggaccagattgtgaagatttgggttaagaacatcagccgggcaaaggggttcaatgaacaactagtgcatgaagcaaacgccaagatttttaccttcggctcttatcggttaggggtgcatggtcctggagctgatatagataccctttgtgtgggacctagacatgcatccagagatgaagatttctttggtgagctacagaagatgctatctgagatgcaagaagtaacagaattgcaccctgtgcctgatgctcatgtgcctgtgatgaaattcaagtttaatggagtttctgttgatctcctgtatgcaagattagcgttgtgggttattcctgatgatttagatatatcacaggaatcaatattacaaaatgttgacgaacaaactgttcttagtctaaatggttgtagagtaactgatcaggtcctgcgattggttccaaatattcaggttgcaggttttcttggtggtataaacctggcattgcttgttgctcgaatatgccagttatatcctaatgcacttcctaatatgttagtatctcgattctttagggtatatactcaatggcgatggccaaatccagtcatgctttgtgctattgaagaaggatctcttggactatcagtttgggatccaagaagaaatcctaaggatagatatcatctaatgcctataattactcctgcttatccttgtatgaactccacttacaatgtgacatcaagtacattgcgtgttatgtcagatgagtttcgaaggggaagtgaaatatgtgaggctatggaggctagcaaggctgattgggatactctttttgagccttatcccttttttgaatcatacaagaattatctacagatagatataacagcagagaatgcagatgaccttagacaatggaaaggttgggttgagtctcgtctccgccagttgacattgaagattgagaggcacacttatggtatgcttcaatgtcatccacatcctggtgaattctcagacaattctagaccctttcaccactgttactttatgggtctgcagcgtaagcaaggagttccagtgaatgaaggtgaacagtttgatataaggctaactgttgaagaatttaaacattctgtcaatgcttacactctatggaaacctggaatgaatatccatgtgtcccatgtgaaacgccgtaacattcctaactacatatttcctggtggtgtccgacctaccttcccatcaaaagtaactgccgagaataaacaaagttccaaatcaagggttcctggccatggtcaagctgaaaagcctcaaggaggtaaaacagttgtagttggagcagatgatgtaaggaagagaaagagatcagaggacataatggataataacccaaggaattccaagtcccctgtatctttagctccccccagcagggaagttaatgaggatatatctcctattagtgcttcaagttcttgttctatgaaatttgatgaatcagaagtcaatagtattggtggacaaaagagcgagaaaccttgtctgaattctccaggggagattccttctggggatagtgggaccaatggatcagtgacaaacaaccaacaa

SEQ ID NO: 4963 - DNA, 763 bp, Glycine max
  Peptide Sequence Number=SeqID_121741
aggacttcacgtcctcaccttcagagggctacaccccctcatcttcaaatggctacatgccctcaccttcagaggactacacgtcctcgccttcaaagtgttgcatgccctcatcttcaaagggctacacgcctttaccttcagaggactacacgccctcaccttcaaagggatacatgctttcatcttcaaagggctgcacgccctcaccttcagaggactacacgttctcgccttgagaggactacacgtcctcgctttcggagggctgcacgccctcgtcttcagaggactatatgtcctccccttgagaggactacacgtcctcgccttcagagggctgcgctctccctcgccttttgagggctacgcacttaagctcccggttaagggaccaataatttcccttcaaccattctttttcccgggccaccccttgatctcaaaggagggccaactgtgcaagcacaaccagaggaaggctatcgcgcagctattgtgcataccggggcaagctttcacccgtgccactggaaagagacgagtggggtgcgcccacaagacacccaatggacccgaagaagtccaacagggccctggggtttccaactttggttacaggcctctatcagtcctacagggtgcccgtacccctcgacaagggatcgcgcccacgggacacccagtggacccaaagaagtccaacagggtcctggggtttccagctctgattacaggcctctgtcacttctacggagtgccc

SEQ ID NO: 4964 - DNA, 1368 bp, Glycine max
  Peptide Sequence Number=SeqID_121742
atgaaaagagtttcaaggcaggaagtggtggaagaaatgaagaagcaagcatggttagccgggcctctcttcactgttggtgtgctgcagtacagtttgcaggtgatatctgttatgtttgttggccatcttggagaattgcctctttccggcgcttcactcgccacttcctttgcatctgtcaccggtttcaatttgttgatgggtatggctagtgcattggataccttgtgtggccagtcatttggggcagggcagcaccatatgctaggcatacaaatgcaaagagctacctttgttctctcatttgtaagtgtctttctagcaatcatgttggtattcaccaaacatattctagttgcaatgcaccagcaagttgccatagctgaggaagccggggtttatgccatttacatgattccaagcctttttgcttatggtatctttcaatgcctcctcaagtttctacaaactcaaaacattgtcttccccatggtgttgagctctgcagtggtggccttacttcacatacctttatgttgggtgttagtaattaagtcaggaattggaagtaagggagctgccatagcaaattcagtatcatactggttaaatgtgcttctgataggattttatgtgaagttttcttcctcgtgtgcaaaaacatggaccggcttctcagtgaaggccttgcaaaatatcccagaattccttaaaatttctattccttcagcttgtatgctttgcttaaaggcttggacatttgaactaatggttctgctatctggccttcttccaaatccacagttagaaacttcagtgttatctatatgcacaagggtctcaaatgaactaggggctggtcatccacaagctgcaagtcttgcagttcgagttgctctcttcctagtccttgctgatggtattatgatggtattagtcatgatcctgctaagaaaaatatggggcaatctttacagcagtgatacacatgttataaaatatgtagcagccgtgatgccaattcttgctacatgcagcttccttgatgggattcaaagtgttctttcaggcattgcaagaggttctggctggcagaagattggtgcaattgtgaatcttggatcattttattttgtgggagttccttcttcagtggtgttggcttttgttttacatatgaaaggaaagggcctttggctggggattgtttctgcattcattgtgcaagtgatactctttggtgtcattacaattagaactagctgggacaaagaagcaaataaggcagcaatgagagtgaaagataccaaaatccctcaggagttgccacagagagatccatttaccatcacagaaatgaattga

SEQ ID NO: 4965 - DNA, 1257 bp, Glycine max
  Peptide Sequence Number=SeqID_121743
atggcaagttccttggacacgttttgtggccagtcatatggagcaaagcagtatcacatgttaggcatacacttgcagagagccatgttcactctcatgatcgtcagcattccgcttgcaattatttgggcaaacacaaggtccattctaactttccttggccaggatcctgaaatagctgcagaagccgggagttatgctaggtttatgcttccaagcctttttgcttatggccttctacagtgcctcaacagatttctacaaacccaaaatattgtattcccaatgatgtgcagctctgcaattaccacattactacatgtacttatatgttggattctagttttcaagtctggacttgggaacagaggagctgctgtagcaaattctatatcttattggttgaatgttactatactctcactctatgtcatgttttctccttcatgtgcaaaatcttggacaggattttccaaagaggcactgcataacattccctcatttgtgaggcttgccattccttcagctgttatggtttgcttgaatactacagcagctgcttggatgatcccctttggactaagtggagcaggaagcattcgtgtctcaaatgaacttggagctggtcgtccgtggaatgcacgtttagcagtgcgtgttgtcttagtactagcaattattgagggcatcatagtgggaacagtgatgatacttgtacgcaatatctggggctatgcatatagcaatgaagtagaagtggtcgaatatgtagcaactatgttcccaattctggcagcatccaactttctggatggactccaatgtgttctttcaggagctatgactcaaaagcactggtataggctgagaggcatattggaacttccaatacatctcacatacaaaaatgcaaatagtatacagtcaattgacatctggttactatgggccaatacccggaaaggaacatgtgtgcatagtacaaatgagtgcactgctagaggatgtggttggcagaaaattggtgcatttgtcaatctggggtcatactatatagttgggattccatcatctatcgtgtttgcttttgtattgcatattggtgggaagggactctggttggggatcatatgtgcactcattgttcaaatgtgttctttaatgatcataactattcgtactgattgggaccaagaggcaaagaaagcaacagatagagtctataattcagtaacacttgagagcttagtttcatga

SEQ ID NO: 4966 - DNA, 462 bp, Glycine max
  Peptide Sequence Number=SeqID_121744
atggcaagtgcagtggacactttttgtggtcaatcatatggagcacagcagtatcatatggttggcatacacacgcagagagtcatagtggtcatcatgctcgctactgcaccaatgtcttttatttgggcatacttgaggcctgttctagttgttctgcatcaagacaaaacaattgcagcaaaagctcaactatatgccagatacttgattccaagcctttcagccaacgctcttcttcggtgcattactaaattcctacaaacccataacactgtccttcctatagtgctagcttctggattcactaccttagcacatgtccttatctgttggcttttggttctaagatttgggcttggcatcaaaggagctgccattgcattttgcatttcaaattggcttaacacagtgctactagcactttacatcaagttctcctcttcctgcaaaagcacctag

SEQ ID NO: 4967 - DNA, 351 bp, Glycine max
  Peptide Sequence Number=SeqID_121745
atggtatccgagttaatcaatgcaaaccctatcatatatgaaaagaaagagcgtcgacctcgaactgctccatctgctccccatgatgagtatgctgtcgaactaatcgaccaacaagaggaccctgagcacccatattccttggaagagcttaaggtgatcacggaggaagcagttgaagttgatgatcaacgtaattatgtgagggttatgtttactcctacagtggaacattgcagtatggcgacagttataggtctatgcttacgtgtcaagctcatgagaagcttgccttcacgatacaaggagttggagaggcaaaaatttatggatgagttatttgttatatga

SEQ ID NO: 4968 - DNA, 1158 bp, Glycine max
  Peptide Sequence Number=SeqID_121746
atgacaagaagatgcatgatacacgatgcagccatgacacctgtagcggctgcaatagcggatggagtcagctgtccttcatcttacaatcccaagcactatcatgaactctacaatttccgagctagaggcttagttgcaagggcatcagctgattcgagggataatttggtgccatttgctcctctccaattggagtcaccagttggtcaacttctggaaaaaatctcaaatacccatccacatctactaacagcagtcattgatcaacaactagagaatcttcagaatgttagagatgctcagaaagaatctgatccatctcaggattccctttacaagaggatagcggaagtcaaagataaagaaaagcgtataacattggaagagataatatactgctcaattgtacataaatttttagagaacaacatttctatgataccaaaaatatcagcaacatcagatcctactggtcgagtggatttatggccaaatcaagagctgaaactagaagcggttcattctccagaggcattggagatgattcagagtcacttatctctggtactaggagatcgccttgtgggtcctctccagacagttgttcaaattagtaaaattaaactgggaaagttgtatgctgcttctataatgtatggatactttcttaaacgagttgatgaacggtttcaacttgagaggtcaatgggaatcctccccaaggattttggaaaagctaaaagttacgatgaaccatcaccgggtatcaagctttgggatcctgattccttgatcacagtacaagattatgacgatgagggttataatgacagtgattacatggatactgatgaagacaaatctttcagactaagagcttatgtgatgcagttggacgcagagacacttcagagacttgctactgtacgatcgaaggaggctatatcattgattgaaaagcaaactcaggccctgtttggaaggccagatattcgtgtctccgacgatggttcaattgaaacatccaatgatgaattgctttcactcactttctcgggcctgactatgctagttttggaggcaattgcttttggatcattcctatgggacaaagaaaactatgttgaatccaagtacccttttcttaatgagtag

SEQ ID NO: 4969 - DNA, 2694 bp, Glycine max
  Peptide Sequence Number=SeqID_121747
atggagaagaacaagagcgatgacatattgttggacgattgggaagacgcgttactggagcagttaatccaaaccgaagagcagtttgtcctcacttccaccgcaccaaaaccacctcccaaccctacttcctcgtcgtcttctttctctctcgctcttcctccaccactaccaccaccaccaccgcctccgcctccttccgccgtttccttctcgcccccgcgagagttctctcagaggcccaccacaagtatcactctggactcgccctctcccactcccattccaatctccgataataaagacctcgaaatcgaccgcttaaaggtaattgcacgcccgcctcttccatttttaggttttactctttctttctatgtaccgtctatgaatgggattcgttctcacgctgcttcatgcaaggaaacaaatgttgtaaagaataactgcagtattgtggttattttagttaagtcagaagaaggtgacaagggaggggaaaggacagagggagctggaacatgcgacaaagcagattgcaaatctggtatgcttgtgcaactatacatactcgacgctgaaaaggagcgtgtcaagttaaagaaagaaagagacaagaaagaagatcagctcaaatccatatcttccaggaatgaagaagaaaatgcttgtactaagttttcaaagtcaaagagtatagacaagggccaaaatgacagggattttggaactcatgctctcaactgtcataaaatctcttcaaaatttcaaaatggagtatcttcaaatgatctgattgttgaatctacttctaaagctaagggagttgaaacagccacgattagtcatcaagaagctcagggtgctctacctctacgtgatgatctgtctgcttatcttgatctctcccagaagttgctggcaatatggggatctccaactgacaacaagatgggaactaatgtgatatcaaagttgcttgtgggttgtcaaagagattttcaggttctctttggctgcatgaatatgagtctgccctctgaaataacaagagaattactttcagatttaagctcttcaggagtagcgttgcattacctcaaggatcgttttcatactccagaagcagcaaagatttctaatctctaccttgcattgacaaagatagctgatgggacagatgttttgaaaactctgattgagccattgcttgatctctgtggtatggaaaatctctctctgtgtactacacatggttctgaagctccttctggaattggaaaagaatgttggaaggaggttgatgtctggtctgggtttgataactatgatgaaaacacgagaaaatggaatgttttctcaaggggcattggtgacttgggagggatgaagtatggtcacttgttgttgttgttgttgattttccctaaatgcttagttgtagtaagcaattctgtaatcatgcttccttcagaaaatgctgctgagcatttggacaatgtcttcattgaaggactttgcattgggaagggccttgcggattctggtgtaaaagatggaaatatcttcaatgaagaaatagggagcagaaaagagtgccagagccatcagaattccttacaacctcgtgtaaattggatttatctttttgagataatgcatcaaatagccatgaagatcacagaagaaagagtgagagtggaggtggtatctattatgaagttgcttttcctacaaagtaatgcttactttgagagggagcggtttggccagaaaatagtttttgaaactatttcagaattgctaaagaaggatgctgggctgtctgtgaagaaacatgctctaagacttctatatctagttctaaatttgaagattgggtgggacatcactagtgttgcatggtatcttgtaggagggttccgagtctctcaaatactcataattgtttctctatctctgggtcttcagctggagcatgccttgaacctccacattcctgagttcttgggatgtccaaaactgttggctgctttctgttgtggttgcaaagagagggatgatagcagtgctatggatgacaatgatttggctttacatttccaaaattttaaaatcatccttcaaggattgtctgattgtgtagcatcttgtagaggaggtatattggagttgaaagtaagcagaaatgcaattcttgtgctggctttccttgcatcatctggacaaccgggttttgaaatttttgttggtcataagctctcttgtagaggagtaaactatcttatgttgattttgcaattactggtatcggagatggatcttgaagctggagcacatgggcagcagccagaaatatttagggagaggacatttctgatacgggagacactgatattacttaacagactagtgtctagtccttcatattctgccactgtcttgcacggtttgacgaccaatagggatatggctggtttgacaattgatgttgcaagcagattatctcagaaaggaaagaaaaatgagcagcaggacagcatggtgaatcatataagagaaactgaaattgttgacctcgctcgcatgttcaagaaaagggagttgatactgaaatgttgcgaagcagataggcagcaaaggcacgctggtctttttttggcagttttaggagttgtgcctgagaaattttga

SEQ ID NO: 4970 - DNA, 2847 bp, Glycine max
  Peptide Sequence Number=SeqID_121748
atggctgagagtgcagtgagttttcttctcgaaaggcttaaacctgtttttgtgaataagttgaaattgttcacaggggttgaagcagaagtgatatatctgaaaggacagttggagttgataagagccttcttaagggctgcagatgcatttgaagagagtgatgaggaactcaaagtttgggttaggcaagtcagagatgttgttcatgaggcagaagatcttcttgatgaattggaactggttcagctacataaccatacaaatggactctctaattatctcagtatcaggaatatgaaagctcattatcggattgcacacgagttaaaagccatcaactcacgcatgaaaactatttctttaactcgcaagagattcctcagtaaacttgacactgcttctgaggcttcaaattccacttatacagttaacgcgtggcatgatcaacggggagacgcccttctcctggacaacactgatctagtaggaatagacaggcctaaaaagcagctgatcgggtggttgattaatggttgtaccggacgaaaagtgatttctgtcactggaatgggagggatgggaaaaactactttggtaaagaaagtattcgatgatccagaagtaagaaaacacttcaaagcctgtgtttgggttaccgtttctcaatcttgtaaaactgaggagcttctcagagacttggcccggaagcttttttccgaaataaggcgaccgattcctgagggacttgaaagcatgtgtagtgataagctgaagatgatcatcaaagacctgctgcagaggaagaggtatctagtggtatttgatgatgtgtggcaaatgtatgaatgggaagctgtcaaatatgcattgcctaacaataactgtggcagcaggatcatgatcaccacacgaaaatccaatttagcctttacttccagcatagaatccaatggtaaggtgtataacttgcaacccttgaaagaagatgaggcttgggatctattttgtattagcacttttcagggtcattcatgcccctcacatttgattgacatatgtaaatacatctccagaaaatgtgggggtcttccccttgcaattgtggcaatcagtggtgtcctggctacaaaagacaagcacaggatcgatgaatgggacatgatttgccgtagtcttggagctgaaattcaaggcaatggtaaacttgataatttcaaaacagtactcaacctcagtttcaatgatttaccttaccatttgaaatactgtttcttgtacttgagcatctttcctgaggactatctgattcagcgcatgagattgattcgcttgtggatagcagaaggattcattaaagccaaagaaggaaaaacaaaggaagatgttgcagatgattacctcaaggagctcctgaacagaaacttgatacaggttgcagagataacatctgatggaagggtgaaaactttgcgaatccatgatcttctaagggagattatcattttgaagtccaaggaccaaaactttgtatccgttgtcaaagaacaaagcatagcatggccagaaaagattcggagactttcggtgcacggcacattaccatgtcatcggcagcaacatattcataggtcaggctctcaactccgttctctcttaatgtttggtgtaggagaaaatttatctcttggcaaactgtttcctggtggttgtaaactgctaggtgttttagattatcaagatgcacctttgaataagtttccagtagcagttgttgatctatatcatttaagatatctaagcttaaggaacacaaaggtgacaatggttccaggttacataatagggaagttgcataatctagaaacactggatcttaagaaaacttctgtcagagaattgcctttagatatactaaagcttcaaaagcttcgccatctccttgtgtataaatttaatgtcaaaggctatgcacagttctactccaaacatggttttaaggcccccactgaaataggaaatttgaaggcactacaaaaactttgttttgtggaggcaaaccaagattgtggaatgataataaggcagttaggggagctaagtcaactaagaaggttaggcatcttgaaacttagagaggaagatgggaaggctttctgtttgtccattgagagattaaccaatctccatgctctttctgttgcttctgaaggtgagaataaagtcattgatcttgcgttcctttgttcgcctcctccgtttcttcaacgcttgtatttgtccgggcgtttacaagagttaccaagttggatacagtctctccatagccttgctaggctatttctcaaatggagctgtttaaaacatgatccactagtatatctgcaggatctgccaagccttgcacatcttgaactagttcaagtatatgatggtgacacattgcattttgtgtgtggaaagttcaagaagctcaaggttttaggccttgacaaattcgatggactcaaacaggtgacagtgggggaggatgcaatgccttgcctagaaaggctgagcatcggacgctgcgaattgttgaagaaggttccatcaggaattgagcacttgagtaagctcaaagtccttgagttttttgatatgccagatgaactgatgaagacaatatgtccacatggtccaggaaaagattactgtaaagtttcacatataccaaatgtttattctacctattggagagatgatggttgggatgtttatgctctagacagtttcagcagagattgttctccccggtctggcacagtcatgagaagtcatgaacctcgcactctgtggaaggtctag

SEQ ID NO: 4971 - DNA, 558 bp, Glycine max
  Peptide Sequence Number=SeqID_121749
atgagatcaaccacgcagggagcccggatgacggagcatacaaacaagcagttcgacgctgacctggaaagcgtccgttcgcaattcttgcaaatgggcggcgtggtcaaagccatgatccaggaggccatcgatgctctggccagcggcgatctgactctggttgagaaagtgcgcgagcgcgataaagaagtcaatcgccacgaagtggagatcgacgaaagcatcatccgcatcctcgcccgccaccagcccaccgcgatcgacctgcgcatgctgatggccgtgtccaagatgctgacggacatggagcgctccggcgacgaggccgagaaggtggccaccgtggcccgccgcatccacgagtccgaagtccgccacatcccggtgatcgaactgcgccacatggccgccaacgtgcgcaccatgctgcaccaggcgctggacgccttcgcccgcctcgaccccatcctggccgctgccgtggtgcgcaacgacaaggaagtggacaaggaatggaagggcgcgttgcgccacctgatcacctacatgatctaa

SEQ ID NO: 4972 - DNA, 291 bp, Glycine max
  Peptide Sequence Number=SeqID_121750
atgcagaggctgacacagtcttctgcaccttttgttcctccggggacaacaaagtcatttacatatggaaatttcatggtcacccgcgactctcgtcagccgagaggagcgaaattagtgtcatacactgattttcggggacctttgcttgatgacatgcgaccattctttggtccttgtgaggtgcttggcatccatcatcaggcaatttgtgaaatcctaggaacgacaagtcacggtcacccgcgactctcgtcaaccgagaggagtgaaattagtgtcatacactga

SEQ ID NO: 4973 - DNA, 156 bp, Glycine max
  Peptide Sequence Number=SeqID_121751
atggctaccgccaccaccataaccatcgtcgtcattaccgccatcaccaccattgatgtcgacagtggtggtggtggcaatgataacgataatggtcatggtgatagaggtggtagtagcaacaatcatgatggtggttgcaatggattattgtga

SEQ ID NO: 4974 - DNA, 291 bp, Glycine max
  Peptide Sequence Number=SeqID_121752
atgtttttacgccatagcttatactattgtgatgtacatattaacaagaagaaccaggaaagtctgaaggacaaaaaaagaaggagtagagacgagagtcgtcatagactaatcacggaaagggcaagatggacgaaatcagtgtcttatctttgctttcctcttatctccgataaaagtctcgagacatgccggaaatcaaaaggaagcaggcttacgcgatccgtgaaatttcgtaatgtggcgaaaaccaaaaggaggtgtttttgcttaatccgtgagtttccctaa

SEQ ID NO: 4975 - DNA, 1068 bp, Glycine max
  Peptide Sequence Number=SeqID_121753
cgtcggttcgacgtggggaatgtcgtctcggctcggctgtactcgacggcgctcggactgtacgaggcgcgcctcaatgggcatcgcgtcggcacggctgagttgtccccgggatcgacgtcgtacgaccgcacgctctatgcgcaggccgccgacgtcaccggcctgctgaccgacggcacgaactcgctcgagatcgaactctccgatggctggtatcgcggacaggtgggggcgttccgcctgcccgccggctgggggaccactcttggagcgcgtgccgagctgcacctcgagctggggggcgggcgtcgcgaagtcatccgcaccgacggcgattggacgagcaccgagtccaaggtggtccgcgccgatctcatggacggtcagaccaccgacttccgactcgaaggccacgcgctagagcctgtcatcgtgggagcggtggaggggcccgcgatctcctggtctcccgcgccgccggtccgggtcgtcgagacgcgtgatgtcgcgcacgcctcccgcaccgacgacgacacctgggtgctggacttcggtcagaacgcctcgggctggctgcgcctgaccgacctcggcccctccggaacccgcaccgtgatcgactacggcgagtatgtgacgcccgacggcgagctcagcacgtcgcatctcgactcgacgaagccgggcgagcccgacgtcgtgttcgtgcagcgcgacgaggtggtgtcggccggcggcgatgaggccttcgagccgcgacacacggtgcacgggttccagtacgcgcgcgtcacccgggcgggtgcaccgttcgatcctgcgaccgcgcagatgcgtgtcgtgcagaccgacctgcgccgcacggcctccttcgaatcgagcgatgcggacctgaaccgcctgcacgagatcgccgactggagcttccgcggcaacgcggtcgatgtgccgacggactgcccgacgcgcgagcgcctggcctggacaggggactatcaggtgttcgcgccgaccgccgcgcgcctctacgacgtgctcgggttcacgcgcaaatggctgcagtcg

SEQ ID NO: 4976 - DNA, 279 bp, Glycine max
  Peptide Sequence Number=SeqID_121754
atgggttttcgtttacctggtatcagaaaggcatcccttgctgcaatccaagcatcttcaaaagccttgaatgtgccaaagggctaccttgcaatctatgttggagagaaaatgaagcagttcgtgatccccttatcatacttgaaccagccttcatttcaagatttgttgagtaaagctgaggaagaattcgggtatgatcatccaatgggtggtctcacaattccttgcagagaagatgtgttcttagatacctcttctcgcttgaataggtgttaa

SEQ ID NO: 4977 - DNA, 897 bp, Glycine max
  Peptide Sequence Number=SeqID_121755
atggttgagtttttaattctctgccctcaaaggtccaggaatgctgggatcaggatatctgacaaattaatacatgttattgattatgggaccgttgaagagttgggcattaaggagcttctgccagcatatttgaaacccaatctccaatctagtgatttgatcacaggggtctgttttgcttcaggtggctcaggctacgaccctttgacatcaatattagagtcatcgatgccattaactgggcaagtggatttgttgaaagaatacatagggaaactaaaagggctggttggagaggacagagcaaagtttatcttagccaacagtctattcattgtagtagcaggcagcagtgacatttctaatacctatcgcactagatccctcctctatgatcttcctgcttacactgatcttttggtcaactcagcttctaatttcttgacggaaataaatgagctgggtgcacggaggattgcagtattcagtgcacccccaattgggtgtttgccatttcagagaacagtgggaggaggattagaaaaaagatgtgcagaaaggcccaacaatttggcccaattatttaacaccaaattgtcaaaggagcttgattccctcaaccgcaactttcccaatagcaggaatgttttcatcaatgtttacgaccctctacttgacatcatcaccaatcaccaaaaatatggctataaagttggagacacaggatgctgtggcacaggcaggatagaggttgcaatactatgcaaccgtttcgattccagctgtcccaatgttcaggattatgtcttttgggacagttttcatcctacagaaagcgtttacaagaggctcatatctcctattcttcaaaaatatttggaccaattcaagtga

SEQ ID NO: 4978 - DNA, 699 bp, Glycine max
  Peptide Sequence Number=SeqID_121756
atgggtctttttatgaagctcccttttcctcctcatcttgcagcttcctcactgctccatttcatattattattattattattgatttttgatattgtgtgtaaaacaagggcagttgtgaaaattccaccaaatgtttcagttccagcagtgttggtgtttggagattcgatcgtggacactggcaacaacaacaacaacttgggaacaacggctcggtgcaattacccaccatatggtaaagattttaagggaggcaaaccaactggtcgatttagcaacggaaaggttccatctgactttatagctgaagaattgggcattaaagagtatgtaccagcatacttggatccacatctccaacctggtgaattggccactggtgtgtgctttgcatccggtggtgcaggatatgatccttttacatcgcaatcagcgtcggctatacctttatcgggtcaactagacttgttcaaagaatacataggcaaactacgaggagtggttggagaagacagagcaaagttcatcttaggcaacagtctttatgttgtggtatttggcagcaatgacatttccaatacttactttttgacccgtgttagacaactgcaatatgattttcctgcatacgctgattttttgctcagctcagcttctaatttcttcaaggtggtacaccaattagataagaactaa

SEQ ID NO: 4979 - DNA, 120 bp, Glycine max
  Peptide Sequence Number=SeqID_121757
atgaggcccaaatcaccattgcctggccttgttgattttcatgggaagcggaagcaaatggttaagattcaggttttggagagagagattggtttgcttcagtttgattttaaattttaa

SEQ ID NO: 4980 - DNA, 354 bp, Glycine max
  Peptide Sequence Number=SeqID_121758
atggctttatgcatgaaattcgattcaattacctttgcattttggtcgaagagctcagtggatgttgagccaggacgaataagattgctgtccaatagatatactaccaacacacttttggatacagttaatgctgctaccatacagttcaaggaaatgggtggaagcaggaggccttccgaatcattgagaacaaacgaacagcctacagaaaaaaagagaggatttggtgattggatgaatttgattaaacctgccgatgaagagaaggatcattgggtaacattagatgcaaattatgttttcttttgcttttttctgaaccccataccagatttggctcctttaaagtga

SEQ ID NO: 4981 - DNA, 1404 bp, Glycine max
  Peptide Sequence Number=SeqID_121759
atggagaagccagctgaagcagagaacgttctggtccttccccctcataaacaacccgacaacgacgacaacaacaacaacaataggccaaagccaaagccaaagcgtttcgtgaaaaaccaaatcccggagtcaatccttaacgatcctgttctgaacgccgcaatctccgtgctcccttcgaactacaacttcgaggtccacaagtgcgtttggcgtgtactctccagcggagcaaagcgcgtggcactccagttccctgagggcctcctcatgtactcgctccccctctccgacatcctcacctccttcgccgccgtcacccactgctacgtcctcggcgacgttacctacggcgcttgctgcgtcgacgacctcgctgcctccgccctcggcgccgaccttctcatccactacggccacagctgcctcgtccccatcgactccaccacaatcccctgcctctacatcttcgtcgacatcaaaatcgacgtcccccacttcgtcgataccctcatcttaaacctccacaaagccaaaacgctcgtcatcgccggaaccattcaattcgcctccgcaattcgcaccgccaagccccaattggaggaactagggtttagggttttgattcctcagtccaagccgctctccgcaggcgaggttctgggttgcactgcgcccaaggtatcgtcgaaattgctcggtgatgatggtgagagtagtgttttggtttttgtggcggatggaaggtttcacttggaggcgttcatgattgcgaatccggggattagggcattcaggtatgacccttacatggggaagttgtttctggaggaatatgatcatttgggtatgaagaggtccaggaaaaatgcgatttttaaagccagggaggaggctcggagttggggtctggttttggggacgctggggaggcaagggaatccaaggattttggagaggttggagaagatgatgagggatagaggctttgattatactgtggttttgatgtcggagatgagtcctgccaggattgctctctttgaggattctatcgatgcttggattcagattgcgtgtcctaggttgtccatcgactggggggaggcttttgtgaaaccggtgcttactccttttgaggccgatattgcgctgggagtgatacctgggtggtgggagaagaataatgaggtggtttgttgcaataagagtggctcttgttgtggggatgcaaagggaggaggagaagattttggtggagattatcccatggattactatgctcaagatggtggggagtggaattcatcttatgtgataaagtctactcgtcctcctgccaggagagttttcgttgtgtcgtctgttgctgatactactgccatttcccaacagccttag

SEQ ID NO: 4982 - DNA, 252 bp, Glycine max
  Peptide Sequence Number=SeqID_121760
atggaggagggtagcaagggacatgcgacgatcttgggggaggatcaacgtcaaagtatatctagatcttgggagagagatgaagaggagatggtggtggcgaacggccaatggcgacatgtgagagagagagagagagtgcattgtacgagagggagaacatcgaacgaccaatggcggcgatcgtcgagtgacaaggatcaaacaatagagagagaccaacaatggcgtgaaggaagcatcgtgaaatga

SEQ ID NO: 4983 - DNA, 183 bp, Glycine max
  Peptide Sequence Number=SeqID_121761
atgaagcacggacgccggacacgacacggacgccggacacatggacacctgtcgtaccgggtgtcggtgtcgggtgcgggcaaaagccaaatctcatcaaaaagctcaggagaaggctcatcattgaaagcaatgagagatccccggtgttattatctgtccattgatggagtagaatactga

SEQ ID NO: 4984 - DNA, 368 bp, Glycine max
  Peptide Sequence Number=SeqID_121762
atggaaataaataaaaagttgatgagaacagagaaaccagcttcttttgataatgtcgtcggcgtcgacgggaagcagcagcagcagcaaaatccggcgcattgtgcgcgtgcggcaaatgcttctccggtggcggaggaaggtggcggtggacgttccggcgggacacgtggcagtgtgcgtggggcccagcaggaggaggttcatcgtgcgcgcgacgcacctgaaccacccgattttcaagatgcttcttgtgaaggccgaagaggaatacggtttctgcaaccacggtcctctcgctattccctgcgacgagtctctcttcgaacaccttcttcgggtggtggcccgacccgtacccctacccg

SEQ ID NO: 4985 - DNA, 3032 bp, Glycine max
  Peptide Sequence Number=SeqID_121763
atgggaagttgcaaaagggtgaagactgtgagaatgaacaacttgagaggagtgggattacagaggaatttgaccaacctgttacttctgtggagccttgctgtttgtctgacagtactcaaagcagcaagagaaaaaggagctccccacaattaactcatgatcatggacctgctattaaaattcgacttcctttgaggaagcatagagaacctgaagaaacgaaatccaaatctaaattacaattggggtcttcttctggaagtgtgggggcaattgcagattccttcactaaaactacccttgcaagtgatcctcagtcacaatgtctcaggattacagagccaaaacgggttcttggaaactctgattctagacatggcaaagctatgctgaattcagttcatggagatgctgtggtcactaagaataatcttgtaagtgatcgtcagtcacaacaacgtctgatgattacagagcccaaacgggttattggaaactctgattctagacatgtcaaagcgatgctgaattcagttcatggagatgctgtggtcactaagaatactcttgtaagtgatcgtcagtcacaacaacgtctaatgattacagagcccaaacgggttcttggaaactctgatttaagacatggcaaagcgatgctgaattcagctcatggagatgctgtggtcactaagaatactcttgtaagtgatcgtcagtcacaacaacgtctaatgattacagagcccaaacaggttcgtggaagggctgattctagacatggtcaagcgaagcagaatttagttcatggagatgctatggtcactaaaaatcccattggaagtgatcaatgtctcaggattacagagctgaaacgggttcttggaaattctgattctagaaactgcaaattgaagcagaattcagttcatggagatgctgtggtcaccaaaaatacacttggaagtgatcgtcagttgaaaagtgtcaagattacagagcccaaatgtgttactggaaactctgattctaaacattgcaaagcgttgcataattgggttcatggagatgctatggtcacagataatgcagttgctgatgtcatagatactgcagttgatgatggaattcaaaaagtgggatctttgtacaagtctttgttacagattcctccactaacgtatgatgcattggactcagtagatgaagattggttatttagttcggaaccgacagaggcaaggcccgtctcaaagaaacagaagtttgattctgatgtctttcagctttcaaattctatgtggcctcgtgcacaatacttgcctgaggcgcgattcaattcaactactgtagccgaggtgcgatctgaggcaattggaagagcaatgatagcacagggattcgaggacgaagagaaatggctcgccgaggggatcgccggcattcagcacaacgcattcttcatgcatcgcgcactggacgataacaatctcagagacgctctcaaatactccgcgcagatgctatccgagcttcgaacttccaggctctcacctcacaaatactaccaactctatatgagagcctttgatgagcttcggaggctggagattttcttcaaagacgaaagcagacacggcgtttccatagttgatctctacgagcttgttcagcacgctggaaatatattgcctagactgtatctcctttgcacggtaggatccgtttacctcagatgcaaggatgctccggtaaaggatgttcttaaagatctagtggagatgtgtcgctctgttcaacatccaattcgtggtctatttttgaggagttacctttctcaagtcagtaaagataagttgcttgatattggctatgaatatgaagagggggaatctaatagtgtgatggatgcagtagaatttgttctacagaatttcacagaaatgaataagctttgggttcggttgcagttgcagcatcagtcatgcttaatctttggtgatcctgagctgaggccttcaattgcccattctggtctgcagggacctgctcggataagggagaagagggaaaaagaaaggaacgagcttcgtgatcttgtagggaaaaatctacatgttctgagtcagatagagggcgtggaccttgagatgtacaaagacaccgtccttcctagtgtcttagagcaggttgtcaattgtaaagatgagcttgcccaattttatcttatggagtgcataatccaggtttttcccgatgagtaccatttgcagacacttgagactttgttaggtgcttgccctcaattgcagccaacagtagacatcaagacagtgttatcacagttaatggacaggttgtcaaattatgctgcttctagtactgaagtattgcccgaatttctgcaagtggaagcatttaccaaattaagcacagcaattggcagggagaactacagaaaaggatgtcctgataaagttatggacaatgaacagactaaatgtgatgatgttgtgatagaagcacaagttgacgacatgcctatcgtgggagcaatagctttgcatgtttctcttcttacatttactctccgtgttcatccggatcgacttgattatgtggaccaagtactgggttcatgtgtcaagaagctttctggaaaaccaaagcttgatgacaatagagcaacaaagcaagttgttgcacttttaagtgctccacttgataaatacaatgatattgtgactgccctgacactttccaattatcctcgtgtaatgtatcatcttgatcatgaaacaaataaagttatggccatggttattatccaaagcattatgaagaataacacttgcatctctactgccgataaggttgaagttttatttgaactaatcaaagggcttataatggacttggatggaacaactgtggatgaggttgatgaagaagatttcaatgaggagcaaaattctgtcgctcgcctcatacacatgcttcataatgatgaaccagaggaaatgtttaag

SEQ ID NO: 4986 - DNA, 957 bp, Glycine max
  Peptide Sequence Number=SeqID_121764
atggacttgcctggtcttgtcaggtccatattccactataaagctaccgatggtgatcctatgaaccatttgatcaggcaattgcaagggcaggatggagatatagtgggagaagaagttcctacaacaccaaaaaaaatatttcagcttttaaatgagataattgaagctctttcttctgtatcatctcctgaactggccctgagactgtatctgcaatgtgctgaggctgctaatgactgtgaccttgagcctgttgcttatgaatttttcactcaggcatttgtattatatgaagaagaaattgcggactccaaagcccaagtaaccgcaatacatttaattattgggtctcttcagagaatgaatgtctttggcattgagaacagggatacattaacacacaaggccacagggtctgtttggatgaggggtgatgatgggaatggaataatccctattacttggaggtttaaaatattttttagggaaagggaataccagggcaatcattcaacttctgctcctaagtattcagcaaagcttttgaagaaacctgatcagtgccgagcagtttatgcatgctctcatctcttttgggttgatgatcaagatggtattaaagatggagaaagggtattgctttgccttaagcgtgctttaaggattgcaaatgctgctcaacaaatggccaatgcagcaaggggtagcagtggtccagtgacgctctttgttgaaatactgaacaagttgaaaggaaaccctcagatcactagttctactatccaagggcttatagaattgatcacgaccgagatgcagagtgactctgcttcagctcttccagcttcggatgccttttttaccagcacattgaggtacatccaattccaaaaacagaagggtggtatactgggtgaaaaatatgatcccatcaatgtctcaatccctgcctaa

SEQ ID NO: 4987 - DNA, 3792 bp, Glycine max
  Peptide Sequence Number=SeqID_121765
atggcagaagtggaactagccccagattcacgtttagaacaaaatgtatcatctaaaatagaccaacaaaccaaaaccgagagtgtttcgttttttggcttgtttgctacagctgatgcaactgactgtgtcttgatgttcctcggatgctttggttcgtgtgtccatggcgctgctcttcctgttttcttcattttgttcggtcgcatgatcgactctttgggacatctttctaatgatcctcacaaattgtcctcacgagtttctgagcatgctttgtatttggtctatcttggaggagttgttctggtatcagcttggatgggtacatcttataacttggacctcatttctttctttccaagtgttgcattctggatgcaaacaggggagaggcaaacggcacgtttgcgcttgaaatatttgcaggcagtgctaaagaaggatattaatttctttgacaatgaagccagggatgctaatattattttccacatctctagtgacgcaatattggtacaagatgcaattggagacaagacgggccatgccattcgttacctttctcaattcattgttggatttgccattggatttacctcggtgtggcagctcacactactcaccttggctgtggttccattaatagctgtagctgggggagcttatacaataattatgtctactttatcagaaaagggcgaagcagcttatgctgaagctggaaaggttgcacaagaggtaatttctcaagtgcgtactgtttactcatttgtaggagaagagaaagcagttggttcatactcaaaatcacttgataatgctctgaagttgggcaagaagggtggtttagcaaaaggaattggagtaggcttcacatatgggttgttattttgtgcttgggcattgcttctatggtatgctagcatactagtgaggaatcataagacaaatggaggcaaagcgttcacaacaattatcaatgtcatctttagtggatttgctcttggtcaagctgctccaaaccttggttccatagccaaagggcgtgccgctgcaggcaatatcatgaacatgattgcgtccacttcaagaaattctaaaaagtttgatgatggtaatgttgtcccacaagtagcaggggaaattgaattttgtgaggtctgctttgcttacccctcaagatccaatatgatctttgaaaaattgagcttctcagtgagtgctgggaagaccatagcaattgtaggtccaagtggttccggaaagagcacgattgtttcgctaattcaacggttctatgaccccacttcaggtaagatcctgttggatggatatgacctaaagaatcttcaattgaaatggttgagagaacagatgggcttggttagtcaagaaccagcactatttgcaacaacaatagctggaaatattttatttggaaaagaagatgcagacatggataaagtcatacaagctgccatggctgcaaatgctcattctttcattcaaggattacctgatggttatcaaactcaggttggagaaggtggcacccaactttcagggggccaaaagcaaagaattgccatagcaagagcagtgctaagaaacccaaaagtattgcttttagatgaggcaacaagtgctctagatgctgaatcggagctcattgtccaacaggcattggaaaaaataatgtcaaacagaacaacaatagttgttgctcatagattatccaccatacgcgatgtagatacaattgttgtgttgaagaacggccaggtggttgaaagtgggactcatttggaattgatgtccaacaacggggagtatgtgaatctggtgagtttgcaggcatcacaaaacctcacaaactctagatcaatatctcgctccgaaagttcaagaaattctagttttagagaaccttcagacaacctgaccttagaggagcagttgaagttggatgcagcagcagaactgcaatcaagagatcaacacttgccatcaaagactacttccactccatcaattttggatttactgaaactgaatgctccagagtggccctatgcaatacttgggtcagtaggtgcaatattggctggcatggaagcccctctctttgctcttggaatcactcacattttgactgcattttattctcctcagggttctaaaatcaagcaagaagttgatcgggttgcttttatatttcttggagtagctgttattactatacctatttatctattactacactacttctatacactgatgggagagcgtctcactgcccgtgtgcgtttattaatgttctcagctattctcaacaatgaagttgcatggtttgataaggatgagaacaacactggctcactaacggccatgctagctgcggatgcaacattagtaagaagtgctctagctgacagactctcaaccattgttcaaaatgtagctctcactgtaacagcttttgttattggtttcacattgagttggaaactaacggcagtggtcgtagcctgccttccccttctcataggagcttctatcactgagcaactatttctcaaggggtttggaggagactatggccatgcttactctagagcaacttctttggctcgtgaagctattgccaacattcgtaccgttgctgcttttggcgcagaagatcgagtctcaacccagtttgcatctgaactgaacaaacccaacaaacaagcacttctacgtggccacatatcaggttttggctatggcataacacagctattggccttctgttcctatgcacttggcctttggtatgcatcagttttaatcaagaagaatgagtcaaattttggagacattatgaagtccttcatggtcttaatcatcacttctctggcaatagcagaaacactagctcttaccccagacattgtgaagggatcacaagcactaggatcagtttttggcattatccaaaggagaacagccatcaccccaaatgacaccaactcaaagattgtaactgatgtcaaaggagagatagagtttagaaatgttagcttcaagtaccctatgagacctgacatcaccatatttcagaacttaaacctcagagtcccagcaggcaagagtctggcagtagtggggcaaagtggttcaggaaaaagcacagtgatttctttggtaatgagattttatgaccccgattcggggttagtcctggtagatgaatgtgatatcaaaaacctaaacctgagatccttaaggctgagaataggattggttcagcaagaacctgctttgttctctaccacagtttatgaaaacatcaagtatggaaaagaggaggcatcagaaatagaggtaatgaaggcagccaaagcagcaaatgctcatgaattcatcagcagaatgccagaagggtacaaaaccgaggttggtgagagaggggtgcagttgtcaggaggacaaaaacaaagagtggcaattgctagagctatcctgaaagatccatccattcttttgttggacgaagcaacaagtgcacttgacacagtatcagagaggctagtccaagaggctcttgataaacttatggaaggtagaacaactattttggtagctcacaggttatcaactgttcgcgatgccaacagcattgcagtgcttcaaaatggcagggttgctgaaatggggagccatgagaggctgatggccaaatccggaagcatctacaagcaattggttagtctacagcatgaaacacgcgaccaagaagatcattga

SEQ ID NO: 4988 - DNA, 396 bp, Glycine max
  Peptide Sequence Number=SeqID_121766
atggtgaaacaaaaatcattcatgaaggtggttggaacaacaatgctgaaatcttggaatgtcaactttttgggtgagcctctaacattatattttgtaaggcaaaaggaatgtactgagccagtcaagcttattaaagtgatatggagtccacccttgtccctcccaccatcgaagccactggacctcagtttgcatgcaggggcagtgggtcattcccaattaagctacaaggggggttcttcaaccaccaaaggaaaaagcaacaaaaagaaggcacaagaggcaaagagcctgttcaatccttgtgattcctatgcgagtataactaactggcgcaagcctatttcttgttttctgtcagcaattgacgagaagtactacctgcctatgtga

SEQ ID NO: 4989 - DNA, 159 bp, Glycine max
  Peptide Sequence Number=SeqID_121767
atgttttcaaatacaagaaaagctggtccacatcagaacaagcatctgtcggcgctgctagtggctcggggacctaagggatatgtggctccacgaatgaggcctcatgcgtcgcaggtggatgacgcgacgaatctgattgctgggctgcgatcatga

SEQ ID NO: 4990 - DNA, 273 bp, Glycine max
  Peptide Sequence Number=SeqID_121768
atgcatgctgtttctattatacatataattggtgtttttatgtcttttcaccctggtgggaatcaacttaagaatggaaattttcagggacttgctggggagttggtgaatgttttaagagaagcagggcaaattgtaccggatgccctcctgaaatttggcacacatgtaaagaaaaaggagtccaaactttatggggcacacttcaaggaaatccctgttgatgctccgaagtctcaaaagaaaacatttgacgactctgatgaagactaa

SEQ ID NO: 4991 - DNA, 429 bp, Glycine max
  Peptide Sequence Number=SeqID_121769
atgactgatcccatcatccatccgagacaacagattggtaatcatcctaattggttttggttgagaagagaagagaagagaagaaaaggatcattgagcatgtggaagaagtggaagaaggggaagaagcaattggtgtcatcggcgccgtggagaggcgaggagacagaagaagagtcgttgaaggagggaaagctgaaagtgacgaggcagggtgatggcacttccaccatgcacgtccctgcctccaattccaaacatcttcaccaccaccaccaccatggaatcaacattgatcctcaactacgctacagcttccagcgcaattttcaggtttctaacccaatgcttaaaccctacttcatttcaacattttaccaaatcacttacttattcaacctatcagctttgtttcatttaggaaattaa

SEQ ID NO: 4992 - DNA, 2703 bp, Glycine max
  Peptide Sequence Number=SeqID_121770
aaatctcatcatcaagttcttcccattgcagaagttgaaaagaaagttatggcagatagttcagtatcctttttattggacaagctgagttcgttacttgaagcagaagtgaaactacagagaggggtccgtgaagatgttcagcacatcaaatatgagctggaaggctacaagggcatcttgagggtggctgatgctctggaagacaaaaaccctgaactcaaagcatgggttaaacgagtaagagatgttgctcatgacatggaagatgctatagatgaattcagccttggccttgttgatcaacatggacaaggcaacaattcttcgtttcatatgaactttttcacccggcataagattgcttcaaatatacaaggtatcaaatccagattggacattatatcccagaaacgtccagacataccttggataggctcaggctcaagtcaacgattgtcatcaaggcttgatagccaaggtgatgcacttctgctagaagaagctgatcttgttggtattgacaaacccaaaaagcagcttagtgacttgcttttcaatgaagaagcaggtagggctgtgattcccgtttatgggatgggggggttggggaaaaccaccttggctaaacaagtctatgatgatccaaaagtgaagaagcgtttcaggattcatgcttggatcaatgtttctcagtcttttaaactagatgagctcctgaaagacctggttcaacagctccacactgtcataggcaaaccagctccggaagcagttggacaaatgaagagtgaccagctcaaagaggtgatcaagaacctgcttcagcgaagccggtacctggttgtgctggatgatgtgtggcaagtaaaggtatgggattctgtcaaacttgctttgcctaataacaaccgtggcagtagagtgatgcttaccacacgcaagaaagatatagctttgcattcctgtgctgaattgggtaaggattttgacctcgaattcttacccgaggaagaagcttggtatcttttctgcaagaaaacatttcagggtaactcgtgccctcctcatctggaggaagtttgcaggaaaatcttgaaaatgtgtggggggttgccactagcaattgtaggaattggtggtgcattggctacaaaaggcagggccaacatagaagagtggcagatggtttgcagaagtttagggtctgaaattgaaggcaatgacaaactggaggatatgaagaaagtgctttccctcagtttcaatgagttgccttattatcttaagtcttgtttgttgtacctaagcatctttcccgagtttcatgctattgagcacatgcgattgattcgtttgtggatagctgaagggtttgtgaatggagaagaaggaaagacactggaggaagttgcagacagttacctcaaggagctcttggacagaagtctgctgcaagtggtagcaaaaaccagtgatggcaggatgaagacttgtcgaatgcatgatcttctaagggagattgtcaatttcaagtcaaaggatcagaactttgcaacaatagccaaagaccaagatataacctggccagacaaagttcgacgcctatcaatcataaacacattgaataatgtgcaacaaaataggactgcattccaacttcggtctctgctaatgtttgccttatcagataattcactcgagaatttttctatacgtgcattatgttccactggttataagttactcagggtgttagacttgcaagatgcgcctttggaggtttttcctgctgaaattgtcagtctataccttctcaagtatctgagtttgaagaatacaaaggtgaaaagcattccaggttccattaagaagctgcagcagttggagacattagatcttaaacacactcatgtcactgtattgccagttgaaattgtggagctccaacgattacgccatctcttggtgtatcgctatgagattgaatcctatgctaatttacattcaaggcatggcttcaaggtggctgcccctataggacttatgcaatctttgcaaaagctatgttttatagaggcagatcaggctttgatgattgagctaggaaaactcactcgactcaggaggcttggcatcagaaagatgaggaaacaagatggtgctgctttgtgttcatccattgagaagatgatcaatctccgctcattgtccataactgcaattgaagaagatgagataattgacattcacaacatcttcaggcctcctcagtatctccaccagttatacttgtctgggcgcctagacaattttcctcactggataagttctctaaagaatttggtccgagtgtttctaaaatggagccggttaaaagaggatcctctggttcatcttcaagatttgccaaatctaagacatgtcgagtttcttcaagtttatgttggcgagacattgcacttcaaggctaaggggtttcctagtctgaaggtgttaggacttgattatttagatggactgaaatctatgactgtggaggagggagcaatgcctggtcttaaaaagctcatcatccagcgctgtgattcattgaagcagcactgcgtccaaatggaggtgaggattattggagagtgcaacaagttccagcagtttatatctcctattggagggataggggttgggatgtctactcattag

SEQ ID NO: 4993 - DNA, 390 bp, Glycine max
  Peptide Sequence Number=SeqID_121771
atgggtcgtcctagttggggccaagctttcatgcttggggatcttttgtggcttcaccttggacttgccatacgaggtcaccaagttgaaaggttcaccaagttgaaaggttcatggttgaaccttggtattgtatctcctcgcggctcggagtttggtgacttcttccttgatcctggccatgtcttggacttcaataatagtctcattgtcgatggttccatgaattcaatggggattatggcatttgtgccatatggccctaaggatgactctattaactgcctctgtctgaccattggtctgagaatgtttgacaaagaggtcgtagctacatatgaggtgtttctaggtgaatttctccacctcgttggtcgtaatttctcgtag

SEQ ID NO: 4994 - DNA, 906 bp, Glycine max
  Peptide Sequence Number=SeqID_121772
atgtcggtggagcagaaagcagcagggaaggaggaggagggaaaactgcagaagggaattgcagagttctacgacgagtcgtctggcatatgggagaacatttggggcgatcacatgcaccacggcttttatgacccggattccaccgtttctgtttctgatcatcgcgctgctcagatccgaatgatccaagaatctcttcgttttgcctctctgctttctgagaacccttctaaatggcccaagagtatagttgatgttgggtgtggcatagggggcagctccagatacctggccaagaaatttggagcaacgagcgtaggcattactctgagtcctgttcaagctcaaagagcaaattctcttgctgctgctcaaggattggctgacaaggtttcctttgaggttgctgacgccctaaagcaaccattccctgacgggaagtttgatctggtatggtccatggagagtggagagcatatgcctgacaaagctaagtttgttggagaattagctcgggtagcagcaccaggtggcaccataataatagtaacatggtgccacagggatcttggccctgatgaacaatccctacttccatgggagcaagatctcttgaagaagatttgcgattcatattaccttccagcttggtgctcaacttctgattatgttaagttgctggaatccctgtcccttcaggacattaaatcagcagattggtctccctttgttgctccattttggccagcagtgatacgcaccgccctgacctggaatggcctcacttcactcttgcgcagtggtaagctcatattgaatttcatctcctatctcaagtcttgtactgtcattgtcgttgataattacttccatatacacagtaacttttatatagctaattaa

SEQ ID NO: 4995 - DNA, 1566 bp, Glycine max
  Peptide Sequence Number=SeqID_121773
atgccttcattcttgtttgattccgccatcggcatgggtggcactgattctggaggctcaattgagcaacccatgatggaccgggaggtcatttccattagcggttcatccttgaaggatactcgttgtggtgcctctgacagcaagtcctcctcttcggaaagggtgagggctttgcatcctactggtgggggcatttctcgcccttgcgagaaggcgcaaccttctactacttccggggagcttgtcccagttattgtgatcctccccccttctgcttctgggggagtgaggagagtgagggacgatgttatgaagtacaagtcctctctcacctctgctgcgagcatcactgctctacaacgtcaggtgaagctggcaagccctaaagacttctggaagatagtcgttcaggcttgcgggagtgatgacttccctttcttgagggcgacatcaggcaatccgccattcgtcttccaatgtgctttgcttgagcacttgaatgtggttccttctgagcttcacccaaacagttgggcgatggatcgtttcttcaaggtcctggattcgggtgtcatggctgatggtttgccactgctgcttaacactgatgctcaacaagacctgttgacccttgtggagagggtcgacaaagctattttggagcacctgccagcctcactggacacacaggctattctatctcttcccttggtgagcaatcctttcgctgttgtggacggtaaagtgccaaaccttgcccctttttttggtctgaggttggtcggacctgcacgtgggaatattccaccgcctactgctgctttcgctgaaaggggtcaacctgctgttaaggttggccatgttgttgttggtactgctgagattgctcccagtgccccttccactgtattggataagaggagggcctcttcgagcgttcgtgccctgaggcaagttgtagggttgacacccgttgtgggttgcccttcaagtgtgcaagatgtgcctctggctctattgatcgtcaaggcttctactattgatgttgttgttgctgctactcgtgctcctccacctcctcttgttgtgcttgttcaggaggttgctcctgttactactgaagtgagtgtgtcagctgctttggctggtgctgtggtggcaccctcatccaccgtcactgcacctatactaaatgtcggtgtgcgccctaaggtagctagtaccattgttgctcttattgaggttacgctgcaaggacttgctggaagagaaaaagaacttggctggcaaggtggagaatgttgcggtggtaaagaacgagcttgcaaagaatatggtggatctcaaggctcagttgaaggagtggagtccatgctggaggagtccaagatacgagctgctagggagagggaggccaacaaggagcttgaggaggagctgctcatttacaagaaagaggaccttgacttgggtctctttgaccctttcaaggacgtgaaggatggtattttgcttgatgaagatgatattgctgctgaagaggaggccagtgaggaggagtag

SEQ ID NO: 4996 - DNA, 309 bp, Glycine max
  Peptide Sequence Number=SeqID_121774
atggggacagatggcaagtttgtggcagataatgctgggatggattcccagcatcacgttggcgatgcgtcgatgctcatggctggtgaggttcttattgagctgcgtacactacccgggtttaggtctgagctacaacttgatgagctcttcgataggttttgggcctctgtcaaaaatgtctttgcaccgatctatatcgaattcatcggtcaggcttgcttggtagacggtcagggctcagattggagacccttcatccatgctcttgacttgagtaccttcaactgctatgggggtaaggcttga

SEQ ID NO: 4997 - DNA, 1032 bp, Glycine max
  Peptide Sequence Number=SeqID_121775
atggcgacgagaaatcgcactctgcttttcagaaagcacagagatgcgttgaagagtgttcgaattccctcattctcttcggcgccgtccaccgcttccggcgccggcggtggccccgtcatcgaattggccaccacttcatttctcaattccaatcgctcttacactccgatcagtaccgatgatcccggcaattcaagtaggggtccaaatgcaattactgtggggctacctccggtgtgggtggatttatcagaagaaatagcagcaaatgtgcaacgtgcgcgcacaaaaatgggagagttggcgaaggctcattcaaaggctttgatgccgtcatttggagatggtaaggaagaccaacgagctattgagactctaacacatgagataactgacttaataaagaagtcggagaagagactgcggagactttctgctactgggccttctgaggattccaatgtcaggaaaaatgtgcagcgctctcttgctactgaccttcagaacctctctgttgagctccgcaagaaacaatcaacttatttaaagcgccttagacagcaaaaagagggtcaagatggagttgatctagagatgttaaatggaagtaaatccaaatatgaagatgatgacttggataatatggtatttaatgagcatcaaatggccaagctgaaaaaaagtgaagcattcacaatagaaagagaaaaagaaatccaacaggttgtggaatctgtgaacgagcttgctcagattatgaaggatttatcagtactagtcatagaccagggaaccattgtcgatagaatagactacaacattcagaatgttgcaaccacagttgaggatggccttaaacagctgcagaaggtcctacttccattccttgtctactattttaatttggcagtgttgctagcttccctcttcccctctatctcactctcattatctcatttcccctatgataattatttggtttatgggaagtgcaggcagagagaactcagaaaaagggaggcatggtaa

SEQ ID NO: 4998 - DNA, 1473 bp, Glycine max
  Peptide Sequence Number=SeqID_121776
atggaatcaaataggcaatctctcgagggacatgagggtgctgatggtagaggtcatagaatttcagttatgcagtctacacagaaacatggtgatccaaaacaaccatctcttagtggccttagaaatgtgatgaaaggactgtgcactaatgactgtgagttgcactttgaacgtttcctccgaagagtggtacgagaggaggtagaatgcaaaatccaggatttcctatcatcaaggggatgggttaatcaaattagcacatctagagcaacaccctttgagttacgcttcgttactagaacgcctgatataatttttacgaactctaacgtgatatcagaggataaaacatccattcaaattgctctctttgatgttagagatcagtcagtggttaatgttggtcccctctcctctctaaaggtagagatctgtgccctcaacggtgagttcggttccaacggaagtgaggattggactgaaggtgaattcaatgccaatatcttgcgtgagagagatggtagaaggccattattgaatggagataggtttattactctgaaaaatggagtaggttgtgtcaataaacttgtgttcacagataattcgagatggattagaagcagaaagtttaggttgggagccaaagttgtgccaccaatttctattgaagccaacattaaggaaggtagaagcgaaccttttgtggtcaaagattacagaggagaggcttacaagaaacaccaccctccttccttgaatgatgatgtttggcgtttagagcaaattgccaaagatggaaaaatccacgatcggctatctctccatggaattcacaccgttcaggatctcttgcggttatacacaacaaacccttcttcattacttgagaaggttggcaacattacgaagaggtcatggataacaattattgaacatgccaagacttgtgcgatagatgatgacgagacttttgtctaccacacagcagaacaatcgataggtctacttttcaattccatttacatccttgtaggtgtgacattcgatggccaaaattacctctcgcctgatattctcaaccccaacgagaagcatttggtggaaacattgaagcaacatgcttacaaaaatacggataatttcaaatcaattcatgagacatcattgagctgctcaaaaccattgacatttctaggagtagggcaatctgatgctacagagcaaagtctgcaacggttcaatatctctacagaacaagaaggtcatcaaggaacatgggttggtaatggtcaaccatatgcctcaacttcatatacagatgaaagcgtacatagttaccaaatctatgctgatccagtgccagacataacagacatgccactgaacaatccttatggtagcaattcaatgaaggattttttctctggattgtgcattgaaggggatagttgggtcccttatggataa

SEQ ID NO: 4999 - DNA, 657 bp, Glycine max
  Peptide Sequence Number=SeqID_121777
atgaacatccatagtcgtagctccaaggctcttaaaactcaaggaccatccttgacaattccctggtcaatcctccaaaggaatcacaaaacccaaggtccatccttggtgagtcctactgattcgcggcactacgtctccaatacatgctacccacaaggagtgacatgtatgcaagagcacaacacacgcgttgcacacaagactcgtcaaacccaagcttcgcacttagtgatcctcacaggttcacaaaatccaaggcccatccttggtaagcctcgatgcagctctacaggcttttcaaaacctagggaaaaacacatcctcgatccaaggctcgataaatccaaggaatacaagtttatcaaaagcccaaggtccatccttagtaccaaaaaacccaaggtctacccttggtatgcacgcctacaaaacccaaggcacccccttagtttgctcactcctagcaactacgacggccaccaccaaaggtcatgcttacttctcataaacatcagaggagaaacttcgcaggtcaagcgacctacccctagactagttggtaagactgttaaccaggggcaagtcaaacatactcctcataagcatcaagggataagctctgcaaagcagaaagaagtcccaccaaatgggtga

SEQ ID NO: 5000 - DNA, 228 bp, Glycine max
  Peptide Sequence Number=SeqID_121778
atgaaaggcttgtcagctttttctatgctgcttgccatgcttggaaatgggcttatgcttccacgtgctctcttgattcgcgatttcatgtgtttaaacattatcagcaaggaattcttcttatcagcaactgttggtctgatttcgtggataggttactctcttaaccctatagcactcataaacacactgtcacatatatctgttgccattcctaggctgtgttaa

SEQ ID NO: 5001 - DNA, 2733 bp, Glycine max
  Peptide Sequence Number=SeqID_121779
atggctgttgagacttctgataaaccaaatttacctcatgattttgatgatgatgatgatgggccagtaatttacaaaaggtactcatcatctaagaaaaatcaattgcattcagaagtaaggaagtcaagttctcacagtcatgctggacagtcatatagacagatttctgatgcaccttctttgaatggccaaacttttagcatgcagaaaggtagtactgtcccttctcctaagccgtcacccgtgaagccttctgtagctatctctaaagcttcaaaatctcttgtcaacacctcctctacgaagttgccagtagcaaactcaaaagcaccttctttgggagataaacagaaaatgtccgttgatgttaaggtggaaccaaaatatattgaacgctgtgctaaaaattttgttgaagattcagaagatgatgaggataataaaccattgagttttagattgaagaattctaaccatgataacaaagcgacccctgttgttgtcaaaaaatcttctgaagactctgatgatgatgtccctttggcaaaaaagttataccgtaatcccaatttgggaacaactagcagtaaccgtgacgactctgatcagaagaagcctatttctaaaattcagaaagagcggcaaaatggtgctggcttgagtaataaaaaagataggccatctccattgccagctaaaagacccctagataatagtgattccttgcatgcctctgttaagaagccaaaggtctcagatccagttgcatctatcaaaactaagccagtctcggtgaaacatgagctgaaggtagaggatgatgatgatgatattcctatttcccagagaataaagaaatcagccatgtcaggtgataaatcatctgccacaaagaagttgctgacaaaggttactaaagttaataagtctggttcaaaaccttttaagaaacagataaagaagacagttaaaaaatcaggcagtggttcagaatattccaaatctacaaagcttcttcctagctctggtgatgggcagaaaaaatggactactttggttcacaatggtgtcattttccctcctccataccagccgcatggggtaaagatgttatataaggggagaccagttgatttgactcctgagctagaggaggttgctacaatgtatgcagtcatgcgagatacagagtacatgcagaaagataggttcaaggaaaatttctggaatgactggcgaaagttgcttggaagaaatcatgtaatccagaacttgaaagattgtgattttactccaatctatgactggtaccaaagtgagaaggaaaagaagaaacaaatgactacagaagagaagaaggctttgaaggaagagaaaatgaaactagaggagaaatacatgtgggctattgttgatggtgttaaagagaaggttggaaattttagagttgaaccaccaggattgttccgaggccgaggagagcaccccaaggtgatgggaaaattgaaaagacgcattcgtccaggtgatatcacaattaatattggaaaggatgccccaattcctgaatgtcctattcctggtgaaagctggaaggagataagaaatgataatacagttacttggttagcctattggagtgaccctatcaatcccaagttattcaaatatgtatttctggctgctagtagttccttgaaggggcaaagcgacaaggaaaagtatgagaaagctaggatgttaaagaattatatagggaatattaggtctgcatacacaaaagattttaccagtaaagatattacaaagcagcaaattgctgttgctacttatcttattgataaattagctctgagggctggcaatgagaaggatgacgatgaagctgatactgttggttgctgcacgttaaaagtagagaatgtgactagagaaccccccaacaaactgaagtttaacttccttggtaaagattctatcaagtatgaaaatacagttgaggttgagcttcctgtttataatgcaattttgaagttccaaaaagataaaaagcctggtgatgatcttttcgatcagctggatacaagtaaattaaatgctcatctgaaggaactcatgcccggtctaacagcaaaagtcttccgtacattcaatgcatcgatcacattggatgttatgttgaataaggaaactaaagatggagaagttggggaaaagattgttgtttatcagcatgcaaataaacaggttgctatcatttgtaatcatcaacgcagtgtttcaaaatctcatactgcacaaatgtcaaagttaactgaaaaaattgatgaacttcaggctgttctgaaagaactgaaaacggacttagacagggcaaggaaaggaaagcccccttcgaagagttcagatggaaagagaaaaaagaacttgggtcccgaaatgctagagaaaaagatatctcaaaccaatgcaaaaattgagaaaatgcaacgtgatatgaagacaaaagaagatctgaaaactgtggcattgggcacatccaagataaactaccttgaccctaggattacagttgcctggtgcaagcggcatgaagttcctattgaaaaggtgctggcttctttctttgttcagattaagttattaatcacgttgttttcttcaatttctagaagctggggtgatctgttatggccatgttcactcccaatttttctgaagtttatttaa

SEQ ID NO: 5002 - DNA, 678 bp, Glycine max
  Peptide Sequence Number=SeqID_121780
atgactgtttcctatgttgttaatgaagaaatggatgcttacgtgagacacatgctacttagagatcgaaccaaagggtggcgtgttttcgtctttaatagtctcggctgtggagatagccctgttactactcctcagttctatttggcttcgtttttgggagatatgcgagaggttgtttcccatgtcaccggtagataccccaatgctaatgtatattccgtaggatggtcagttgcggccaacattcttgtgcgttacttgggtcaggaatcgcacaattgtccactttctggtgccgtgtcattgtgtaatcctttcaatttggttatggcagatgaggacttccgcaagggcttcaacattatttatgacaaggccctttcaaaggctcttcgcaagattttcaacaagcatgttttactcttcgaagatattggtgctgaatataacattccactggcagccaatgccaagtctgttagggagtttgatgatgcactgacccgtgtttcttttggattcaagtctatggatgaatactactctaattccagcagttcagactccataaaacatgttaaaacccctttgctttgcatccaggcagccaatgatccgattgctcctaataggggaatccctggtgaagatatcgagggagatgaaaaatactaa

SEQ ID NO: 5003 - DNA, 941 bp, Glycine max
  Peptide Sequence Number=SeqID_121781
ctcttgaaatgaaaccacaaaccaatgggatgtctagagctcataaggcaaataataatacacagtttgaagggcctaactggcttatttttgctgctggtgctttgttgagtaccctatccattcgcctcggttacaagttaaagcaggcagtcgactccaagccgaagcaaaatgcaactactggtcagaaaggaactggaggtaccatggagctaaagtgcccaccaaatggccaaatgcagatgctgaatgagtttgatggggctctccctttggtaacagttcctgctgttgctgaatttagcaaggaaaatggtgttgtctgggcatgctctcctgatcgtctcgaactgccttcaaagccattccaccattcaaactgctcagattcaccatgcgtatcagaatctggttctgatatttttagtaagcgggaagtcatacagaaactgcggcaacagttgaagagaagagatgatatgatactagaaatgcaagatcaaatggctgaattgcaaaattcactcaatgctcagatgggactttcttctcatttgcaattgcagcttgatgctacaaacagtgacttatttgactccgagagagagatccaacggctaaggaaagcaattgcagatcactgtgttggatttgttcaccatgacaaatcttccaaggtgacagtttttcctgctgagattagaaatgacctttcaaatgggcatcttgatggggagaataattgtgaatcccctgaaaaactaagggatgaggaggagagaattgagttgctgaaaaggcaagtaggagagttgaaagaggtaatagaaggaaaagaatacttgctccagaactacaaggagcaaaaggcagaactgtctctgaagattagggaattgcagcagagattggattctcagctgcctaatattttgtag

SEQ ID NO: 5004 - DNA, 627 bp, Glycine max
  Peptide Sequence Number=SeqID_121782
atggaaacgtggttcgttgccactattctgtgcctttgcctttcagtgattctcaaagcaatacgcaacgttttcttttctcccctccctccagggcctcacaaatgcagctttagattgctaccacaatacctcaccgatccaaagaccattcttcaaaagcttcatgcaaaatatggttcaatcttcactgttcacgttggttattctcgcacagacattttcattgcagatcgctttcttgcacaccaagctttgatccaacatggcaccgtcttcgctgatcgccctaaggccaatcccaccaacaagattattagtagcaaccaacatgacattcttttcagcttctatggccccaaatggcgcctccttcggcgtaacctcacttcaagaatccttcacccctcacagatcgggagggacccaacagcttgggatgatcctttggcctttaagccagagaggttcatgaacaatggtgaacaaaatggaggcacaaattttgacataatgggaagtaaagagatcaagatgatgccgtttggggcagggaggagaatgtgtcctggctatgctttggaaattttgcacttagagtactttgtggccaattttgtttggtag

SEQ ID NO: 5005 - DNA, 129 bp, Glycine max
  Peptide Sequence Number=SeqID_121783
atgaagaaaaattgcctcagaaaaaagagaaatcgtacccctcaagcaaagtggagtggttcagttcacgttctccaccgtttaaagagcttgcgtctgcgcgtgtgcttggtgacggttgttgcttaa

SEQ ID NO: 5006 - DNA, 552 bp, Glycine max
  Peptide Sequence Number=SeqID_121784
atggccacacttcctagctcacctccttctcctcctgagtcaacaacacctttttcactgtttacgttgaagaagacaagaaaagcaacacgatttagattgttggctactagaccagctggggtggagagaccagtgattcatgtcgatcctgtcactggaaaagccgatggtctccacaaaaagaaattaagaatatatttggggattgtcgcttgtgataaagtggatgttacatatgataattggaaacaagtccctgtcactcaaaaggatttgatctgggaggatattcagattgtaggagagcggtggaggcagtttgagtcatatttgacctccaaatggggcctggcacacgacagggagtgtgaggatgacaaagtatgtgagaagtacgacataagtaaagagaagtgggcccaattttgtcaaagtcgtagagacccttcatgggagatgttcgaaagaaggcgtaggccatttagaaacaaaacactacccttcacgtgttgtctcatgaggattatgattttctataacaaaagttaa

SEQ ID NO: 5007 - DNA, 159 bp, Glycine max
  Peptide Sequence Number=SeqID_121785
atgggaaatgctaatagacatccctacagtacatgcgaaagccctgctgatagtccgatgaggaagttcgaacgaactcgtcgaaagcaacttgacgaagaggctagctgcttcaatgtgaaagagattcacaaaggggtgttgcgtgtgcgcaactag

SEQ ID NO: 5008 - DNA, 366 bp, Glycine max
  Peptide Sequence Number=SeqID_121786
atggaagaggaagcccactctaagccttatggtgaagaacaagcagctaatgtaggtggtgagtctcttcataaaggagaagaagaattgatgaagttgtgctacctcaaaaaggcatatcagttaaacttcatcaaaagaatattcaagtatagattctttctccgcaaacatcagaatgactatttaatgtatcgcaacatgccccttttgcgggcgagcgagacgaggctcacgggtgcgctttccaaaggaggaaagatgtgcggagtcgccaccaacgtttatttgtggaaaacgtcggaaaaaccgaaggaaaccggtcaaaacgaaaattctaagttcgggagttgtatttacgtttga

SEQ ID NO: 5009 - DNA, 672 bp, Glycine max
  Peptide Sequence Number=SeqID_121787
atgaatgactcagtggacaaactggtaatcttcctagcaaagagagatggcatagacaaggtggtgaagacgttccagtacgtgtcaaagctcgtaaactggcacgtggaaggcacgcaggcggacatatcgaggaggttcaagcaatgggaagtggcctcagggctcagcagaaaagccttcagaactggaaggttcctcagcggcttcaacgttcttcgcagaaacccaggctccaccctttctcttaggctactagcggtgctcgcaaatgcaggggaaatggtgtatttcttcttcgatcactttctttggttggcaaggattgggaccatagacgcaagcttggcgaagaagatgagcttcatatccgcgtttggtgagtctgttgggtatgtcttcttcatcatagctgattttattatgctcaaagaagggatcaaggcacagagagagctgagcagctccaaggaggaagagatcaaaatagggattcagaagatcagaagcgatagaatcatgaggctaatggcagtggctgctaatgttgcggatttgttcatagcaatagcggagattgagccaaaccctttctgcaaccacactgttacgcttggtattagtggcttggtttctgcttgggctggttggtatagaaattggccttcataa

SEQ ID NO: 5010 - DNA, 565 bp, Glycine max
  Peptide Sequence Number=SeqID_121788
atggcgataaaagaaaggcatagcatagggcggttgactcaaatcttgaacagtgttttcgtgttcggtgagatggaagaaaggaagcaatcgcgttatgtgaagttgactaaagatcagacacctctcgaagatattacccctggcgaactcaatcagccaattcaggttcctcagggaaacccaatccccaccaagggtagggatggctacttattttctaccccggaaaggaatcgaaactgggttgaggatagattggatgttcgtaagtgccctgaatgtagacagccgctacctgaaagctatgctcctcctgctgatgaaccttggatgactgggatctttggatgtgctgaagacagagaaagctgcttgaccggactgttttgtccttgtgtattattcgggcgcaatgtagaaagattgaaggaagacactccttggactggaccatgcatttgtcatgccatttgtattgaagggtttattgtttacatggtggatgtgtggcattcacactggtcaagtgcgccaatccttacagaagaaatatcacttgaag

SEQ ID NO: 5011 - DNA, 336 bp, Glycine max
  Peptide Sequence Number=SeqID_121789
atggcgtcctctctcattctgaagcgctttgtctactcttcacttctttcctgcaagtctcccactctccttcgccccgccgcttccgcttcccaccgctccttcaacgaccacgccgatgacaacgacgatcgtggctctcgctcaggtacgcgtgttggattcgagccaggttctgaacatgatgaatctcgtcgcggatgggagtgggacgcgaaagagacgaaggatgttctgcttctccgcgtgaacatgcctgggctcggaaaggaacatgtgaagatctcggtggagcagaacactctcgccgtcaaaggtgaaggcgacgagaaatag

SEQ ID NO: 5012 - DNA, 2481 bp, Glycine max
  Peptide Sequence Number=SeqID_121790
atgatgctggatttgggttcgttctcgaatgagaactttgacccgaagaaatggatcaactcagcgtgtcagagtcggcaccctcaggactctttggacaaacacctggtggacatggagatgaagctccagatggtctccgaggaaatcgccgcctcgctcgaggagcagagctccgccgctctcctccgcgtcccccgcgccactcgcgacgtcatccgcctccgcgacgacgccgtttctctccgctccgctgtctcctccatcctccagaagctcaagaaggcagagggatcatcggctgaatctatagctgcacttgctaaagtcgatgttgtcaaacagaggatggaagctgcatatgaaacgttgcaggatgctgcgggattaactcaactgagtgcgactgtggaggatgtatttgccagtggagatcttcctcgtgctgcagaaacgttagctaacatgaggcattgcttgtctgcagtcggggaggttgctgaatttgccaacataagaaagcaacttgaagtcttggaggacaggctagacaatatggtgcagcctcgtcttacagatgcattatctaatcgtaaggttgatgctgctcaagatttacgtggaattctcattagaattggaaggtttaagtctctggaatcacaatatataaaggttcacctgaaacccataaagcagctttgggaagattttgattcaagagaacgagctagtaagtctgcaaatgagaagaatgagatggagaggacatcaagtggtgatgattttcagtcggtttcacctgcaattccattctccagttggctaccaagcttttatgatgagctactactttatcttgaacaagaatggaaatggtgtatgattgctttccctgatgactataaaactcttgtcccaaggctactaagtgagactatgatggctataggttccagtttcatatctcgtatcaaccttgccattggagatgctgttccagaaacaaaagcactggctaaaggtgctggagatatgcaaaagggtattaagcttcagacaaagcatctggaggccttgattgaattgcacaatatgactgggacctttgcaaggaatattcagcacttattttctgtttctgatgtccgggttttaatggatgtgcttaaatctgtgtacttgccttatgaatcgtttaaacagagatatggacaaatggagcgtgccatcctttccgctgagattgcaggagtagatttaagaggagctgttatacgagggttgggagcccaaggtgttgaactcagtgaaacagttcgcaggatggaggagtctattccccaaataactatacttcttgaagcagctgcagagagatgcatcaacttcactggaggttctgaggcagacgagttaattcttgctcttgatgacataatgttacagtacatttccactctgcaagaaactctcaagtcactgagaactgtctgtggtgtggattatggaagtgatggtactgttaagaaggacatggagaagaaggatggaaaccaaaatgctcggagagttgatttgatctctaatgaggaggaatggtcgatagtccaaggggcattgcagatcttgacagttgcagataatttgacaagcaggtcttctgtatttgaagcatctttaagagctactcttgctagattgagcacaactctatctttttctgcatttggatcaagtttagaccaacaccagactataaacagtagtgtagatggggaaccatcttatggtggaagggctgccttggatatggcagcactgcggttggttgatgtgtctgagaaggcaaggaaactctttaaccttttgaatcagtctagagatcctcgatttcatgcacttcctcttgcatctcaaagagttgcagcatttacagatacagttaatgaacttgtatatgatgtcctcatatctaaagtacggcaacgcctcagtgacgtgtcccgtttgccaatttggtcatcagtcgaggaacaaggagcctttcctctccctaccttcagtgcatatccacagtcatatgtcaccagtgttggtgaatatcttcttactttaccccaacaattggagccacttgctgagggaatctctaacaatgaagtcaatgatgaagcacagttctttgcaactgaatggatgttcaagggtgcaactgcactttacatagagcagttgcgtgggattcagtacatttcagatcgtggagcacagcagctatcagttgatattgagtatcttagtaatgtgctctctgctctttcaatgccaatccctccagttctggctacattccaaagttgtctttctactccaagaaaccagctaaaagatcttttaaagacagattcaggaaaccaacttgatttgccaacagcaaaccttgtctgtaagatgcgacgagtgaatttggattcatga

SEQ ID NO: 5013 - DNA, 1002 bp, Glycine max
  Peptide Sequence Number=SeqID_121791
atggacgctcagagggctttactcgacgaactcatgggtgcagcgcgcaacttgacggaggaagagagaaaggggtacaaggaagtgagttgggacgataaggaagtgtgtggattctacatggtgcgcttttgccctcacgatctcttcgtcaacacgcgcagtgatctcggaccttgcccgagaatacatgacccgaagttgaaagaaagtttcgagaaatctccaagacacgatgcatatgtaccgaaatttgaagctgaactttctcaattttgtgagaaattggtgatggacttggacagaagagtaagacgtgggcgagaacgtcttgctcaagaggtagagccagcaccaccaccaccgctgacagccgaaaaatctgagcagctatctgtgctggaggagaaaataaagaaccttctggaacaagttgaatctcttggcgaagcagggaaggttgatgaagctgaagctcttatgagaaaggtggagacacttaatgctgagaagacagccttaacgcaacctcaaaatgataagctgttgatgcttggtcaggagaagaagatggcactctgtgaaatatgtggttcttttcttgtggcaaatgatgctgcagaaaggactcagtctcatgtcacaggaaagcagcatgttggttatggaatgactgctaaggagaaagctaatgaagaggaaagattagctcgggaaagagaggtggaagaacggaggaaacagagggagaaggagtctgagaggagacgaagtgattcaagtgatagggataggcatcgtgataaagatcacaatagggagagggataggtatagagatagagactcagatcgtgaaaggtctcgggagcatgatgttagaggttatcgagatgggggaagggggatggattatagggtgagaaatggaggtagagacaggtaccgtgatcggagcaggtcacgctcccctgttaagcatagccacagaaggtcttcttga

SEQ ID NO: 5014 - DNA, 174 bp, Glycine max
  Peptide Sequence Number=SeqID_121792
atgtcgctgcggctgggaaggtacctagcacgagatgtacctgtcaccacaaagaaaccaaataaaaagagaaagggtgtaataaagggaagggtttctaatggaaaaacataccaagaggaggacttgctcttacgaagtaggaaaaagaacaagcaaggcaggtggagttag

SEQ ID NO: 5015 - DNA, 156 bp, Glycine max
  Peptide Sequence Number=SeqID_121793
atggtgacgtattatggatgcaagctaagcatgtttcagaacatgtttggaatggagaagaagaccggaaattacacatcagacgagttgtccccacagagatgcgcagcgccaccgattacaaaattaaatcaatcggaggtatgtgcatcttaa

SEQ ID NO: 5016 - DNA, 477 bp, Glycine max
  Peptide Sequence Number=SeqID_121794
atgtgtcaacgtcagcccaaagccgccaatggggctggtgatatgcatacaggtacgtcattgccacgtgccagataccaaagcaacggtccagatcatggagcactcaccaaatccaaaggctcttatttgtccgtgcaaactcacacttgttgctccccttccgttccgtttcacctttcctcttcccgccagagcagtcgtcacctgccgtcggccaccgtatcagaccctcccaatacaccgttttcgacttccacacagaatttgatttgtttcatctttctcaatgcttcttcgattatttgtttgtcgatggcggactccaacaacgagtccggtggtgcgctcaacgccgagaaggggagcgagatgtcgccgcgggagcaagaccagttccttccgatcgcgaacatgagtcgcatcatgaaaaaaggaattgaaaatggctatttaccattttttaatcaagagtga

SEQ ID NO: 5017 - DNA, 354 bp, Glycine max
  Peptide Sequence Number=SeqID_121795
atgaccgttgtaaaccctcctccggttcaagagatgaaaaccactgatgacaaggaaactcctgaaacgtcttcacctaacaacggtgagcatactgatttggagatacaggctccttggttagaagaagaagaagaagaaggtatgggagacatattctacggcaacgatgaccaccgagaaatgaatgattgtatgtataaggaggatgtgatagaaagcatgagaaagcaaagggaaatcaaagaactcaagcgcagacaaaacaacaacaactactgctgctgctacttgtacttccttcgatgctttgatgactttctcacgcttctccgtgctttcatcaacttctga

SEQ ID NO: 5018 - DNA, 201 bp, Glycine max
  Peptide Sequence Number=SeqID_121796
atggcagctgcaaggaattataaaataggtgcagcacattttcaatcattaggcttcgaggagaaagtactggtttattgtgatgggataattacccaactgcatgtggaattgtccagcaatcagctccataggtctgttaagcctcctattttttcaagttttggagacatagccttggcaattggagaaaagttttag

SEQ ID NO: 5019 - DNA, 957 bp, Glycine max
  Peptide Sequence Number=SeqID_121797
atgatcagcattatgaaccttactagttccatggccattatcagtgtccttatttcagccttagtttgtgaagctaggcttctccgtgttacacctggatttgttgaaactaagggaacagaacttgtgctaaatgactctccctttctgttcaatggttttaactcttactggatgatgaacgtagctgctgatccaaaccaaagatataaagtttccaatgtatttcgagaagcttcagctataggtcttacagtgtgtcgtacatgggcatttagtgatggtggcaatcaatctctacaaatatcgcctggtctctacaatgaggctatgtttcaggcattggattttgtggtggcagaagcgagaaagtacagagtgcgtttgattctgagcttggtgaacaattacaatgattttggaggaagacctcggtacgtgcagtgggctaatagcagtggtgttcccgtcgccaacgatgatgacttttacacaaatcctgttgtaaaaggttactacaaaaaccatgtcaaaagggtgctgacaaggatcaacacaatcactaaaacagcttatagagatgaacccaccatcatggcttgggaactaattaacgaaccacgctgccaagttgattactctggcaagaccataaatgcatgggttcaggagatggctccctatgtgaaatctattgacccaatgcacttattggaggttggaatggaagggttctatggagactccatcccggataggaaactagacaaccctggtttccaagttggtacagactttgttagcaaccatctcattaaagaaattgactttgcaacaatccatgcttaccctgataattggctaacaggacaaaacgataccatgcaaatggcattcatgcaaaggtggatgacaagtcactgggaagactcaagaacaatcttgaagaagccattg

SEQ ID NO: 5020 - DNA, 114 bp, Glycine max
  Peptide Sequence Number=SeqID_121798
atggagactggctttgcccaagaatcggctgtggagtacataattatgctagcaggacagagtgcttcaaatgcaaagtgccaagggattttggtgagaaagtttaacttctga

SEQ ID NO: 5021 - DNA, 1593 bp, Glycine max
  Peptide Sequence Number=SeqID_121799
atgggaagcagtagcaggaagaagaaccaagatctggagttggagaaagttcgcttaatcagtttagccctcgaatttggcttcgacgaatcctccgccaacaaatgcctcgaccgtctcatcgctctctacggcgaagacggtcgcgatttcatcaccgtcgagcactgcggcgacgattttctcgcggcgctggcggagtcgatgcagaccgaggattgggatgaccagcaggaaatggagtcgcaagcgtgtggaacattgacgcacgtactcgacaaaaccgttgacacgtgtgccgatgcagataatgacgatgcttcgagaagcttcttcgttgacattgttgacgactcgcctcaaccgcagagacgcaaaggcaaaagccacactaatgtagtggagttggattcgagtgacgacgaggatatgcactgtagtgtttcgagggaaaaacctacggattacagaagtggcattactcaagggtcagtttcatcaacttccagcaaaatgcaatcctcctttgcatcaagggatacaagcagtagtcccacttatgaagaattgcaagcactagatgatattgaactggccaatgttgttatctttggtaataggacgtttcgaccattgcagcatcaagcatgtaaagcagctttggcaaagcaagattcttttattcttatgcctactgggggcggtaaatctctttgctatcagcttccagctactcttcaaccaggtgttacagtagttgtatctccattactttcactcattcaggaccagattataacactaaacctcaagttcggaataccttctactttcttaaattctcaacaaactgcttcccaggtcacagctgtgctccaagagctaagtcttcttgtatccagaaaagacaaaccatcatgcaaacttttgtatgtgacacctgagagaattgctggcaaccaatcgtttcttgagattctaaaattcatgcatcagaagggacagctagcaggttttgttgttgatgaggcacattgtgttagccaatatcacaacaacaatgttaatgcatcagtttattcaatcaatacgaagattcaatgccaatggggacatgattttcggcctgattatcggggattgggatctcttaagctacactttccagatgtacctgtcatggcattgactgccactgcaacgcatgctgttcgtgaggacatattgaaggctttaagaattccccatgcacttgttcttgaaagaagctttgacagaccaaatttgaaatatgaagtgattgctaagacaaaggagccactaaagcagctaggacagttactaattgatcgcttcaggaatcaatgtggaattgtttactgcctttcaaaaagtgaatgtgttgaggtctccaaatttttgaatgagaaatgcaagatcaaaacagtgtattatcatgctggcttggctgcccgacagagagtagccgttcaaaaaaaatggtatgatggagaggtccatattgtatgtgcaactattgcttttggaatggggatagacaaacctgatgttgtaagttgtgctacatcttaa

SEQ ID NO: 5022 - DNA, 912 bp, Glycine max
  Peptide Sequence Number=SeqID_121800
gcaaaaagccagtttgggattataggaggtagagtcaattgggtaaatcatgctgcacaaattatgaaatgtaggcagctgcaaacccctttctgttatttgggaattccgattggggctaaaccttcaagcaacatggtgactttaatcaattcggtgctcaatgctttaccaatatatttgctttcctttttcaagatccctcaaaaggattacaagaaaatcccctgggtaaaatgggaaactatatgtttacctaacgaggaaggtggtttggggattaaagaaatatctaaatttaatgaagctttgttgggtaaatggatatgggatttagcttctgaccagcagcagttatgggctaggatcattaaatctaaatatggtggttgggaagagcttcagttgggcagagatagaaggggctgctcacactggtggaaggacttgaggaagatttatcataactctggtcagagcctctttcaacaaaacttggcaacaacacagcatcatatcacagatggggaattttctgaagatggttggagatgggatctcaattggaggaggaatctttttgaccacgaaagtgttttggcagtgaattttatggaagatattacttctatttctattcagagaaatgtgaaggatactatggtgtggaaagctgaatctacaggagtatattccaccagatcagcttatagaatgatgttgaatatcaatgcctcagccatagatgtcagaattttcaaactaatatggaagatgaacatccccccaagggcagcaaccttcacttggagactcctcaaggacagattacctactaagggtaaccttctaagaagaaatgtcattacccaagatgctgattgccctttatgtggtcaagtacaggaggaa

SEQ ID NO: 5023 - DNA, 2001 bp, Glycine max
  Peptide Sequence Number=SeqID_121801
atgaactgggatgatgacgagcgcatacacttaatcaatcttcttaatgactgtgtcaggcttactgaattaggcaacttcaatgatgcagatattgcactctaccatctctctcaacttgcttcctctgatggtgattccatgcaacgcgttgccacttatttcattgaggcactagcctattgccaagtcgtcaaaaatttgcgtggtgtacccaaagttctccatttggtaaaaacactatcaactcccgaacaacaattagtcaagaaattattctttgatttctaccccttcataaagatcgcacacaccatcacaaatcaggccattattgaagccatgaaaggggaaacatcgattaatgtccttgatctcagtccatcttataatgctcttcagtggactaatctcatgaagtgtttattaaaaccaaacacaccaacatgtctgaaaattactatcacagccatacatgagaagaaggaggttttagagcaaatggggttgcatcttggagttgaagctgaaagtttggagaatcttgaccctgagaaattgcctatcaagaaaggtgagcctcttgctattagttctgtgcttcagcttcactctcttcttgccaccgatgatgataatgagatggtcaaaatgaggaggggtactggtcaaaggatgtttcctgagatgcttgccaaacccaaaaagaagaaggtggtgaatccaagtcctgattcagcactctcacctttctctccatgtccatcacataagatggagtcttttctctatggcctgtggaagctccaaccaaaagtgatggtgattactgagcaagagtcaaatgttaataatgggtctagtttgacaaagagggtgagaagtgctttgaaattttatagcacactgtttgattgcttggaagcttccacttccagaacatcagaaaggagaagcctaatggagaagatgttacttggggaagagataaggaacattgttgcaggtgaaggagttgagagaaaggaaaggcatgagaaactagtgacatggatcccaaggcttgaattggctggatttaggagggaacctatcagctccaatgggataaggctggcaacaaagctgttgcaaacctatgtacctggataccacatccatcagaagaacaaggctaatagagctatccatctttcttcttctaggcctcgtggaacagttagtgttgatgactttggagccaaagcagatggaagagatgacagcgaggcatttgggaaggcatggaatgaagcatgttctagaggggctatcctcgtggtacctgaaaataagatctatcgtcttaagccaataacattttctggtccatgtcgacccaacactgcctttatgctctatggaacaatcgaggcatggactcaaatgtcggcataccaagaagatagacaacactggattgtgtttgatagagtttcaaatttcagagttggtggtggtggcacattcaatggcaaagggaaaaagtggtggcaaagctcctgcaaagtcaacactaaccatgccgtgactttctatcaatgcaacaacttgaaagtgacaaacctgaggtttaaagatgcacctcaaatgcatgtaacctttgaaggatgcttcaatgttattgtttcgaatctcgtcatcagagcaccaggtgacagccccaacactgatggaattcatgtcgcagacacacaaaatattgtcataagcaacactgatattgggacaggtgatgattgtatttcaataataagcgggtcccaaaacgtacgagccacagatattacctgcggacctggacatggaataagcattggaagcttgggagctgataactcagaagctgaagtctctaatgtggtagtgaacagagcaaccttaataggaacggctaatggggctgttaggcaattcacaactcctgagacagttgaaagaatagagacaatggaggtttag

SEQ ID NO: 5024 - DNA, 789 bp, Glycine max
  Peptide Sequence Number=SeqID_121802
atggctataaatgatccagtggctgcatctgcacaaagatacaaaccaatacaatctgcagttcccggaactaccttagggccaattcaaattaatgctttcctaggaggagggaaattgtatgacactcctggagttcatctcttccataggcaaactgcagttgttcattctgaagatctacccatccttgctcctcaaagccgactgaggggcctggctttcccaagttctatagtatcttcagacaatgtagaggaaggagcttccactatagtgaatggcttgaatgaattttcaatattttggggaggtcttgttagaattgatgtcttgaaggttctcccagaaacttgtttgacattttatggacccaagagaataccaattcatatggtacccactgagcaagcagttgaattttatcagacagaacttggatttctgctgaccccaccaagtgggggagaaaatgctgagaactggaaaggacttgaatcagaacgtaaattgcaaataaaattcgaagttgtggacagaccagcttgtgatatagctatatcaggtctaggatggtttactgttgagccagttagcaggtcacacaaaatctcgcaaccaaaacctgtagagactgctggggaattgatattggctgtgcatgtccccaaggctgttgagatttttgtgaggccaccaataccagtaagcaaggctggagcagagtggtaccagtatgtagaattaacagagaaacaagaggaaatgagaccaaaatggtacttttaa

SEQ ID NO: 5025 - DNA, 1494 bp, Glycine max
  Peptide Sequence Number=SeqID_121803
atgaaaaatgatccaaattacctcagttgcaaaaagaaagaatgtaagacattccaaaatgggaaatgtgatgtctcaacgtgcagtggttcactacagtttcatgttatcaacattagaagtgacatcgagttcgtgttcttctctggtggattcgtgaaaccctgccttgtgggaaggtccacgcctgtgagctttgctaatcctaagaggccactctatggacatatttcaagcatagattcaactggaacatcaatgagattgacatgggttagtggagacaaggagcctcagcaaatccaatatggaaatggaaaaacagttacttcagcagtcactacattttcacaggatgatatgtgcagttcaacgctgccaagtcctgctaaggatttcggatggcatgatccaggatacatccactcagcacttatgactggacttaagccttcaagcaccttctcctacagatatggaagtggctccgttggttggagtgaagaaatcaaattttcaactccacccgctggaggatcagatgagctcagattcattgcatttggtgatatgggcaagactcctcttgatgcttcagaagaacactacattcagccaggagctctttctgtgattaaagccatagccaatgatgtaaattccaacaatataaattcagtctttcacatcggagacataagctatgcaacaggttttctagcagaatgggattactttcttcaccttatcaacccagtagcttccaggatttcttatatgacagcaatagggaaccatgagagggattatatagattctggttcagtatatgttactcctgactctggtggggaatgtggagtgccttatgaaacatactttccaatgccaacttcagcaaaggataagccttggtactcaattgaacaaggaagtgttcatttcacagtaatatcaactgagcatgcctggtcagagaattctgagcagtatgtgtggatgcaaaaggacatggcatcagttaatcgacagaaaacaccttggctaatcttcatgggacatagaccgatgtacaccaccaaccatggattcgtaccttctgaaaacaaatttatgaaagctgtggagccattgctattagaaaataaggttgacttggttcttttcggccatgtgcacaattatgagagaacttgttccgtgtttcaaaatgaatgtaaagccatgcctacaaaagataaaaatgggatggacacatatgatggcagaaattacagtgcccctgtgcatgctgtcattggcatggctggcttcaccttagacaagttctcaaacaatgtggagagctggagcctgaaaaggatttcagagtttggctatttaagagcacatgctacgaggaatgatttaaacttggagatacaagagaagttaaggacagtttccacatcacaaagtaacagctctctcaagatagaaagcatacataagtga

SEQ ID NO: 5026 - DNA, 759 bp, Glycine max
  Peptide Sequence Number=SeqID_121804
atggctccatcttctgtcactgtcacatcccgttttcatgaatccgtcacccgcaatgcacttcgctcctatctctctgagtttatctccactttcttctatgtctttcttgtcattggcgctggaatgtcctcacggaagttgatgcctgatgcttcactgaacccaacaagtctggttgtggttggcattggaagtgcatttgctttgtcttctgttctgtacatcgcatgggacatctccggtggacacgtcaatccggctgtgacctttgcaatggcagttggaggccacattagtgtaccaaccgctctcttttactgggttgctcaactcatagcctctgttatggcttgccttgttttaagggtcattgttgttggaatgcatgttccaacatacaccattgcagaagagatgacagggtttggagcatcggtgttagagggtactctgacatttgttttggtgtacacagtgtatgcagccagggaccctaggcgtggtccaatgagttccactggcatacttgtagttggcttaattgctggtgcaagtgtcttggcctcaggtccattctctggcggctcgatgaaccctgcctgtgcttttggctcggctgccattgcaggcagtttcaggaaccaagctgtgtattgggttggacccttgattggtgctaccattgctggccttctttatgacaatgtgttgttccgttctcaactcacagattcaattcaaggaattggggtctaa

SEQ ID NO: 5027 - DNA, 1422 bp, Glycine max
  Peptide Sequence Number=SeqID_121805
atgggtcggaaacacgacgccgttttggtcagcgaaccagtcgccgaagaagttccctacagccccgagctcgattccgagaagaagaagaagaagaagaaaaagaagaacaagaacaaagacaagcaccaaaccgatagcagcaccaaacgaaagctcgacgaacaactagaccctcaaaacggcatcgaatcgaataagaagaaaaagaagcaccacgagtccaaacagaacgccgaggaaaccaacggcaacaacaacagtgacaacggtgctaatcgcgacgaaacggtggcggacgggtccgtggtggtcaccggtaagaatgcgggagacgcgaaatatgcggcggtgaagagcttcgcggattcggggctgccggagaacgtgctggagtgctgcaagggtttccagaagccttctccgattcagtcccgagcctggcctttcttattggacggtcgtgatttgattggaattgctgccactggctcagggaagacgttggcgttcggcttaccggcggttatgcatgttttggggaagcggaaggggaaaagttccaagggacgaaaccctctcggcctcgtgctatctcccactagagagctagctcaacagatatcagatgtcatgtgtgatgctggtaggtcttgtggtgtgcaatcaatttgtttgtatggtggaacctctaaagggccacaaatctcctcactaaaatctggcatcgacattatcattggaactcctggtcgtatccaggatctgattgaaatgggtatctgttgcctaaaagaagtatcttttgtggtacttgatgaagctgatcggatgcttgatatgggttttgaacaaatagttcgttctatactgggtcagacatgttctgatcgtcaaatggttatgttcagtgctacatggcctttgccagttcattacttggcacaggagtttatggatcctaatcctgttgttgtaggctcagaagacttagctgccaatcatgatgtcatgcagatagttgaggtcttggatgatcgttctcgtgataagcgcctagctgctttactggaaaagtaccacaaatctcagaggaatcgagtattggtttttgttttgtacaaattggaagccaaacgagttgaaaatatgcttcaagaagggggttggaaggttgtatcaatacacggggacaaagcccaacatgatcgcacaaaagcactctcattgttcaagaatggaagctgtcctttgatgattgctactgatgtggccgcacgaggattggatattccagatgttgaagtagtgatcaactatagttttcctctgactacagaagattatgttcatagaattgggcgtactggacgagctggtaaaaagggtgttgcacatacattctttatgcagcagaataag

SEQ ID NO: 5028 - DNA, 624 bp, Glycine max
  Peptide Sequence Number=SeqID_121806
atgttgctgacaccttggaatttgacagcaatagataggccaaaaataatctcccgaattttcaagcttaaatatgagcagatgttatcagaccttacaaagaatcacttactagggaaagtcgtcgcatacatgtacacagtggaattccaaaaacgaggacttcctcatgtccatttattgttatttttacatgccaacaacaaatatccatctccaaacgatattgatcatattatatcagcagaaataccttcacaggaagatgatccagaactctataaattagtgcaaaatcatatggttcatggtccatgtggaattttgaggcctgcatctccatgcatgaagaaaggaaaatgcagtcgattttatccaaaaaagtttcagcccacaactcttatagatggagatggttatcctgtgtatcgtagaagaaacactggtcggacaataaccaagaatgagattataattgataatagatgtattgtaccctacaatccaaaattgctgaaaaaatatcaagcacatataaatattgaatggtgtaaccaaagcacttctatcaaatatttattcaagtacatcaataaaggatatgatagagttaccgttgtcatg

SEQ ID NO: 5029 - DNA, 1599 bp, Glycine max
  Peptide Sequence Number=SeqID_121807
atgtttctatttgggtcatttactgaagatgaaactcaatcattgctgtcaaagcagtcttctggaaaaaaggaaaaacctgtggagaagaatcagctgcaatttggttctctgaattctgttactgttgagtcaaacaacctgctaaattcatcgaaatcaccagataattctccaccctctgattctcagaaatgtaatggagtgaagagtgtcagtgataattcacctgaagtgtcaggaacaattaaagagaatggcagcattaccaatatctcccctaggtccatcaccaccagtaccatcagtgtaaatgaagttgaagaaaaaaatgcaaattcttttacattacgtggtgaagatggtccctcaaacaagtttacaaagttgagcctagatgcttctgaggctgaaagcttgaagaatttacataaaattggtaatggggatgattctgcaccgaagttatctgatcgagaaccccaaaaggcacctaatgggcatgctgttatgcatgttaaggatatactgcctcgaggccttatcaactctgggaatctatgttttcttaatgcaaccatgcaggctctcttgtcatgctcacctttcgttcatcttttacagcaattaagaactcgcaaccttcctaaggttgggtatcccacattgacggcatttgctgagttcatagcccaatttgatatgccaagcacaactaaagtaaagaagcaagatacagatacgtttgagtctggaaggccatttcgccctgttatgtttgaagttgtcctaaagaattttactccggatgtgccaaatagcatttcaggaagaccaagacaggaagatgctcaggaatttctgagctttgtaatggatcaaatgcatgatgaattactgaagcttgaaggacactcttcaagtcttaacggcagcaaatcttctctggtttcttcggtggaagatgatgaatgggaaacagtggggccgaagaataaatctgctgtgacaaggactcaaagctttctcccatcggatttaagtggtatttttggaggacaacttagaagtttggtgagagctaaaggaaatagagcttctgctactgttcaaccatatctcttgctccatcttgacatctatcctgatgctgttcacacaattgaggatgcacttcacttgttttctgcaccagagactcttgaagggtaccgaacatcactcactgcaaaggccggtgttgtgactgcaaggaaatctgttcgaatagtgacactcccgaaaataatgatattgcacctgatgcgttttggttatggaagccagggaagcatcaagttgcataagcctgtccactttcctcttgagttggtattgggtcgtgaattgcttgtttcaccatctactgagggtcgaaagtatgaacttgttgctacaattactcaccatggaacggagccttcaaaggggcactacacagctgatgcccaatatcccaatggtcgatggctacgatttgatgaccaatctgtctttgctattggaacaaataaggtgctgcatgatcaggcatatgtgcttttctacagacagatgtga

SEQ ID NO: 5030 - DNA, 1194 bp, Glycine max
  Peptide Sequence Number=SeqID_121808
atggatttaaaacccaaactttggaacacaccaccttcaacttctagcagctgtagtagcagtagctgtagcagcagaagcatcagcagcgagagcgatgagagccccttctgttcccaacgcatacccatacccatagtttctggcggcttcttccactctcaccgatcactctcggttctctcgggacacgtgggctccgtttcatgcttggccttatgcggtgagttcatcctcagtgcctcgcagggtaaggatatcatagtgtggcagcaaccagatttgagggtatttgcaaagttcggacaaggagatggatcagtgaaggcacttgcaacggttgggaacaaggtcttcaccgcgcaccaagatagcaggatcagagtttggaaggtgtcaagaagctcagagaacgtgttcaagctcgttgacactcttcccacaaccaaggactatttggggaagttcatgaagcagagcaactatgtccaaacccggaggcaccacaagcgtttgtggattgaacacgcggatagcatttcatgcttgacggtgtataacggttttatttattctgggtcgtgggacaagactcttaaggtgtggaggctctcggatttgaagtgtttggagtcaataaaggctcatgatgatgctatcaatgggttggtggcgtgtaaaggggttatgtattctgcttctgcggatggaaagattaaggcttgggggagaaaaaaagatggaaagggggaggagcatggtttgaagggggttttggagggtcataaagatgtttcttttaatgctgttgttgtttctgaggatgggaaatgggtttatggaggagggtctgatgggtttgtgatggggtgggaggggcttgagagttgttgttggaagctggtttctgagaccaaggcacatgagatggctgtgttgtgtatgtgtttaatgggggagattttgtgcagtggatcagcggataaaaccatagggatttggaggagagagacttttggtaagctttgtaaagttggggtcataagtggtcatgaagggcctgtcaagtgtttgcaggcttcacctaataggattggtggtggctttttgttgtacagtggaagccttgacagaagtgttagagtttggtgggttccaaggatgctgaaatactggaatgaagggcagaattga

SEQ ID NO: 5031 - DNA, 347 bp, Glycine max
  Peptide Sequence Number=SeqID_121809
atgggaaagatgggaaagaaattgggaaattccgacgccaatgacctaagtctatggtttgtagatttccaaggggtattcttcgcctctaaacactttcctgcaaaagagctcccaacgttccttctacgcttatgcagtgactgtgccctttgctgtggaatgattattgttttcttggaactcatcgtatttgatcttattgtcgcgtatctcgttccgggtgattttctcagctatatcgtggagtatcgtggattgatcattccgagctcattttggagggacaagatcatgtcttccacgccacacagcaacctagcttcacgtgccagaagctgggacaa

SEQ ID NO: 5032 - DNA, 438 bp, Glycine max
  Peptide Sequence Number=SeqID_121810
atggtggcggctgcggcgacaacggaggagaagcataatgagaatttgagcagcgaggggagtttggaggacgatgattcgtggagagtcagaatcttcaatgggcgcaggggaaatggacctgatgtacttgattaccttctctccaatctccacaccgcggtgcataaggagcttaaagggttgttatgggatgatgggtctgcaccggaaaattcaatgataaaggaggacagctcctccgtcgtgccaagctttcaagccaccgcgaaagactttgtagtcgctgcgtttgtgaacgacaagcgagcgtttagatctaggttttttcaagtgggcgttcttgatggagaacactatcggttggtaatggaggagtacggtggtcacggtggaggtgaacggcaacagcgaaagatggagagtaacatccaatga

SEQ ID NO: 5033 - DNA, 1470 bp, Glycine max
  Peptide Sequence Number=SeqID_121811
atggccgcctgcgatgtaactcctgacccctccaagattgaagccatggtgaattggcctactcccaccactcctcagtccttgcgtggcttcctcggcttaattggattttaccgcaaattcatccgcgaatatgtcgccctcgccacgccattgattgcccttcttcagaaggataatttccattgggatcctcatacgcaattagccttcaaccaactgaagagagcaatgactcaggcgctggtattgtctttaccagacttctctattccgttcacccttaagacggatgtgtctggcacagccatgggcgtcttcctaacacagcgcggtcaccccttggctttcttcagcaaggctttctgtccatgcttggagcttgcatccacatatgttctagttgttgggccatcgattcaccatcctcatcgatcacaaaagtctgaaggaccttatgaatcaggtcattcaaacgtcggagtaacaaacgtacttgtcgaagctgttaaggctccccagaacaccaatggccaatgcatgttgttatcggtaccccattttgtcttcctcgatgccatgcccgaccactttatcaccaacgccccatttcaagacaaactcacccaagtcacctcaaaccctggttcccaccctggttttcatttgcgcgatggcctattattcttcaatgatagagtgtggctcgaacccgggaaccctttcattgttttgttgatggaagagtttcattccactccccttggtggccatttgggtttcgcgaagacccttcatcgacttcaaatgaacttccattgggccaacatgcgtgcgaatgtcaatcagttcatacgacaatgcaccacctgccaaccggtcaaatatgaacctaagaaactcgcgggcctgctccacccattgcttattcctacttcaccatggcaagacctgtcactggatttcatcaccggtctccctccctctaagggttatactgcagttctggtagtcattgatcgcttctcaaagggagcttatttcggtgccctccttacccactacacagcaaacaaagtggcacttatttttcttgatattgtttgcaaacatcatggttttaccagaagccttgtttctgatcgcgaccttatcttcatagggcacttctggcgtgatttattcactttgagcggcaccaaattacgcatgagtatcacatatcaccctgagactgacgaccagaccgaagtgttgaatcggacactggagcaataccttcgatgcttcgtccatgacaccccttcaaaatggtcccaattcctttctcttgcggaatggtgttataacactgccgttcactctgccacgggcatcacccccttcgaagctacatatgacaagccctctccgtctcttgccacttactttaagggccgtccactgttgaggcagctgatagtcttctga

SEQ ID NO: 5034 - DNA, 228 bp, Glycine max
  Peptide Sequence Number=SeqID_121812
atgtcgtcaaaaaacacaacggcggaggaacggcttgaggagttcattcatggtggcttggaaggtggaggggggattacaaaggccgaacaacatcaccttgtattcatagtggttgtgaggtcgagcttcgagaaccatgttgcagaacccagctcgtcgaaaagctcgtctatggtcggcatcgaaaaacggtctttaaccgttaaagcattcaaggcatggtag

SEQ ID NO: 5035 - DNA, 1683 bp, Glycine max
  Peptide Sequence Number=SeqID_121813
atgagatacatccttggagaacacaacattctgttcctcaaaagcttcgccttcacgatattattccttagttgcatagccattcggcttaacttgtgtctttccagcatcccttcttcactgaaatcaattccccttgaagggcatttaaaatttgatcaagttagcctaagccatgcagcaagggactttggcaacaggtaccaatataatccaatggcagtgctgcaaccagaatcagtttctgatattgtagccaccataaggcatatctggctgatgggtcctggctcccacctcaccattgcagcgaggggccacggccactcgctgcagggtcaggctcaagcccatggaggacttgtgatcaacatggaatcactcaaggtcccagaaatgcagctaggcaatcaaatccacaatcttttcctctcttccttcttcttatacaaccaaactaaccttataactccaatgcagatacatgttgatgagggaaacaagtctcctccatacgtggatgtctcaggtggcgagttgtggataaacatattgcatgagactctaagatacggcttggcgccaagatcgtggacagactacctgcatctcacagttggtggcactctctccaacgctggtgtcagtggtcagacatttaggcatggtccccagataagtaatgtacagcagctcgagattgttacaggaacaggggaggtgttgaactgttccgcggagaataatggggatctctttcatggtgttctaggggggcttggccaatttggcattataacccgggcaagaattgtcctagaaccagcacctaccatggtaaaatggattagagtgctgtactcagatttcacagcattcacaagagaccaagagaggttaatatctgcagaaaagacttttgactacattgaaggatttgtgataataaacagaactggtcttctaaataactggcgattatccttcaacccacgagacccggtccaagctagtcatttcaagtcggatggaagaactctcttctgccttgaaatggccaaatacttaaacgtggaagaaatcgatgcagcaaatcaggaagttgaggaacatttgtcccgtttaagctacatcccatcaactcttttttcaacagaagtcacatttgtagatttcttagacagggtgcacatatccgaggtcaagttgcgttcaaaaggcttgtgggatgttccacatccatggctcaatcttctaatacccaaaagccaaatactcaactttgcacaagtcgtcttcgggaacatcctatcagaaactagcaacggccccgtccttatctacccagtaaacaaatcaaagtgggacaacagaacttctgttgtgattccagaggaagatattttctacttagtggcatttcttacatctgcagttccatcttcaaatggaactgatggcctagaacacatactaagtcagaacaaaagaatattagaattctgtgaaagagcacaacttggagtgaagcagtatttgccccactacaacacacagcaagaatggagggcccattttggtcctcaatgggagacttttctgctgagaaagtccgtttatgatccattagcaatactcgcccctggccaacgtatatttcaaaaagcaataaccttctcatga

SEQ ID NO: 5036 - DNA, 825 bp, Glycine max
  Peptide Sequence Number=SeqID_121814
atgcaagattctaaagacaaaataattaggatggactcgaacagtgaaagaaagtgggatgaaagcactgtattgaaggaagaggtagacacctcctgcactagcaagaaagaaacaattctcaagagagaaagaataaaagaatactcatttaaccatagagatctcaaactaacctacataaacccctctcagaggtcagcagagtcagaaagaagtaaggtaaatggaagatggaggtactggctagagcagtgggtagatacacaactttcaaagagtaaagagcttgaagatttagactcagtttttagctcacattctagggctggggaggaatatggaggaagacaacttaagctgacaagtattaacaatcagagacaaagtccagttgaaggattggattctcctacacttggttcaagaagatcttttcctcataggaggcagtgttcagtgggagaagaccactcattttcaagctctcctgcaactccagcatacatggctgcaacagaatcagcaaaagcaaaagcaagatcaacaagctccccaaaaataaggactggggggaatgtggacatgaactctgatagctattcaccatgcaagaaaaagctatcaatttcatcttctattaacagtgaagtgcttaatagtggtaggatgggcaagctcagtagtagtaaccagcagcaaagatctccaagctttaagggcctttcagtgcctataaaatcaagcagaactactatcaaggatctcagtattaattcagattgctcactgcctaattgggatcgacaagcttccttcaaatga

SEQ ID NO: 5037 - DNA, 336 bp, Glycine max
  Peptide Sequence Number=SeqID_121815
atggctgcacatgaagtcctcacggtaggggaaactaggcatgagactatgagtgtgatgtggttgataccccaatacttgattcttggcattggagattcattttctctggttggcttgcaagagtatttctatgaccaagttcctgactcaatgagaagcataggaatggctttgtatcttagtgtgcttggagtaggatttttcttatgcagctttttaatcatcatcgtggaacatatcacggtgtcaaaaaggtacacttataaggccgtacagagaagagctatggaaactgattgttgtaagagtgatgaggtagacatggtggcttga

SEQ ID NO: 5038 - DNA, 783 bp, Glycine max
  Peptide Sequence Number=SeqID_121816
atggaggttggttatggcggggtgtggttgagctggggaaggttgggtggaaggtgggaaatgatgggagacatcgacgggaactgtgggtgcgtatgcccggagaaggaccgaacgactattgtattcaaactgcatggtcaaagaggcatagtccgtaacaatgggcccgagctgttgaagccattggattccgaggactatgtcggcgccgctaaactccaggacatggaggtcgatagtgaatacctaaccttggagtcatattggagtatgggagcaaatatagtcgcagggaagcacggtaccgttagctactgttgcctgcagagggttggtttgagttgtaggcaactggaggtgcttggcgatgcgagactagataaaattatgagtactcccatcatcgatgagtactgtcatgcggaaattgtggataaagccaaagagtttgagtgcctccggggtagatgtgccagagagtgcgttaaagcttatttgggttggggtcgtgggctgggtggtgagacgtacgattatcaggtcctgggtcatcttcctcgaccacaagtaggaagaagcgagccttgcatttgtgtgaaagagcccacttctcgtcacaattgtaacataggccatgttctcctttgtgagctatttctttcgaggtcaagtggcagacctgggggccggtgggtggtgatgggttgtttatcgaccaaggaaaagaggggtgtcaatggggttaggatggtgggtggtgcctgtgggcgagggcggtaa

SEQ ID NO: 5039 - DNA, 682 bp, Glycine max
  Peptide Sequence Number=SeqID_121817
atggagatccagaaaaaaggtttcaagggaagcttccttagcttctttgactggaatggcaaatctcaaaagaagctgctttgtgacaggcctatcttacctgatgtttcaaagcaaggaaaggaaaacatggacagcatgccaaagtcacaggaaaataggataaaaatggatgacaatggagtaaatcctagcaataatgcaagttgtggttttgattgtgccatatcaattaatagtgatgaagggtatgggactaaagccccagggttagtagccagacttatgggtttggattcgttgccagttttaactgtctctgagctctcctcatcatccacttcattatatggctccaactctcttggatcttctcattctcatgatgaggatgttcttcactcaatggttgactatggttgccctgtggatcccataaatatgcgacttaagccggagaagtcttcttggggtgccatgcaatcaagggctttgaaagtgggaaatccgtcaatgaagagatttcagactgaaatgttgcctccaaagtctgctaaacccattccagtttctcacaacaaacttttgtctcctatcaagagccctgcttttatgcaacctaagcatgcagctcatataatggaggcagctaccaaaataattgaggcaagtccccagccat

SEQ ID NO: 5040 - DNA, 504 bp, Glycine max
  Peptide Sequence Number=SeqID_121818
atgatgctgtgcgactcggaccaggctaagctatgctgggagtgcgacgagaaagttcacagcgcgaatttcttggtggctaagcattcgcgtgtgcttctctgtcgtttatgccattccccgactccgtggaaggcctccggcaccaaactcatgctcacggtgtcgttttgtcagcgttgcgtcgcgcatcgacacgtgagcttaaccgtgcatccatatccatcatatggatatcaatctagtaataataatgatgatgttgacctcgatgttgatgatggtatcgatgattcggatgaaagggaaagtcatcaagtcatgtctagttctgccacctcaccattcaagcgactaagaaataactctttttctgtcgattccaatgatgagacagtgagttcttcatctgagatgtttagtgctacatggcccgatgatgatgaatcaacaacttctctctccgtattgaagaggcaccgagatgatcaaccaaattattga

SEQ ID NO: 5041 - DNA, 162 bp, Glycine max
  Peptide Sequence Number=SeqID_121819
atggagcaagaaatggaaaagagaaatgtagtcagaattgaagaaaatgaagagaaatgggtgcatgatgcatctgtggattataaaggcagagttcctctccgtgcttccactggtgtatggaaagcctccctctttgtcctcactttatcttcatcataa

SEQ ID NO: 5042 - DNA, 141 bp, Glycine max
  Peptide Sequence Number=SeqID_121820
atggtgaaatcatttagagttcaagtgcaaatgcagttttcagagttgttcgatgctttaaagttgttattttcaatttacttcaataataatagcctacacatgcatgatttcagagatgcagaacagtgtggtacctaa

SEQ ID NO: 5043 - DNA, 441 bp, Glycine max
  Peptide Sequence Number=SeqID_121821
atggcttcgcagacgcaagtgcactcaagttgttgtctgttgcctaccattacccgcaacggagtagtggagcatgttgtgggtacttcctccgtccaccaggagcaccaccgtataatctccgacgaggcccaagaaccggagctggtcaaaggcttctatattaggcagagaggggttctcttcctctgtgatgaagagaaaaaccttagatgcatatggatggcccctatggaacttctcgtcatagttgaaacagagcccgcgctcccagcgcgaggctattcctccgtcgaaaaccacttcaagattggtggcagtggtcggctgagggatggtagcaggggtgtgggtggtatcacgcgaagaagtggagtgggcaaaggtggtggtgtgcggctacgcgatgccggacgagtatcgaggagcttctcctcctag

SEQ ID NO: 5044 - DNA, 1905 bp, Glycine max
  Peptide Sequence Number=SeqID_121822
atggatacacacactgctaaccctctgaatggcaagcctagtgagaggagaaacaatttatataaatccactttaagtttcaaaggttcaaggcattcagtaaagaacagttcttgtcagttggcaagcaaaggaaaatctgcttcacttgcaatgccatctaaaaccaatgctcagagccgtgatgaattgactttgaatgggaataggagatatatgaggcagaaagaacataacaatataaaatcaaaccagttgcccaggagccagaagaaacaaattgcagacaggggcagggtaatgcagcagagagcttgtacaagccagaatagaaatgtgcttggaaagaataatcaaaagcagaatagtgtaaccaacaaaggtagttcagcttcaaagatggactctaataagccaacacaaacttggtcttcagaaagttctactggagcaaagaagactaaaaaaaaggtttctgtaaatgccaacattgagcccaaaaggtttggcacaaggatcactgataccataaaggagtttccagtttccaaaaggaagggtatttcccaaaagaaaaactatagcagttgcgatattcacaataagccaagaggttctgatagtgcagctaatacttatgaaaacatgcccataaaatgcaatattacgactgatggaagtattgaccaggatgcatttagcatgaaaggaagcaatggtgtgatttcatttacatttacatctcccttgagaagaaacttgcccgagttacagtcctctagcgagcaagcgatgggaacaaggaacaaaattgatgtcaattcttgtagtagtaatgacaagttttatcctcaaaagtcatcattttctcctcccaggttacatgtaatagatggtgatgctttaagtgttcttttggagaaaaaactgcaagaattgacatctagaattaacccacctcagtgctccctcacgacagaagggtcttctactggtttaagatctagtttggaagacaaatttcgaagtgtgttaagcaccacagtaagggaacaagacataagcttttacaatcaattggacagcgtgcatgacaattgttcttcaagtgatattgtggtgcttagcatgaatcagcaactgcagacatcagaatcaatggaagagcctagctgtcgcagcaacagtgaaagcaaaaatggaagttacttagatagtgcatatggcattacagtttattcttccatgcaagatgaagaggtatctaatttttctctaatgaatgaatctatgtcactcgaaaacgaggcagaatggtctgagcaaagctcttccatagtgatgggggataacatggccagtgaacaatcaagtgtaatgtcaaattcggccgaatttacaagatcagcgaggaacatggaacttgaatatgtaaaggatatattcagcaatgcagagttgatgacagaagaatttgtggtgggtgagacagacaagatcataatgccaaatctctttgacaagttggagaataaaggccttggggcagaaaactatgaagagtactctaagattgagaggagggctatatttgacactgtgagtgagtgcctagaactaaggtgcagacaaatttttgttggaagctgcaaagcatggccaaaatggttggcttcagttcagaggaagaactgtttagcagaagagttttacaaggaaatactgagctttagaagtatggaagaagaggtagaggtggatgaacttgtcaacaaggacatgagcactggatggtgtaaatggcttgactttgaaattgaagcctttgagaagggttcagaacttgaatttgatatcctaacatgtttgattaacgaattggtttctgatttattgcatgtttaa

SEQ ID NO: 5045 - DNA, 573 bp, Glycine max
  Peptide Sequence Number=SeqID_121823
atgaaacattttgttgatgtcaaacgacgcgaggtaacctaccaagtgggagattgggttctactcaaactgagacctcaccgccaagtttcagtcaaaggaccagaggcgatacatggcaaactcgccaagagattttatggaccttttcaaattgtggagtgcattggtccggtagcatatcaatttcaacttcccgacatggcccgtatacaccttgctttccattgctcagtgttgaaaccatttcgaggttcaccagaattcaaggatgcaactcaattgcccaatgacttcatacaagatcaaccaatcatttctcctttggccattttggtttaccgtaagtcatcatcatcagctgagagtccctgggaagttctagttcaatggaagggattgcccccagatgatacatcatgggaagattgggaccaattgcagacagactatcaccttgaggacaaggtgattttgcaaggaccgaagagtgataacatagcaaaggaaccagtcgaagaaacagagaatgagccaattacaaagcccacttacctcaaggattacatgtga

SEQ ID NO: 5046 - DNA, 3129 bp, Glycine max
  Peptide Sequence Number=SeqID_121824
atggagaagtaccttagagaaaactttagcgttcagccgaagaacccttccgaggcggccctcctccgatggagatccgccgtctccgtcgtcaagaatccccgccgccgcttccgcatggtggccaatctcgcccaacgcgccgacgccgaacaaaagcgcacgaagctccaggaaaagatacgggttgctctctatgtgcaaaaagcagcgttgcattttattaacgcagctgggaaccgtggtggtggttccatgctctccaaagagattcaggaagcaggctttggaattgagcccgacgaattagcctccattgttcgatcccatgacaccaaatgtttagaacatcataaaggagttgaaggagtagcaagagctgttcgtgtgtcattgcaagagggcgttaacacactcgatgttcaccacagacaaaatatctatggttttaaccgccatgccgagaagcccccaaaaagcttttggatgttcgtttgggatgcaatgcaggacttaactctaatcatccttatggtatgttcttttgtttcagtaggtgttggaatcctaacagaaggttggccaaaaggtatgtacgatggagttggaatcatactatgcatccttttagtggtctttgtcacttcaatcagtgactataaacagtctttgcaatttaaggatttggacaaagaaaagaaaaatgtgagcattcaagttacaagagatagcaaaagacaaaaagtttcaattcatgatctagtagtaggagacatagtccatctgtcaataggagacatagttcctggagatggattattcacgtcaggtttcggtttattaatagatgaatcaagcctatcaggtgagagtgaggctgtgaatgttgatcaagagaagccttttcttctatcagggacgacagtgcaagatggttctgctaagatgctggtgacatccgttggtgtgaggactgaatggggaagattgatggatactctgaacgaagggggagatgatgagacaccacttcaggtcaaactaaatggggttgctaccattattggaaagataggtttgtgttttgcagtagtcacattcatggttctcacgggcaggtttttgtgcgagaaaatagctcaccatgagatcacaaaatggtcgctaaatgatgcatctagccttctcaatttctttgccactgctgtcatcataatagttgtggcagttcctgaggggcttcctttggcagtcacactaagccttgcatttgcaatgaagaaattgatgaatgacaaggcactagtaaggcacctctccgcatgcgagacaatgggttctgctggttgtatttgcactgataaaaccgggactttgactacaaaccacatggttgtggacaaaatatggatttgccaacaaactaaggccattaatatcggcaacagtgaaaatgtgttcaagtcctcagtttccgaacacatatttgatctcctcttgcaatccatattccagaacactggctcagagatagtcaaagggcaagatggaaggaacaagatcatgggtactcccacagagtccgcgttgctggagtttggcttgcttttaggaggtgattccaagttttataacgacaagtataaaatagtgaaggttgagcctttcaattcaatcagaaaaaagatgtcagtgctggtggctcttcccgatggcaccaacaccaagtatcgagcattctgcaaaggagcctcagaaatagttctgaaaatgtgtcaaaaagttgtgaatgcagacggcaaagtcgtccaattgaacgaacaacaaaggaatagcgtcacagaagttatcagtggttttgcttctcaggctctgagaacactctgcattgccttcaaggatattgaaggatcttctggaagtgatagtaatagtattcctgaggataagtacacgttgatagctattgttgggatcaaggatccagtgaggcctggagtaaaagaagctgttaagacttgcttagaagctggcattgtcgttagaatggtgactggtgacaacataaataccgctaaagcaatagccagagaatgcggcatattgacagatggaatagcaatagagggacaagatttcaggaacaagagcccgcaagaattgatgaacataataccaaaaatacaggtaatggcccgatccttgcctcttgacaagcacaccttagtgaaacatttgaggaatgattttaatgaggttgtggcagtaactggtgatgggaccaatgatgctccagctttgcatgaggctgatattggacttgctatgggtattgcagggacagaggttgccaaagagaacgcggatgtgattgtaatggatgataacttcacaaccatagtgaatgttaccagatggggccgtgctgtttatattaatatacaaaagtttgtccagttccagttaacagttaatgttgttgctctcatgctgaattttgtttcagcatgcgtgtcaggctcagctcctcttactgctgttcaaatgctttgggtaaacatgatcatggacaccctgggagcattggcactggctacagaacctcctcatgatgggctgatgaagatgccacctattggaaggaacgccaaattcatcaccagggtcatgtggaggaacataataggtcagggcatataccaaattattgtccttttggttctcaagtttcgtgggaaacagattctcaaccttaatggaccggatgatgctaccttacttctcaataccgtcatattcaacacctttgtattttgccaggtattcaacgagataaacagccgtgacatggagaaggttaatgttttacaaggcatgttgagcagctgggtttttctgatggtgatggccgcaactatatgctttcaagccataattgttgaatatttgggtgcttttgctcaaacagtgccactgagcagggagttgtggttaacaagcgtgatgattggtgcggtaagtatagttgtaggtgctatcctaaagtgcattccagttccatccagtaactacgttgccacgcaccatgatggctacgagcaacttcccagtggaccagagctcgcatga

SEQ ID NO: 5047 - DNA, 1419 bp, Glycine max
  Peptide Sequence Number=SeqID_121825
atgccagacgggtgggaaaatcgatgggttaaatcagattggaaaaaagatgagaacgtggctggggagtggaaccacacctctggtcaatggaatggagacgctaatgacaaaggtattcaaaccagtgaggattacagattctatgctatttcagctgagtaccctgaattcagcaacaagggtaagacactagtctttcaattttctgttaagcacgaacagaagcttgactgtggtggtggctacatgaagttgctcagtggggatgttgatcagaagaaatttggcggggatactccttacagtattatgtttggcccagatatctgcggttacagtaccaagaaagttcacgctattcttacctacaataacacaaaccacttgataaagaaggatgttccttgtgagactgaccaacttactcatgtttacacatttatcctccgtccggatgcaacctacagcatcctgattgataatgtggagaagcaaactggtagtctctactctgattgggatcttctccctccaaagacaatcaaggatcctgaggctaaaaaaccagaagattgggatgacaaagaatatattcctgatcctgaggataagaaaccagaggggtatgatgacatcccaaaagagctcccagaccccgaagccaagaagcctgaagattgggatgatgaggaagatggtgagtggacaccccctaccattgccaaccctgagtacaagggcccatggaaggcagagaaaatcaagaaccccaactataaaggaaaatggaaggcaccattgattgataacccagatttcaaggatgaccccgacctctatgttttccccaacttgaagtacgtggggattgaattgtggcaggtgaaatctggtactttgtttgacaatgtcttaattactgatgatcctgagtatgctaagcagctggttgaagaaacatggggcaagcacaaggatgctgagaaggcagcatttgaggaggccgagaagaagagggaagaggaggaatcaaaggatgacccagttgactctgatgctgatgaggaagaggaagatgctgatgaagctggcaatgactccgatgctgaatcaaagacggaagctggagaagacaccaaggaagagggtgtacatgttcttccagaaagcttccggaaaaaggttcttccggtagaacaatttgttcatccgaaagaaccttcttccggtaaaacaatttgttctaccggaagaaccttcttccgaagaagctaccggaagaatcttctttctaagaagctaccggaagaagttcttccgatagaacaaattgttcatccagaagaatcttcttccagagaagttactgaaagaacttcttccggtagcttctccaaaagaaggttcttccggtag

SEQ ID NO: 5048 - DNA, 507 bp, Glycine max
  Peptide Sequence Number=SeqID_121826
atgctgggttcgaggccagctcctccagaattaagagagggaaagggaaaacagacacagagagaaaggaagtttaccatcaaccaacaattctgcaattgtggattctccttagcgcaaccatgtcagcttcccttcataccagcctcatcatatgtagtcgttgagtccaagttcggcgcctggcgagtctacgctgcctcagacgtcggacgcacgctaccaggcggctcggttgtccgctccatggagacttcctttgagattttttccataaacggaaatggaagcttcagggaggttttggactttgaatttgggaacgccgaagaggggggtaatgttatagtggttgaaggaaaggctgtgaaagaggaaggtaatgagagcgagatagtggtgagagcgtatcctcagagtggaagaacgcatcagattcggttgcactgtcaataccttgggatttctatcataggagatgtgaaatacaagggtgtgcacgagtga

SEQ ID NO: 5049 - DNA, 273 bp, Glycine max
  Peptide Sequence Number=SeqID_121827
atgacgaaaattcaggggcgcgatctagtgagagaagagaagaaacgaaggaaggattttataccatcgaaacgctcttcgaagaagacattggcggaagcgatggacaagagagagagaagaaagagagagcggaggtcagggcttcgcacccgaaacgccatcgtcaacgacggaacgacagagctagggatgtgtagaaatgaactggagtggacaaatttggaaattgaggtggctcagtcctacgtggacacgaggtggcagttttga

SEQ ID NO: 5050 - DNA, 666 bp, Glycine max
  Peptide Sequence Number=SeqID_121828
atgtttttgtttgattggttttatgggattctggcatcgcttgggttgtggcagaaggaggccaagatcttattcttaggtctcgataatgccggaaagaccaccttgcttcacatgctcaaagacgagttgaggaagcctcaaaaactgcaatattgtgctcaaggttttaaaaaaatcatctgcaaccgccattgcagcctcagtgtcatgagactagttcagcatcagcctacacagtatccaacatcagaggagttgagtattgggaggatcaagtttaaagcttttgatctcgggggtcaccagattgcacgaagagtctggaaagattactatgctaaggtagatgcagtggtctacttggtagattcatatgacaaggaacgatttgccgagtctaaaaaagagttagatgctctgctctctgatgagtctttgactactgtccctttccttatccttggaaacaagatagatattccatatgctgcctcagaagaagagttgcgttaccatttgggcctgaccaatttcactacgggcaagggaaatgtaaatttgtcagattctaatgtccgtcctatggaggttttcatgtgcagtattgtgaagaaaatgggttacggagatggtttcaaatggctctctcagtacatcaaataa

SEQ ID NO: 5051 - DNA, 570 bp, Glycine max
  Peptide Sequence Number=SeqID_121829
atgtatcattatggcactggaaaactaatggcttggggaaagacaaaaataccccaaaatgatttatgtcttagcacctcccttccccaccatggacgacttgcattgatcaacaacaacttcctctgctacctccactacaagcgtggagtagcgtcacaccatcacaacactaataaatctgcttcctgtgataaacacatcatccaagactccttggaaactctcatcagagttagatctgagaagaatgatgatgatgtggttgaagggggcggcagatttgagaagctagagataggcattcctcatggcataaaagatgaacaaggagaaagaagaacaaggatatcaccctacttccagaatggggttcttggtgaaaggactatttttgttcacatgaataaaattggaggtgcaagatacaagttgggaggtgcaaaactcaaatgccctacacaagggacccaaaaacatggcataaaaaaagaacaaaaatacgacaaagtctcacaccacaacgttgcagttgcccaatgggtcatgcccaagccccaacgtgtataa

SEQ ID NO: 5052 - DNA, 345 bp, Glycine max
  Peptide Sequence Number=SeqID_121830
atgtgtttggaattggatatgttaaaacttaaaacactctctaagcagacctccctggagattagtgaaacggttgagcgagtgttttgtcgattgagtggccaggaacctccattatttccacttccgaatggagaaccacaacctgataaggagactgacaacagaaaagaaaaaggaaagcagaaggaaaatgaaaacacaaattcaaatactccatctaagaaaagaagcttcagtgaaataaatttggatggagcagatgaaactgcaaccaggtcctctgatcctgcagcagtattggaaggttctggcaaatcgcccctatcaatttctaagacttga

SEQ ID NO: 5053 - DNA, 1965 bp, Glycine max
  Peptide Sequence Number=SeqID_121831
atgggtgtattgagcgagggtcttacacaaattctgatacctgtgactgcattaattggaattgggtttgctttgcttcaatggcttttgttgtcaagggtaagagtctcttctgctgatcacaccaatgcggacaacggatatagaaaaagcttaataggagattcagagttggagaatggtgttcagagtgttgaagttaccaataactgtgctgaaatccagcatgccatttctgttgtatctgactatcttcatggagtgtttggtgcaataattttcgtctttctgggatctgtgaagggctttagtacacaaagtgacccttgcacttacaatgaaggcaatatttgtaaaccagcacttgctaatgccgtctttagcaccgttgcattcttgcttggtgctctaaactctgtcctttctgactttcttgggatgaagattgcaacctatgccaacgctagaactactcctgaagcaaggaagggaataggaaaggcttttgttaccgcttttcggtctggtccgggactttacgagtctattactggccatggccttggaggtttgtcaatggcactcttcgaaagagttggaggtggcatatacaccaaagcagctgattttggtgctgacctggtgggaaacttgaacactgtcccagaagatgatccacggaaccccgctgttattgtagacaatgtaggagacaatgttggagatattgctgggatgggctcagacttatttgggtcttatgcagaatcatcatgtgcggctttatttgtagcatccatatcatcgtttggaacgaatcatgactacacagccatgacatatcctctcatcataagctccatgggaattgtggtttggttgattgcaactctttttgcaactgatctgtttgaaattacaaacgtgagccaaatagaaccatccttgaaaagacagcttcttattgcaactatattaataactgctggtattgccatagtcagcttcactgctttgccatcagaatttaccctctataactttggagccagcaaggttgtcaagaactggactggagctgcaacaaatttgatttttggattggcacttggatataaatcagtcatcattcccgtatttgctattgctattgctattcatgtaagctttagtcttgccgccatgtatggaattggtgttgctgcacttggaatgctcagtaccatcaccactagtcttgccattgatgcttatggtccaatcagtgataatggtgggggtattgctgaaatggccggaatgagacataagatacgagagagaactgatgctctcgatgctgctggaaacaccacagccgctataggcaagggttttgctattggatcagctgtacttgcgtctcttgcattgtttggtgcttatgttagcagagcaggcatcaaaacagtgaatagtgttgggagtgcagctctcaaaatggttgaagaagttcgtaggcaattcaataccattcctggtcttttagaaggaagagaaaaacctgattatgcaaattgtgtaaagatttccactgatgcctctcttaaggagatgatcccccccagtgcattggttttgcttacaccacttattgccggaacattctttggggtagagaatcttgctggggttcttgccggttcccttgtttccggtggtgtgcaggtggcaatttcagattccaacactggtggtgcatgggataacgccaagaaatacatagaggccggtactaccccacatgatgcatcacttggtccaaaaggctccaatccacacaaagcagctgtcactgttggagaccctctcaaggatacttcgggtccctcactcaacattttgattaagctcatggcagttgaatcattgctgtttgctccattctttgcagctcatggaggcttaatctttaaatcgttctga

SEQ ID NO: 5054 - DNA, 3855 bp, Glycine max
  Peptide Sequence Number=SeqID_121832
atggatgaccaacggccagttcacgtcgtggaccgtgttcctccaagctctccagacacgattcgccccaatatgatgatcctacgggggcgttattcaagctcacttagagaggttgcttcgtctccgggctcaccccagagatacgccgagaggttcaggcgcttcagccactcactctggtccaagctgcagggctggcgcgcctccaagaagagaaactcttggacaaacgtcctccaccatgaccaagacctactccgccagtcccaaccccagccttggttccgccttccccaccatctcattccccacgccctacaccattaccaccccttctccctgctcccacccgcactgcaccacccccaatacgccgtctatctctggacgaaatcgcctcacggcgggaatgtggtctctgtttctattgtgatgaaaaattccatagaggacacaaatgtgcctctaggccaccctgttgtggtgctcgtggacggtggcaacacccacaattttattcaacaggagctcgtcactcaattgcgccttccctgtcagcccactccttcaccactacgtgttatggtgggaaatggtcagaatcttcaatgcaccagcttttgcgaaaccatcattctcgacattcaatccactcagttcaccgtggatttacatgtcctgcccattgtcggagcaaatgtgattttgggaggagacaaggaattcactctaaacccgataacttcatctcaatttcgtcatatgtcgcagacaacagagacaggcctgtattgccatatctcccttattgagactgactccatcacatctcagaacttccatccggatattcaaaagctcctcaccaagtttgcgagcctatttcagcaaccaaacaccatacccccggcacgtgaaactgaccatcacattcatcttcttcctcactcagctcccgtcaatgtctggccatacagatatccccactttcaaaagtgtgaaatcaaaacacaagttgacgcaatgctccaaaagggtctaattcaaccaagcaccagccccttctcttccccggtgttgctggtgaagaagcacgacgacacgtggcggttctgcgtggattatcgcgccctgaatgcaattacgattcgtgatcgtttcccaatcgcaatgattgatgagctcttggatgagcttggtggtgctcgctgcttctctaaactcaatttattgcagggatatcatcatatacgcatgcattccgacgacatcccgaagactacctttcacacccatcatggccactacaagttcagagtgatgccatttgggttgtgtaatgcgccttcatccttccaggccatgatgaacgccattttccgcccttacttgcgtcaatttatcattatgttcttcgatgatattctcatatatagttcttgctttgctgaccatcttcttcacttagaactcgcctttcaggtggagtacttgggccacttggtgtcctaccgtggtgtggagcccctcgcatcaaaagtggcggccatccataactggcctatacttcggacaactcgagcagttcgaagcttcttaggattggctggattctattgtcattttatacgagggtatgcttctattgcagctcctttggtgcacatcactactatggatcaatttgcgtggtcacccctggcgcacactgcattcgatcagctcaagcaagctctctctcacgcacctgttttggccttaccggactttaccatgttgttcaccgaggaaacggatgcctcagggattggaatgagggcagtcctttcccagaacaatcaccccatagcattcttcagtaagccctttcctccaaaattgctacgggcttcagcatacgtccgcgagctcttcgccatcacagccgccgtgaagaagtggcggcagtatctgctcggccatcgtttcaccatcattactgaccaccaaagccttaaggagctgctaactcaagtcatccaaacaccagagcaacacatgtacttggctaggttaatgggatatgattatcaaatccaatatcggtctggtgcccacaaccaagctgctgatgctctcttacgatgctttgaccaagattccactctgcttagccttttcgtgccttgccccttgtttttgactaaattgtacaaccaattggatgctcaccaggaatataatcaactccgacagaaaattctaaagaatcctgagaaacatgttggtctctccctcgctcagaaattgatccttcccaaaggacgaatttggttacccaaagacttgaaaatcatccccaccttgctggtcgagtatcacactacaccaactggtggtcatatgggggttgtgaaaaccatagcccgcttaatggaaaattttgattgggaaggacttcgagcagatgccactaagtttatggctcaatgtcttgattatcagtacgttaaatatgaaacgaaaagagtagttggtctcctgtgtccattgccggtaccgcatagaccttgggaggacctttcattggacttcatcaccggacttcccccttatcacgacaacattgtgatactagtcgtggttgatcagttttttaaaggaatgcatttaggtatgcttccagcgtcccacacagctcaagttgtagctaccttattcatggagatcgtaggcaaaatccatggtctaccaagaagcttggtctctgaccgtgacccgctatttgtcaacaagttttggcaagaactattccgtcggaggaccaccccattcgaagtcacctttgggtgcaagcctttcaaatttcctgaatacatcgcagggacttcggtgctagatgcagttgatgaaatgttgacaaacagagaggagacatttcagactataagaaagaagcttctgcgggctcaagaacggatgaggaaggcagcagacgctaaccggagagaagtgaattaccaaacaagggattgggtaatgctgaaactacgcccctaccgccaagtctcagccaaaggacctcaggcagcaatgggcaagttgaccaagagattctatgggctgttccaaatcgtagagcttattggcaaggcagcatatcgcttgaagctatcggaaggacctcgtatacatccgatcttccattgttccttactgaagtcttttaaaggtaatcctgaacaaggatccgaagttgctctgcccaaatgcttcactcagcaccaacctgtcatctcccttatggctatccttgattattgccgagcatcagagcaagctccctgggaagttctggtgcaatgggaggggttattgccagaagaaacatcctgggaagattggaagcagctgtgtgcagattatcaccttaaggacaaggtgaattttcaagggcccacgactgatacaaagactgaagcaagcacaagcaagaaggaggtgaaaatagcaacaacagaccaagaacacgaagcaagggtgcagtcacaaaacacagggctgacgtggttgcgcaaaggagaatccacaattgcagaattgtcggttgatggtactgcagacccgttcctaaatgggaggagaacctgtgcagagggcaatcaatatgccgatggtgtcgcgatcgagccgattagcgagggaggagaggaggttctggcagtagatttcgcggtgcttgttgactgcgatgaggatgtcgacggagattgggtaatgacatgtgacattgacatggctacggcggagaagaccaaagccttggggttgaacgagagcgtgagccctgaggctcataagtcacctgtttaa

SEQ ID NO: 5055 - DNA, 1164 bp, Glycine max
  Peptide Sequence Number=SeqID_121833
atgaaaacccgcgccatctcccccgacgagtacactctcgcgcctctcttcaagtccgcctccaacctccgctactacgttctcggcggatgcgtccacgcgcacgttgttcgactcgggttcacgcgccacgcctccgtccgcgtcgccgcgttggaggtctacgcgagttgcgagaggatgggcgatgccagcaaggtcttcgacgaaatgcgtgacccagacgtcgtcgtttggaacttgatgatccgtgggttttgcaagatgggtgatttggaaacgggtatgaaggtctttggacaaatgaaggaacggaccgtggtttcgtggaatctcatgatgtcttgtttagctaagaataacaaagaggagaaggctcttgaacttttcaatgaaatgctcgagcagggttttgaacccgacgatgcttccttggtcacggtgttacctgtttgtgctcgcttgggagctgtggatattggcgagtggatccattcctatgcaaattccaaggggttcctacaagacactattaacgtggggaactcgctcgtggatttctattgcaaatgtggcaacttgcaagccgcgtggagcattttcaacgacatggcaagtaaaaacgttgtttcatggaatgccatgatatcgggtttggcgtataacggtgagggtgaagttggggttaacttgtttgaggagatggtgcatggaggctttgaacctaatgattccacttttgtgggggttttagcgtgttgtgctcatgtgggtttggtggatagagggcgtgacttatttgcttctatgagtgtcaagtttaaggtttcacctaagctggagcattatgggtgtgttgttgacttgcttgggcgttgtgggcacgtgagggaagctcgtgatttgattacaagcatgccattgaagccaactgcggccttgtggggtgcgttgcttagtgcttgtcggacttatggtgacagggaaattgcagaaaatgcggctaaggagctcgttcgtcttgaaccatggaattcggggaattatgtgttgttgtccaatgtttatgctgaagaagggaggtgggatgaagttgagaaagttagggttttgatgaggggaggcggtgtcaagaaagttccagggcagagtgcaactggatag

SEQ ID NO: 5056 - DNA, 1281 bp, Glycine max
  Peptide Sequence Number=SeqID_121834
caccgcctccaagatgatgctactcaactctctccttgcaaacaacaacaacaacaacacacgacttaaatcaccaccttattcctctccctacaactacaagttgtctttcaaatactccatggctttaatcgtggaccttcccattgggaccccaccgcaagttcagcccatggttttggacaccggaagccagctctcgtggattcagtgtcacaaaaaagcacccgctaagcctcccccaacggcgtcgtttgacccttctctctcctccaccttctctatccttccgtgtactcaccctgtctgcaagccgcgaattcccgattttaccctccccacctcctgcgaccagaaccgcctctgccactactcctacttcttcgccgacggcacctacgccgagggcaatctcgtcagagaaaaattcaccttctcccgttccctttttacccctcctctgatcctcggctgcgccaccgagtccaccgaccccaggggcattttgggaatgaaccgtggacgcctctctttcgcttcgcagtccaaaattactaaattctcatactgtgtccccacccgcgagacccgacccggttacactccaaccgggtcgttctaccttggcaacaacccgaactctaacacatttaaatacatcgcaatgttgacttttggtcagagtcaacgcatgccgaatctcgaccctttggcctacactgtagccttacaggggataagaatcggaggaagaaaactcaacatctcgccggcggtttttcgtgccgatgctggtgggtcgggtcaaaccatgcttgactccggatccgagttcacttaccttgttaacgaggcttatgataaagtgcgggctgaagtggttagggctgtgggccccaggatgaagaagggttacgtgtacggtggtgttgcggacatgtgtttcgatgggaatgcgattgagatcggacggctaataggggacatggtgtttgagttcgagaagggggtgcaaatagtggttcccaaggagagggttctggctaccgtggagggtggggttcactgcatcgggattgcgaactctgataaattgggtgcggccagtaacattattgggaatttccatcagcagaatctgtgggtggagtttgatctggcatatgatcatgatgatgtggttgaaatccaacggtccaagagcgaggaagaaaaagaaagttctacaactgttgccatgatgacgccaactgcttttggaagatgtgtgaaggcacacaa

SEQ ID NO: 5057 - DNA, 261 bp, Glycine max
  Peptide Sequence Number=SeqID_121835
atggcgtgggacaaccgtcaggcagcggtgagcgacgatgtgaaccactgtctgagctacgccgatgtcaccgaagcgatcctcagtcatctgcaggggcagcgtttcgcgctggtcgaacgggtggcagaagaaatcgccgatctgttgatgaatcgtttcaaaacgcctggcgtacgcgtgaaggtaggtaaaccgggggctgtcgcccaggcggcgagcgtgggcgtgagaattgagcgcgggactattcctaaataa

SEQ ID NO: 5058 - DNA, 1182 bp, Glycine max
  Peptide Sequence Number=SeqID_121836
atggcatccaggcgattccattctttggacgcttggaatagatacaccaataacattctcggccggaatatccttccggagagaaatgtgcagatttatcatactgagtatgacgagtttaaagtggaattggagaggcgtaatctacacaaatgcctcgctaatctccaagatggaagcatagatgtagctatggtgaaggagttttatgctaatttatacaccatagaggagcaagcacctaagcaagccagagtacgaggacacttgatcaaaatagatgcagacggcctgaatgagttccttcaaatgccaatggtattggaagagggggaatctttacccacttactctagattttgcaggttaaggactaatcctcaagatattgaagctaggctctgtattccctgcaaggggtttgttttgaatgctgagggccagccatggaagcttcttagaaaagatctgatgacactggctcagacatggagtgtcttctcttactccaacctagctcccacatcccacacctcagatctaaatatggatagagctaggttggtctatggcttggtgactaacatggatatgaacatcggagcccttatcttgggtgagttttcttctattgctcagagtaactcctctaggcttggatttccagccttgatcactaccctatacagagctacaggagttacctctgacagtctgacctatgagagcttgagcctggccattaacttggcctacattaagaaaaactattggaatgtggatgatctaatagttaacttcagaggggcgaggaaggcaagggtgagaccagcttatgttccttcttcttctactctaccagctccttccacttctgctactcctacaccagctcctccaggctcatctactcaggactctcagcgctttgaagctatgcttcaaaagcagttcattgagaaggtatcctggcctggaaccttgccttctgttgtgagaaaaggtgaaggtcccagtgctcagccagcagatcctcctacaccaatgcttgatcttccagcagacccgtctacattacttgagattctagaggaccctgtcacaccagtcctgggactgactaccactcctccaaccactcctgtgctacatttgacaaatgaggagggcactcaggactag

SEQ ID NO: 5059 - DNA, 546 bp, Glycine max
  Peptide Sequence Number=SeqID_121837
atgaccggtagattgttggccagatcattaacctttgattgtcgcatcatgcactatattattgttagaattttgcttccccgttcttctaatctggctcaagcctctaaggaggacttgattttgatgtgggctttccttaccggttgtcaggtcgacagggctcacttggttaggtaccgaatgcataaggcattacgggccaatgcacctcttccgtatcctcaattggtcactctttttctccatcattttcaaattcctcttgatgatgaaccttttgttcaagtcaagcgatcttttgccatatgtgctagtgcaataacttcatttggttaccgtaaggatcgtgatggacaatggctaaagaaggacgcgctacctccgcaagacgagcgtactccctctcctcctccacagcgagatgattcctcagcccttatgaatgaagttctttcagaattacggggcctccgcacctatgttggcgaacgctttgattccttggatggtcgttttgaaggaatgaatactcgcatcacctag

SEQ ID NO: 5060 - DNA, 167 bp, Glycine max
  Peptide Sequence Number=SeqID_121838
atggctaccattgttatggctaccattgaattatcgagtagatatgggagcaaattagcatattacaccggaattggggtaggctttatggttgatttagggatggcccttgtggatgactgggtggtgggtaatgacattgttgagccggtggaaaacttggccat

SEQ ID NO: 5061 - DNA, 609 bp, Glycine max
  Peptide Sequence Number=SeqID_121839
atgggtgaagtagaggaggtgcaaaagcagatgaaggccgacatggaggccgtgaaagtgcaaatggccacaatgatggaggccatgatgagcatgaaggaaataatggaagccaacgcggttgcagttgccgctactagggctgttgctaaggtgaacccgatgcccccatttgatatcaatcaaatgaatcatccaacctcagatatggtgggcaaagatttgggaagtacgaatgaccccatgatgtgcaaattcaaaatgagcacgccttcccgccatatggctcgcctcccaacacatgaaattccccaccacaatctagccgacttcgagccttgcctcggatatgccacaggagggcaatcagttggtggtatacccatgccaaacactttggagggccctcagtttcgcccacaaccacaacccttgcattttgcggtgggaagagcccctcctgctatggctgaaaagggaaagttggatcatatagaggaaagcctcaaggacattgaaggaggcgaagattgcgcctttgctaacctagaagagttgttcctagtacccgaacatggtcattcccaagttcaaggtgccagactttga

SEQ ID NO: 5062 - DNA, 348 bp, Glycine max
  Peptide Sequence Number=SeqID_121840
gtattcaagcccagcaagttgcaaatcaatgccgattttcacttgttcaagactgggattgaccctaaatgggaagatccagagtgcgccaatggaggaaagtggtctatcaccagcaacagcggcaggaaggctaaccttgataacatgtggcttgaaactatgatggctttgattggggaacaatttgaggatgctgaggacatatgtggtgtggttgctagtgtgcgccagtggcaggacaaactttcgttgtggacaaagacagcagcaaatgaagctgcccagttaatggcagaaggtggcatggaccactcaccccaaaaaatgctacagcagcatatctaa

SEQ ID NO: 5063 - DNA, 894 bp, Glycine max
  Peptide Sequence Number=SeqID_121841
atgactgaggctactactttgcagcagcacttagagaaagcttacatgttattcggcaaagctcagaaactaactgcagatagagctgcaaggaggatattacatgaaattaacgagttgataagtgcaatggaagagtttccgctatacggcttagactatgatgaagcagaagttggaacaaaattatgctattatgaaaagcagttacaattaattgaagagaaaagagattctatgttattgagaagttttaggcaaatggtatcaaaatctgacgataaactggggagtttaccgcaaaatctagatgaagagaaatacttcattaattggatgaaggaaaagggatatgaagaatgttactattctaaggtagaggctcttagaaggttagatgagataggagcagaagctgcagttgaagaagttgaagatcccctgggcagcggattggatatttggtgtctaaagttcagaagagtagacaacattcagcaattagaaggagattgtcagcagcttattagcaaattcttcaatgctattgctaatgatgatcctagctttactgaagacttagaagaagacaaagtgaaagttctcgaattaggatttgatgatgttgaaataaattctaaagatttcgccgaagaagggagtttattattgtctatacactctgagaatcaaaagaccttcttccatctctcaacagctgaagctgctctacttaaagagagattagattacattctagcactcttagctaaacaatacatagaggcagatgaaaaagctgcaaaaaccaggcaaagtaagaatcagcagaaaaagaaccaagaagaaggagaggaagtagactgggaagagatcgagagtgaaaaggaatga

SEQ ID NO: 5064 - DNA, 645 bp, Glycine max
  Peptide Sequence Number=SeqID_121842
atggcccattttaaggctttatttgggagggaccctcccatgatagtcaagtatcagccagagtcgacaagggtgcaacaggcggaccacatgttgattgaaagtgatgctattttggaagaattgaaggcacagccatatagatttaaatcaatggctaaaagggtgaatgagaaattaggcccaaggttttatgatcctttcatggtaatagaaagaatgggacagactgcttacaagctgaaactaccaccggatgctaaaatacaccttgtggttcatgtgtcccgactgaaggaagctgttgcagttactggtttgtgtcagaaattgcctgcagctttgactgcagaatgggaactgctggtaaagcctcaagaagtggtggcagtgtgtaagcatttagatggaacggttcagggcttaatcaaatgggtgaacctgtttgaacatgaaaatacctgggaggatagtaaggtgattgatatggtttttcctgattttcaccttgagaacaaggtgcagcttgctggagagggtattgttaggccctcaattaaacatgtttaccatagaaataggaggggacaagtggtaaaaaataagaggattgtagtggaaaaggagggagtagggaatgattaa

SEQ ID NO: 5065 - DNA, 1167 bp, Glycine max
  Peptide Sequence Number=SeqID_121843
atgctggatgtcggtaggagtactttatatagatacgttaacagtgatcagagtattcctttagacattgtgaggaaagctgcagaaatgttagcttcagacgaactttcggacgcaatgtacggcctgaaagtagttgacgttgattttactactgcattatctgtagttgttaaagctatgaaagatgagaagttccggaactttttcgtttcgatactttatcaatatctaggagactatttgaagaacgtatcatcaacatacattgttactgaagaagacgtgaagaagtttgaaaaattgctccagggtaagagtaaaagcactattgtcatgaggatgaggtatcttaggatagcgcttacaaagttgggatatgagttaagcccggacagtatcagagacttaatagcggagttatctgaagatagcagcaatgtagccagacataccgcgaattccttgaaactatttatcaaaacagtagtaaaggagaagaacttgcagttagcacagctgttatataattcgttcaaagttcctaagtctaagtataaatacaaaccccaaccgcttagtttagagacgttaagaagaatctttgataatatagaacacttaggtgctaaagctttcttcttattgctatcagaatcagggctcagggtaggagaagtatactcgcttaagatggaccaactagatctggaaaaccgcataataaaagtgatgaaagaatcagaaaccaagagggcctatatttcctttatccatacagaaactaggaagtggttacaagaagtttatttcccatatagggaagagtttataaggacgtatgaacacgttgtaggtcatataggagctgatgtagaagcgtggaagcagaaactgttcccttttcagttagcggacttaagatcttcaataaaagaagggatgaggaaggttctgggaaaggagttcagactttacgacttgaggagcttctttgccagctatttaatcaaaaacggagtatcgccgatgatagttaacatcttacaaggacgtgctccccctgctcaattccagatactacaaaaccattatttcgtgatgagcgagatagagctgaagaagatatttgatgaaaaagggcctaagctgctttctccaaaataa

SEQ ID NO: 5066 - DNA, 282 bp, Glycine max
  Peptide Sequence Number=SeqID_121844
atgaaagtctaccctatcaacgctaaatacaaggtacttatagtgttattgaaacttggaggaagcggaaagtatagtgatatagacagaatgatgcgtaattctaacttacgcttcttcatagaacaattaagacaagaaggttttattgaagacagatatgagggaaataaacatataataaagttaacagaggatggagaaaaactcgctaagagattaatggaagctgaagagttcgtaatgatgaaaatagctcaagcgagaggccagattcaatga

SEQ ID NO: 5067 - DNA, 297 bp, Glycine max
  Peptide Sequence Number=SeqID_121845
gtgaacccacacctcacatctaagtcctgccccagatgtggatgggtttcccgaaaggtcggcaggattttcaagtgtgagaggtgtgggttcactctagataggcaactaaacgcatctctcaatatttacctcaagatgtgcgggtttccccacctctttcttactcccactgggagtaggtggattggggttatcccgctaaaggggcggaggggtatgaacggggcgttgccccgcgactctggtgaagcccaagggctgaggattggatacaaattcatgaaaattcaatga

SEQ ID NO: 5068 - DNA, 1032 bp, Glycine max
  Peptide Sequence Number=SeqID_121846
atgattatcggtatgggaaaaagtccagtaactgcaattctgcagcaatacagctatatctgtgcatatccttgcttctttgataacaaagtattgctgactgagaatagaagcagggcttatatccagtacattaaattattagtaaggcattatgcaaaatacggcagggctcttaaaatcgcaatatggcccgactatactccattatataaggtagagaaaatagcaaacatatacttgtttaataatataagcttcatagttcctatacacgatttatcagaactagagattgtagatgaactagtagagaatgggttcagggttttcgcgggttatgcttccgataagaagcttagaaaatatgaacttgatgacttcaaagaagtagcaaattacgaccggtggtatctaggagtatcatctaagcatgaggtaagagaggcagtactatataatttccagggttttgacataacaacatttctctttggaagacatgaggatagaaaggacagcaaaaaacttgcatcaaatatactgaatttcgttaaagagatcagtaaggtcaaaggcaaacaaactattctttacgatttctgcggtaaactggggagtttaacgggtgaaagacgggttatcaacaccttggcctttctgctggagaacgggagctccttcgctcaccaactatctcaaatcatgaacatggactccagagaagtataccccatgctgaagacctggatcctaaagggagttgtaacggtatcaaaacagggtaggaggaacgtctattcgatctcccagaaattcaaatctttaatcagcagtgtcgtaaagaagtattcttataagggcagggaattcataatagctaaggctaaggagaggtataagaggttcttagggagggatccggacccggaagtattagcagtaatagagtactttgtagataaagcactctctggaaacccctacgtccaaggatctcaaaacgaaagcgttgcagagttgttggccagg

SEQ ID NO: 5069 - DNA, 648 bp, Glycine max
  Peptide Sequence Number=SeqID_121847
atgatcatccctttcctccgtcctactctgtcatcgtgttcggactctctctctcggtctacccactctcacactcctccactcactctccctcacattctgagagaactctcgctgtctctgtgtcactttgtctctctcacactctcttgctctctcactctgtctctctctctctctacctctatgtctctctctcataatgtcccacctggagccattatccccgaggccatgcaaccagactatagttgcttggtgtttacctttaggcctgacaacataggcataatagaaaggaacaggtggcaggaagtgagcggaggagggggggaggggattcggttagcagagagtgtgagagcgatcaacatcaaaattatgacgagacagatccgggaggccaccgtgaatgaagggagagcgatcatgtggatatacaaggccaaatattatttcgcgattaaccaaatccctgaagaagagaagcaacgaggaatagtggtggagtatattgagcaattcgagctggtgtcatccccgttgaggcatgcggctgatgaggtgttatccgaagcattcatgaatgggcttaaggagaagattagagaggaggcattttgcatcgtgaaggtcaggggagtgtga

SEQ ID NO: 5070 - DNA, 702 bp, Glycine max
  Peptide Sequence Number=SeqID_121848
atggcggagttggggaggggatactgccgacagaggtacgtcggagttgcttttcaactcaatgaggcttccatggtgtacaaacttcatggtcaactggccctgaacctgcaccaccacattccggcatactgtgcaactttcaacttcgttcccgttatcgacaagcacatgcagtgtaggggtagattggacttgcaaccccagggatttgaccaagcgctgttgcatgaaattgtgtgtgttgtcaccgtcgatcaggatcacaacgtggtggtgggtaatccgacccaccgtgcacaaggtttcgggggcggtgtggcccgaaagagcatgcaaactaatttaggcttgaagcgggtcgtgggctcgaaatggtatcatcctgctcctcatcagccacgagaaggaaaaattgcgaggcacatcgatggcccctcggagtggtgggggttttacgggagaaggcaaaaggggaaggagatatcggaggcatgtggtcgtgaaggtgcttgcggtgttcatgaagtttctcctcttgcagacgagccaaccccgcgacgtgcaccaaggtcatgtgttgaagagcctgtacttcatggcgaatttcaaggaatggctgaggatgacgaaggggaggagcttcctccaggcggtccatggccgatttggattgagtggattcggccatcaggtcaatga

SEQ ID NO: 5071 - DNA, 627 bp, Glycine max
  Peptide Sequence Number=SeqID_121849
atggttgcagtcaaaaagtggcgccaatatctcttgggccaccatttcacgatcttaacagatcaccggagtctcaaagaactaatggcgcaagaaattcagactccggaacaacatacatacctcgatttgaaagtggagctgatgactaacctggagtttcttagatactcagtcaatttcgacgatccttaccgaattccattcaaaacccataggagggcacatgggcgtcatgaagacattggcatgggttcacaaaaatttcacatgggccaatatgaaacagtgtgtctagcaggcgtccatttgggcatgctacctccacattacacagcctccggcgtgacgaagacattcatggagatttccgacaagattcacgacatgcctcacagtttagtcttggaccgggatcccctctttgttagtcgattttggcaggagctctttaaactaagcggcacgaagcttcacatgagctccgtgtaccatccccaaatcgatggccagacggagtggtcatacaatacttcagtgcactacgctacggggatgtccccatacgaagttactttcggcaagaaacccccaagcttgcctcagtatctcgtgggaacttcacag

SEQ ID NO: 5072 - DNA, 1377 bp, Glycine max
  Peptide Sequence Number=SeqID_121850
atggggccatgccaccatccttcttgcgagttaaggctttctcaaaacctgcttgatgggatagtttgtcttgaccacctcttgatgaatctggaagtagggcctaagtcgtcagcccgagggagctcgtgcttccattcctcttgtacgagggttgagctaacgactttgtcagctactgagagatacagtagtaagggtgctcctagcctgggtcaactcaaaattggcagtgtggctatggtcttcttgaaaggcaggaaagcttgttcacaagtctcgtcccataggaaaggctcagttttcctaagtaatgttggtagtgcatttatcagggttggcttcaatcccccagtgtgtgatcatgaagccgaggaacttgcctccgcctacctcgaaagtacatttctcaaggttgaggtgcatgccatatttgtggaacttctcgaagacttcttccaggctgaaaggcatggccctatagcaaaagttggcatcttcagtgataaatgtaattttctcctcgtttggaggatgcatcttgatctggtatgcgtctttggggcatgtcctgtccaaatctgtgtagttggtgcacattcaccattttccattggcctttttgaccatgatgacgttggcaagccagtgatattggtttggccttcgagcaaatggcaacacgtcaacaatgcatcgttgctcatgattggtaaggtccctactgagccgcgtgcacttcccgggtgtcactcgcagatctatgtcgaattgatcgccttggccttcttggtagatagtcagggctcagatttgaggcctttcatccacgctcatgattcaagtgcgtttaactgttgtgggatatttgatggtgaagctcctagagagcttgccctgaccgaaggtggtcatcaagtccaagcagcctctagtcttgactctctcgcctgtaaagccgaggagtggaccagcgtgagggatatcaaccgaaatgccctgatcaatgaggaccctggacaccatgaagttcgcaatgataatggagacaaccacggggtcgtcatggttgatagggttaatgcccttgaagtccatgttgtcgctcgcatcgctgttgttgttgtctttatctgccttggtcttttgctctttttctatctgcttcttggttcatatgctactcctcttggtgttctccggggtaactggatgggtacccccaggttgaatgcttactccagaatcgtggcgcgattggccgttagagaaacacagaaaaaggcatggaagagagttgaaggcctggagactctcgctcaacgcaccatatgcactaagtgcgacgcagtcgctcagtgggcagccctcgcttag

SEQ ID NO: 5073 - DNA, 333 bp, Glycine max
  Peptide Sequence Number=SeqID_121851
atggagcacaaggtttacttggccctcaaatttctcaattctgatgaatctctatctggtgagaagcggaaactgcaacttctagagctggaggagatgaggctcaatgtctatgaatcctccaagatttataaaagtgttgatgctaagtctggaaatggtcatttggcgctaagcgcacatcagcatgctaagcgcgtgtgtattgtcacgagagtcgtgcttagtgcactaactctccctaagcgtgctctaactcccgctaagcgcagcttagcgtgcctccccgcgctaagcactaacctgcctttatgtgccagtgcactggcttag

SEQ ID NO: 5074 - DNA, 297 bp, Glycine max
  Peptide Sequence Number=SeqID_121852
atggaggcatacatacccttagggtggaaaccactcaacctcgagcggtacgatgagacaaaaaatccaaatgagcatctggatgccttcttgacacaggcgaacctctacaccaatgacaatgcgattctatgtcgtgtcttgcatatgttccttaagggggtagcattgacttggtacaatggactcccagccaggtccatagacaacttcgacaccctctttgaacgattcagtgtgcagtacaccaccaacaggtctcaccacatgattgcagtcgccttggccagtttataa

SEQ ID NO: 5075 - DNA, 321 bp, Glycine max
  Peptide Sequence Number=SeqID_121853
atgtcagggtggacgtggctcaagtggggtcctggacttcacacatcagctttgagggtggcctttgttgagaggacaggagaggggacctggaaaacaaaggactctgacactcaaagcgttcaatggaacttggtacttataggggtggagcgtgactggcagtccttgtttgtaggggctgttgtagcctttgtagataatagccgggagctaatagataatgttagagataaacatttgcttatagataaaaggttagagataacctatttgttggggagcctggctgctaagggtcaggcgtctgcgctcctgtaa

SEQ ID NO: 5076 - DNA, 495 bp, Glycine max
  Peptide Sequence Number=SeqID_121854
atggttgactttctggaagaattcactggaaacgacacaaccaccccagactggtggaccctttacgttgatagtgcgtccgacgtaaaaggaagcgaggtagggatcatcctcgaaggccctaacaatatcgctctagagcaagccctcaagctcaacttcagagccttaaacaaccaagcagagtatgatgcactcattgtagactcgcaacttgtccaaggacatgttgccaacatataccagaccaaggaaattatgcttctcaagtactatcacatagcaaagtctctcattaacaatttagaatgtttcaaaatgtactacatctctagggaatgcaatactagagtagacattttctccaagttggctagcactaagaaggcagggcacctcaagactatcatccaggaaacgctccaaactcccaccatagatgcaaaggacattatggttggagaagaggaggaaccaaactggatgaccccttaa

SEQ ID NO: 5077 - DNA, 867 bp, Glycine max
  Peptide Sequence Number=SeqID_121855
atggagctcatgcccaaccagtatgatgaattttacgatgagctgaagcggaggcagtggcaccaacggctcaccagcttgccagaaaaacacatcgatgtggcactggtgaaggagttctactctaacatatatgatccagaggatggctccttgaagcagtgtaagcttaccacacatgcccagtacctccacacctaccttgaccatcagaccatcgcggtgaagctttgcacatcaggtggtaagattattcttaatgccaagagggcttcgtggaagattctacggaaagaccctacctcccacacctctgacctcaatgtcgaccacgcccacctgatatatgggcttgtgatgaagatggaactagatctgggcaacttcatctctttccagattacgcagatcgcccagtctagttcgtcgcggttgggcttccccaccctgatcatgactctttgcaatgcaaatgaggttacttctggctccctaaccttcgagtcattgagccccgtgatcaacctggcctacatccaaaagaattgttggaattctatagatccttccatcatcttccccgggccacggcagcctccaccaaggctagttcctcctcatgcagagcctctacctgctcttcctccagcagccaatgatgatgctagaggacttcctagagtgtgttgcttggccaagggtccaaccttcctctgtccaggggggggggggggagacacctttggcgatggagatgatgcggatggcagtgatgttgatgttgcagatgtcggtgtcgatgatgattatgtcacagatgtcattgtcattcagggagctggggatccttggccgactcaggattga

SEQ ID NO: 5078 - DNA, 885 bp, Glycine max
  Peptide Sequence Number=SeqID_121856
atgagtgacatagagcaagtacaggagcaaatgaaggttgatatgagggccatgaaggagcagatgacaataatgatggaagcaatgatgagcatgaggaagatgatggaggtcaacgtttctatagctgttgctgccagtactattactaagagggactcgattcacccacccggtttcaatcaagtaagtcgttcaatcttagatgtagtaggtcaagaaggcgagggggtggatatgagcctcattatatctaggtctaaactgatgcaatcctaccccgcaagggcattggatagaaatctccaagtagattgggccagagatgcaagagaaggccctagggttcttatgagccttaggatttcagagctccttttaagcacaaaatttcgtgctcttctctccctctcccttcattcatctccttcttcctccaagctcttatccatggcctcctatggtgagtttatctggggggaaacacatgactggcctgcattttctagtgtccccatgccaaatgctgtgagggagcctcagtatcgaccaccatcacaatccttacattttgtgatggaaggaggaccttctgctatagttgaaaagaaaaaatttgatcatatagaggagaggctgagggtcattgaaggaggaggaaattatggctttgctgacatgtcagaattatgcttggtacctgacgtgtttatttcactgaagttcaaggtgccagaatttgataagtacaaaggaaccacttgtccaaagaatcgcctaaaaatgtgtggaagcaatgacttccaagattattttgatgatgccaaagaatcaagagttaagcaagtttcaaagaaccaggagtcaaaaagcttcaagaattaa

SEQ ID NO: 5079 - DNA, 600 bp, Glycine max
  Peptide Sequence Number=SeqID_121857
gttcacttctcctaaggcctgggaaaggtatactaacattattgttcctaggaagctgctgctagagagaaatgtggtaatctacgacattgaatttcatgaattcaaggaagaattggagagaagaagatgggatgaagaattgaccagctttgaggaaggtagcattgatgttgccatagtaaaagaattctatgctaacctctatgatccagaggacaaatcaacaatgcagttggctgctaagctctgcatcccagggaggggatttgagcttaatgttgatggtcaacctctaaagatcctcaagaagaacatgaccacacttgctcatacttggagtgttctttcttactccaacttgatccccacctcccacacttctgacatcccactagaccggaccaagttgatttatggcattattatgaagatggacatgaatctgagctacctcatctcccaccagatttctatcattgcccaacatgactcctctaggctaggatttccagccttaatcacaactttgtgtaaatctagaggggtcactattcgattgctggcaagtgcaccagatcgtgcaagtagtataaaacg

SEQ ID NO: 5080 - DNA, 518 bp, Glycine max
  Peptide Sequence Number=SeqID_121858
atgaccacactggtctctgcgtgtcatcaaacttggggtctctgaatgacgagctggaagatgctgacatttgcgggaagggtgcagatgaccacattggtctctgcgtgtcatcagacttggggtctccgaatgacaaggtgcagataatcggtgcagatgactacattggtctctgcatgtcatcagactcagggtctccgaatgacgagtcggaacattctgacatcttcgggaagggtgcagatgaccacattggtctctacgtgtcatcggacttggggtctccgaataatgaggtgcagataaccgtaaggtgtctccacatgtcatcggacttgtcgtctccggatgataagggtgcggataaccgtgagacttgccgtctccggatgacaaaggtgtggataaccgtcaggtgtctccacatgtcatcggacttgtcatctcctgatgacgaaggtgcggataaccataagaagtctctgcgtgtcattggacttgccatctccggatga

SEQ ID NO: 5081 - DNA, 723 bp, Glycine max
  Peptide Sequence Number=SeqID_121859
gtggtctccgactggtaccaggccgacaagttcatggtcgaaccgctggtcaaggagtgctcggaccagtacgccgaggaaaagaacggggacgacaccctcggtgcggggcggcccttcctcggtgtccctgagttgggccgtggcggctttacaaagtgttcgccttgcgcaggccgccctcccaccaatcgcgttgtcagttgcgcggcatcaggccgggaccttctggcccacttcgaagttggcctggatctccagcgcacgcaccatgcccgagtggtcccagttcgcgccgccgtgggccacgcagctgttgaacagctcctgggcctgggcggtgttgggcagggacacgccgagctggcgcgcgctgctcagggccaggttcaggtccttctggtgcagcgagatgcggaagcccggatcgaacgtgcgcttgatcatgcgctcggcatgcacctccaggatcttggacgaggcaaagccgcccagcagcgcctcgcgcacgcgggccgggtcggcgccggcgcgcgatgcgaacagcagggcctctgccaccgcctcgatgttcagcgccacgatgatctggttggccaccttggcggtctggccgtcgccattgccgcccaccagggtgatgttcttgcccatgcgctcgaacagcggcttgacgcgcgcgaacacgtcctcggggcccgcgaccatgatggacagcgtggc

SEQ ID NO: 5082 - DNA, 516 bp, Glycine max
  Peptide Sequence Number=SeqID_121860
atgcaagacaccattattctagctggcggctgcttctggggcatgcaggatttattccgtcgattgccaggcgttctcagcacacgtgttggctatactggcggcgaagtagccaatgccacttaccgtaatcacggcaatcatgccgaggcgatagaaattacgtttgattctgcaaacatcagcctcaggcagttactggtgttcttttttcagattcacgacccaaccacattgaaccgccaggggaatgatttgggcccgtcataccgctccgcaatttactatgcgaatccagcacaaaaagaaattgcgcagcaactaataactgaaatggacgcttctggaatttggccgggtaaaattgtcacagaagtcactctcgccagtgacttctggcttgccgaaccagagcaccaggactatttagtcaaatacccgactggctacacctgccatggactacggccgacctggatcttgccacaagaccgcgcatctgctgtctggttgtaa

SEQ ID NO: 5083 - DNA, 549 bp, Glycine max
  Peptide Sequence Number=SeqID_121861
atgttagatcgtgatggataccgtccaaacgtcgggattgtgttatgcaatgcacataatcaggtgttctggggcaagcgtatcagggagcatgcatggcagttcccgcagggcggcatcaagtatggtgaaacgcctgagcaggccatgtatcgtgagctgatggaagaggtgggcctcaagcctgagcacgtcaagattctgggccgcacgcgtgactggctacgctatgaggtgccgaccagctggatcaagcgcgagtggcgtggcagttacaagggccaaaaacaaatctggtttttattgcggctgactggtcgtgattcagatgtttcgctgcgtgcgaccgagcatcctgagtttgatgcctggcgctggagcgaatattgggtgccattggaggatgtgattgagttcaagcgcgaggtctatcaattagcgctcaacgagctggcaacatttttacatcactccggccgacgtcatggcggcaaaccacgtaaacctgctgttacgaacaagcagccgccaactgtgacgcctgagtaa

SEQ ID NO: 5084 - DNA, 312 bp, Glycine max
  Peptide Sequence Number=SeqID_121862
atgcatcacccaaaaaggaaaactctagatgagtattcactgttatcaagcaagtcggagatccagcatgaccacagatcaacctctactccctatggctcacacagacctggggaaggtattagcaccttacgtgcccaccacaaggggcagcagcctttaatcaaattcattttaattccaaacaaaaagtcgtttaaggcgttggaccttgaaacggtgttgtcataccctaatttcgtccggggacctttgctcgatgacgtgcgaccattctttggtcctcgtgaggtgcttggcacccatcattag

SEQ ID NO: 5085 - DNA, 249 bp, Glycine max
  Peptide Sequence Number=SeqID_121863
atgaatattgaagaattcattcatgttacttttgatgaatctgatgctattctatcaagaaagaatatactagatgatattgcaactttagaccaaattcatattcatggacaagattctaaaggaaaagggaaaggaagcactgaagatcctcaagaagaagcagaatcaaatgatgaacttccacaagcatggaaagcctcaaaagatcatccccttgacagcattatcggtgatatctcaaaaggg

SEQ ID NO: 5086 - DNA, 818 bp, Glycine max
  Peptide Sequence Number=SeqID_121864
gtgcaaaagtccattttttggatcaccacacctcctttggctatccacagggcatgatctgtgcctttcaaaggtttcatcctcttgaagaactgaaaggttccaacgatattcagccagctagactctctcctgccgaaatagcaaaaacaactgtagaggctaataaaagcgctttgctagtatttcctggaatggtacactgtgaaccacatgaccagatttcatgggctgagtttcaatatcatattgatgatgttggagatatatattttgaaatctctgatgatgcaaaccttttggcggattgtggagctaacaatcctgtggtagtaaaaattttaagaacccccaaatgctttgcttctgggaatcatgtgatgggtctttctgtcaaacctctgtgcacaatatttctgaatgctttgattggaatggacatcccaatatatgataataatagaaggactgctagtgaatatgacattttcaataatggcagcgatgatgaattcaaatttgatgatgatgatattgaggtttcagaaatggaggagtttaatattccagtgaattggggacagtctgatactacaaagtctgttcatccaatttatttctcgaagtgcttagcaaaggccatcaacaacatggaatatgttaaaagaatgaaccatccttcaaatggtgtttctataatagggttccttagacccgtttatggtgaagaaaagtcatatctaagatggatgtatcacactgaagatggcgatgtatacatctcagactggagaggtatctgttttcttcaaatttaa

SEQ ID NO: 5087 - DNA, 261 bp, Glycine max
  Peptide Sequence Number=SeqID_121865
atgaagcacatgtggctcaccttacaagttttgggagtgatgagtgagatttgggatgcaaggaagatcgtgctgcagcggcaagagaggatcgaaaaagttggagtgaggtttttcatttttgtgttcacccgagaagcagaagcagaagcagaagtagaagcccgtgttgagttccattttccactgcacaaacaacgcacaacgcacaacgcacacacgcgccatcgtcatggttctgccagagtcgctgttctttag

SEQ ID NO: 5088 - DNA, 804 bp, Glycine max
  Peptide Sequence Number=SeqID_121866
atcggtgcccttggtggccctgcctttggtggtcccgaagttgtaattggtgctcttggttgccctgcctttggtggtcctgaaggtgtaattggtggctctggttctgaagctgtaactggtgcccttggtggccctgcctttggtggccctgaagttgtaatcggtacccttgggggcccttcctttggtggtctcgaagttgaaattggtgctcttggtggccctgcctttggtggtcctgaagttgtaactggtggctctggttctgaagctgtaactagtgtccttggtggccctgcctttggtgacctcgaagttgtaatcagtacccttgggggcccttcctttggtggccccgaagttgaaattggtgctcttggtggccctgcctttggtggtcctgaaggtgtaactggtggctctggttctgaagctgtggctctacaacttcagaaccagagtcaccagtgttatacaccaaatgactacaattgttcacaagtgaataacttgttaatttcgtgcgtggattacctcattggtggagatggtatcccttcaggtgtttgttgccaaagtgttaatgcagtgaaagcatcagcaccaacacaaattcaacaaatggctgcatgtaagtgctttttcgacgtagcaattcgccttccttccttgctagaaaacaaggcaggttcacttcctaaattatgtggtgttaatttgggttttatcatgagcaagcagaacaccaattgtaacaatgttcatgtaagctcagggcaaaggggagaattgtacaattaa

SEQ ID NO: 5089 - DNA, 615 bp, Glycine max
  Peptide Sequence Number=SeqID_121867
atgaccagccctctcaacgagtcaatctcttgctttctcataagggtgaacctttgggtactagtaccctcaccttcgagaggactacacgtcctcccctccagaggactgcacgtcctcaccttcagagagctgcacgccctcgccttcagagggctacatgtccttgccttcagagggttgcacgtcctcaccttaggtactcgtaccctcaccttcagaggactacacgttctcgccatcagagggttgcacgtcctcaccttcagagggttacacgccctcaccttcagaggactagacgtcctcgccgtcagaggactgcatgccctcactttcagtggactacacattctcgccatcagagggctgcacgccctcaccttcagaggactacacgtcctcaccttcagagggctacacaccctcaccttcagaggactacacgtcctcgccatcagagggctggacgccttcaccttcagaggactacacgtcctcgccatcagaggactagatgtcctcaccttcagaggactacatgtcctcgcctttagagggctatgcgtcctcactttcagtgggctccataagccacaccttaagagaatttaa

SEQ ID NO: 5090 - DNA, 411 bp, Glycine max
  Peptide Sequence Number=SeqID_121868
atgtgggacctggaagcggcatcgcggttcgagagcggaagcatcgtggaccatttgcaatatgaggggtctgcgagtgcccatctcgacctcacggacgttgaaacggaacccgaggagcgcttcgaggagggagctcttcccgtcggactggcccccgaccgccacgatctccgggatcggcagcgtctcgccgaaggccacggcggcgccctggagccggttgtaggcctcgaaccgggaagtcgaatccacgtggctcctcctgcgcttcgacggggttttcgacggagtgggagcgtcggcgccggcgacggtggaggaggacgacatggtggtggtggtggtggtgatggaaagggaaagagggagggagaaaccaaaagtttgaatttgaattttggggtttaa

SEQ ID NO: 5091 - DNA, 2046 bp, Glycine max
  Peptide Sequence Number=SeqID_121869
atgataaaaaatcggttaagttggtttggatatgtgaaaagaaagccattagaagcactagtaaggatgttagattgcatagtttttagtcctgagaaaagtgggagaaggagttcgagaaaaacattggaaggagttgtgaagagaggggtctcatggtatcaagaggaggattcagaagagtatggaagtcctgtggttttggcatctgccattgcagacattataaagtcccgaactgaggcacttttgaagaaaaccaagacagcagtttctcctaagccaattgtaatgagagctgagtatgcacattgtcctaaccttactattattgacacacctgggtttgttcttaaggcaaagaagggtgaaccagaaaacacgccggatgaaatcctttctatggtgaagtccttggctagtcctcctcaccgcatacttttgttccttcagcaaagtagtgttgagtggtgttcctcattgtggttggattccattcgcgaaattgacccagcatttagacggacagtgattgttgtctccaaatttgataaccgtctcaaggaatttagtgaccggtgggaagtggatcgctatttgagtgcaagtggttaccttggagataacacacaccccttttttgtggccctgccaaaggacaaggggaatgtttcaaatgatgagttccgcaggcagatttctcaggtggactcagaggttcttcatcatctccgtgagggtgtcaagggaggtttcaatgaagaaaagttcaagtcctctattggctttggccgtttgagagattatttggagtctgagcttcagaagaaatacaaagaagccaccccagcaacccttgctttactcgagcaacgatgcaatgaattgacttctgaacttgctagaatggattcaaaaatacaggccaattcagatgtttcccatctcaggaagtttgcaatgctgcaagcagcttctatcagcaatcacgtgggtgcattgattgatggtgcagcggatccttcccctgagctgtgggggaaaacaactgtagaagagaggtcacgaagtggtattggggtttggcctggtattactgctgatgtaaatccccccaatgctactcttcgtctttatggaggtgctgcatttgagagggtgttgcatgagtttcgctgtgctgcatattccatagaatgcccctcagtgtcaagggagaaggttgcaaatatattacttgctcacactggtcgaggtggggggagaggaataacagaggctgctgcagagattgcacgagctgctgctaaatcatggcttgctcctcttcttgacactgcttgtgaccggcttgcttttgtcttgggaagtttatttgatttggctctagaaagaaaccgcagtcatgattcagaatgtggtattaaaggagaagacatggatggctatgtaggtttccatgctgctttaaggtgtgcttacaatcgcttcataggggatcttgctaagaagtgcaagcaacttgttaggcaccaccttgattcagttacttgtccatactcacaggtctgctactttaatgactcttatagcaaagtccttgagttgagtgatactagttcagcttcccatgatgcaaggagggatcaggaaaatatacctccagaaaaaaatgcacaagaaactacaccaggtaaagcagcagaaaccagagatgttttgagagaaagccacataactatccctgagaccccatctccagatcagccaggtgatgcagcatatggggtggttaaaaaggagcttggaatttgcaatgacatgggaccaagaaagagagcgtccagaatagtagggaatagcaaaaattctgacaatgcaagactgcaaaatggtgtcattttatttggaagtggggagagatcaggttcaccttactcagatatctgtgtatcagctgcccagcattttgcacgtattcgtggagttcttgttgagagaggcgtgacatcaacattaaattctggattcctaaccccttggtaa

SEQ ID NO: 5092 - DNA, 450 bp, Glycine max
  Peptide Sequence Number=SeqID_121870
atgtgtcaggagaaattggtacaagaagccgtggatacacttcttgataatggaatccgcggacaaccgatgagggacggtcataataaggtttacaaatcattttctgatataattgagggcaaagagggaagatttcgcgagactctacttgggaaacgggttgattattcgggtcgttctgtcattgttgtaggtccatcactttcattacatagatgtggattgccccgcgaaatagcaatagaacttttccagacatttctaattcgtggtctaattcgaaaacattttgcttcgaacataggaattgctaagagtaaaattcgggaaaaagaaccgattgtatgggaaatacttcaagaagttatgcagggacatcccgtattgctgaatagagcgccgactctgcatagattaggtatatccacggaattgcggaaattttag

SEQ ID NO: 5093 - DNA, 468 bp, Glycine max
  Peptide Sequence Number=SeqID_121871
atgatttggggtgagattgtttacctgggtggccatgataacggcaccggcagcgagatacagcgtcatgtggctggccttggtgttgagggtgcgtccatcacccacgcccccaaactccgttatggatatgttgtcgttgtaattggtgctcttggtggccctgaagttataatcggtgttcttggcggccctgcctttggtggtcccgaagttgtaatcggtgcccttggtggtcccgaagctgtaactggtgcccttggtggccctgcctttggtggtcttgaaggtgtaactggtggctctggttctgaagctgtaactagtgcccttggtggccctgcctttggtggtcctgaaggtgtaactggtggctctgattctgaagctgtaactggtgcccttggtggccctgcctttggtggtcctgaaggtgtaactggtggctctggttctgaagctgtaact

SEQ ID NO: 5094 - DNA, 699 bp, Glycine max
  Peptide Sequence Number=SeqID_121872
atgggggtttcacaagccgaaccagctcatataccaacccctacttttataactggtgctcttggtggtcctgcctttggtggccccgaagttgtaatcggtgctcttggcggccctgcctttggtggccccgaagttgtaatcggtgcccttggtggccctgcctttggtggtcctgaaggtgtaactggtggctctggttctgaagctgtaactggtgcccttggtggccctgcctttggtgggcccgaagttgtaatcggtgcccttggcggccctgcctttggtggtcctaaaggtgtaactggtggctctggttctgaagctgtaattggtggttcttgttctgaagctgtaactggtgcccttggtggccctgcctttggtgggcccgaagttgtaatcggtgcccttggtggccctgcctttggtggccctgaagttgaaattggtgctcttggtggccctgaaggtgtaactggtggctctggttctgaagctgtaactggtgcctttggtggccctgcctttggtgggcccgaagttgtaatcagtgcccttggcggccctgcctttggtggccctgcctttggtggtcctgaaggtgtaactggtggctctggttctgaagctgtaactgtgagaacaaatacaactagtagagaaaaaattgttacaaacactcccttcattttgtaa

SEQ ID NO: 5095 - DNA, 216 bp, Glycine max
  Peptide Sequence Number=SeqID_121873
atgaagcagctcaagcgtgaagaggcccgaaagcatgatgccgagctctacctcaatcgactccgcatcgctcaaggcttggcattgtcgatcgagtgtgggccatgtgtcgtcactgccgaagctagaggattttctcagcaactcctccgtcgtgatgtgctactcggaccaccaccactgcttaggtgtgagagaaagaaggggtctatgtga

SEQ ID NO: 5096 - DNA, 169 bp, Glycine max
  Peptide Sequence Number=SeqID_121874
atgctagcttacctggaactctttgttcacgaaaaaaattccgaatcgagacaagacaatgacatagcgagactctccaaagcacttgagcttgaagccagtgtcgaggaattatgtcccaccgaagtccccagcaaggatttcgatgtcatcgagcctcacggtagcg

SEQ ID NO: 5097 - DNA, 380 bp, Glycine max
  Peptide Sequence Number=SeqID_121875
atgaaggaggacttaaagaaattaagagatatgaacaaagatgacgtcaactcccaaaataatgtagtaaaaagggttgaagatgaagacgacgtattcttggcaacaaacgatgaatttgctaaaataaaatgggcaataaattatgctgcctcaaagcacatatgtagagatcgagagatgtttggaactttgaaaattgatggagaattcagccatttcaagttagggaatagtggaaaaatgaaggttgaaggcataagaagcatgaggatgaagattcatgatgctttaaagaggaaccatgatggcaaagtaaagaagaaagtgaagttttctaatgttgtagaagtgttgggagatacttccattggaggggg

SEQ ID NO: 5098 - DNA, 2664 bp, Glycine max
  Peptide Sequence Number=SeqID_121876
atgaagctctcttcttctggatttaaccctcctgctgaagaagaaggggagaaaaaatgtttgaattctgaactttggcatgcttgtgctggccctctggtttctctgcctctggttggaagtcgtgtagtatactttccccaaggtcatagtgagcaggactgggattcacaatttgtctgcagtactgtgaaagtatggagatgtaagctgggagggggttcaagccaaatggttgctgcatcaaccaacagggaagtagatgcacatattcctaattaccctaacttgccaccacaacttatctgtcagcttcacaatgtgacaatgcatgcagatgctgaaacggatgaagtatatgctcaaatgactctgcaacctctaagtccacaagagcaaaaggaggtgtatctgctgcctgcagagttgggtactcccggcaagcaaccaaccaactacttctgcaaaacattaactgcaagtgataccagcactcatggaggattttctgttcctcgaagagcagctgaaaaagtcttccctcctcttgattactcacagcagcctcctgctcaagagctaattgccagagatcttcatgataatgaatggaaattcaggcatatatttcgtggtcagcccaaaaggcatcttcttactacagggtggagtgtctttgtcagtgcgaagaggcttgttgctggtgattcagtccttttcatctggaatgaaaaaaaccagttactcttgggcatacggcgagcgaatcgtccgcagactatcatgccatcatcggttctgtcaagtgatagcatgcacattggtcttcttgctgctgcagctcatgcagctgccacaaacagccgctttactatattctataatcctagatacatgggtaccataactggtattagtgatttagatccagtccgctggccaaattcacactggcgttctgtgaaggttggctgggatgagtccactgcaggggagaggcagccaagagtttccttgtgggagattgaacctttgacaacattcccaatgtatccatctccattccccttaaggttgaggcgcccttggccatcgggcttaccttctttatatggtctcaaggatggagacatgggcattggttctccattcatgtggctccaaggtgggcttggggatcaaggaatgcaatctttaaacttccaggggcttggtgttacaccatggatgcaacctagacttgatgcttctataccaggtctccaaccagagttataccaagcaatggcttcttctgcattccaggaaataaggacaatggatccttcaaaatcttcgcaatctctgttgcagtttcagcagacttcgaatgttcccagtgctcatgcttctgaggtacagaggcaagtattaccacagtctcagcctcaaaacacccttctacacaattatcaagaaaaccaggtgcctgctcagtcacaacttctgcaacaacagttgcatcgttaccacccatatagtgatccgcggcaacagcagcagcaacttaaaaacttgcctgttcagcagcagttaccaaatgtcatctctcctttgtctaattttgcatcaggtacccagtctcaatctcctcccatacaagccctagcttcacattgccagcagcagagctttcctgaacttatgaggaatcatatttctggttctgatgtttcctctatccatagtctactaggttcattctcccaggatggaacatcccagttacttaacttgagtggatccaattccgttatgtcttctgcagccatgctacccaagcaaataaccactgaacctcctcagcttccatctgctgctcctcagtgtgtattgcctcaggtggaaaacttgggaacatcacaatcaaatgtgtctgaacttgctgctttgcctccatttgctggaagagaacattctgcataccatgctgctgctgatcctcagagcaatcttttatttgggattaacattgacccctcttctcttatgctgcaaaatggcatgtcaaacctgagaaatataggcaatgtgaacaattcattatcgttgccattttctgcttcaaattgtggtggtgcttcaggcactgatttccccttaagttcaaacatgacaacttcgagttgtgtggatgaatcaggtttcttgcagtcttctgaaaatgtagaccaagcaaatacaccaactggaacctttgttaaggactactattttttccaattagttcacaagtcagggtcctttggcaggtcactggacatttccaagttcagcagctatgatgagctcattagtgagcttgctcgcatgtttggccttgaaggccaactagaggaccctaagactcagagatcaggctggcagcttgtatttgttgaccgggagaatgatgttcttcttcttggtgatgatccttggcaggagtttgtgaacaatgtgtggtacataaaaatactatctccactagaagtgcaacaaatgggcaaaggtcttagtccttctacttctgccccaggtaacaaactttctactcctgccaactcttgtgataattatgtgagtcaacaagagttgagaagttcgagaaatggcatggcatcaatgggatcttttcactactag

SEQ ID NO: 5099 - DNA, 1531 bp, Glycine max
  Peptide Sequence Number=SeqID_121877
atggcattgccaacgaatcgagatcagactcccaaatctgactccacaaacccctgctgtgaactctggaagaagaaatacttgaagacccaagaatcgcggaatgctctgcgacaagccgtcaaggttcttgaacaaaaaattaacgaaatccagtcccgctacaacaaagtatgtggggtcaaagtggaaagagaggaaaaattaggagaatttgttgcttctagggcacctttagagagtgaaaattgcagcttggagtctcagattggtactcccataacagagctgggacatggcggtggtggaaatgagaatgggaccttacaagctgattgggaaaaggaaattggtagactgaaggagcttacagaagtggagaagggaagggctgattctgagaggaagaaggctgctgaagcttgtaagttactagagaatgagaagaataaggttgttgaaaaggaaaaggaaatcggtggattgaagaggcttatagaagtggagaagggaagggctgattctgagaggaagaaggctgctgaagcttgcaagttactagagaatgagaagaataaggttgttgaaaaggaaaaggaaatcagtggattgaagaggcttatagaggcagagaagagaagggctgattccgagagcaagaaagctgctgaagcttgcaagatggtaggggatgagaagaataaggctgcggaaaaggagaaggaaatgagtagattgaaggagcttatagaggtggagaagagaaaggatgattctgagaggaaggaagacactgatgtttgcaagttacttggagaagagaagaaaaaggttgctgaaaaggaaaaggaaattggtagattgaaggggcttatagaggagaagaaaagaagggttgattctgagagcaagaaagctgctgaagcttgcaagttactagaagaagagaagaaaaaggcttctgtaaagggggagatggccagaattgaagcggagaaggcagtgaagtatagttttcagattggtcaattggagaaacaggtaaatgaagcaaaaacaaagttggcgtttgagatttctacatttagagaggcaaccaaaaagtttgaagctgaaaagcgcaaactattagctgagaaaataaatgctgagtcagggatggcaaaagcaaatgaaaggttagaggttgaaaaacaaaaggtcgatgaggaaaaaaggcgtgcagatgcagagatggttaaattaaaggagcagaaggcacttgctgaggataactggaacaagttcatgaaagagaaatgtcttgctgatcagatgtctcagcagttagaagaggataagctggctattgaggatttgaaacggaagatccatgaactctcatccttgacaaaacctgtggaaatggctgctgacagcaaggccaatgctgaaagtacagaagtgaagcttttgaaaaacaaacttaagctggaaaagctaagagcaaaacataccaggcaaaaatataagttagaagcaagtcgttatg

SEQ ID NO: 5100 - DNA, 337 bp, Glycine max
  Peptide Sequence Number=SeqID_121878
atgatcgctgatcagcaaaggaagcagtcactgatcttcgaccacaccctacgtatggatgtctttctttgtaagaaagagattggaaagctccgacatcgtattcgccctttggctaaccagagtcaaaatcagagtaaggaagcagcgaataactcaaattctcagaagagaaggagtgccggggattactaccttcgccaccgacttgttaccgcacaaggaaggactttgaacccacgcgactttcctactgagaacagagctgctggagagcttccctgtgactacccgaagggtaagaaagagatgctccgtgtagctaaccccaagtctg

SEQ ID NO: 5101 - DNA, 378 bp, Glycine max
  Peptide Sequence Number=SeqID_121879
atggatccaaacatcgatttagatgaagttttggataaaatgatagatgaggaattggaagacaacaacaatgaagaaatcattaggttaatacttgagagccaacaacaactagatggcaacaccactaggcgtaggcaaagaagaagagtggtacattggaattgtgaggaagataggttcaacaatcatgatgagtactttcaaatgagggtcgatgcactacgtcgaaaaggcttatctccattgcagaagtgcacaattgctcttcgtatattggcttatggctcacttgctgacagtgtggatgaatatgttctaattggtgaccaaataacgaagacaccgagcgactactacaaatggagcgacacataa

SEQ ID NO: 5102 - DNA, 465 bp, Glycine max
  Peptide Sequence Number=SeqID_121880
atggttggaggtgtcgacgcaaggtgcacaatgactagcgttggtgactctatgagctgtagtggagagaatcaatgctggtggctggtggagaggatcattgctggtggatggtggagaggatcgatgcaagggacagagatgtcgagagaatggtttggacgtgtgaagacagaaaatagagaaaggtcgatgcagggttggtggggaagtttctggagaaaaaggatccaccctccagttcaaaagtttaacggtagctacaaaaaagcagttaaacataggagaagtggaagttcagagaaggatgttagtgttgatgctcatatgatttacttacaagatactggtaaaaaatttgaggtttctgctagtggaaattactcgttgtcttctaacccagagatacccattgaagtcaaagaatatgatacgccatcgccagtgtctcactcaattggataa

SEQ ID NO: 5103 - DNA, 1653 bp, Glycine max
  Peptide Sequence Number=SeqID_121881
atgtctaacaatgcttacacatgcacaagcaatgactcagctcaggtagttttatctacttgtctctacgtcaagaagcacgtgaacacaactgaaaggtgccaacaaaacatgttggaagtgcacataataaccatgagctctttggagcaccaacctttactacccaggcttgattcacactcacacattcaaaacttgtcatcagatgccattgaagaattcttggaacataggcctattgcattgagatggtggtcaaagcttattgtgtgggagtcaaggcttctctggctcctctctggggcttctattgttgtgtccattttcaattatatgctaagttttgtgaccttgatgttcactggacatttggggtctctagagcttgctggagcatccgtagccagtgttggtattcagggtctagcttatggtattatgctggggatggcaagtgcggtgcaaactgtgtgtggacaagcatatggggcaaaaaagcatggagcaatgagcatcatattgcaaagagcaatcatcttacacattggagcagcagtgattctctcatttctctattggttctctggggattttcttaaggccataggacagtcagatagcatagccgagcgaggccaagtgtttgcacgcggaattattcttcaactctatgcatttgcaataagctgtccaatgcagaggttcctccaagcacagaacattgtgaatcctcttgcatatatgtcagttggggtgttccttgttcacattctcctcagttggctagttatatatgttttgggttatggccttcaaggggcagcccttactctcagcttttcttggtggcttcttgtcttgtttaatggtctctacatcatatttagtccaagatgcaaggaaacctgggcaggcttcagtgttaaggctttcaaaggaatttggccttatttcaagctcacagtagcttctgctgtgatgttatgtttggaggtatggtacaatcaggggctggtgcttttatcagggctgctctccaatcccacaatctcactggactctatttccatttgtatgaattacttgaactgggacatgcaatttatgttaggccttagtacagcagccagtgtccgagtcagcaacgaattaggagcatcacatccaagagtagcaaaattttctgtcttcgtagtgaatggaaccagcatcctcattagtgtggttttctgcacaattatcttgatattccgggtttctttgagcaaacttttcacttctgactctgacgtcattgatgctgtgtctaatttgactcccttgcttgctatttctgttttctttaatggcattcaacctatattatcaggggtggcaattggaagtggatggcaagcattagtggcttatgtaaacttggcttcttactacgttgttggtcttactgttggatgtgttcttggcttcaaaacttctctaggagttgctggaatttggtggggaatgatccttggagttcttatacaaacagtaactctaataattctgactgccagaacaaattggcaagcagaggttgaaaaagctgttgttcgcatcaataaatccgctgaaaatgacaccttagatcaactggttgctgacacttag

SEQ ID NO: 5104 - DNA, 1215 bp, Glycine max
  Peptide Sequence Number=SeqID_121882
atgcagacaaataatgtacgagaggaattcagtgaggatatgtccatactccgtgcactttcaattgtttttgaaagaaaaccggaattgaggttggaagggctttcccacaaggtgctacagtggtatttatgcagaatggaaggttggtttgctacagatgctgataccatatcactgaaatgttgggatcaggaagtattgctccctggtggtcacggtcttatggtcaggggttaccagcctgttataaataccctagccaagggtcttgatattcgccagggacacagggtaacaaaaatagttaggcaatataatgaagtaaaggtggcagtggaaaatgggaaaacatttgttgcagacgctgctattgttgctgtacctcttggggtgctgaaggcaaagagcataaaatttgagccaaagctaccagactggaaagaagctgccatttctgatattggggttgggattgagaataaaataattttacactttaaaaatgttttctggcctaatgtggaattcttaggagtagttgcagagacatcttatggatgcagctactttcttaatctccacaaggctacaggtcgtcctgtccttgtttacatgcctgctgggcagctggccaaagacattgagaaaatgtctgatgaagcagctgctagctttgctttcatgcagctcaaaaagatccttccagacacttcttcaccgattcagtatcttgtgtctcgatggggtacagatattaatacactaggttcctatagctatgatgcagttgggaaaccacatgacctgtatgagaggctacgggtccctgtagataatttattctttgcaggggaagcaacaagtatgttgtatacggggtctgtgcatggtgcatactctactggaatgatggctgctgaggactgcaggatgcgtgtcctggagcgttatggggagctagatttggtcccgccgaccggtaggacagtaggatatatacatggatgtatggttcgtgcctcaattcatccagaacagtatatttatcatacggaactcatcgatggtgtgaagtttgctgctcccgatgattggagttccattgcaatcgaaagtgattccaaaaaggtaggtaacattaatagaaatgtaacagattggtctgaactaggtgttatttatgagggcataagattagcagtcattgtttga

SEQ ID NO: 5105 - DNA, 2688 bp, Glycine max
  Peptide Sequence Number=SeqID_121883
atgcagaattcaaatgtcatgagacaaatttgcaatctaaatttgtctgagacatgtcgccaatttgagaatgagcttctggaaccctgctgcacaacaattgaggcaagtgatccattgagggaaaacatgcagaacactcaactcctcactccaggtggaaattactctgaaaaatctatcacaggtattggttctaaattagagcctcttgttagaggatccgacagaacaaagatacagagttctgcagtaaattccagtacagaatctttttctgatggacagttaatgggctcacaggatgcaaccattttcccagttactgcatcagcaaaattgactcaggacttcaagccatctgacaaacctgttgatgtgcaccacaggaagaggaaaagaacgcaggacacagttgaacatgatgcaaatttatcttctgagaaactctctgatttgcatggtttgatgcatataaaagttggcaaatgcttagacggaggaaaagaggtgcttcataatctcaataatttacaggaagagaataaaagggcccacaaaaagagaaagaaatatcgtagggaaaaagtggacatgatacctttggttaacagggacgagcaaaagggcacagaagaggccggcactgaggtctatgatgatgcaaatgtctgtagacacacttcctgccctgctccacatactttagaaacctctcaagcatatggggataggatatgcgatgctgtgaataattttgatactgtgcctgatggaaattatatgaaattattagaattagaagatgctaccagtgaggaatgctatagaaaagcaatggattttcccatttctccatctcttcctgaaattgaatttcgtgaaacatttgaagagggtaatttgacgaatacctctctagaggaagcactccaagatgacatgttgagatcaagaacagacctgtttacttcaccttacttcgatgtaattaatgttgaaatcaattctaacgaacaaaaatgtgatgattatggagtttcttgtaatttacatatgcacactacagaaaagtcaaggactgctttttcagtggaggatggaattggatctttaaacaatcaacttcctggattttgtgttgtcttttcaaatatggaggacaatagtatcatatctagaatacttgttgctacaaaaaattgtatagctcggtgcaatttggctactcaaacaggctggggggttagtaacattctgactgtacttaaaatggaagaaaagctctcacagaaggagaaggtttcggtgctgttaacacttatgctgttcaactttgccatgactgcatcaaagacatttggaaaactctgggatggaaatttattccactgcttgcaatcttattctgaacatatttgtacagagacaagaatcctgtttgtagagaattattctttgcacgagctgcttagcctcattgaagattttcttattgagggaaaagtaatagtaaacagtggagtagatgctgaaactttgtcttgtgatttgagagccaatgattttctggattgtgttaatgaagtatcatccaatgtagcttcaagtgaacaattggtggcagcaagtattatattagcgtcagtatgtgcggcgactgattatgttggatttatttgtgatgcttcatatcatattcttcagtcatgcaagtgggattccctgatggtgctgactattctccatatttttgcttatctgggtggagagaagttttttaacatcgataattttggattaatggtgactgttttgaaatctctaattatgtttcttgaggatgagagcccatctgttgcatctgcttgtcttccttcaataaatcagctgcatgctgagttgtgtatgaatgttaaatgcccattctcggaaggtgccgaatccattgatgcagttgtgtgtttgctcttggaagagataaagcgaataaatttgtcagattctggattaatgtcagacaattataatgacagacaatggtataatcagggtgcagttcaatgtgccattagcaagaactgtgatgtgccctgtttgaaaaaatgcttgatttctgctactcaaccagatgcccttatgaatgtcaacttttgtcgcctgaatgatgtcctgtcattggtggaactggttgcaaacaaaatgagctggcactgggttgatatgaaacttgttcctcagcttctgaatttactcgactcatgtgtagaggagaactttgctgttcgtataattgttcttctaggtcaacttgggaggactggagtggatgttggtggatatgaagataacggagttggaaacctgagatgttatttgtatacttatttttgccgaacctcttccatgaaagcaggtctttctcttcaagttgccgcggccactactctgtttgaccttcttcctcttgattttgaaaccctttttcatactaaaatccatctttcagcatattctaagtctgtttctgacaatgctgaaactttgaggaagtggttctctgggctagatttgaattacttccaatcatccctcgacatccaccaccatgcatcgcctccagaggaaatttttggtggaggaacccaccgtttcagaaaaccccatctcgctgaatttgtcctttaa

SEQ ID NO: 5106 - DNA, 159 bp, Glycine max
  Peptide Sequence Number=SeqID_121884
atgtgttcagaatgcaagatacaaagaggatcattctctaaaagcctttgctgtgcaaatgatgacaagcagcaggagaggtccccatctgttattgtcattggaggtggcatggctgggattgctgctgctcgtgctcttcaagatgcctcatttcag

SEQ ID NO: 5107 - DNA, 273 bp, Glycine max
  Peptide Sequence Number=SeqID_121885
atggaagcagcaccatcaccaaacactaggagcacaaaaaggaagcaaacatggtctcaacacacaaaggtgagaacacatgcatcgaggttgttctcgacaatgtctcttggctttgcaaagaatggttccaccatagtgacaactgtggctgaagagcatgaggcaattgactatcgacttgagtctcaggagcttggagagatagtggccagggttaggaacaatgtgaaagtaggaaatgatgtgtattacaaattgagtaatccataa

SEQ ID NO: 5108 - DNA, 972 bp, Glycine max
  Peptide Sequence Number=SeqID_121886
atgtattacaaaatgcaatggagaatgacagaagaagcttctcgaaaggcatacaaaaccttactggcagtggccaagtatggcttcaagggtatgagcaatgatgtggagaaatgcttgtcactggaaaggatgcgtgggctgataaataacctgattagaatatcaaaacagggagctaaaaaaattgcagtttctttaaaggaaaattggtcaataacaacattgaatttgattttatctcatggctcatgcttagctatgatcccgttggaccaaatggtgccaaggccttggctgaagttctcaagtttcatgggaaaaagttctccagctattgcaaaggaagacaaaagaagcttcctggccacaaaaaggctgaaagaacttttggaatttagaaaagcttcctctagtgaaactaagggtgttggaggtgggaatggccctggagttcagttattggcaattgagcatgagattgaagtaaatgtccgagtgcacgaagttcgttcagaatgtgaacatcaaaaccattctctctgtctttcacaggaatttcccatcggcagcaagctagatcctattgtttatggccctcctgaatcgacaataacaaaggaaattctagagcaagaacttagtggaatgagcttggaacagtttagctctatattttcatgccatatatcatcaagaattgcatttagtgaaaagaatggaaagtttgtaatccatgagttcgtggatacccataaccacctttacagcttgcagaaacaacacatgttatcatcacatcgcaaaatatctgaagttcaagcctatgagattcagatagagaaggactcaggaatgaagcaaaaggcttcatttccgcttatgagtgcacacgttgcaggagatagagctaatcttggttatacacgcttggatgccaagaattatctccaagcaagaagacaagcgtag

SEQ ID NO: 5109 - DNA, 744 bp, Glycine max
  Peptide Sequence Number=SeqID_121887
atgtctgagaaaatcacagctgaaaaacttttaaacacccttgtggaaacacttactgaaaagcaaaaatctggattattttttgaagaagacaagtcaagctcagtgagctcccaattcaatagactatttggacgccagaaacctgtgcaccatattttagggggtggaaaatctgctgatgtcttgttatggaggaacaagaagatctctgctagcgttttatccgcagcaacagctatatgggtgctttttgaatggcttaattataatttcctaactattttattctttgttgtggctcttggtatgcttggacagtttctttggacaaatgcatccggcttgtttagcaggaagccatctaaagttccccgttttgtcctcccagatggtatcttcgtgaatattgcaactgcagttggtgctgagattttaattagtgagcaaaaaacacaaggagttggcacccaggaagggtgtggcataggaaatgatttgaaagatgttaaattcctgttaagatgctggagtgaggagtttggatggtgtaacacaatccacgcacacaaatgttttgttgctgcacatacactcccagttctctatgaaaggtatgaggatcaagttgacaactttgtgtacaaggtctttgatcagttgcaaaatcactatcagaagctggacactggtttgctcagcaaaatccccaagggaaagctcaaaggaaagaagtatgaatag

SEQ ID NO: 5110 - DNA, 759 bp, Glycine max
  Peptide Sequence Number=SeqID_121888
atgggaatcagtaaaacagaagtaaacttgaggaggttgcttgcagctgctcctcaacagcaaaatcaagcaaaacttgtgcattatgttgctactttgcgtgaacaattagaacaattggctgaagaaaggacactggaaggcttacccaggatttcaaaggctatgttgaatgattattcagagaagattgaagccattgcttccaaattggttaatcatgtgattgacacacaagtacccgggaaggacttcgaaaggaattttgttaaagaaaaacattctgaaattgaggaaaaaaagcagatactcctttcttctggattgagaagaaggcctgtgctgttttactgttgctcatctgattcattggacagacctgcctcaagtatggaagatagagcgcatgagcctgctgagactgaccacacatcacctattaaactggatgctacagcacatgcacacattgaaaagcacagaaagcttcaagaagatttgactgatgaaatggtggttttggcaaaacaactcaaagagagtagtctcacgatgagccagtccctgcaaaatactgaaaagatacttgattctacagagaaggctattgaacatagcttggcaagcaccggtcgtgccaatgtgcgagcaacggcaatctactcggagagttctaagacttcttgcttaacatggcttgtcatgtttgtcatgacatgcgtatttgtcatggttattcttctaatccgtgtcacatag

SEQ ID NO: 5111 - DNA, 228 bp, Glycine max
  Peptide Sequence Number=SeqID_121889
atgaagcacacgattttgaaaagtcccttttcctctcaaatgagcatgtttggccaaaatctatgttgtaaagcaatggtggtctttatttgcaaggaagaatatggtgtgctcttgggcaatgactgggctgcaactcatgaatttggccacaacttttgtatctcaaatgaaggtgacgatgacgatgatgataatggcgtcattgatgtggccccagcggcatag

SEQ ID NO: 5112 - DNA, 791 bp, Glycine max
  Peptide Sequence Number=SeqID_121890
ctgaaagaacggtgccgattggtgccatcaaagctgtcagcacctcaaatttgaaagacgactggttctccttgatcatcggtgggcaggaacctgatcctttgattaactgtgtcttcaaaacggaatttttcacacatcttcagaccgctttgcgtgggcaattgaatctgaaggtttctgagaacattgaatacaacaagaagcccggtaagttggctacggttaaagctattaaggatccggccgcctctccgaacgttgatacctacaagagccacactattcacaccagtcccggtgagcccccgagctcggtctccaagccgacgccgaaagcgaagcaagttgcggcacggccagtcaccaaaggaaagctgttgcgccccggaggtcctggtggcgggccatcgaaactggcgtccagacctgcatccagacctacacccaaacctcaacctctgcctcaatcacagccggctacggcgcaaccaattcctgcccctcagcctgccgccgttcctagaccagttccccagcccgttgcagccgctgccgcttctcatacacggaatgcctcatccggctccgtgagagctccgcctccgccaccgccagcgagtcccccggcgccgaagaaagcaacagcgaaggccttgtacgatttcactagcgcacagtccaacgagctggacatccgggcgggagatgtcgtgcagattgtatcgaaggaagggaacggtaagttttggcttcctcatttctatgcttacgaggctaacgtgtactag

SEQ ID NO: 5113 - DNA, 243 bp, Glycine max
  Peptide Sequence Number=SeqID_121891
atggcgagttcagtgcgaaacggatgcgtgacaggtaaaccgctagtacggctggcgacttcgcctctggtggatctcgccacctctactggcgagtcagccagtggtttcacaaaccgctggtttgactggcgactcgcaagtgcaggaggctcggtttttcattgtgagggttgctttttcagagaaaaggaagttgcaactcccattgaccgagttaaggccaagttgcgctcccattga

SEQ ID NO: 5114 - DNA, 885 bp, Glycine max
  Peptide Sequence Number=SeqID_121892
atggggggaaataattcaaggctgaatggaaatgggggagaggtgttgcctgctagaatccgcaaccgatgggaagagttgagaaaacgcaagagtggggaagatggcaccctcttaaagaaagagttgctgaattctgatggtgttgatgaaggaaactctcaatcttccgaagaaaatggaagtgagcacaaaagggattctctgaatgatgctcaacaagccaaaggggtggaaaagctctcgaaagtggttcctttgccggtttccgaacctggaaatgaggagcagcgtaatgagttacacaatgaagagaaagggaaagatgctgagaagaagggtgaggttgttgagctcaaaacagggaaggtgcagagtactgcagggctgcagccagagattaaacatgaggaatcaaatgtaaaaaatgatagcagcgacgacgacgacgaagacgaagacgaagacgaagatgaggaggatgacattcaaagacttataggtccatcatcacccagcttcaaaatttattgcactgaagccgataagataaaggaggaagaactacatgattcaaaggctctaggtgatgagaaccaaaccgttgccttgctccaaaagtcatccagtactaatagcattgatgaaagctctacatcagcttcagggaacacaggaaactccaacgaggcaaatatatatgaaaattgtttcagtattgttgaaatcaaatcagcttcttcgaagagaaaaggaaataagaaaaagaaattcggggcaatgaagaagaatctactccaagttaagcatctaaatatgaaccgaatgaacccaattttggcttgcacgggcaatgacagaagacgtcttctttcagaggattga

SEQ ID NO: 5115 - DNA, 456 bp, Glycine max
  Peptide Sequence Number=SeqID_121893
atgggttgcgtgctcgggacgccggccggtgccggagatcagcgccttcgccggagcgagaagcgcaacggtgcagtcgacgaaggcaataatgcagttgggcttcgagagaaggagagaaaccggcataccggcgattttccggggactcttccggcgccggggcgccggaagcctagactcgatccgtgtgccgtcacgcagcagggatggccgtcgtggctgatggccgtagccggcgaagccatcggcgattggactcctcgtcgcgccaacactttcgagaagctcgctaagattgggcaaggaacgtatagtaatgtgtataaggcgagggacctggtgacggggaagattgtggcattgaagaaagtgagatttgataatttggagccagagagtgtgaagttcatggcaagagaaatacttgttttgaggaggcttgatcaccccaat

SEQ ID NO: 5116 - DNA, 1380 bp, Glycine max
  Peptide Sequence Number=SeqID_121894
atgggtgatccattatctgctgaagcttcctcttcttatcatcatctggttggtcgccttatttacctcatgaacacacgccccgacatagctcatgttgttcagcaattgagccaatacatggctcatccaactactgctcactctcaagctgcctctcgtgttcttcgttaccttaagggtactccaggttctggaattttcgccactggttctctccagttcaaagcattcagtgattctgattgggccggttgtcgtgacactcgacgttccatcaccgacttctccgtctatctcggcaattccattatttcttggcgctcaaagaaacagcccacggtgtctcgcagctcctccgaagctgagtatcgagccttggcctccactacttgtgagctccaatggcttacatatctccttcaagatttacgtgttttgtttgttcaacccgccaatctttactgtgacaatcaatctgctatccagatcgcctctaaccaagtttttcacgagcgtactaaacacattgacttagattttcatattgttcgtgaaaaagttcaaagtggtctccttaagcttcttcctatctcatcttcgatgcaactggctgacatttttactaaatctttacctccgactatgtttcagcttctgttttcacgatttgttgttctccccgtctgtgactcactgcctagggtttggttaatcggtgacagattgaagatgatagaccttgcgcgcgtgcagaaggagctcgtggaatgcagcaaggacgcggagggatcgggcatcaaagtctgccccaaaagcgacaaccttgttctcttgatcggcaccattcctggccctgtcggaactccttatgaagggggcattttccagattgatatcacattgccagatgggtacccgtttgaaccccccaagatgaagtttaaaaccaaagtttggcatcctaatatcagcagccaaagtggagctatttgcctggatatcttgaaggaccagtggagcccagcactcactctgaagactgcacttctttctgtgcaagcacttctctctgctccacagcctgatgatcctcaagatgccgtggtggcacagcaggaaaagtttcttcttatatcctttgcttatggaactgccaaagcacagtatattgaagattatattccttatctgaaagactatcagacatttgttaacactgctcgctactggacagaaagttttgccaaggaatcgtctcgcgggattgaagacaaggtacagaaactcgttgagatgggatttccagaagctcaagtaaggagcattttggaagctgttggtggtgatgaaaacttggctcttgaaaggttgctgtag

SEQ ID NO: 5117 - DNA, 258 bp, Glycine max
  Peptide Sequence Number=SeqID_121895
cttctcaagctcaagcatttacttttctagttagagaccaacgtcttggggctaatgtaggatctgctcaaggacctacaggtttagaacctctaaggggtccgaatggtttagacttgagtagactgaaaaaagatatacagccttggcaagaacgccgttctgcggaatatatgactcatgctcctttaggttccttaaattccgtgggtggcgtagctacagagattaatgcagtcaattatgtttctcctagaa

SEQ ID NO: 5118 - DNA, 378 bp, Glycine max
  Peptide Sequence Number=SeqID_121896
gaatttaaagatgtctttcccaaggagattcctcatggactgccaccttcaagaagcataaaacatcaagttgatctccttccagaagcttcattgcctaacaggccaacttacaacagcaagccccaagagactcagcataaggatgcacaggccaaagttgagtatgtgaaaagattgtatgaccaagtgaaggtgcaaattgcaaagaagaatgaaagttataccaagcaagccaacaagaaaaggaaggaagtagtacttgaacccggtgataatcttggacatttgaggacaaatgtttaccaagaaggagggaatgatgagaatcctgaaactggtcaaatacaggctaaaggtccaagtggagaaggatga

SEQ ID NO: 5119 - DNA, 129 bp, Glycine max
  Peptide Sequence Number=SeqID_121897
atgtatcgtgggccccgtggctcgttcggtgtagaaggtcgatcgaaagtcggcccgtgcgatcatcccagcactaatgcaccggatcccatcagaactccgcagttaagcgtgcttgggcgagagtag

SEQ ID NO: 5120 - DNA, 3495 bp, Glycine max
  Peptide Sequence Number=SeqID_121898
atggaaacgacgacgaagacgaacaaaacagggaagaagaaaggagagccacttttccgtcaaaaccccaacgttgatgaagtcaccaggatttgcatttcccagattctagaacaattccgagcttccaatgatgaagtgtacaagtttgatgctggtttgtccaaccaagagcgtgctttggtgcatcaaatggccctcaaaatgggatttagatctaaaagttatgggctagggaaggaaaggagagtgtgtgttcaaaaaatgaaaaagaaggttgacacggataacgagtttggaagtcttcctcctttcacattttctggagaggcaaagtgggtgttgggtgatttgtttgctcatcatccacccggtgagggaaacttgtgggagatggttggagaaaatagtgaagacactactactgacggaacaaaacagaggccgggtgatattttcagccggccctctatgaccaaagctgaaattgctaggagattggaagctcttgcttctagaatgaacaatgtctctaacttgaaacagatcaatgaagggagatctaagcttccaattgcgtctttcaaggattcaattacatccactgttgaatctcaccaggttgttctcatatctggtgagactggttgtggaaagactacgcaggtcccacaatttattttggatcatatgtggggtaagggagaggtatgtaaaatagtttgcactcagcctcggcggatctcagcaacttcagtttccgagagaatcgctagtgagagaggagagactattggagaaaacgtgggatataagatacggttagaaagcagaggtggaaggcaatcatcaattgtgctatgtactactggagtggtattaagggtgctggtttccaaaggttctcattcgtcaaagacagggcgtgtgaaggatgagatttctggcatcactcacataattatggatgaaattcatgaaagggatcgatactcagacttcatgttggcaatcatcagagacatgctccctttatatcctcacctacgtctgatattaatgagtgctaccattgatgctgctagattttctcaatattttgggggctgcccaatcatccatgttccgggcttcacttatccggtcaaaactttctatttggaggatgttctttctattgtaaaatcccggcatgataatcatcttgatagtaccacatgtagtattccaaaaaacacttgtgagctaagtgaagaagagaagctttccattgatgaagctattaatttggcctggtctaatgatgagtgggacctgctgttagaattggtttcttcggaaggaaccccagaactatttaattaccaacattctttaactggtcttactccgttaatggtgtttgctggaaaaggtagagtgggtgatatgtgcatgctgttatcttgtggggcagatttctgtttaagggccaaagatggaatggctgcattggagatcgctgaaagggaaaaccaaccagaagcagccgaaatattgaagaagcacatggatagtgatttttccaactccatggaagagaagaagttacttgataaatacctggcaacagtcaacccagaacttgttgatgatgttttgatagagcagctgataagaaaaatatgtattgattcaacagatggagggatccttgtttttcttccaggctgggatgatataaatagaacgcgtgagagattgcttgcatcatcctttttcaagaattcctcaatgtttatgctcatatctctgcattcaatggttccaagcatggaacaaaagaaggtttttaggcgcccacctcatggttgtcgcaaaattgtactatcaaccaatattgctgaaacagccatcaccatcgatgatatagtgtatgtcatagacactggacgaatgaaggaaaaaagctacgatgcttataacaatgtgtcaactcttcagtcatcttggatttcaaaagcaagtgctaagcagcgagagggacgtgctggccgttgtcaacctggaatatgctatcatctatattcaagaactcgagcagtttccttgccagattttcagattccggaaattaggagaatgcctattgaggagctttgtctgcaggtaaagttgcttgatccaagttgcaaagtagaagaatttctatgcaagacattagatcctccagtttttgagtccatacgcaatgcaattatagttcttcaagatatcggggcattgtcaaatgatgaaaaactcacccaactaggggagaagcttggttctcttcctgttcacccattaatatgcaggatgcttttttttgctatattgatgaactgccttgatccagctttaactcttgcatgtgcatctgattatagagatccatttacacttccaatgttacctgaagaaaagaagagagcttcagctgccaaatatgagcttgcttctttatatgggggttgtagtgatcagtttgccatattggctgcatttgaatgctggaataatgcaaagaaaatgggtctagaagcacggttttgttctcagtattttgtgtcttcaagcaccatgaatatgttatcaggcatgcgcaggcaactccaagcagaactaattcgacttgggtttattcatgaagacgtttcaggttacagtgtgaatacacatgaccctggtgtgctcaatgcagttttggtagcaggtttgtatccaagggttgggaggtttcttacaaataaaagtggaaaaagggttattgttgaaacaacaagtggagataaagttcgcctgcacaatcattccataaattttaagttgtcattcaagaaaaaattagatgacactttaattgtgtatgatgagattactcgcggtgatgggggtatgaacctaaggaactgcacagttgttggaccacttccacttttgctgctttcaacagagattgctgttgccccagcagaagaaaatgatgaaggggatgaggatgatgtaggaggcagtgaagatgaagctggaagtgaagatgtgatggagtttgatgctgagtccagtggaggccgtgaggataagttgatgtcttctcctgataatatggttaaagtaatcatggaccgttggctttatttttgttcaacagcaattgatgttgctcagctatactgcttgagagagagattatcagcagcaattttatacaaagtaacaaatccaaggaatacacttcctcccatcatggcggcatctgtgcatgctatagcttgtattctgtcttgtgatgggtgcattggtgtgccagcaatgttagaaggtgtggaaacactaaccactatggtaaatgcaacaactttaggcaagccagcaacaggtactaggcgttttggtaagagaccaaaaggatcccttgcagagcttttaaattacgatgggcgccagacctctgggccttattttaaagcatag

SEQ ID NO: 5121 - DNA, 234 bp, Glycine max
  Peptide Sequence Number=SeqID_121899
atgaaattcaaacacaagcgttatgtaacaattatactaagactcaagcctacatgcaattggtaccatttttcagtgaaaaacctcgtcgggcgcctaggagtacatgacaggacatgcctcacaatgggcaagtcaggcttacaggagcattcaaaccggatgacccccaaggcctacactccgaagagtccgttagggcctctccctcctgattcagtgcgcctcaagtga

SEQ ID NO: 5122 - DNA, 564 bp, Glycine max
  Peptide Sequence Number=SeqID_121900
atgatcaaaaactctgagagcagtgtaagaaagtacaacaaatctgaacttccacgcctgcggtggacacctgaacttcatcaacactttgttgaagctattgaaagtctaggtggaaaacacaaggcaactccaaagcgaattttgcagcagatgcgtgtgaaaggactgagaatcgctcacatcaaaagccatcttcagatgtacagaaacaggaaaggacatgccattattgcaccagtgggtcagttgctggaagatttcaaaatatgctccatttctccaaccgaaaggattctgaagcgggaagaaactgattatgatctaaaccaggaaccacagtcaagtgcactcttgcttagtgatgatgtgtcaaatgaagaagaaaattttgctgatctatctttctcctttagcacgcctctaatgtccattattcaacgtgagaatagcaaagagataatgcgtttttcgtcatccactgcagctgctaatcattccgttgattctagttctacgccgtcttttgcaaacaattacataaacttagacctaacaatctga

SEQ ID NO: 5123 - DNA, 243 bp, Glycine max
  Peptide Sequence Number=SeqID_121901
atgaagtaccgaggaagggcgaataggcgagagtttggcgaagggaagaaatgcgatcggttggttgaaatgggaaggggaaatttgaacactgaaaaccctaacatgtttggattgggattgggattgggattgggaatgggagaggtgaggctaaggaggaagatgataggaagaaatatggttggcaccccgcgtcttttatacactttttcaattcttcttcctttttttatattttaa

SEQ ID NO: 5124 - DNA, 1689 bp, Glycine max
  Peptide Sequence Number=SeqID_121902
atgaaagattcaacagaaacagatgctatcagcgattcccttgagcttctgagtacctttctggactcggagctcccaagcgtgagaaacttcaaagggaaatggtcactcgcccgagtcaaactcacccaactccaaacccacctcaccgatttctccgccgagttccccaacgcctccaccacaaaccccctctccctccacctcctccactcaatcttcaaaaccctaaacgacgccgtttcgctctcccgctcatgccaaccccaaaccctcccaaacggaaaactcaaaacccaaagcgacctcgactccctcctcgccaccctcgaccgccacgtcagcgactgcgacattctcttccgcagcggcctcctcctcgaaaacgacgccgtttccgtttccgtttccgtttcatcgaaacgcgaagccatccgctccgaatcacgtaacctaataacccgtcttcaaatcgggtcgcccgagtccaaagcctccgccatggactccttactgggccttctccaagaagacgacaaaaacgtgaccatcgcggtggcccagggagtcgttcccgtgctcgtgcgcctactcgattcccccccctccgacacaaaagagaaaaccgtcgctgccatctcaaaagtctccaccgtggaaagcgcgaagagcgtgcttctcgcggagggcttgctccttctcaaccacttgcttagggttttagattccggaagcgggttcgctattgagaaagcatgcattgcgcttcgggcgctgagtttgacgaaggagaacgctagggcgattggctctcgcggcggaatctcgtcgcttttggagatttgccaggctggcacccctggtgcacaggcttctgccgccgccgtgctgcgcaacctcgccgcgtttgaggaaattagagataattttgttgaggagaacgcggtggtggttctgattgcgttggcctcctccggaaccgcggtggcgcgtgaaaacgcggtagggtgtttgtctaatttgattaattcggattcttcgtcggaggagaccgagggtttgtcgaatttgaggattacggtggtgaaagaaggtggtgttgagtgtttgaagaattactgggattcagggactcaaattcagagtcttgaagttgcggttgtaatgttgagacatttggctgaaagtggtccaattggtgaagttcttgttggtgaaggttttgttcagaggcttgttggggtgctgaatcgtgaggttttggcggttcggattgcggcggcgagggcggtttacgcgttgggattgaacagtgggagggcgaggaaggagatgggggaattggggtgcgttttaggtttgattaaaatgttagatgggaagggtgtggaggaaaaagaagcttctgcaatggcattgtcggtgctgctgatgcacccggcgaatcggagggttttccgcaaggacgaaagaggggttgtgagtgcagttcatctcttgaacccttcgttgcaggggttggataagaagtaccctgtttcgttgctcgctttgcttgttcattccaagagttgcaggaagcaaatggtggctgctggagcctgtgtatatacgcagaagcttgttgagatggatgttcccgggtcgaagaaattcttggagagcctcgggcgtggaacaatgacataa

SEQ ID NO: 5125 - DNA, 954 bp, Glycine max
  Peptide Sequence Number=SeqID_121903
gttctcagcaatccagagaggacacctatccatacctttttttgcaattatgatttgagtgacatgccaactggtaccaagagcaaattagggtacaatccgagtttaagggagtacaatggccaattggagcaacttggtgtaactagactacaatataccttggcctcaatattaaaggccaagactggtgtgatctgtgttcgaacagctacattcttgcggcaaaaggtcactttaactgcgtctagatcaaagtctatgatgggtaaggaaagccaaacagattctgacaccagagctgatgccaagtcttcgttgatctcagtcaccagtcacagagataaagatcttctcacctcaaaatgtggagagtttgatagttttacatgttcaaaagctggtaaggaagaaaactttagttcaatagcatgcctcattaatcaagacaaatttttacatggttcttccaagatcattgacaacgctattaacacaggcattttgctttatgctcttcaccttcgctttatgtgccccttgcctaagagacgttcaaggtctgttcataagtgcaaatctggccctgtctctgctgatatgagaaatattgtggacattgaacaagaaagaagcttctacttgtatgatgatatgagggtagtgtttcctcaacgtcattcagattctgatgagggcaagcttaatagcttgactgagtcgatggttggatggtgttttacaactctaataatgagactgtaccaatctgaacgagtggttaaatacttgcttcaatcttgcaaatgttcatatttgattcatagcacttgctttgaccctttacgagtgtgcttatgctctcctactactgtccatcagatggcacaaaagaggcctgaggtgccgtggccaaaacagaaataccattatgcttataccggaagagtgtga

SEQ ID NO: 5126 - DNA, 1217 bp, Glycine max
  Peptide Sequence Number=SeqID_121904
ctttgagcaacatcatgaagatctccattctctttatcacaatcttttcttgtggttttcttggaaatgttgtttcaaatgctagtcctcttccatatgaagctatttttaactttggtgactctataagtgatactggaaatgctgctcataaccacccacctatgcctggcaatagtccttatggttcaacatactttaaacatccttctggacccgaggcatatgggatgccaatgttgccagcctatttgaatctcaccaaaggacaagacattaagaaaggagtgaattttgcatacgctggttcaactgcacttgataaggattttttagtacaaaaaagaatcaatatagaggaagctactttttcattgagtgctcaatttgattggtttaaaggactcaaatcctccctttgtacaagcaaagaagagtgcgataattacttcaaaaactcattgtttctagtaggagagattggtgggaatgacatcaatgcactcatcccatataaaaatattacagaacttcgagaaatggttccatcaattgttgaaacaattgccaataccacctctaaattaatagaagaaggagcggtagaactagtggtaccagggaacttcccaattgggtgtaattctgctgttttggcaatagtgaatagcgaaaagaaagaagactatgatcaatttgggtgtttgatagcttacaatactttcattgagtactacaatgagcaactcaaaaaggctatagagacattaagaaaaaacaacgcacatgttaagataacatattttgattactatggtgctaccaaacgtttatttcaagcaccacaacaatatggtggatgggagttgagtttagaatggaggaggttgtttgagtgggagaagtctcaagttgtggaacttcatcaaggcttagcaatcgttacagttaacggtgatcgtgaggatcaatggaggtgggagttggattccacgggtagcttcaatgttaaggtggcatatcaagctttgcatatggatacagtgggatcacaacctaatgaacctacggatgtgtggaagaatttgtggggggtgaaggcacaaccaaaggcgttattcttagtgtggagggatgtgatggagagagatgcattttttgtagaggcggtgaagaatccatatctcatcattgcttcttttcttgtggccaaatga

SEQ ID NO: 5127 - DNA, 1299 bp, Glycine max
  Peptide Sequence Number=SeqID_121905
atgcagcggcatctcctaaattttgttgagaaggctcttgtggaagatgtcattcctattcttatggctgctttcaactgccaactagaccagcttctctctcggtgcattcagagagtagcaaggtctgactttgacaacacatctttggaaaaagagctccctcatgaagttttgactgaaatcaaatcactccgactctcatttcagccagaatccacacctaatgcaatggaagcggagtccttgaatgaaaagagtatcaggagaatccacaaggcattggactctgatgatgttgagctactgaagcttcttctaaatgagtctagtgtcactctagatgatgcatatgccctgcactatgcttgtgcctatagcgattctaaggttattcaagaagttcttagtctaggcatggctgatattcttcgtagaaattcccgaggatacacagttctccatgtggctgcaaggcgaaaggatccatccattttggtagcactactgaataaaggggcacgtgcatcagataccactccagatggacaaaccgctcttgcaatttgtcagaggttgacaagatgcaaggattatcatgagaaaacagtgcagtgtaaggaatctaacaaggacaggctttgtgttgatgtcctggagagggagatgagaagaaattctatgactgtgaatatgtctgtttcatcacagttaacagctgatgatttgcacatgagactggattaccttgaagatagagttgcatttgctcggctgttgtttcctgctgaggctagggtagccattgagaatgctgaagcagattcatcatcactgtatgcaaattcatcggctttgaaggtcacaaatggcaacccgaaagaagtagatctaaatgaatctccctcggctcgaaccagaaaactccagttaagattgcatgcccttatgaaaacagttgagaatggtaggcgcttctttccccattgctctgaagtgcttgataagtttctggaagacgacgaaatgccagatgttttcttcctagagaagggcagtgaagaagagcagagaatcaaaaaagcacgcttcatggagcttaaagatgatgtgcaaaaggcatttcacaaggatatggctgaaaataaccattctggtttttcatctacggtgtcttcctcttcttcctcaactcgtagggaaggtcttaaccatagattgcaacaaggagtaacccttgttttcaacaaagtaatggaaggtttaatgtggacttattgctatagtcaagctggttga

SEQ ID NO: 5128 - DNA, 1071 bp, Glycine max
  Peptide Sequence Number=SeqID_121906
atggctatgtttcttaaagcttgtgggaccttagcaggaacacctgctgaaattcgtaaagcatctgagaagttgaaatcacttgctcctgataaagattcagacccttcaagatttcattcttggcttcctaacacgtctgtggagaaactgcagctggatgtccaaccatttgatccaccaactcccataaatctttgccaaaaattgggaaatagcatggattcatttgagcacacaccaagcagccgtatctccaaagcacaagatactgaagatgactctgttgactatatggaaaaaaattggtcagggaaccttcatacggcggataggtctgaaaggaatgcagctttggtttcacctttgctagccacatatactcagagaaagaacaagtctgttcgttttgaaagtgaaactgacttggcaacctatggaagctcatcagatgattggcatatgaaggaaaacaagtcaccaaatagccaaagtgcatataaaccatctccttatcctaccccgttgaagttatttgacgagatgcaaacaccaggaactgtgtaccctgcatcattagaagagttacgtacgggtaaggctcaagttcggtcccagtttgtctatccaactaacaaaccaggtgataatgtcttctggtgcaaaatactcgaggagagagattttaaccttgaagaagattcaagtgagctgagtgatttggttgagaaagctcaaaatgaaactcctaccccagaaaaagggtccaagaaattttcaaaagaaaatgacgatgaggtcaaatcaaatttgtctgctagaataagtcctgtgtcaaccatcaaggagcattcgcctatgccatttaagtggtggtatgacaatggcatcccgaattcaacaactaagtacaaggaggaccagaaagtaaaatggcatgcaaccccatttgaagagaggctggataaggcactgtctgagaattttatatctcaaaggaagcttgtttgtgggaaaccagtggaatttgatgagattgaagaaagtgatactacattatctcagctatag

SEQ ID NO: 5129 - DNA, 1362 bp, Glycine max
  Peptide Sequence Number=SeqID_121907
atggcagtgaaagtatacggtccccactgtgcttccaccaagcgggtgctggtttgtctggttgagaaggaagtcgaatttgaggttgtccctgttgatgtcactaagggggagcagaaggatcctgagtacctcaaactacagccatttggagttgttcctgtcatcaaagatggagattataccttatatgaatctcgtgctataatgaggtattatgcagaaaaatacagatctcaaggggttgagttgctgggaaaaacaatagaagagaggggtctagtggagcaatggctagaagttgaagcacacaactttcatccacaagcctacaacttgtgtcttcatggtttgtttggttcactatttggtgtgactccagatcccaaggtgattgaggagagtgaagcaaagctggtacaagtgttgaacatctatgaggagaggctctcaaagactaagtatttggctggggatttcttcagcattgctgatattagccaccttccatttcttgattatgttgtgaacaatatggggaaaaagtatttgttagaggagaggaagcatgtgggtgcctggtgggatgacattagcagtagaccatcatggaacaaggacaacattgtgcaagactttgatgctgcaagttttcttgccgataagacccttcttttagagatgcaagaggagttagaaactgaattggggggcagtaaaagtaaaagaatgtatgaaataaaacgcaagcttcgccgaaagaaagttcctttggttcttgatgatgttgatgacaaagacaagttagaaaagctggcaggagggcttgctgtagatgtttccaagcatcttccattggctttaaaagtaataggctctgatttggctactcttgatgaagaaagtttagatgattgggaatgtgcattggaagaatacgagaggactcctcccgaaaggattcaagatgaatttggttcaacatccaacattaatgtacttgttaataaatctcttctcacaattgagtatggctgcttgaagatgcatgatctaatacaagatatgggtagagagattgttaggaaggaggcaccaaaaaatcccggccaacttagcagactatggtattatgttgatgttattgaaatactaactgatgatttgggaagtgacaagattgaggggataatgcttgatcctccccagcgagcagtagtagattggagtggttttgcttttgagaaaatggaatggctcagaattctcattgttcgaaacacatctttttcatatgagcctaaacatctgccaaatcatttgagggtgcttgactggaaagagtatgatggaaataaattt

SEQ ID NO: 5130 - DNA, 423 bp, Glycine max
  Peptide Sequence Number=SeqID_121908
atggttaagaagcagtgtaaagaggtaagtgtctcccccgagaggttagctaagaaggaaagtcattttgcaataaagacaaacattaaaaaatctttccttcttagacaacctccgcatcttctcctttgtaaaagaaaaattgttagcattgccatacctcttgagcttaaggttattactcaagtaaaggagctgttggatgagggtgtggttcgtaagagcttaaatccttatgctttgttggtgcccaaaataggggttcccacgaaccctaagagaataaaggtcattcctgagtggtctactccagcaagtgttgagggaaaaagcctagagtttcaggaacctctggatttgaggtcaaatccttttcaagggggagggaatgatgaaatcctacccaccaagggcattggatag

SEQ ID NO: 5131 - DNA, 183 bp, Glycine max
  Peptide Sequence Number=SeqID_121909
atgagccacgagcgtatgtaccagagatgggtaaagaacactttcgataagaaggtatgcctgcgcaaattcaacgagggggccctcgttcttaagaaggcattctccggaggagcactggtgctcgctaacatggatgataaggagttggcttcaccagtgaatgctgatatcgccaagtga

SEQ ID NO: 5132 - DNA, 333 bp, Glycine max
  Peptide Sequence Number=SeqID_121910
atgaactgttggaatcttgatgatccaatagtaactttcagaggactcaggaaggccagagggaagagatctgaggccccttccacttcagcatcagaggcaccaccaggagaccagccttcttcctctggagggggtggggcctccacagcccaggagcctatgactaaagagcccacaacaccagtaccatcaccagcagcagtagaagaggagaccactccagctcagaccccacaaccatctccaccatctgcacctgctcctgaggagactcagccatcagcattggatattaatgaagaccagccacaggaggagcaggacgtttaa

SEQ ID NO: 5133 - DNA, 549 bp, Glycine max
  Peptide Sequence Number=SeqID_121911
atggatgtggccaagttacataactctgatgatgatgatgacaagaaagaagaagaagttgtgcttcctgggtttagattccatccaacagatgaagaacttgtggggttttatctgagacgaaaggtggagaagaagcctctgagaattgaactcatcaaacagattgacatctacaaatatgatccatgggatcttccaaaagtgagttcagttggggagaaggaatggtacttcttttgcataagagggagaaaatacaggaacagcataaggcctaatagagtgacaggttctggattttggaaagccacagggattgacaagcctatatactgtgttagagaaccccaagaatgcattggtctaaagaaatcattggtctactatcgtggaagtgctggtaaaggtaccaaaactgattggatgatgcacgagtttcgcctcccacccaatggaaaaactagcaataatccacaagctaatgatgccaatgatgttcaagaagctgtaagtcaattatacaaatgttactctttgtttccttaa

SEQ ID NO: 5134 - DNA, 744 bp, Glycine max
  Peptide Sequence Number=SeqID_121912
atggtacccactttgatatattctaaagttccatgtagtgctgaagctagattagactatactgccgtgggtgatggattcattgctcaagacatcacattcaggaacactgcaggagcagcaaatcaccaagctgtggcattccgttctggctcagatctctcagtattttacagatgtagctttgagggtttccaagacacactatatgttcattcagagaggcaattctataaagcatgtgacatctatggcacagtggatttcatctttggcaatgctgctgcagtcttgcaaaactgcaacatctatgcaagaacccctccacagagaaccatcacagtcacagctcaaggcagaactgaccctaaccaaaacacaggaatcatcatccacaactccaaggtcacaggtgcctcgggcttcaaccctagttcagttaagtcatacctagggagaccctggcaaaagtactcaagaaccgtgttcatgaaaacctatcttgatagcttgatcaaccctgctggttggatggaatgggatggcaactttgccctagacactttgtactatgctgaatatgcaaacactggtccaggttccaacactgccaatagggttacttggaagggttaccatgttctcactagtgcttctcaggcctcacctttcactgttggcaactttattgctggtaacaattggatacctagctctggtgtccctttcacctcagggctttga

SEQ ID NO: 5135 - DNA, 246 bp, Glycine max
  Peptide Sequence Number=SeqID_121913
atgatgatgaaccaagaaagactggaatccaaagccaagagtaaactcttctggaagttcaaggaggaagacaaagctatgggcaacaaatttatactacttgaaaatgaaaatgaaaatgtttctccggtaaagatagtgtacgtgacacaaccagctcttggaaaaatcaatgtgatggaattgattgagaaattcaacactcaatctgatgagtttatatcaaagaaagcatcacgaccttga

SEQ ID NO: 5136 - DNA, 690 bp, Glycine max
  Peptide Sequence Number=SeqID_121914
atgattctgagaagcagcaagagctgtttacacagaaggtatgccatttggctgctgaaagagtctgcagaaaagattgtgggcttaagcaaagaaagagagcaattaatcaggcagagagatgctgctattcaggaagcaaatatgtggcgttctgaactggcaaaagctagagagcatgatgtgatcttagaagcagctgtagtaagagcagaagaaaaggttagggttgcagaagcaaatgctgaaactaggataagggaggctgttcagagagaatccgcagcattaaaagagaaggaagagcttcttgcatatgtgaatgtactaaaagcccaacttcaaaggcaacacattgatacaactcaagtttttgagaagacagagtcatgctcagatacaaagcatgttgaccccacagaagagaatgtggataaagcatgcctgagtgtttctagagccatccccgtccctgcagagaatgtagtccacatggcaacagatcaggtgaacattcaaccagttggagataatgaatggagtgatattcaggctacagaggcgaggatagctgatgtaagggaagtagctcctgaaactgatggaagcagcttggatattcctgtggttagccagcctggaaccaatcaccaccatgaacaaggagctaactctttccatcaaccctga

SEQ ID NO: 5137 - DNA, 689 bp, Glycine max
  Peptide Sequence Number=SeqID_121915
ggagaaaatacaggaacagcataaggcctaatagagtgacaggttctggattttggaaagccacagggattgacaagcctatatactgtgttagagaaccccaagaatgcattggtctaaagaaatcattggtctactatcgtggaagtgctgataaaggtaccaaaactgattggatgatgcacgagtttcgcctcccacccaatggaaaaactagcaataatccacaagctaatgatgccaatgatgttcaagaagctgaagtgtggacgctatgccgaatattcaaacgagtcccaacttacaagaagtacacaccaaatttgaaagactcggcagcaccaatcactgagccaaatcaccccacaaactcttcaagttccaaaacatgcagcttagaatctgacaactgcaagccatacttgactttcacaaactcatcatcaccacaactcattctacaaaatgaaaggaaaccagttattaatggacatgttgacgttgaacgtaaccacttatttctaggtcaattaggcaatgtagctcaggctccaagtttttggaatcatcatcagaataataatgtggaatttgctaatgagaattgggatgatctcacatctgtggttcagtttgccattgatccatccagggtttctgatcatagtaaagaattcaatagattttaa

SEQ ID NO: 5138 - DNA, 630 bp, Glycine max
  Peptide Sequence Number=SeqID_121916
atggaacgagcgttgggtcatcttggacccgactacggggagaatggaatacaagtatgtgtttgcatattggtttctgtttgtgtggggaaacggaaaatcactttgattactgatcttctgtattgttttgaatgttttcctttccttaggataagacgaaatgaaccttctgttaaaggaacaattatatttgacgccaatagcaccatcaccatatctcccgtgaatttccacgggcttccaaagtacgatgggtgctgcttttgtatcctttttgtcgcatttactacttatgaatcatcagatattgggacaccacagaaaaaggattacttcctctgtgcagagactcctggtgcagctagagcatgggtgtcaactttacatgcaactcagttggttctaaaagcccataaagaagctgtgaattccttaagtgggaatggttctacaaaattaggaactgttgcaacagttgttgctgcagccaattcaacagccttggaatgttcaaaagaaattgaagcagcaatgcagatttctttgcgaaatgctctgggaatgatgaataataggactactgatggtcctatggatgatttaacaatcatgaagagaactgcatag

SEQ ID NO: 5139 - DNA, 1527 bp, Glycine max
  Peptide Sequence Number=SeqID_121917
atgggtgggatattgaagcaacccggcgcgtttgcaatcacaccgcacaaagtatcactctgcatacttcttaagatctacgctccacccgctcagatatcggtccccttccctttcgcttccgttgctcagcacaatcgccttggcttgttcttattagccctcaccaagtcctgcgatgatatcatggagccaaaattggatgaactcatccatcaattgagaatgatgagccaaaactgggaggcttcctgggttattgatcagttgatgagcagactatcatctctgtcatcacctgatgatttgtttaatttttttagcgatatacgaggaatacttgggggtcctgattcaggtgctgtggaagatgaccaggttattttggacatgaacagtaacctggggatatttcttcggcgttgtgttcttgcttttaacttgctatcgtttgagggtgtatctcatctcttgacaaacctcgggatctattgtaaagaagaattctcaaattgtccttcctatgaagaacacggtttagatgattctagtagtaatctggagacatattcagaatatgagaatatggacctggagaactttgtctatgaaaaggtttcagaagaaattgaagcaagaaaggaggctagtgaaattgttccattccatcttcatacacacaacactcttctgagtttagttgatgatattgatgtgcctgctgattcagtatccaaacagagtgagaaagttagagtagctagtccatatggggacccttcaagtaacatgctgcgagatgttgatcacagcagcccggtatttctgcggacaaactggcaggtacaagggtacttacaggagcaagctcataccattgaaaagaatggtagtgctgtatctttcaatgggcttgaaatcattctacggcaactacaaaagttggcacctgaactgcatcgggttcactttttaagctacttgaatggtctttctcatgatgattatatttctgctttggagaatcttcattgctattttgattacagtgcagggactgaaggatttgattatattccttcagttagtggtaatggctttggaagatatgaaattggtttattatgtttggggatgatgcattttcactttgggcatccaaagctggctttagaggttttgtcggaggcagttcgtgtttctcagcagcaaagtaatgatacctgtcttgcatatactttagcagctatttcaaacttgctgtttgaaaatggcatctcaagtacagctgcgacactaggatcgtcatactcaccttttacaagtataggtatttcgctctctgttcagcaacaattgtttgttctcttgagaggttctttaaagagagcagaaagtttaaagttaaaacggttggtggcttccaatcatctggcaatggccaaatttgatctaacggtaatgaaatttgctgactactttaaactaaacactctctttatactgccagtactttatgaatcctaa

SEQ ID NO: 5140 - DNA, 231 bp, Glycine max
  Peptide Sequence Number=SeqID_121918
atgaattacggtttcagatctcttgagaagtggtccttgcaacaggtttctaccggaagcggaagcgagctggcgcttgatcttctccaagctattctcggtgttttctgcagctcgctgtgtcattgcaaattcagctcagtgtcattaacagcgattcaaaaacacacaacacacaacgagagtgagaaagagaaggtgtcgattgatcagttaccggagaagccatga

SEQ ID NO: 5141 - DNA, 225 bp, Glycine max
  Peptide Sequence Number=SeqID_121919
atggaagaaggtcgcaaagggtatgttccagtgctagtgggcaaagggggacacaacatggagaagatttgggtatccatcaaagcgattcagcatccaaccattgttgagttgctggatcagtctgcagatgagttgggataccagcaaggactcctcagaatcatatatgatgttgacaacttcaaagccattgttgacaaggcttccaagaattgtatctag

SEQ ID NO: 5142 - DNA, 984 bp, Glycine max
  Peptide Sequence Number=SeqID_121920
atggaagtggggatctcaccactgtctcgcataaatgcgctggtgcatgcaactcgctttgctgatgcatcaagctcatcagatgcagcattagcatatgtaaagctcattcaacatttagcagtatctaaaggatacaaagaggcctttttcgcccttaaaatagcagaagagaagtttctatctgtctcaaaatctcaaatcttactgctaaagttgcagctgcttcatgagcatgctttacatcgtggacaattaaagctagcccagaaactgtgtgatgaacttggtgttttggcatcacgagtaactggtgtagatatggaactaaagacagaagcaagccttcgccatgctcgtacattgcttgcagcaaatcaattccgagaggcagctgctgtggcacactccctcttctgtatgtgctacaaatacaatcttcaagttgagaatgcttcagttcttcttttacttgctgagattcacaagaaatcaggcaatgcagttcttggtcttccatatgctttagcaagcctctcattttgcctctcatttaacttggaccttctaaaagcttcagccacacttactctagctgagttgtggctctctcttggatcaagccatgcaacaagggctctaaaccttatccatggagctttcccaatgattcttggtcatggtggtttggaactccgctcccgtgcctttattgttgaagcaaaatgctatctgtgtgattcaaacttcaatgtctttgaaaattatgagattgtgatagattcattgagacaagcatctgaagaactccaacttttggagtttcatgaactggcagctgaagctttctatctgatggccatggtatatgacaaactggggcaattagaagaaagggaagaagctgcagcttcatttcagaaacatattttggctctccgcaatcctcaagatgaggatgatcctcttgttagtgtgttttga

SEQ ID NO: 5143 - DNA, 324 bp, Glycine max
  Peptide Sequence Number=SeqID_121921
atgataagggatcatggtaaagtagaatgcatggtagaatccgtagaagaaaacgatgctcatcctgacatgatgaatagggagcaagaacaacagcagcagcagaactgtttggagaagtatgggtgccatgactttgagtggctcaatatgatggagccaactaatccactgaatgatgtgaaaatgaattggttttcagatgacattgttgggatggtggattttggttatgctaatgaagaatgttactctcaaatttgtgatgggcttgtctctaatgaggcaagttatggtttcctgtgggaagattatgatatttag

SEQ ID NO: 5144 - DNA, 627 bp, Glycine max
  Peptide Sequence Number=SeqID_121922
atggtggaggttggtctggccaagaaattcaaagaggcccaacttgtagcagtggaacaacagttgcggagtcaatcgaaatcggcggagatggttgccatgaggtttcaccagtaccaggtggtgggaagggctcttcctaccgaatccgatgagcatcctaagatctaccgcatgaaactctgggccaccaacgaggtccgtgccaaatccaagttctggtattttttgagaaaattgaagaaggttaagaaaagcaatggacaagtgctagccatcaatgagatttttgagaagaatcctaccaagattaagaattatggaatttggctgcgttatcagagccgcactggttatcacaatatgtacaaggaataccgagatacaactctgaatggtgcagttgagcatatgtacactgaaatggcatctcgtcatagggtgaggcatccatgcatccagataattaagactgccaccatcccagctaagctgtgcaaaagggagagcaccaagcagtttcacaattctaaaatcaagttcccattggtgttcaagaagattaggcctccaactaggaagctgaagacaacatacaaggcatccaggccaaacctatttatgtga

SEQ ID NO: 5145 - DNA, 1680 bp, Glycine max
  Peptide Sequence Number=SeqID_121923
atggttttgaaggtttctctcattgtggttctgcttgtgatatgctcctgtgttgtggaagccatttctaggaatcacaataatcacaatcacaacaatatcaacaaaaatggatcttctctggctgccataaagtttcctgatcatccaagtttcagtgatgtctcttcttctggggacaatgattgtagcttctcaaattctgagcaacttgggcattctgtacctaccatgacatcaggtgaagaaactgatgaagagagtgaggcttttccagcaccaaaaccacacaagaattcggtgaaactccacttgaaacacagatcagggagcaaaggtgctgagcctaaaaactctgtgattgattccacagtaagagatttgaccagaattcagaaccttcacagaagggttatagaaaataggaaccaaaacaccatttcaaggctgcagaggttacagaaggagcaaccaaagcagtccttcaagccagtgtttgctccggccgcttcatcgacaagtccagtttccgggcagcttgtggcaaccttggaatccggggtgagtcttggctctggtgagtatttcatggatgtgtttgtggggacaccccctaagcatttttctctgatacttgacactggtagtgaccttaattggattcaatgtgttccttgcattgcatgttttgagcaaagtgggccatattatgaccccaaagattctagttcttttaggaatataagctgtcatgatccccggtgccaattggtttcatccccggatccacctaatccttgcaaggctgagaatcagagttgtccctacttttattggtatggggatggttccaatacaactggggattttgcattggagactttcactgttaatctcaccactcctaatgggaagtcagagttgaagcatgtggagaatgtgatgtttggatgtggtcattggaatagaggcctatttcatggtgctgctggtttgctaggattggggaaaggaccattgtcatttgcttctcaaatgcaatctctctatggtcaatccttttcctattgtcttgtggataggaatagcaatgcaagtgttagcagcaagttgatttttggtgaggacaaggagctcctcagccaccccaatttgaatttcacttcttttggtggtgggaaagatggttcagttgacacattttactatgtccagataaattctgttatggttgatgatgaggtgctgaagatacctgaggagacttggcatttgtcttcagaaggtgctggtggtaccataattgattctggcaccactttaacatattttgctgagcctgcttatgagattatcaaggaggcttttgtgaggaaaattaagggctatgaacttgttgaaggccttcctcctctaaagccatgttacaatgtgtctggaattgaaaagatggagctacctgactttggaatcttgtttgctgatggagcagtgtggaattttccagtggagaattattttatccagattgatcctgatgttgtttgtttggctattttggggaatcctcgatctgccctttcaataattggaaactatcagcagcagaatttccacatactatatgatatgaagaaatccagacttggctatgcaccaatgaagtgtgctgatgtttaa

SEQ ID NO: 5146 - DNA, 207 bp, Glycine max
  Peptide Sequence Number=SeqID_121924
atgttttgtgacggtggtggtgacgatgattcagaagtggcagccacagcaaaggtagaagaaacagagggtggagacaaggactacagcctcagccgcgtagagtatcttgaaaacgacggtgtcgatgatgagtatgagctgttgtttgtttatattgagaaagggtggcatgcttcaaagacaaggatgtttgctggcccatga

SEQ ID NO: 5147 - DNA, 1068 bp, Glycine max
  Peptide Sequence Number=SeqID_121925
atggcaaaccaggtggttcctcgtgaatctcacccttatgcctttcatgtctctggccctcgcaagttcacttcccttaattggagggaccttttcatttctagttggaaggatgtaaattataagagaactgtcattgcctgctttatacaggcagtgtacttgcttgaacttgatagacaggagaagagaacacaaggaaatgctcttgccccaaattggtggattcccttcaagtacaagcttaaacaaacactaattgatgaaagagatggatccatttttggtgcaattcttgaatgggatagatctgctgcattggctgacttgataccaattagaccaagtggtgcccccagggctgttttagcactcagaggaacattactcaaaagccctacaatgcgaagagatatcgaagatgacctccgttttgttgcttgggaaagcttgaagggctctgtgaggtttaaagcagctttggaggtactaaaattgatttgtggtaaatacggaagcaataatgtatgcattgcagggcattccttgggggctggttttgctcttcaagtgggaaaagaactagccaaagaagggacttatgtggaggcacatttgtttaatccaccttctgtttcactagccatgagtctcaaaactattggagaaaaggctgagtttgtgtggaatagacttaaatccatgcttccttatattggtgaggctcaaatcagcaatggtggtttgaaagatgctagtttgggggtggcaaaatgggttccttatttgtatgttaacaagggtgactatatctgttgctattacaatgatggtgctggcacaagcacaaaggtgaatgtaggaactacaaatggacaagcaaagttgtttgttgtctctaaggagaaacagaagtttctcgagggagtttgtgtagttgttttgttttttcttctcacccgtcaaaggttgtttagcggtcaacactggtctcatttcattcttaaacaaaaattctgtcggagatgctttgagtggccattaatcaaaagtgaaaattacaaatga

SEQ ID NO: 5148 - DNA, 414 bp, Glycine max
  Peptide Sequence Number=SeqID_121926
atgaggttctcgttcatgtctgacttggcttctggggactttgtgttgttaggatctttatcttcttctcgtgcacagctggatcttttggagcaacttacatctacaagctcacctaatagtggttatgaaagtgatggaagcaaacttacaatccgagagcagctcgagcagttgtttggagaaagggatgatgatttcaccatacccctaggtaaaaacttgaagaaagtgagtgcgaagttcttgaccatctcacaaaagagaaatatcaggagacaagcttacctcaatgaagtgtctcaaaggaatgattcagttttctttgcaaccataggagcatttgtgattcttccaccttttataatactaggaatagctatattaactggctatgtacagctttttccttga

SEQ ID NO: 5149 - DNA, 980 bp, Glycine max
  Peptide Sequence Number=SeqID_121927
atgggatggctgttccatggcattctccatcttgggcgacgtagaggaggtggggccaggagaggatgtgatagaggtagtatttcatctggtagttctcaggcaagcagaacaggttgcacgcctgcatcgccattagaaacaatgtcatccattaataggcaaccttcgaagaaatctgcacgtaattctggaggatcaacatctcaagggtcacaaagctctggcgggccaagtgttaagtttgcgagaagaacttcaagtgggagatatgtgagtctgtcaagggatgacattgatatgtcctcagacttatcaggggattacatgaactacactgttcatatacctcctaccccagacaatcaacccatggactcatctgttgcaatgaaagctgaagaacaatatgtttctaattctttgtttaccgggggattcaacagcgtcactagagcgcatctaatggataaggtcattgattctgaagtcactcatcctcaaatggcaggctccaaaggctctctatgttcaatttgtgatggcagggtcatgagggatgagaggggacatgatgtcactccctgtgagtgcagagattgctttatagatgcacaaaaagaatctggtatgtgtcccggttgcaaggagccatataaagtcggggaatatgaggaagacctcacagatcagtattctaacaatggggcattgccattaacagcgccaaatggttccaaacgtaacgcaaacaacatgtcagttatgaagagaaatcaaaatggagaatttgaccataacaagtggttgtttgagactcaaggtacctacggagttggtaatgcatattggccccaagatgaaatgtatggtgatgatggtgatgatgccctaaaggaaggaatactggatcaagagaagccatggaagcctttgagccgggtaatgccaattccatcaggcatcataagtccttacag

SEQ ID NO: 5150 - DNA, 2502 bp, Glycine max
  Peptide Sequence Number=SeqID_121928
atggcgtcaccagcggcggcgaggacgccggtctctaccggcgcatctccgatgcaacgcctctccaccttcaaaaacccctcctccgccgccgcctccaccgccaccaccaccccctcctcctccgccctagactctctggcctcggatcccatcttctccgccttcctctctccttccttctcctccacctccttctcctccgccgcgctctcctccggctccccggcctccaccgcggagaagctccaccacgcgatccgcctcctggagaaccagctccgctcggaagtcctctcgcggcaccacgacctcctctcgcagctctcgtccctccaccacgcggaccacgccctctccaccctcagatccgcgctctcctcgctccagtcctccgtccgccgcctccgctccgagctctccgaccctcaccgctccgtcgccgccaaaaccgcccagctctccaacctccaccgcaccaccgagctcctccagcactccatccgcgccctccgcctctccaagaagctccgcgacctcatggccgccgccgaccccgaaaaactcgatctcgccaaggccgcccagctccacttcgagatcctcagtctctgcgacgagtacgacctcgtcggcatcgacgccgtcgacgaagagctcaattgggtcagggaaacgggagatttgcttcgcagcgaggcgatgaaggttctggaacgcggaatggaagggttgaaccaggcagaggttgggaccgggttgcaggttttctacaatcttggggaattgaagggcactgtggagcaggtggtgaataagtataagggtttgggtgctaagagtgtcactgtggcgttggacatgaagaccatttcgggtggaagcgggtacggtcctggtgggattagaggatctggaacgccccacattggaggaggggctaaagctagagaggctctctggcataggttgggaaattgcatggatcagttgcattccattgctgtcgctgtgtggcatttgcagagggtgctctctaaaaaacgtgatccctttacacatgttttgttgcttgatgaggtcattcaggaaggtgatcccatgctaactgatcgagtgtgggaggccattacaaaggcttttgcaagccaaatgaagtctgctttcactggatcaagttttgttaaagagatttttacaatgggatatccaaagctttactccatgatagagaatctacttgaaagaatttcacatgacacagatatcaaaggagtgttaccagctatcaatttgtctggaaaagagcagataatttcagctgtcgaaatattccagaatgcatttttggctcattgcttgagtcgcctttcagatctagtgaattctgtatttccaatgtccagtcgtggtagtgttccctccaaggaacaaatatcaagaattatatcacgcattcaggaagagatagaaactgttcagatggatgcacgcttaactcttcttgttttgcgtgaaattggcaaggttttaattcttcttgcagaacgagctgaataccagatatccactggtcctgaatcacgtcaagtaaatggtcctgcaacaccagcacagctcaagaactttacattgtgtcagcatctgcaagatgttcatacacggatatcatctatacttaaaggaatgcccagtattgctgcagatgtgttgtctgcttcattaggtgtcatatatggtgttgcctgtgattctgtaacagctttattccaagcaatgctggatcgtcttgagtcttgcatattacaaatacatgatcataactttggagtgctcggaatggatgctgctatggacaacaatgcatcaccttacatggaggagctccagaagtgtattcttcactttcgcagtgagtttctttctaggttgttgccttccaggaattcaacagctcctggtacagagaacatatgcaccaggcttgtccagagcatggcttcacgtgttctagtattcttcatccgacacgcatctcttgtgagaccactttcagaatcaggcaagttgaggatggctagggatatggctgaattggagctagctgtgggtcaaaatttgttccctgtcgagcaacttggtgcaccatatcgcgcacttagagcatttcgtcctcttattttcttggaaacgtcccagcttgcatcatcaccacttcttcaagatctgccaccaaatgtcatacttcatcatctgtacacccgtgctcctgaagaattgcagtcaccgctgcaaaggaacaaactaacaccattgcagtattcactatggctagattctcaatgggaagatcaaatctggaagggcatcaaagcaacacttgatgattatgctgcaaatgtgaggagcagaggagataaggagtttagccctgtttatcctcttatgcttcaattgggttcttctttgattgaaaaagatcagacttcctcaaagtcatga

SEQ ID NO: 5151 - DNA, 585 bp, Glycine max
  Peptide Sequence Number=SeqID_121929
atgggagttcaacaaaaactcagtgctttcctctttcaattaagcatgtttctccttgttagcgcatctcaagagcacaagaaagctaaaggcagacattcaagcaaaaaagaccataacatcaagatgagttctagacttcagttcgaaatcacattacatgggtttctcttgtgggcttcaatggcgttcttaatgcctattggtatgaagcttgccgtacttcttgccactgcaggagcaatcatgtccataaaaagtttcaacaactccttcagcaataatcatcaaagattaggggtagcattatattgtattatctggctgcaagttctagttggtatttttcgaccacaaaggtttacaagcctaccaagaaaaaacatccaaaagcataacaacttggaatatacttttcaccgttcagatatctttgattgtgatcttctaccttcttcaataaaaatgggtctacatacaaaaccagggagtgatttgggacaactaattactgattcctacttgataagaaaaaaagctagttcagatgacaagaatgcaggcatgaaggctgagtcttgctaa

SEQ ID NO: 5152 - DNA, 327 bp, Glycine max
  Peptide Sequence Number=SeqID_121930
atgaccctttcatcatggcagaacaagctaagcaggccgatggctactccagccaactctcctcctcttcctcctcattctcctcctcctcctactgaagcagcatcacagtcgccgtctaccttgaagcggacaagaaaagctacacggctaagatcattggcgactagaccagctagggcagacagaccagtggtccccgtcgatcctgggatcgggaagcctgacggtccccacaagaagaaattaagaacatatttggggattgtcgctcgtgataaggtcgacttgacatacgagaattggaagcaagtccttgctgcttag

SEQ ID NO: 5153 - DNA, 261 bp, Glycine max
  Peptide Sequence Number=SeqID_121931
atgtcgatgccgatctgttgccgatctcgaatgcgctgcgtgagttgcttgggcgcgaaaccgcccgcgaatgcgcactgcggggtggcgacgactacgaactgtgcttcacggcagctgccgaccagcgcgacgcgctgcattacctcgccgaatcagctggatgtgccgctgacccgtatcggccgcattgccgaagggcagggcgtgcacgtggatggcgaagccgccggcggcggctaccagcacttcgccggttga

SEQ ID NO: 5154 - DNA, 2568 bp, Glycine max
  Peptide Sequence Number=SeqID_121932
atgccaattccatcaggcatcataagtccttacaggttacttatcgtggtgcgacttatagtattgtgcttttttttacactggagagtggtaaatccaaataaagatgcagtatggttgtggcttatgtcaattacttgtgagatatggtttggcttctcatggattctagatcaagttccgaagctttgccctgtgaatcgttccactgaccttgaagcccttcatgagaaatttgatagtccatccccatcaaatccaacagggcgatctgatctacccggtatggacgtttttgtgtccactgctgatcccgagaaggagccacctctaaccactgccaataccattctttccatattggcagttgattaccctgttgaaaagcttgcatgctacgtttctgatgatggaggtgctctcttgacctttgaagccatggctgaggctgcaagttttgctgatttatgggttcccttttgccgaaaacacaacatcgagccgaggaatccagagtcatatttcagcttaaaagttgatcctaccaagaacaaaagcagaactgattttgtgaaggacagaaggagagttaagagggagtatgatgagttcaaggtacgtataaatggccttccagattccatcaggagaagatctgatgcatttaatgccagagaggagatgaagatgatgaagcatatgaaagagagtggggctgacccttctgagcctgtcaaagtgttaaaggccacatggatggctgatggcacccactggcctggtacatgggccagtccttctggtgaacatgctaaaggtgatcatgctggaatacttcaggtgatgctaaagccaccaagtcccgatccgttatttggaactgcagatgaaaagattctagacttcacaggggtagatacacggttgccaatgtttgtatatgtttctcgggagaaacgaccaggttacgatcacaacaagaaagctggtgcgatgaatgcattagttcgagcatctgcaattttgtcgaacgggccattcattctaaactttgactgtgaccattatatctataactgcaaggcagtacgagaagggatgtgcttcatgatggacagaggtggcgaggacatatgctacatccagttcccacaaagattcgaaggcattgacccttcagatcgttatgcaaaccacaacactgtgttctttgatggaaacatgcgagcccttgatggtctacaaggtccaatgtacgtgggaacaggatgcatgtttcgacgatttgctctatacggattcgaccctccagtagtggacaaggacgctgacaataagaacgatggtaaaaggcttcaagggtccgaaacgccagccatgaatgccagcgagtttgatccaaaccttgacgtgaacttactcccaaagcgctttggcaattcaacaatgctggctgagagcatacccatcgcagagttccaaggacgtcctttagcagatcaccccgccatcaagtttggacgtccactcggtgttcttaggacacctcgcgagccactcgatgctactaccgtagccgaagccgtatctgtcatttcttgttggtacgaagacaagactgaatggggagacagagtgggatggatatacggatctgtgacagaagatgtggttacaggataccgcatgcataaccggggatggcgttctgtgtattgcataacgaagcgagatgcatttcgtggatctgcaccaattaacctcacggatcgactgcaccaggttctgagatgggccacaggctcagttgaaatattcttctctaagaacaacgcattcctcgccagcaagcgcctcaagcttctccagcgtctctcttatctcaacgttggcatctaccccttcacctccgtcttccttgtcgtctattgcttcctccccgctctctctttgttctctggtttcttcattgtcgaaactctcagcattgccttcttaatctacttgctcatcatcaccgtatgcctggttatgctggccattctggaggtgaagtggtctggtgtggagttagagcagtggtggagaaacgaacagttttggctcatttctggaaccagtgctcacttggctgctgtggtgcaaggactcctcaaggttatggcagggatagagatctctttcacgctgacgtcgaaatctgccggggaagatgaggatgacatgtttgcagatttgtatatagtcaagtggagctcactcatggttccgccaattgttattgctatgaccaacatcattgccattgcggttgctttttccaggactatttacagtgccaatccacaatggagcaagtttattggaggtgcattcttcagtttctgggtgcttgctcatttgtacccgtttgcaaaagggttgatggggaggagaggcaagacacccactattgtctttgtgtggtcaggtctcattgccatcacactttctttgctttgggtttccattagcccaccccaaggtgctgacggacaaggtgtagggggagattttcaatttccatga

SEQ ID NO: 5155 - DNA, 309 bp, Glycine max
  Peptide Sequence Number=SeqID_121933
tgggccattcctggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcgggttaaaattcctgaaccgggacgtggcggctga

SEQ ID NO: 5156 - DNA, 514 bp, Glycine max
  Peptide Sequence Number=SeqID_121934
acgcccggggaagaggccccgaagggcccgttccaatccgtcccccgaccggcacgcgacgacccgctctcgccgcggaagcagctcgagcagtccaccgacagccgacgggttcgggactgggacccccgtgcccagccctcagagccaatccttttcccgaggttacggatccattttgccgacttcccttgcctacattgttccatcgaccagaggctgttcaccttggagacctgatgcggttatgagtacgaccgggcgtgggaggcactcggtcctccggattttcaagggccgccgggggcgcaccggacaccacgcgacgtgcgaaaagataactctttccggggcccccgccaacgtctccggactccctaacgttgccgtcagccgccacgtcccgatctgcaccgacgaccgctccgcccgggctcgcgccctgggttttgcagcgaccgccgcgccctcctactcatcggggcttggtccttgccccgacggccgggtatag

SEQ ID NO: 5157 - DNA, 276 bp, Glycine max
  Peptide Sequence Number=SeqID_121935
atggcgctagtgttcatcgctttagaactgtcataccctaatttcggccagggacgatcatttgcaaatgtttggatttttgccagccaaattgagctgcttaacaccaattgtcatgcaatccataaggctagcctctggctcgcctgggccaccataaaccttagggtcgaagtaaccagctcgcctgggagagcaaggttgcttttggaggaagcaagcagctcacctgggcgagctgttgtgcaacctccacccctcatttcctataaatag

SEQ ID NO: 5158 - DNA, 516 bp, Glycine max
  Peptide Sequence Number=SeqID_121936
tagagtattggaatgatcttaagagtgcccttaggaagaggcacattccctcctactatgaaagggaacttatggacaagctccaaaggcttagacaagagagtatgagtgttgaagaatatagacaacaaatggaactactctttttaagagttggacttagggaagaggaaagaacaagcatagctaggttccttagtgggcttaatatagaagtgagggacaaggaagataagggtaagaccatagagaaatacacccctaagactaattccgaagaaaggactagcaacattaaatgcttcaaatgtcttgggagaggtcacattgcctctcaataccccacaaagaaaaccacgatcatgaggggtcaagatatttatagtagtcaagaggagactacttctagcccatcctctagtggaagtgaagatgatgtaaggggtgaagagtatagtgaggaagtctacccccatgaagaatgtgacctcttaatggttagaagactccttggag

SEQ ID NO: 5159 - DNA, 174 bp, Glycine max
  Peptide Sequence Number=SeqID_121937
atgttaaatattgcatacatgaatctgaatactctgaatcctggtggattccctcctgggctttcagtagctcaagtcaatcgtgttacggggaaacaacaattgcaaagtaatgaaattttactaagaaagaagaaacactttctaattcaagaatccctcatctcaatatga

SEQ ID NO: 5160 - DNA, 327 bp, Glycine max
  Peptide Sequence Number=SeqID_121938
atgctccaaccatatgggatcaacataggcttaaaggaacactcaaaccgtgtgacccccaaggcctacactccgaagagtccgtcagggcctctccctcctgattcagggctttcctctaagctcagatatgattttgaaattcccaacggtgagaatgttcggaattgggttgcgaacatgatactcaaatttcatgacgatccaacggtgaacgggttccagatcgtcgtttttctgagactggtttggtgggctgcgggaaaaagaaagagttttgagaggagaaggggaaaaacgaaaatgaggccaaaaggaaccagctga

SEQ ID NO: 5161 - DNA, 1407 bp, Glycine max
  Peptide Sequence Number=SeqID_121939
atgatgacattggttgacgagctggagacattggttgacgagctggatgcattggacttggggtcgtcggtggtgccggtgaagaaggtcccatacggcgacgtgttcgaggcgtcccgcgcgggcgacgtcgagcggctccggtaccttctggaggcaggcgtgaacgtgaacgctcgtgaccagtgggactccgttgccctctactacgcctgcctcgccggccacctcgacgccgcccgcacgctccttgagaacggcgccatctgctccgaaaacaccttcgacggcgaccgctgccactacgccgccctcaatttgagtgtccgcagactcctcaaggccttcgaggcccgcccccctcccttggaccccttgcaggcctctttgcgcgacaccttcctcggctgtattccatccactcaggggtccatttgcagcagcagccacttccctccagatgtagcttttattgtacaaggaaaacctattcgagctcacagagtcatattaagttcgaggtcaccatttttcaagaaaaaatttacaactgattggaaggagcgcagtgaagttagattctcaagggaaaggttgtcatatcctgcactttatagccttatacacttcttttattcagacagattagaggttgctgttgatgacatgcaggaccttataagaatctgcaaagtatgcagatgtgaatcactgcataaagttcttgagaaagaactgattcatcaaaagtatgcagattataaggcactgggtgatgtagataactctcagaaacggtatatcttacaaggtctatcccttccccaagaagataggcttcctgcagccttgcatcgaatccttctgaccgccctttcaaattcaacccgccaaagtggtcaagaagatgaaattgataagttggtaactaggatgggtgccatgcagatggcgaaatctctggatgatctcgctgatgtttgtgtaagagttgatagaaaaattttccgctgtcaccaagttattctggcatctaggtcagaatatttcaaagcaagattatcacatatgaaggacttccatgaagacatagatgagttatctgttgacatccttccttgccttgaagaacatgacttgagcatggaagcttttgagaaaatgattgagtatatgtacactgatcgtttgcaggatataaatccagatcaggctgaggaaatgttggatgttgcttctagatacttattgtttcctctcaagcgggcggtggctgatgtcttgttgccacacttggaaatggtgtcacctgaagaactttgccattggttaatactagcagacatgtatttgcttttctgccaatctcctcattctcaatctattagcatggaccatcttcactaa

SEQ ID NO: 5162 - DNA, 555 bp, Glycine max
  Peptide Sequence Number=SeqID_121940
atgcccctatctaaggctgcggcacgtggcacttttccaggcagaaaaaagaagaagaaggaagaagagaagagaaagccatctatatctgtagagaagaattgcatacggattgaggaaccaaatatggttaccaaaaaaagaaggagagagaagaagagaagagaagcatacgggattgagggaccaaaaagcctaggtttgcatactctatatgattgtggtgcatgcactgtttatgatgcaatgttctatggaaattggattaagtgtgtggatttgggcaaagcatcaatggcgacaaaagctttgtccttcgctctgtctctcaatgacctcaccaacaagcacttctcttccaatacgccacacaccgccactaaagtttccgtctttactgtccaatgctcttcttcgggtggtggagagaggccttggaagaattcaaatgctagacttgtgcttgaagatggttcaatttggaaagcaaaatcatttggtgcttcggggactcaagttggcgaagttttttttaatacatcattgataggatga

SEQ ID NO: 5163 - DNA, 534 bp, Glycine max
  Peptide Sequence Number=SeqID_121941
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgcccaagcccgttcccttgggctgtggtttcgctggatagtagacagggacagtggggaatctcgttaa

SEQ ID NO: 5164 - DNA, 492 bp, Glycine max
  Peptide Sequence Number=SeqID_121942
atgtcgatctcctcctgcaaaaggatcacgaccacaaggtacccagtggacccggggaagtccaacagggccctggggtttccagccctagttagggcctctgtcagtcctacagggtgcccgtcccccccagcaaggtcatgccatcgtgacatagggatcgcgcccgcaagacacctagtggacccggagaagtccaacagggtcttggggtttccagctctgattacgggcctttgcaagttttacagagtgtccgtcgcccccagcaagatcatcaggccccctactaaccgagctttcatcaagaagtactacaccccccaggcaagcacagggcgagacaccacagcagcccggggatggcaggcagcgggcaacagatgcatcgccgccacctccagagcacctcagcgcatccacaaaaaggttagagcgttgcctacgacacatggccgaccaataggcgaccaagtccaaagccaaaggtaa

SEQ ID NO: 5165 - DNA, 201 bp, Glycine max
  Peptide Sequence Number=SeqID_121943
atgtggaatgcaaggggtgtggttatggctgatactgagggccctccaaagtgttttgcagaggtatatcaccaactacttgcccttcagtggcatattcgaggcaaggctcgaagtcgactagagtgtggtggggaatttcgtgtgtctcccccatgggttgagagacatgtgcatgatgaggttgtcggctctcaatga

SEQ ID NO: 5166 - DNA, 558 bp, Glycine max
  Peptide Sequence Number=SeqID_121944
atgggaaagttggatcatatggaggaaaggttaaaggccattgaaggaggcgaagattattcctttgctaacctagaagagttgttcctagtacccaatatcatcacccctcccaagttcaaggtaccaaactttgacaagtacaaggggactacttgcccgaagaaccatctaaagatgtattgtcggaagatgggggcatacacaaaatatgaggaactgctaatacatttcttccaagaaagtcatactggggtagctgttacctggtacactaacttggaaccttcccgagtccattcttggaaggacctaatggttgccttcgttaggcagtgtcaatacaattctgatatggcttcggataggatgcaactacagaacatgtgcaaaaaggggcatgaatctttcaaagaatacgtccaaaggtggagagacctggcagcccaagtagttccctcaatgacaaaaagggagatgataaccgtgatagtagacacattaccaatattctactatgaaaagatggtagggctacacaccttcaagctttgctaa

SEQ ID NO: 5167 - DNA, 2853 bp, Glycine max
  Peptide Sequence Number=SeqID_121945
ttggaaggggaggagctgcagagatttgcaaacagaagatgggagagagaacaaggacgcagggatgcaacagaggatctgtctgaagagttgtcagaaggggaaaaaggagatggcgttggggagatgatacaaattgagacatcaaagaaaaatttccagaggcagatttccaacttggaagtatggtctgatgacaaaaaggaaaagaagctttacattgtcctcgtaagtttgcatggtttggttcgaggagaaaacatggagcttggtcgagattctgatactggtggacagattaaatatgtggtagaacttgctcgtgcactagcaaaaatgccaggagtgtatagagtagacctcttcacacgccaaatctcatctcctgaaattgattggagctacggagaacctacagaaatgctaactgcaggcacagatgaggatgatgataacattggggagagcagtggtgcatacatcataagaataccctttggtccacgtgaaaaatatctacagaaagaacttctttggccccatattcaagaatttgtagatggggctttagctcacattctcaatatgtcaaaagtattgggtgaacaagttagcggggggaaaccagtgtggccacacgttattcatggacattatgctgatgctggagatagtgctgctcttctttcaggtgccttgaatgtgccaatggtgctcactggtcattcacttggaagaaacaagctagaacagcttcttaagcaagggcgtcaatcgaaggaggatatcaattcaacatataagataatgaggagaatagaagcagaagagctttccctagatgctgctgaacttgttatcactagcacaaggcaagaaattgatgagcaatggggactttatgatgggtttgatgtcaagcttgagaaagttttgcgtgctcgagttagacgtggtgtcaattgtcatggccgattcatgccaaggatggcggttatcccgcctggtatggactttagcaatgttgtgacacaagaagatggccctgaagttgacggggagctcacacagcttactcgtggtgttgatgggtcttcaacaaaggctctacctacaatctggttagaagtgatgcgtttcttcacaaatcctcataaacctatgatcttagccttgtcaaggccagatccgaaaaagaacataaccactttgttaaaagcctttggagaatgccgccccttaagagaattagctaatcttacgcttataatgggaaacagggatgacatagatgaaatgtcctctggcaatgctagtgtgctcacaacagtgttgaaattgattgataagtatgacctgtacgggcaagtggcatacccaaaacatcacaatcaatctgatgttccagagatatacagatttgctgcaaaaacaaaggcagctgcccatggacttccaatggtggccactaaaaatgggggacctgtggacattcatcgggccctgaacaatggtttgcttgtggaccctcatgatgacatagcaattgccgatgcattggtgaagttgttgtcagagaaaaacatgtggcatgagtgcaggaagaacggttggaagaacatacaccttttctcatggcctgaacactgtcgcacttacttgacccgggtggctgcctgtaggatgaggcatccacaatggcaaaccaacaatccagaggatgataaagctgttgaagaagaagagtctttcaacgattcgctcaaggacgaacacgacatgtcccttaggctctcaattgatggtgacttggctgcagcaagtggaggcactggtctagatatgcaagaccaagttaaacgcatcctaagcaagataaggaagacagattctggctcaaatggtaatggtggtggaaatatcaatatgctgcttgacaatgtaacgagcactagcactagcactaacactagcaaatatcctctattgagaagaaggcgtaggttgattgttatagcacttgatttgtatgacaataatggagctccggagaagaaaatgattgagatggtgcaaaagataattaaagctgtgcaactagaccctcaaactgctagagttacagggtttgctttatcaactgctatgccagtgatagaaacagtagagttcctaacatcaggcaatgttcaagtgaatgagtttgatgctttaatttgcagtagtggaagtcaagtttactaccctggcatcaatacagaagaaggaaagcttttgcctgatccagattatgaggtacatattgactatcgttgggggtgtgaaggtcttaagaaaaccatttggaaacttatgaatggtgatgagaacagccccattgaggaagatctcaaatccagcaatgcacattgcatctcatacaaaataaaggatcttagtaaggcaaaaaaagttgatgagttgaggcagaagcttaggatgagaggtctacgttgtcatcctatgtactgcagggggtcatctagaatgcatgtgattcctcttcttgcatctagagcccaggcactcaggtatctctttgtacgttggaggttgaacgttgcaaacatgtacgtcatccttggagaaaccggggacacggattatgaggagatgatttctggaactcacaagaccataatcatgaagggagtggtgtctaagggttcagaagagttactaagaggtccaggaagctaccaaagagatgatattgtcccaaatgagagccctcttgttgcatccattactgaaacaacacatgaaaacattgctaatgctttgaagcaactttccaaatctggaggaatctga

SEQ ID NO: 5168 - DNA, 1491 bp, Glycine max
  Peptide Sequence Number=SeqID_121946
atggaattgtcaaagaagacgtcatttttgggtttgaaacgatgggttttgattgggataggtgtcggtgcatttatagtgctgattttgtgtatattatcgatatgggcgatgtttcggagaaagtctaggagatctctggacaagtattctgtatcccaaataccaaatttctcaaaagatatcgatgttgacaaggttggggtgcagagttctcatgttcaaccagaaaatgtggttattcctgttcatgacaaggcaagtgacaagaattcagataatgtatcagttcatttgggaaatagcaaatctggtgatcctgataatatcagtcagtgcagctcaatttatcatcatgagagaggattgagttcaatgtccgccgaagaaggaagctctgggaatgttaagaagcaatctacgttgtcacatggagggctggccactgcctctcctttagttggcttgccagaattttctcatcttgggtggggccactggtttacacttagagatctggaaatggcaaccaatcatttctcaagcgagaacatcattggcgagggtggatatgggattgtttacaggggcagactggttaatggaaccgaggtggcagtgaagaagcttcttaacaacttgggccaagctgagaaagaattcagggttgaagtggaggctataggccatgttagacataagcatcttgtacgccttcttggatattgtgtagaaggagttcacaggctgcttgtgtatgaatatgtgaacaatggtaacttagaacaatggttacatggagacatgcatcaatatggaacacttacctgggaggcccgcatgaaagttatacttggcactgccaaagcgcttgcttatttacatgaagcaatagaaccaaaagttattcaccgggatataaagtctagcaacatattgattgatgatgaattcaatgcaaaggtttctgattttggtttggccaaacttttggattcaggcgaaagtcacataaccactagagtaatgggaacttatgtggcaccagaatatgctaacagcggtttgttaaatgagaagagtgacatttacagctttggtgtcctcttgctggaagcagttactggaagggaccctgtagactatgcgcgtcctgctaatgaggttaatctagttgaatggctcaaaacgatggtggggacacggagagctgaagaagtagtggactcaagccttcaagttaaaccaccactgcgtgctttgaagcgcactcttttggttgcacttaggtgcatagatcctgatgctgacaagaggcccaaaatgagtcaagttgtgaggatgcttgaagctgacgaatatccacttcgagaggatagaaggaaaagaaagagtggcactgccagcatggaaattgaaaccgtgaaggatatttctggtccatctgatgctgaaaagatgggaatttctgaaagccacgttgaagaatag

SEQ ID NO: 5169 - DNA, 1098 bp, Glycine max
  Peptide Sequence Number=SeqID_121947
atggagaatgagaaggaccgtttttatgatccctttcattacaaccaccaccatgatcagcaactcaaccactcatcatcaagctttccattctttagggacaacaacaacaactcagcaccaattggctcacaattaaactttcaagggtttgatgatcataataacccttcttctcatcatcacaccactttcactgactgcttacatggttccatggattacaacaccctctcaagagcctttgacatgtcttgttcatcttctgaagtgatctcctccaatattgttgaaaaccccaagaagcctagtgcaggaggagactctgtgggggtcagtgggaaccaacaatcaacacctaattcatctgtgtcttcatcatccaatgaagctgaagcaatcatagaagaagactcaaccaagagccagaaagataagcagccaaaagggtgtgaagaaggagatgaaaagtctaagaaagaggcacttaaccctaaaataattgttatcggtttggtgagtattatctgccatcttgcggagaatttgactgatgttttggagcgtttcaggaacaaacccaaaaagaaagagaaaaagccaagagagcctcgcttttccttcttgactaaaagtgagatcgatcaccttgaagatggatacagatggagaaaatatggacagaaagcggtcaagaatagtccatacccaaggagctattatagatgcacgagtcagaagtgcggtgtaaagaaaagggtggagagatcattccaggacccaacaatcgtgatcacaacatatgaagggcaacacaaccatcactgtccagcaacactaaggggcagtgctgcaagcatgttgtcatcaccttccttttttggttcctcttatatggcgtcaagcttaccccaagattttcttgctcagttgcttccaagttatagccaaaatgatcaccaaaatccaatgtttaaccaaaacctttcccataatctccatccccagcctcaacagcagcagcagttccaactctctcgtgactatggtttgttgcaagacctactaccatcattccctggcaaacaagtgccatga

SEQ ID NO: 5170 - DNA, 762 bp, Glycine max
  Peptide Sequence Number=SeqID_121948
atgatcaatgacctcgtgctggaaattcaagaatttagagagagccttttagatttagggatcgaggttagatcaattttggcgcctattggacaagggagttcacaggtttcagggtcatctcaattatcatcaaaagatgcgtttctgtcaaagactgaagtaaaaaatatctctcagattaatgccagttcagaggagtttgtttgtgttactgtagtgaaggacaactattcatggtgctatccggcttgtggtcaatgttataaaaaagatgacatgcaaactgtgccgttcacatgtccatgtggcaaagagaatgatcaacctgtactaaggtatcaggttgaggtgatggttaatcacaagggtgaacaaaccaaatttttgatctggtatcgtgaatgtgcacagttaattggtcagtcagcggatgaagtcaacaggctcaaaatagaagatggggatgttgatttaaatgcctctcctcaagcactagataggctattgggttgtttccttgcattcaaagtgaaggtgcaaccaaggttcaagaattctgttgttcttaaatattcagatgaattagacttgatcaatgttgtgctagatatgattcctgatagtgagccatgttgcaagatcgagaattcaatacttgagttgaccgatcctacagagcttgaatctcaatttgtgtctattaccgctgatcatgatcggtcaatgcttggctcaagtgagcctatagagcttgaatct

SEQ ID NO: 5171 - DNA, 318 bp, Glycine max
  Peptide Sequence Number=SeqID_121949
atgaagatgaaagcaaacaaaaaaggaaatgaattgaaagtctcggattcgaacacttatcggttgaagaacgaagaacgaatgaagaatggacaaagaaaggtgaagaacggaggaaaatcatcacagatttgttcacagaaatgtctcggaagcattacggaagcacttcgacatgatttttcttcacagaaacgtgttttttttttatccaaaatagccaaaatgcataacctaggggtcatgaaaattttgaaacacctccctcccctatttattgggaaaaagggaggtgcttgcagcccagaggcttcttga

SEQ ID NO: 5172 - DNA, 282 bp, Glycine max
  Peptide Sequence Number=SeqID_121950
atggagtttgcccccccccctaacaatggttatgagcatcactttacacaccgcaagcataccctgtactgcaggctggccatcctcaagtatctttcagatcaggtttcctggagtgatgggcttaaagagcagcttgatacgctgatagcacagccgccggcctgcgtcacgtgggaaaaaatgggctttcccgaactctggcgggacgatcctctctggacccggccctttaatccgcccggttcgggtgctcagccggatcagaccgcaggcgggtaa

SEQ ID NO: 5173 - DNA, 775 bp, Glycine max
  Peptide Sequence Number=SeqID_121951
cccaggcagagtctggctggtaggggccggaccgggggatgttgagctactgacagtcaaggcgctgcgcctgctgcaacgtgcggatgtcgtggtctatgatcgcctggtcagtgaagcggtgatggcggaagtcgccagcagcgcactctgtatcgacgtaggtaaacagccgggtcatcacggcctgaagcaggcacaaattaatcaactgctggtggacctggctgccagcgggcgcaatgtcgtacgtttaaaaggcggcgatccctttatctttggccgtggcggtgaagagatggtcagcctgcagcaggcgaatattgtctgcgaagtggtgcccggcattaccgccgccgtgggctgtgcggctgccagcggcattccactgacgcaccgtgactgtgcccagtcattgcgctttatcaccggacacgggcgcagcggcgagccgcagttggatgcggcggcgctgaccgcgaccaatcagacgctggtgttttacatggggttaagctggagcagcgtgattagcgcccggttacgggaatgtggccgcagcgaggcgacgccggtggcgatcattgaaaacggtacgcgtcagaaccagcgggtgctgatcaccacgctggccgggttgcctgaaactgttgaacagcaaaaaccggtgtcgccgtcgttactgattgtgggcgaagttgtgcgctattaccgtgccgatagagtctctgcgcatgggtgtgatttggcgttaagtgacatagaggcgcactga

SEQ ID NO: 5174 - DNA, 672 bp, Glycine max
  Peptide Sequence Number=SeqID_121952
atgacgacacttgctcagacatggagtgtcctttcttattacgatcttgcgcccacttctcacacatctgatgttaatcttgacagggcccgcttgatctacggtttggtgagccgcatggacatggatgtgggcagctttatatcacagcagatcagccagattgcccagtccagcacctcgaggctcgggttcccagcgttgattacagcgctgtgcgacattcagggggtggtttctgataccctgatctttgagtcactcagccctgcgatcaacctagcctatgtgaagaagaattgctggaaccccgccgatccatcgatcacgttccctgggcctcgccgcacacgcaccagagcttcagcatcagcttccgagggcccccctacctacccagtctccgtctcagccatcccagcgaccgcgacatccacctgcttccacctcagcatccatggacacgcatgggcagatgctgagatggaccccccgctcaccactccagaggcctatcgtcagcgagtcgcctggccaggagaccagccctccactgacaggggggaagagccttctagagtcgctgaggatcctgcagtcgatgaggacctcattgctgacttagccactgctgactggggcccatgggcggacttgggcggaggcagttga

SEQ ID NO: 5175 - DNA, 785 bp, Glycine max
  Peptide Sequence Number=SeqID_121953
atggtttatttcttggctggtttttgcaaacttctggttgtctatctttatagtcacggatcaaacaccaatctcatcaacattacttggaaaaagctgataaagcaaggaggcaaagactatcatccagttctgcttctgccaaatcaggaagtagataatttgaccagagaaaagatagaagatgaactcaatgaacttaaagaagcacacgctgcatatgaggtggatacaccattggatgttcctgctaggaagaggtttgcaaaatacaggggactcaagtcctttaggacttcttcatgggatcctaaagactgtattccagttggctcatatgctaggttgcatatcatgggagtgcccagtgctattgcttcaaagttatctttgcttgcaaagacaatcccaattacagcatgtggcctattgaaacatgagtccaaagtatctgtccttcatttcagtgtgaagaagcatgaagcatatgatgcacccatcaaatccaaggaagagttaattttccatgttgggtttcagcaatttgttggctggccaattttctctagcgagttcataaatacagacaagaacaagatggagaggtttctccatgctgggcgtttttcagttgcttcaatctatgcaccagtttcctttcctcctcttcctatgataatcctaaagagaaatggagagaatgctacccctgtagtggcagctgttggctcactgaaaactgttgatgcagataggataatccttaagcgagttattttgacagg

SEQ ID NO: 5176 - DNA, 264 bp, Glycine max
  Peptide Sequence Number=SeqID_121954
atgggtgtctataaagccgttgagggtgcaaagtacttagtttatattgcagggtggtccttcaatcccatgatggttctgccaacaaaggttggtccagttgataacaataacattcataccatcatgaatttgaattccactgcggatataagaacctcatgggttgcagatcctcacacagaaatcccacatgccacaagaataaaggtaggtgaactattgaagaagaagacagaggaaggaatgcaattggaaagttaa

SEQ ID NO: 5177 - DNA, 2109 bp, Glycine max
  Peptide Sequence Number=SeqID_121955
atggggcttcccacatttgaagtttctgatttggaacagggagggaaatcttcgaggatagtgaattgtgttttagcacttaagtcttacagtgaatggaaaatgggaggaaaaattggatcatggaaatatggtgggaatccaaagccacctgctccctctgcaaaacctattatgtggaaaagctcagaaccattcatgaggtctttgtcaaggggtttttggttaggcgatagagatggtttgccgagtgataattctccaagcagtgttctcagtgaagagggttctattccctccttgaattcactagttcgcgaaattttatgtaataagaagcaagaagagattcccattgtggtggagtctctacttagcaatgtcatggaggagtttgaacaacgcttgctaatccaacaagaaacattcaaaacaactcaagaagataaggcaccacctgaagcagaggattctaatgtggaagctgcttgtgatgatgaagagcacaatggcgacgaagaatcaattgaccagcctttgaagcagcaaaagttatttcagcagcaaaatgaaaacgttcaggaattgaaaatgatggttcatcaaacaaaaacaggaattcaggttctgcaacataaatacgaggaggatatcatctatctaagtaagcacctgcttggcctagcttctgcggcttcaggatatcagaaaatttttgaagaaaaccgcaagttatataatcaattgcaagacctgaaaggaaatattagggtgtactgcagagttcgaccctcaacaagtggtcaaacaaaccatcattgccctatcaataacatagatggaggaagtatgtcactaataattccttccaaaaatgggaaagatgggaagaagacatttaatttcaacaaagtgtttggtccttcttctacccaaggggaggttttctctgatacacaaccactgattcgttcggttcttgacggctacaatgtgtgtatatttgcttatggccagacaggatcaggaaaaacacacactatgtctggaccagacaattatactgaggaaacagtaggtgtcaactaccgcgcactgagagatcttttctttctctcagagcagaggaaagacatcattcactatgatatatctgttcagatgctagagatttacaatgaacaagtcagagacctattaaccacagacaaaattcgcaacagttcccataatggcattaacgtgccagatgcaaacctggttcctgtttcatcaacttccgatgtcttgaatttaatgaacttgggacaaaagaatcgggcagttagtgctactgccatgaatgatcggagtagtcgttctcatagctgcttgacagttcatgttcaaggaagagagcttgcatcagggaatagtcttcgtggttgtatccacttagttgacttggcaggaagtgaaagggttgataaatctgaggtcacaggagataggctgaaggaggctcaacatattaacaagtcactttctgctttaggagatgtgattgcttcccttgcccaaaagcaatcacacgttccctataggaacagtaaacttactcagctgcttcaagattctcttggaggccaagcaaagacactcatgtttgttcatgttagtccggatgcagaagccattggagaaacaattagcacattgaagtttgctgaaagggtctccactgttgaacttggtgctgcacgagttaacaaagatagttcagaggtcaaagagctcaaagaacagatcgctagtctgaaggcagcctcagccaggaaagatggagaattggaacactttcaacagtatgcaaatagcattactgaaacaccaaagttcaaacctgatttgacttcctttgcacggtcacctagttggtcgcatggacctcctaggccaccaagcagagatgatcctagtagcatggaggacaagaaaaagcctacacccaagttcatgaaaaggcgaagctttgatcccagggacatttgtaggaaatcaccccgttggccacatcatgaaagggtaaatggaaaggaggatgataaagaatcgatttctggggattgt

SEQ ID NO: 5178 - DNA, 831 bp, Glycine max
  Peptide Sequence Number=SeqID_121956
atggtgtgggttttttttccattctatttgttcttccagaatggtggtgctgctcctgcatccaaatcacgtattccaccattagcatctcagccactgggctttggtcaaaggcatgatgctacagttgatattcctttggatactacaaatgtaatgtcatcgctaattcagggacttccccttatgactgactccaagaaaagaggtcaagagctagctgcttgggaagcggatttaaaacggaaagagaaggaaataaaaagaagagaagaggctgtttctagagctggtgttcctgttgatgataagaattggcctccaattttcccaatcattcatcatgatattgccaatgagataccggttcatgctcagaggctgcaatatttggcctttgcaagttggttaggaattgttctctgcctagtttttaatgtagttgctgtgactgtctgttggatcagaggcggcggtgttaaaatttttttccttgcggttatatatggtctacttggtgttcccctttcatatgttctttggtacagacccctctatcgtgctatgaggacggatagtgcactgaagtttggttggtttttcatgttctacttgcttcatattggattttgcatctttgctgcaattgcgcctccaattgtttttcatggaaaatcattaacgggcatccttgctgcaattgatgtcttctcagaccatgtattggttgggatattctatttgattggatttggcatgttttgcttggaggctcttctaagcttatgggtgcttcagaaaatatacatgtacttccgggggcataagtga

SEQ ID NO: 5179 - DNA, 168 bp, Glycine max
  Peptide Sequence Number=SeqID_121957
atggttgtgtcaggaaacaacaatggttgtgtgagcgggcaacaatggtggctcgaggggctatcatgtttgcaagggagcgacactggtggcttgaggggcggccatggttcaaataatgatattattgtgttaaatgtatctaatgtgtttaatgaaattttttag

SEQ ID NO: 5180 - DNA, 638 bp, Glycine max
  Peptide Sequence Number=SeqID_121958
atggcaacccttgtagacattggggtctcagctgccatcaacattctctcagcctttgccttcttgctggcttttgctcttctgagaatccaacccatcaatgatagaatctactttccaaagtggtatctcagtggagggagaagcagtccaaagaggtctggtgagaattttgtgggaaaatttgtgaacctcaatttcaggacttacctcacttttctgaactggatgccacaggctctcagaatgagtgagtctgagattattagccatgctggccttgactctgctgttttccttagaatctatattcttgggacagatgaacttgctgtaatgcttctgggaattgtggttttgcttgttgtgatgcatcgttgtgcggcaaccatagattctagagttatgccgtgtggttttcaactatcttttttggttttgccagcttttgttaaagccattccgtggaagcttcaccttatgggcttcaaggtttttgctccaatcacacttgtggcactcttcattcttataccagtcaacgtatcaagtgggacattatctttccttaaaaaggaattggtagtgagtgatattgataaactctcaatatcaaatgttccacctaagtctataag

SEQ ID NO: 5181 - DNA, 276 bp, Glycine max
  Peptide Sequence Number=SeqID_121959
atggcgccagagcttgccttgccattctctgttgtatctgtggtcgaagatgttcttcaaaagcatggaagtcctttaatcgacattgacttggcatcaaggaaggctgaagaagcttccttaagaaggaacgaagcggccgcgtggctgcaaaagacagttggagggaaagacatgccaggtgagcctactgaagaacatttcaggattgcgttgcgtagtggcattgtcctttgcaatgctcttaacaatattcaacccggagcagtgcctaag

SEQ ID NO: 5182 - DNA, 924 bp, Glycine max
  Peptide Sequence Number=SeqID_121960
atgggtacctcggaaagttgcaaaagtgaagaactttgcacagaactactcgaattccaaactggggacacttccactgagtctgtgattcaaactttccgtcttctagtatatggagtgctacattgggttgtttcactaggcctcattctggccattgactttctcttgaagaaagccttcgtagcagcttctattgagttccccagtgccctgtttgggatgttctgcattttctctgttttgattatacttaattatgctataccttctgctgctatggccttgatgaagttttttgaaccagggattatgttcattcagagatggctccctttgttctatgttccatatttggttgtgctacccctttctcttaaagatatttctccttcttctgccatcaaaatttgccttattgtagttggaggatggctggctacactttgtgtgactggtttgacagctataggtgtaaggaaagctgtgaagacagaattgatagacgctgaacctatggagaagccatctccattttcttctagtgaattgtgggcatggactgggattttcctcatatcgtttgttgcttcattagtttatccaacagcactgggaacacgagccagaacgtatcttccattcttgcttgcatccacggtgttaggctacatgattggttccagattgccatcaagcgtgaagaaggtcctccacccaataatttgctgtgcggcatctgcagaactaacagcagttgtttttgggtttctttccaagtcagggcttgatcctgttctgggtataaattataatttgaagttaaataggaaactcactatattgtataagagcttgtttgttatagatattaacaaggttatcaaactcgagaatttacgtaaattcgtgagagttttataa

SEQ ID NO: 5183 - DNA, 636 bp, Glycine max
  Peptide Sequence Number=SeqID_121961
atggttgtgctttttgtgaggtttgaagcttctcaatatggactctcttgcttgaggaatgtatatcgggctgtttggccaatgtttcatgtgaatgttttgtcgctatttgctgtgggattgctgtctttgggctctaccgttgttgtcatgatgaaatttgacatagatgaggttgtcagggtgattgatgaatataaagttatacactttcctgttgttccgccgatgttgacagcactgataacgagggcaaatggggttaatggcggtgagagtttggtacaagtctccagcggtgcagcacctttgagcacgggagttattaatgagttcatccgagctttccccaatgttgattttatacagggaatgactgagtcaactgcagtaggaacacgtggattcaatactgaaaagtttctcaattattcttcaatagggttattggctccaaacatggaggcaaaagtggtagactggaatactggtgcatttttgcccccaggcagcagtggtgagctttggttgagagggccttcaattatgacaggatacctgaataacgaggaagctacaatgtcaacaattgataaagatgggttggctacatactggagatgttgtttgttttga

SEQ ID NO: 5184 - DNA, 1845 bp, Glycine max
  Peptide Sequence Number=SeqID_121962
atgagattgcatttcttggcctcacagtggaggcgtgtggaccaattcacagtagttgtcaggaatatccctcatatgtctggtcatacagtatcagatactgtggatagcttctttcaaacaaaccacccagaacattatattggacaccaggctgtctacaatgcaaacaaatttgctaaatttgcaaaaagaagagagagactccaaaattggctggactattaccagcttaagtttgagagacatcctgaccggaggccaactgtcaagactggaattttagggctttggggtgggaaagttgatgctattgagcactacaaacattcaattaaggaacttgataagatgatgacattggaacgccagaaaattataaaagatcccaaatctattttgccagttgcttttctttcattcaaatcccgatggggagcatcagtttgtgcgcaaacccaacaaagcaagaatcctacactctggctgactgattgggccccagagccacgtgatgtatattggcggaacttggccataccatttgtttctttaaacattcgaaagcttataatatcattgtctgtgtttgccttggtatttttctacatgattcccattgctattgtgcaatcccttgccaatttggagggtcttgaaagagttgctcctttcctcagaccagttatagaattgaaattcatcaagtcctttctacaaggttttcttcctggtttggcccttaaaatatttttgtacattctacctacagttctgatgatcatgtcaaaaattgagggatatattgcattgtcaacacttgagcggaagacagcaggaaaatattattattttatgctggtgaatgttttcttgggaagcatagtgactgggactgcatttcagcaactgcatgctttccttcaccagtcacctactcagattcctagaacgattggagtttccattccaatgaaagctaccttctttatgacatacataatggttgatggatgggctggaattgctagtgagattctcagattaaagccattggttatataccatctcaagaacatgttcttagttaaaaccgaaagagatagaggaaaggccatggaccctgggagtgtggactttccagagactattccaagtcttcaactatacttccttcttggaattgtgtatgctgtggtgacaccaatccttcttcccttcatagtagtcttctttgcctttgcatatttggtttaccgtcatcagataatcaatgtctacaaccaacagtatgaaagtgctgctgcattttggccacttgttcactgccgcatcatcgcaagcttgctaatatcccagcttcttctgttgggtcttcttagcaccaaaaaggcagctaaatctacacctttgcttgtcatattaccaatattgacgtttgcattccacaagttctgccagagacgttttgagccagcatttaggaagtaccctcttgaggaagcaatgtcaaaggatttattggagaaaagcacagaacctgacttgaacatagaggcttatttggctgatgcttacttgcatccaatcttcaggtcatttgaggtagaagaagaggaattggttgaagtcagagtagataaacaccaaactaatgtagctagctccccaccaactgagcctagttcaccctctccaccccatcacgtgcaacaacaaccatccccacctcatcatatacatgaaccctctctacctcaatatagtgagtatcaaacttcaccaccaggttattactaccaataccatcctccatctcctccccattatgtttatcagtactaa

SEQ ID NO: 5185 - DNA, 171 bp, Glycine max
  Peptide Sequence Number=SeqID_121963
atggaggtgcctcacgatgctcaagaatttgtagtgactccaatgaggtttgatgcaagaggtaatgtcactgaggaccagggagattacacagacatgacacttaaggacgaggaagaatatcacgagttgctacgagacttggagtcgtcattcgagaaggaggattga

SEQ ID NO: 5186 - DNA, 288 bp, Glycine max
  Peptide Sequence Number=SeqID_121964
atggcatatgatctgttacagattgctcctgccaatttagatgctgtgttaagtttacatcctgaaatagttgatgttgctgttacaggtgcaatggatgaagaaactggggagatgccagcagcattggtggtcaggaaggttggaagtgtgctgtctccaaagcgtattatggactttgttgctgagctggttaggaaggttttcttcactgacaagataccaaggtctgccactgggaagatcctacgaaagcagctgagcaattgctcgacttctaaactataa

SEQ ID NO: 5187 - DNA, 525 bp, Glycine max
  Peptide Sequence Number=SeqID_121965
atggttaggggaggaaggtttagcggcaaacgcaatttcaggaaaagggttcggtcaaaggagggaggttctgatgattcggatgaggactatgtggtttcagatgaaggtagagaggcatctgactattactgctcctccttagatggatgcgcatcagaggagggttttgatagttttatggaagaagaggaggagcaatttcgaagagtgaggagtatcaatagatccaagtcaaaaaagggcattgctggtcggcggaaaaatggcagtaaaagctcacacaggaggggaaggattacatatgcagaagaagaagacgtagaagaggaggaggaggaggaggaagagtttgaagacgaagaggaagaggacgaggacgaggaagaatacaaagaggaggaggaggaggaggaaagtaaaatctccccaaagaggggaaggaaaatacgtgcagaacaattggaagaagaggaggaggaggaagaagaggagaaacaggtggaggaagaggaggaggagaag

SEQ ID NO: 5188 - DNA, 144 bp, Glycine max
  Peptide Sequence Number=SeqID_121966
atgaaagaggtggcagttgaagctgaaggaggagcaccaggagtggtgcacgagggtggaaaagcaaccacgacgtgtggatacacttgtttggatgagggatcaaaacttgaagagaatgaaattgtaaggaataaaaattaa

SEQ ID NO: 5189 - DNA, 450 bp, Glycine max
  Peptide Sequence Number=SeqID_121967
atgcttcgtagcttgaccaaacttcgttgtttggccgttcaatcacgccaagttctatcacctccgtcttctcgccgtctccttcaccacttgccgccgccgcaatcgcttcactccgcttccaatttccgcatttctagtccttccttcattttctcgtggtgtcctccccacgcatctcagccttccccttctttggttcaagtgcgtcatgcttcgtccaaggagcgaaagcgaaagccagtgcctccaaccgtttccaaggttaagaaaaccaaaatgaaatcttattcgtctttcaagtccagattcagagcaatgaatgatgggaacatcagacgctggaaggagggaaagcgccacaatgctcatctcaaggttgaattcttttctttcttccacttctcatacggttttgtgattttttttattgtgaccctgtttcgataa

SEQ ID NO: 5190 - DNA, 1455 bp, Glycine max
  Peptide Sequence Number=SeqID_121968
atgaaaaccatcaaccattggatcaacggcaagaatgtcaccagcaaagagtatttcaccaccaccaacccggcgaacggcgaggtgctggcggaagtggcctccggcggccagctggagatagaccaggcggtggcggcggcgaaagaggcgtttcccaagtgggccaacacgccgatgaaagagcgcgcgcgcctgatgcgtcgcctgggcgagctgatcgaccagaacgtgccgcagatcgccgaactggaaaccgccgacaccggcctgccgatccaccagaccaaaaacgtgctgatcccgcgcgcctcgcacaacttcgagttcttcgccgaggtgtgccagcagatgaacggcaagacctacccggtggacgacaagatgctcaactacacgctggtgcagccggtgggggtatgcgcgctggtgtcgccgtggaacgtgccgttcatgaccgccacctggaaaaccgcgccttgcctggcgctgggcaacaccgcggtgctgaagatgtccgaactgtcgccgctgaccgccgatcgcctgggcgagctggcgctggaggccggcattccggccggggtgctgaacgtggtgcagggctacggcgccaccgccggcgacgcattggtgcgccataaagacgtgcgcgcggtctccttcaccggcggcaccgccaccggccgccgcatcatcgaaagcgccgggctgaagaaattctccatggagctgggcggcaagtcgccggtgctgatctttgaagacgccgacatcgagcgggcgctcgacgccgcgctgttcaccatcttctcgatcaacggcgaacgctgcaccgccggttcgcgcatcttcattcaggagagcatctacccggaattcgtcaaacgcttcgccgagcgcgccaaccgtctgcgcgtgggcgatccgcaagatcccaacacccaggtgggggcgctgatcagcccgcagcactgggaaaaagtctccggctatatccgcctcggggtggaagaaggggcgaccctgttggccggcggcccggacaaaccggccggtttgagccacggcaacttcctgcgcccgacggtgctggcggatgtcgacaaccggatgcgcgtggcgcaggaagagatcttcgggccggtggcctgcctgctgccgttcaagtcggaagaagacggcctgcgtatggccaacgacgtggaatacggcctggcgtcgtacatctggacgcaggatgtgagcaaggttctgcgcctggcccgcggcatcgaagcgggcatggttttcgtcaacacccaaaacgtacgcgatctgcgccaaccgttcggcggtgtgaaagcctccggcaccggccgcgaaggcggcgaatacagcttcgaagtgttcgccgaaatgaagaacgtgtgcatttccatgggcgaccacccgatcccgaaatggggcgtctaa

SEQ ID NO: 5191 - DNA, 606 bp, Glycine max
  Peptide Sequence Number=SeqID_121969
atggttagcacttggtctggcctcaaatgcaagacccctttcgaaggctccaactctccactaacagccatgacaaacacagatactcttcagcaactccaaaaccgcattacggagatggagcaatgccacgaggaggagccgagaaagctaaaggttgactacgatcaactggaggctcgtatcaaatgctcccaaggggaatcacatccccaatgcacagtcaacaatccaggtgacttaagtctctcccacaagcaccgtctagcagggcggactactcgtcggcattccttcatcgacaacattatgaaagttgacatactcttggggtggaaaccactcaacctcaagcggtatgatgggaccacaaatccatacgagcatttggatgccttcttgactcaggcgaatttatacactaatgacaacacgattttatgtcgtgtcttcccaacgtccctcaagggagcgacattgacctggtatggtggactcccacctagatccatagaaaactttgacaccctcgtcgaatgcttcagtgtgcagtacgcaactagcagatctcatcgcatgaccttagccgccttggccagtctgtga

SEQ ID NO: 5192 - DNA, 249 bp, Glycine max
  Peptide Sequence Number=SeqID_121970
atgacacttatcaacaagcgccaacctcttccaaaagggcccaggtacgagcgttacacacccctgacggccaatcataccacaattctggaggaagctttcaacttggaggtacccatcaggctacccccaatgaaacctcctaggccggtgttatatgcgaccaaatactacaggtttcatcacggtattggtcataacacaaaacactactgggccgtaaaagacaagatagaagagcttatacag

SEQ ID NO: 5193 - DNA, 372 bp, Glycine max
  Peptide Sequence Number=SeqID_121971
atgctccaaccatatgagatcagtataggcttaaaggagcactcaaacccggtgacccccaaggcctacactccgaagagtccgtcagggcctctccctcctgattcagacagctctgggtttctgcgggaaagaaaaaggctacaatgcgaaggatttttctctcatttcagacatgatatcgaaattcccaacggtgagaatgctcggaattgtgttgcgaacatgatactcaaatttcacgacgatccaacggtgaacgggttcgagatcgtcgtttttctgagactggtttggtgggctgcgggaaaaagaaagggttttgagaggagaaggggaaaaacgaaaatgaggccaaaaggaggcagctga

SEQ ID NO: 5194 - DNA, 348 bp, Glycine max
  Peptide Sequence Number=SeqID_121972
atggacggtgattcctcttggagtgctcgactctcttccgcttccaggcgctaccaatccgctcttcaatctcgatcagacatgttcatgggttttgatgaaaatgatggggacgatgatataagagaggagtttctctgcccattttgttctgagtattttgatatcgttggattatgctgccacattgatgaagagcatccaatggaggcaaaaaatggggttgaatcattcgggtattatccgagttcgatccttggcagaaacaattcttggtcggactttacttacctctggacgaactccggattagtcagaacctctttccctgaaaaaccggagggttaa

SEQ ID NO: 5195 - DNA, 798 bp, Glycine max
  Peptide Sequence Number=SeqID_121973
atggagggtggaggaagagaaggttacaatggaattgtgatgacgatgacacgagacccaaagccgaggctacggtggacggcagatcttcatgaccgctttgtggatgcagtcaaaaagcttggtggccctgataaggcgactcccaagtctgttctgaggttaatgggcttgaaagggctgacactatatcatttgaagagccatttacagaagtatagacttggacagcaagctcggaaacaaaatgaggatatgcacaaagaaaatagtagatgttcgtatgtaaattttagcaatcgttcttcagcacctaacaccagttacagaggtgatgatgaagggggagaaatcccaatagcagaagcaatgaggtgtcagattgaagttcaaaagagattggaagagcagctagaggtacagaagaaattgcagatgagaatagaggcacaagggaagtatttgcaagccatgttagagaaagcacagagaagcctttccctggatgggccaggcagtcttgaagcatcaagagctcagttgactgaattcaactctgttttgtcaaatttcatggaaaatatgaaaaaagatagcaaagaaaacataatagaagtgagtgatttttatagtaagaaccacgactcagctttccattatcaggaagtagggagagaccaaaagcccaaggttgaagggggttcaattcaatttgacttaaacatcaaaggtagcaatgaccttgtatgtgcaggtggagctgaaatggatgccaatatgatttcatatagggtataa

SEQ ID NO: 5196 - DNA, 2304 bp, Glycine max
  Peptide Sequence Number=SeqID_121974
cgatgtattccttaagttcaaacaatggaagtcactagtggaaaaacagacggagaaaaaggtcaaacgacttaggacagacaatggattggaattttgcaataatgagttcaatgagttttgcgcaaatgaaggaatagcacgtcatagaactatgagacatacaccacaacaaaatggcgtggcagaacggatgaacaggacattacttgagagtgctcgatgcatgctctcaaatgtaggtttgccaaaacagttttgggcagttaatactgcatgttatttggtaaacatatctccttctacagctattgattgtaagactccagaagagatgtggtcaggctctacaacaaattattcaattctgcgtgtatttgggtgtccagcttatgctcatattaatgaaggaaagttggagccaagagccaagaaatgtatattattgggttatcaagatggtgtaaaaggatacaggctgtgggacccaaagaaatctaagctcttaattagtagagacgtgacctttgatgagacaactatgcttaacccaagaccacataaagaccatgataataaagttgaagttcatggtgatatcaagaaggtggagtttgaagttgaagcacggaaaccagaggagatctatgatgaatctgaagtgacacctacagaatttgaacatacattggctagtgataggccaaggaggcaaactaggccacctcagaggtatgatgactttgttgctttcgcactcaacatggccgaaagcatcgatgatgaacaagaaccaagttcattccacgaagcagttacttgtgatgaagcatcacagtggattggtgccatgaaagaagagcttgaatccctccacaagaatcatacttggaagcttgttgagaaaccagttgatcagaagattgtgggttgcaagtggatatacaagaagaaagatgggataaggttcaaagcaaggcttgtagcaaaaggctttacacaaaggaaaggtattgactttaatgaagttttttcccctgtggtaaagcatagttccattagagtgcttcttgctttagtgtctttgcttgacttggagttggagcaattagatgtgaagacggcttttctccatggtgatttggaagaaacaatttatatgcaacaaccagatgggttcgttgttccaggaaaagaagaccatgtgtgtcttcttaagaagtcattgtatggattgaagcagtcacctagacaatggtacaaacgttttgactcatttatgattgatattgggtacataagaagtgaatatgatagttgtgtttatcaaaagaaactatttgacaacacatatatttacttgcttctttatgttgatgacatgctaattgcatgtaagcacccaaatgagatcaataaggtgaaaacacaattaagtggtgaatttgagatgaaagatttgggtccagctaaaagaatccttggtatggagattacacgagatcgaaaaattggaaggttgtgtttatctcaaaagagctatgttgagaaagttctagagagatttggaatgcacaatgcaaaagcagttagtacaccttttgcggcccattttaagttatctgcaaatatgtcaccacaaacaaaagaggaggaagagttcatgtctcgagtcccttactcaaatgcagttgggagtctgatgtatgctatggtttgtaccagaccagatatagcacatgcagtgagtgtcgttagtcgttatatggctaatccaggaaagtctcactggcaagcagtaaaatggattctcagatatttaaggggttcaactaatctgggtctagtgtttagcaaagcaacaaatgaatgcaatggtcatgtcattggatattgtgactcggattatgctggtgatcttgatcgtagaaggtccttgagtggttatatttttacgcttggaggtagtgctataagttggcgtgcgactctacagtccactgttgccttgtcgactacagaagcagaatatatggcagctactgaagcggtgaaagaagctttatggcttaaaggtcttgttggtgatcttggtgtaagtaaaaaggaagttgttgtgcattatgatcgtcaaagcgcaattcacttaaccaaaaaccaaatgtaccacgaaaggataaagcacatagatataaggatgcattttattcgtgatgtggtaacacaaggtgatgtgttaatagaaaagatttctacttcagataatcctgctgatatgatgacaaaagctcttccaacattaaa

SEQ ID NO: 5197 - DNA, 338 bp, Glycine max
  Peptide Sequence Number=SeqID_121975
tccgggctgcgggcgtagcggaaaaatttgtgggtatagccgccgttgccggtgtcggtattccagcacaggcgatcctggctggccggatcgtgcagcgcgtcatacagctggccgacagacgccgccgcgttgcggaacgccgggtgggtggtgacgtctttcacgcgctcgccgtaaatgtagatttcgcggctgtcctgcaaacttttcagctgccaaagccggtttcgagaagagacttttgcggcaatcgccggtacttttcaggtcagtttgccgctttcgcggcaaactgtgatcgcggttacgaaagggcgtgttgcgccgcgcggtag

SEQ ID NO: 5198 - DNA, 656 bp, Glycine max
  Peptide Sequence Number=SeqID_121976
gtgcactggcacgactgcttcttccaggtgcatttcctggaaaccggcaagatagagctgcagctcgacgatcagcactattcggtgcaggcgccgctgttcatccttacgccgccgtcggtgccgcatgcgttcttcaccgaaccggacagcgacggccatgtgctgacggtgcgccaggagctgatttggccgctgctggagcgcctgtatcccggcagcaacctggcgctggacatgccgggcatctgcctgtcgctggccgatgcgccgcaggagctgacggcgctcagccactactgggcgctgatccgccgcgagttcggccagaacctggccgggcgcgaacagacgctggcgctgctggcgcaggcggtgttcacgctgctgctgcgcaacaccgcgctggaagacaacgccaacagcggcgtgcgcggcgaactgcagctgtttcagcggttcaacaagatggtggacgagcgttttcgcgagcacctgccggtgccggagtatgcgcaggcgctgggagtgaccgaatcgcggctcaacgatctgtgccggcgcttcgccaaccggccgcccaagcggctgatcttcgatcggctgctgcgcgaggccaaacgcatgctgctgttcagcgcctgcacggtgcatga

SEQ ID NO: 5199 - DNA, 366 bp, Glycine max
  Peptide Sequence Number=SeqID_121977
atgggaaagagcaaggttcttgttgtgggtggaactgggtatgttgggaggagaatagtgaaggcaagtttagaacaaggccatgaaacctatgttcttcaacgtccagagattggtcttgacattgagaaggtgcagatgctgctttcattcaagaagcaaggtgctcaccttgtggaggcttctgtttctgatcaccagagcttagtggaagcagtgaagcttgtggatgttgtgatttgcaccatgtctggtgttcattttcgctctcacaacttgttggtgcagctcaaacttgtggaggccatcaaggctgcagggaacgttaagcattattcaatctttttaagtaaaaaattgaggtag

SEQ ID NO: 5200 - DNA, 237 bp, Glycine max
  Peptide Sequence Number=SeqID_121978
atgaagaacgaagaacggatgaagaacgaacaaagaatgaccgaagaacgaacaacgaacggtgtaggaatcgatcacagatgcaattcggaagcgtttcaacttgttttctcttctttcttcttcctttctcttctttcttcttcttcctggaccattggacctcaaggaacctcagggaccctttacttcagccttcccacgcctatttatagcaaaacaaagcatttaggctga

SEQ ID NO: 5201 - DNA, 282 bp, Glycine max
  Peptide Sequence Number=SeqID_121979
atggcttattccctagtggatggtgcctcctctcacctcttctcctttgtcttccactgcatctccatggtagaaaatcaccatttgagaacctcattgaagctcaaagatccagcctccatagaagccccacaagcaagcttccatcagaaaccatctttgaaggcaacatcatggaaagtcttcgctttcaacgacgagagcaacataagcctcaccatcccaaaaggatttgactttggcttccttactgaaacttttgcatttgaaacaaagagctag

SEQ ID NO: 5202 - DNA, 474 bp, Glycine max
  Peptide Sequence Number=SeqID_121980
atggctaagtatgaccctgagttactcatggagttctatgaaaattcctggcccactaaagaaggagtcatggataagcgctcatgggtgcggggccaatggatcccctatgatgaagatgctacccaccaattcatggggcatccattgattagtgttcatgtagcacagcttatcttggaagccatctatcagtttgtaggtatttcacctccaagacactcagtggacccagaaaagtcgaaaaaggcactaggatttccagcattgatcacgggtctctgccagttctatgggcttctattagtatacactgcaccaacagcgccaggaccccaacccttaccctggcctcttgagcagttcagagccactattgcatggcctagggacaggcctaattttcaagcggggcaggtcccactgaggccccaggagatgaagacgaagctgagtaagacggagacatggtag

SEQ ID NO: 5203 - DNA, 372 bp, Glycine max
  Peptide Sequence Number=SeqID_121981
atggaaaatattgtgcgtatcactgatctttggcaagctcgaaagcaaaatagtaaacaaacaattgagatggtgttgatggaccaaacgggttcaaaaattggagctactctctggcaagaactcttcattgaattgcgggacaagttacagtgtggttcttcgtatttgattcaaaacctgaggattgttgacaaccaatctgaatacagagtcagcccagctccatatttggtttatttcctaaaaactacatctgtcaaggaaatccaccgtccagaaattccttctaatgtttatctcataactccttttactgatataatctctggcctcgtaccacgccatactttagtgggtcagtttgtttag

SEQ ID NO: 5204 - DNA, 2013 bp, Glycine max
  Peptide Sequence Number=SeqID_121982
atgaacaataatgaagaactcgatggcattcagaattgtgacaatgatgacattgaaaaagctggacttgaggagctagaggagcaaagtggagtagcatcatggacaaggcaaatcacaattcgaggactaataactagcttcatcattggtatcgtctatagtgtgattgtgatgaagctgaacctctcaacagggcttgttccgaatcttaatgtttcagcagctctccttggctttgtgctagttcgagcttggatcatgcttcttgagaaagctaatgttgtgtcaaaacctttcactagacaggagaataccataattcagacttgtgccgttgcatgctatagcactgcttttggaggtggttttgggtcacacctcttgggtttgaataggaagacatatgagcaagcaggggttgatacaaaggggaatactcctatcaccaaggagcccggcattggctggatgacagcctttctctttgtgacatactttgtcgggttatcagcattgattccccttaggaagatgatgatcatagactacaaattgacttatccaactggaactgctacagctgttcttattaatgggttccatactcctaaaggagatgagatggccaagaagcaggtccatggtttcttgaaattcttctcattcagtttcctttggtctttcttccaatggttctatgctggtgatggagatcaatgtggattctctcagtttcctacttttggattgaaagcgtggaaaaactcattttactttgacttcagcatgaattatgttggagcaggaatgatttgttcccatcttgtcaacttatccttgcttcttggtgccgtgctctcttggggtgttatgtggccattgatcagaggactaaaaggacaatggttccctgagagtttatcagaaagtagtatgaagagtcttaatggttataaggtttttatttccattgccttaatccttggagatgggctctacaattttgccaaaattttgctttttactgctacaaatatccatgccagcatggaaaggaggaatcataaatcactttcaatttcagatatccagaagcagcagcagcctcttgatcttaaacgcaatgaagtgtttgtaagagaaagaattcctatatggttagcatttacaggatacatactgttctctgccatttctatcataattatccctttgattttccctgaagtgaagtggtattatgtggtggttgcttatctgcttgcaccaactcttagcttctgcaacgcttacagtgctggcttgaccgacatgaacatggcctataactatgggaaagtggctctctttgtgctagctgccttaggcgggaaaagccatggcgtggtggccggacttgtagggtgtggcgtgatcaaatctcttgtttccacctcatccgacttgatgcaagatttcaagaccggccacctcaccttcgcttcccctcggtcgatgcttctttcgcaagctatcggaacagcaataggttgtgtccttgcacctctcacattcttccttttctataaggcttttgatgtagggaatccagatggtgattacaaagctccatatgccatcatttatagaaacatggcgattctaggtgtggaaggcttttctgcactccctcaccattgcttgcagctctgttgtgggttctttgcatttgctgtagcaaccaacttggtgagagatttgaaccctaaaaacattggtagatggattccacttccaatggcaatggctgtaccctttgtagttggtggatactttgcaattgacatgtgtatgggtagtttagttgtgtatgcatggcaaacacttaaaagcaaggaggcaagtttgatggtaccagcagcggcttctggtttgatttgtggagatggattttggattctcccttcatctattcttgctttgtttaaggttcatcccccaatctgtatgagattcttgccaaccaagtag

SEQ ID NO: 5205 - DNA, 474 bp, Glycine max
  Peptide Sequence Number=SeqID_121983
atggcaccctggtttcgacaaattgccccctttggggcacttttaaaaactttttccccatatggggttatttgcaaacattttccgccagggggctgttttgcacgtaaattacatgcaagcccaaagcaaaccgccagtcaaactggcgagttcactgacagtgaagaagctgccatccccattggcgatttcgccatgcatgggggaaccgccagtcagactggcgagttcgtggcaggagaaggcagagggccaggctacgttgtagggctacgtcacaggggtgcaagtgaacgttgcagggatgcaagaatcgtcattggtgctggcgggttgcaggaagaactcgccagtttgattggcgagttgaagttcacaaaaatttttataaagcgcaacgcgaggctcccatatgcatgcattcctttcttctgtttgtatctccttcactgcattcgtttcttctcttga

SEQ ID NO: 5206 - DNA, 666 bp, Glycine max
  Peptide Sequence Number=SeqID_121984
atggcggttagtggtggtggaggaggaggttggggtgttgggggagggtttaggggaatagatgaaggtgtctcccgcacctccaccggaggtccagtgttgccattgaaccctctctctaatgtctgtccgctgccattgtgtgccattgtcatcgtgtggaagcgtcaagactcttggcgaagtagtagcagtaggccaaggtggcatcgttctcgacctccactcctcctctgtcctccgttctccaatggctccccatctgaggcaccaccgaagcaaaaggctcaagcattggacaagttgaatgaatcattgccgacatctgaatcaatgtcgaccacttcctcaaagcattcttcatcatggcagcccagcctcaccaaggcaacaagcctctctatgtcttcttcaaagatgatgcattcagtcttctgtatctttaagacctttgatcgcttggaccagctagtgcttatgctgttgacaagaccagatggtaagcttggagaccttgaacagaggacttttcaagtccttgttagattgagggatgaaggagatgaggccaaagaggcccttgaagaagtactttctcaaaattcttcaaagcagtatgactcatactttgctaatacacgtgaatctgttttccagctcatttaa

SEQ ID NO: 5207 - DNA, 360 bp, Glycine max
  Peptide Sequence Number=SeqID_121985
atgaaaagggtggctctgtcttctctcttcgtctatggttttttcgaagtgatcgttgtgttgaacggcttacttgtgacaaaagatcttaacggaactagtgacggttgggttcttgtggtgagctattgggtgttcattgtgtcgcaatcttatttcgttgcggtgtttatggtttctaaaattgcgttcaatacggtcttgtacgcatattgcaagcctaatcatggagaagttattgtggaggagtttgagaaggaaggtcttattggcttgcccttccatgacgatggaaaggtgaaaataattcttcacattaagctaaatctccttgatttctcggctacagaagttcggtaa

SEQ ID NO: 5208 - DNA, 453 bp, Glycine max
  Peptide Sequence Number=SeqID_121986
atgacgttgctacttagcaacattctgcccagtgaccacaatgccgatctccccctgcggaagtatcagttgggatcgcgcccacaagacacccagtggacccggaggaacccaacagggccctggggtttccagctctggttattggcctctgtcagtcctacatggtgccctcccccccagcaagggattgcgcctgcaagacaaccagtggacccagagaagtccaacagggggcagggcgagacaccacagcagcctggggatggctggcagcgagcaacagatgcaccgccaccacctccaaagtccatcagctcatttacaaaggctggagcgttgcctatgacccatggccgaccaagtccaaagccaaaggtaagcaaaagtactaggtccgcgatcgaaaagtcatcacgcgtccagctcaagacgttaaagaagcgctactag

SEQ ID NO: 5209 - DNA, 166 bp, Glycine max
  Peptide Sequence Number=SeqID_121987
tgctttaaaaggtcttgatgatgctccacatcctaaatcaaaggctcctactaggtggattgtcgtcaagtattttaacgatcctagaccattggagccaaagagattaaaggcacttcggatccagtggacacagtattatctccaagttagagctcagagctag

SEQ ID NO: 5210 - DNA, 585 bp, Glycine max
  Peptide Sequence Number=SeqID_121988
atggataagcgttcttgggtgaggggccaatggatcccatatgatgtctctgctatcaaccaattcctagggcatccattgatcttagaagagagccaaagttatgaatacgctgaaagaaggagccaagtcttaggttttgatgaagaggccataggccagctactatgctccccgggacatgattttgcatggagcgtagcgaggaggcaggtgtggatcatgcgcactagcatgaccactttgactcagatctggatgacgcttctgctcagcaacatccttcctaatgactataattctgatcttccgcttcctaaatgccaattgttcgacgctatcttgacccagaccagtgttcatgtagcacgacttatctcagatgccatctaccagtttataggtattgcacctctgagacacccagtggacccagagaagtccaataagggattgggattttcagcattgatcacaggcctctaccagttctacggggtaccgatcacaccgacaaagctcattcgacccctcattaataggtccttcattgagaagtattgcatgcaaaggcaggcagagtag

SEQ ID NO: 5211 - DNA, 438 bp, Glycine max
  Peptide Sequence Number=SeqID_121989
atggcacccagaatccgaaaaacggcaacatgttctgtatcgaaagatggtaatgatgcctctgttgggactgatgtacctttccctgctgattactctgagcttctggaacacgcaagagtagctgcagatttggctataaaggataacagacagctaatggagattgagtttcccactgctggactcaggtctgtgccagaggctagtgaagttgactttgccagacaatcagtctttagcagatgttcttttaagttggactatctgacaaagtcttcgttttttgaagattttggctttgttgagaaagtaaaaatgtcagacagggtgaagacaggagatgaactttttttggttggctacccatattttaatgtcaatgaaatacttgttgtggaagaactttataaagaggctgtcttgaacactgaatga

SEQ ID NO: 5212 - DNA, 180 bp, Glycine max
  Peptide Sequence Number=SeqID_121990
atgggtggggtggggtgtggaataaacttctccataagcacttcttgggaaaaaatgagaaggtcttttctgacttggagcgttcagtgtgtagaatggtccatcgacagggatttattgcatccgcccttaattatggactcattacatggtgacgaaggtttcagcattgctttatga

SEQ ID NO: 5213 - DNA, 1416 bp, Glycine max
  Peptide Sequence Number=SeqID_121991
atgtgtagagaacctcgttgcaccagctggttttgtgttgctgactctgcctttcaatatgaggtatctgatgactcagttcaagctgattggcgccagacatttgctgatgcatcgggaacctatcatcactttgagtgggctgtggggacaactgaaggaaaatctgacattttggaatttgaaaatgttggattgaatggatgtgttcgagccagtggcctggatcttggtggcttgagtgcatgttttgttaccctccgagcttggagattagatggacgctgtactgaacttactgttaaagctcattccttgaagggtcaacaaaggttctttgagcatgctgaagaggccgaggaagaagaggatgatgattcagttgacaaggatgggaatgagcttgatggagaatgctcccgtccccaaaagcatgcaaaaagccctgaacttgctcgagaatttcttctagatgctgccactattattttcaaagaacaggcatgtttagcactagttgaaaaggctttcagagaaggaacagcacgtcaaaatgcacacagcatatttgtttgtcttgcactaaaactgctggaggatcgagtgcacgtggcatgcaaagaaatcattaccttggaaaagcagatgaagcttcttgaagaagaagaaaaggaaaaacgtgaagaagaagaacgcaaggagcggagaaggacaaaggaacgggagaaaaagcttagaaggaaggaaagactaaaaggaaaagaaaaagaaaagaagtgttctgaatcaaatgatgctcttggttctcctgaaatctcaaagaaagaattgtctgcagttgctgatatggagcaaaatactcctattagctgcagtaatttagttattgaaacagatgaaactaatctattgagggatgattctcctaacatcgaagatgaagaattctctagtgagtgtagtactttgaaaccacaagacctctcttatgatgattgtgaggaagaaatttcaaatgcagaagatgagatgggtcagtctacaattgaacaatcaatgttttctcatcgaaaactaagatgtaggaaagaatttcaacttgatatgcctatgaagtggtctgacagacgacgatatgcagttgtttcagaaaatagtgtgatggtttgcagatctgagccaagacattatggagagagttttgtgacatcatccagggtaatgaatgggttgaataggaaatcaagaataaatttcccaacaaaatccaattgtcgaaatgttggtccagttcatcacagaaaactgaatctaactgaactagaaaacagttctctacagggtagtaaaggaacattgtccattactgacaacagcggaatatttgaaatctgtgaatggaatccagtgaactag

SEQ ID NO: 5214 - DNA, 213 bp, Glycine max
  Peptide Sequence Number=SeqID_121992
atggcgggaccatttgcgcaacacccaggacagaacttcttgcagcactcattctgtagtacctatcttgctatcaaatcacagagatgcttcaatgccaataagatacaggatggcgccattttcttttgctggagttggctgaggaaccttgagaaaggattcgacaatccttttcatcaatggtcgccatatcagagtagggttctgtaa

SEQ ID NO: 5215 - DNA, 747 bp, Glycine max
  Peptide Sequence Number=SeqID_121993
atgtctactggagaaatctcccgatcaaatgtatatgctgaacaccaagggggtgggggtgggggaggggaaaactgttctatacttctagccgtttctgtcaaactcatggtttatgttttgttgttttacaacaagaaagaaaagaaccatcgaattatgatggcagcatttaacatccaagaggctctaatttggaaggaaaaaattgagtatgtcattgatcagcatcagggagcacaaccatcaaatggcaacaaatatatttcttttgagtacaaatctgggatggacaatgggaaaacagcttcttcctcagaccgtgaaagccagttcagtgctcaggaggatgaagatgaacctcatccaaatttgttaaggaggaccacaattggaaatggtctactttgtatccctacatcttgtgggcttgcaattactctgctacagtctatatttaaacctttcctttcttgtgatgcaggtcctccggaatcagtttttgactggacacgggaaatagactcagatttgtcaaatcagaatatcaataaccaagcattctcaagaaagcattggcgtcttttacaatgtcaagatggacttcgtatttttgaagaacttggtgaagttgattaccttccaagaagctttagtaaagctatgaaggcagtaggtgtcgtggaggcaacttgtgaagagatttttgaacttgtgatgagcatggatgggacacggtttgagtag

SEQ ID NO: 5216 - DNA, 294 bp, Glycine max
  Peptide Sequence Number=SeqID_121994
atggctcggatgatccgcgtggtggatgaagagagggtcgtgaagatcaagcggaagagaagaagtagcagccatgaaagagatggaaatggcggaaatttgatcgtcatcttgccttcatgtccttctcctttgagacctttgttgttagctgatgccctcaatgttgctactttgaagccttggccacctctgaagtcttatcaaggtacagcagaatggtgtttgcacggaagcatagttcctacttctttacctgcagatttcgaatgtttcaaggttggcacgagttaa

SEQ ID NO: 5217 - DNA, 525 bp, Glycine max
  Peptide Sequence Number=SeqID_121995
atgatttcggctaaaaaacttaaaaaccaatctaattaccatgagaaattagaaggtgctctttgtttgcttgctgcctcagcattcactgcagagtaccttcttttctacttccattcaacaacacacaagggccttgagggctattaccacaccctccttgtcttcgtggttggactctgcattttatcttcaattgctggtgcccttttgccaacaagctttccagtggatttatgcaatggcattgctatagcactgcaaggcttatggttctatcagactgcgtttgttctctatggccctatgatgccaagtggttgtaagcttagggaaaacagtgtcatgtgtcattctattgatagcgaggttcggggcgaattgcttgctaacattcagctctttgttgctgtccttgtggtccttgtgggaactgtggcatcatatggctttgctgcttcaagatatgggaattctgaagttaagaacttgcatgcaattcaggctgaattagatcaagactga

SEQ ID NO: 5218 - DNA, 657 bp, Glycine max
  Peptide Sequence Number=SeqID_121996
atggattcttttaaacaaatctggggtagtgcagaaggatgtagcagtagtgaatctggttggactatgtatattgcctctcccatgcaggaagacgatgctggatgcagcaatgaaaatgatggatatcatgacaacaacatctatggtgagaacaggagaaagaagcaaggggcccaagtggatgaagaagaaagcgatgattcgatggcttcggatgcttcctccggtccagttcattaccaccatgcctatactcacaggcaaagtagtcatggcaccgcagcctctaagaaagataaacaagatcatggaagcaaattttcttctaagaagaatgcaaacaaacaggagaagaaacgtgttgacagcagaattgaaatttctcttgttgattactatgcaaaaagttgtattgagctggttgacagaagaaacaagaaacatgacacaagaaaagtggccaaggggcagttagagattgaggataacattagcacaaagggagaaagtttctcaatcattgagttcattatggacactgaagacttgaaagaaaatgtcagaaaagccaagaagctcaacatcaacatagaagaaaagataatgtcaaagaaagaaaaatatgggttcacagaagttacttctaaccactag

SEQ ID NO: 5219 - DNA, 318 bp, Glycine max
  Peptide Sequence Number=SeqID_121997
atggactggattgaagcacagcttgatgatgaatccatattcccacagaagcttggttcaccatttcctcccaactttaaggaagttgtgaagacaatattcaagcggttgttccgtgtatatgctcacatataccattctcactttcagaaaattgtgagcctcaaagaagaggcgcacttaaacacttgcttcaagcattttatactcttcacctgtattttgtttgaaacttttgttatgcaggagttcgggctgattgacaaaaaggagcttgcgccccttcaagagcttatagaaaccattatcccatattaa

SEQ ID NO: 5220 - DNA, 273 bp, Glycine max
  Peptide Sequence Number=SeqID_121998
atgcttgttctgaagaagttacttatcagcagtaaagaaatcattattatgggagctcaacttagaaaacatattgatgccacgttgggtagtggaaatctgagggaagcagtaaagctacctcctggggaggatttaaatgagtggctagctgtcaacactgttgatttcttcaaccaggtgaatctgctttatggtacccttacagagttctgtactcctgagaattgtcggacgatgtccgcaggacccaagtatggcatatttaactga

SEQ ID NO: 5221 - DNA, 813 bp, Glycine max
  Peptide Sequence Number=SeqID_121999
atggtggctaagagtgttagggctccagtggtggccaccactaccgaggcagggacatctgagaaggctgcttctcggcctaagaggctcccaatgttgaaggagaggtgtctgcttcctttcatcatgtttccagagtatatgcgggttgacaaagaggtaggcacctacttctcccgctacaaccacaaatcgtacttcaccaacctcattagttggctaccaatcaacaccataacggacttggagacgtatctggtcactgtccacacaattcagttagacgccacaccgctcgcagagtttcgtgttcatgaaccgagggggatgaacaaggacttctttcacatgtatgattgcctatttcttgatctgcatgtgagggtcccatttgatgattttattaagggtgtcctccagatacttaatgttgctccgacacaactacatatgaataggtggacaatcatgaaggcgttccaagcactttgcttgttactttccgagaaggaccatttctacgatttggtagggaaccatttgttccccttctactggcagcagtgtcctcaacgatatgacaagtacccaaacaagcatctaagtgttgacgaaagtcgagacctcgaattcctcgagtcgctccctcgacaacttcctgctaggcgaaaccgaatcgctactactggtggtcaatcgcctcatgctaccactaaccagacatcgaggccccgcgaggttccaactgatatagttccccctgttggcaaggacccaagggggaaacataagcataagaagcggagccactag

SEQ ID NO: 5222 - DNA, 138 bp, Glycine max
  Peptide Sequence Number=SeqID_122000
atggaaacttgtttgcactcacctgcctataccgaagaggctcatggctgggatatcgaaattacaaaatcacccttccttctacttctaatcactcctctcggtcccttccgtccttgcggcatgactctcccataa

SEQ ID NO: 5223 - DNA, 756 bp, Glycine max
  Peptide Sequence Number=SeqID_122001
atggaacaatccactaaccaccataacgaggacgttcacatagaggatcaaactcacctatcttcaatagttaggagactacaagctcaggctaacccgtcggaaggacgggaggctgaatcaactacagtcggtttaccgagagccattaatctaagtgtgtgtttggacattattccctcgtcctttaacactttgggaagaaagttgtcacagttcaagaaccgcttcatccctagcatcatggaggcaacccttccttccaactggaagaatttgaatattgagaagtatgatggcaccacagactcggacgagcacctagatgtgtacattacccaaatgaatgagttgatcgaataccaaaaccaggtgcgggccaatgtcgtgtcaactaagaaagataatgatagacccagctccaacaaggcccgtgatgaagggaggagggatcagccactgcgggagtcgtgctttacccaatacattcttgttaccactagcagatcccgtatcatggatcaggccttggctgtcaacattttgaccatgcccaaaagaactaacaccccaccaaaagccgactactctaaacgttgccggagtttgttcataacccgcaattgtacaggcctgaggggaggaataggcctaagtccagctaggggagagatcaagaacatgcagattggtcagaaaggtgaaggagctggagccgctcttgggagagagaagaaagacccttcgaccaagtga

SEQ ID NO: 5224 - DNA, 510 bp, Glycine max
  Peptide Sequence Number=SeqID_122002
atgggaactggtcacagttctcataataacctaagaagcgattgtacttctttcgatgtcacccacgatggtgccaaagcaagatggagaaactcactagaggtttccatgggcaactggagaaaaggcaacacagaattttggggtgtggaatacaaaaccaatcagaaaaaacgggaaaagtgtagtcattttgaattttggggtgtggaatatgatgatgttggtctttatgttgtggccaaaattcgacacaaaatgggtcacggttttgttgttgaagtggatggtcctttcaaacgctcagtggtttatcttgatgaggttattagcctaacctttcacaccggtgtgtggtcacctaatgcgttttctcactctaatggagcaaatcgcagccatggcgaagaaacaagaggtcaaattgtcaatactttcttacagaaaaataacggggagcaatacaatacagtcttctcaattcaagtggatgcactactggttatctaa

SEQ ID NO: 5225 - DNA, 1092 bp, Glycine max
  Peptide Sequence Number=SeqID_122003
atgagcgttcctccgccgtctacggcggcgatgtggacgccgttcacggcagcgcagtggcacgagctggagcaccaggccctcatcttcaagtacctcaaggcgggtctctcggttccccctgacctccttctccccattcgcaagagcctccaattgatatcgtctcacccatcgatggggtattatgggaagaagatagaccctgaaccgggtcggtgcaggagaaccgatgggaaaaagtggaggtgttcgagggatgcacaccctgactccaagtactgcgaccgccatatgatacgacgtcgttaccgttcaagaaagcctgtggaatcatctcaaactcactcttcttcttctgcttctgctgcttcttcaaattcaaaccctgttgctgctggtggtggtggtggttctgttgctaatgtttctgcaactgctgcaaaaaaccttcacacacttcccttgcacatcaatggcgcaagggaaggtttcactttcacccttgggaacaacaccagcaccaacaccaacaccaacaccaacaccctccctcaccttcacatgaaccccctcactctttcagctgacaataccaagaaaacttacagcaaacatggtagctgtgatgttaagttacctaacatgtggatcattatgatgtgtggggtgagggtgagattctgggagtttggactgaactcagaagcagatgagcacaacgtcttacagaaagatctgggaagtgtgaggtatcaaggttatgactttacctcagatgccatgtggtctcaaatgtctcacattccatcaaatactgtttcggaatcgagaatcggttctactatgctgggcaactgcttccagcatcaaacaatgcgagatgctgagctgttgaatctggaaacggcgaggaccaaagaccttgtctttagtggccagctaagttctgcagggggtatgaaacaggaatatcagtctccccagtctctcttcagtgactgggactggaagaaggatttaagttcctctgcccttgagtataggcccaacaaggattttaactgcaacccagatgtcaatgttgattaa

SEQ ID NO: 5226 - DNA, 210 bp, Glycine max
  Peptide Sequence Number=SeqID_122004
atggagatcgtcgggaagatgcgaagggtgcaacagagtggaagaagcaattgggaggtgggggtttgctacccgattaacaataaattgggattgggtattttgctcttttcatctaatgttgggggtttaaatagaagtaggggtgtgactagtagttctcttagctatgtctatcggattgggcccatcagatcaacctccaattaa

SEQ ID NO: 5227 - DNA, 2994 bp, Glycine max
  Peptide Sequence Number=SeqID_122005
atgaactatgcattcaaggtgtttgacagaatgcctcatagggacgtaatctcttggaatactatgatatttgggtatgctgagattggaaacatggggtttgcacaatctttgtttgacacaatgcctgagagagatgtggtttcatggaattctttgctctcttgttatttacataacggtgttaatcgaaagtcaattgaaatttttgtcaggatgagatcactaaaaatcccgcatgactatgctacattttctgttgttctgaaagcttgttcgggtattgaagactatggtttagggcttcaggtgcattgccttgcaattcagatgggttttgagaatgatgtggtgacaggtagtgctctagtagatatgtactcaaaatgtaagaaactagatggtgcttttaggattttccgtgaaatgcctgagagaaatttggtatgctggagtgctgtaattgcaggctatgttcagaatgaccggtttattgagggattaaaattgtttaaggatatgctgaaagtaggtatgggggtgagtcaatctacctatgctagtgtattcaggtcttgtgcaggattatctgcatttaaattgggcacacagttgcatggtcatgctctaaagtctgattttgcatatgacagtataattggaactgccacattggacatgtatgcaaaatgtgacagaatgtctgatgcctggaaggtatttaacacattgcctaacccccctcggcaatcatataatgccattattgttggatatgctcggcaagatcaaggtcttaaagctttagagatttttcagtctttacagaggacttatcttagctttgacgaaattagtttgtctggtgctttgactgcttgttcagtgatcaaaggccatttggaggggatccagttacatggattggcagtcaaatgtggtttagggtttaatatttgtgttgcgaatacaattttagacatgtatggcaaatgtggagctctggtggaagcttgtacaatatttgatgacatggaaagaagggatgctgtgtcttggaatgcaatcattgcagctcatgagcaaaatgaagaaatagtgaaaactctttcactctttgtttcaatgttgcgatcaacaatggaacctgatgattttacttatggcagtgttgtaaaggcatgtgctggtcagcaagccttaaactacggtatggagatccatggaagaattgttaagtctgggatggggctagactggtttgttggtagtgcccttgttgatatgtatggcaagtgtgggatgctaatggaggcagaaaagatccatgacagactggaagagaaaacaactgtttcctggaattcgataatttcaggattctcatcacaaaagcaaagtgaaaatgctcagaggtatttttctcagatgctggaaatgggtgtaatacctgacaacttcacatatgctacagttctcgatgtttgtgcaaatatggctaccatagaacttggaaagcagattcatgctcaaattttaaagctaaatttgcattcagatgtgtatattgccagcacacttgtagatatgtattcaaagtgtggaaatatgcaggattccaggcttatgtttgagaagacaccaaagcgggattatgtgacttggagtgccatgatttgtgcatatgcataccatggtcatggtgaacaagccattaaattatttgaggagatgcagcttttaaatgtgaaaccaaatcatacaatttttatttcagtcctcagagcttgtgcacatatgggttatgtggacaaagggctccattacttccagataatgcaaagtcactatggtttagatccccatatggagcattattcgtgtatggtagatctattagggaggtcagaccaagtaaatgaagctttgaagcttattgaaagcatgcattttgaagctgatgatgtaatttggagaactttgctcagtaattgcaagatgcaagggaatgtagaagttgcagaaaaggcattcaattcgttattgcagttggaccctcaagattcttctgcttacgttcttttagcaaacgtatatgctaacgtagggatgtggggtgaggttgcaaaaataagaagtataatgaagaactgtaagttaaagaaggagccaggttgtagctggattgaggtcagagatgaggtacacacatttcttgttggtgacaaggcacatccaagatctgaagagatatatgagcaaactcatttacttgtggatgagatgaagtgggctggatatgttccagatattgattccatgcttgatgaggaggtggaagaacaagatccgtatgaggggctcaaaactaccgtttgtagtgtgaggttggaatttggctccatcaaggtgaaactttttccgactaatccactgaatagtaacacagcggaagcaaagcttcatggtgaatcaaaggtggttcaaaggtgttttgatgataacaatgataatgacaaaggtgatgacaaaaagctaaaagatcaatcaaagaacaactcaaggtacatctacttgggtttgactgagaacaagagagggtacatctcttgtggatcagttctagtgaagggtacatccactaggttcaaagagaacaagggagggtacatcccttgtggatctttgcttgtaaaaggatttttacaagaagttgtcatcatcaaaaagggggagattgtagaagcaaagcttcatggtgaatcaaaggtggttcaaaggtgttttgatgataacaatgatgatgacaaaggtgatgacaaaaagttcaaagatcaatcaaagaacaattcaagtgaatcaagaacaattcaagagttcaagataagaatcaagaaggattcaagaactcaagaagaaagtctagagacaagaatcaagatcaagattcaagactcaagattcaagaataaagagaagactcaatcaagataa

SEQ ID NO: 5228 - DNA, 1134 bp, Glycine max
  Peptide Sequence Number=SeqID_122006
atggcaccgacacatcttaaaaccaaataccagactagcattaaaaggatgtttaccataggcggggagcgtcatcaagtgatcatcatcgaggagggggcaagcgacgacgggaggcacaatttctcgagtcgaagaccatcagactcattagaagagctatattctgatggtatcgacggagagtcattgatatctccgtactcgcctccgtacgagcttcggcgtcaaccaaacaaccaacacagtgacccaaaagttgtcgccgatagcgatggtggtccccccacaggcaccggtatactcatcagaagagcaacagacccattggaagcgaaccactccgacgaccccagtagcgaccctctaaacacggctcagaaagccacccgtgacggagacacggttgttgttgctgccaacaaacccaggctccctttacccaaaggacctaaagcaatcgaaaacacagcggataactccccaccctcgaaactagtgagcgtatatcgcccgaaaagagggtacatctacttgggtttgactgagaacaagagagggtacatctcttgtggatcagttctagtggaggatacatccactaggttcaaagagaacaagggagggttgaaagaaatctcaaggaccgcaggtcgcttggggactggaggccactcgatccaacaggaaatatgggccacagtgatctactcaaagtatggtgggtggaggacattggaggaaggaagaataggcactcatgactcaacatggttttgggaagatccatggacagctgatgaactgccactaatggagaaataccttaggatgtatcacatctcatgccaacaaaagcaattgatgacgcagatggggagtagcatgaacaatgggtgggaatggaagctcatttggaggagggaagacacctggatttggaaacttgacacatgcggggattactcaacaaaaagtgggtataacttgatatggggagaaacaacgggggcaattttgaattctgattttcaggaattatggaaactcaaaattccagcaaaagctgcagtgtttgcttggaggctcatccgagatagactaccaacaaagaaaaatctcagtaggagatag

SEQ ID NO: 5229 - DNA, 249 bp, Glycine max
  Peptide Sequence Number=SeqID_122007
atggctcctctgcctccgaaagatgatgtgccattaatgttctggagtataacttgtgtgttagaggactctgcttgccccgttttattaaagtgtaatcttgcagcgattttatttaagcctcccttgcaccgatttttcgttctccagacaccatgtccattaaaacaacgcacagccattccaggcaacactggctgtagacttgtagtgcttcaggctatagacattgtggacaaactccaataa

SEQ ID NO: 5230 - DNA, 297 bp, Glycine max
  Peptide Sequence Number=SeqID_122008
atgtctgcaccacatgtctcgccactcgaaatggcaacactccacacctatttcgcaggtggtattggcgagatatgcatggcacatgtttcgcaggtggtactagcgaaacatgcactgttgctctgcgtgcctctggacctagctgtggatgtagccctgctgcctgacctggcctgtgtcgccactttgactggtgaaataagtgatgcaatttcgcaaatggcactagcgaaatggccgccacatgtcgctcccatgcatgtttcgccagcatgcatggcgatatacgtttaa

SEQ ID NO: 5231 - DNA, 516 bp, Glycine max
  Peptide Sequence Number=SeqID_122009
atgacgattggtagtctagcacctaaggcagagaagaagaaatcaaggaagaacaagactgttgttgttaatgagaatgcacccttgttgccaaaaagtcatgttcaggagagtgatgctggttttgatgatttcaatggagcttcattttctggggctgtttttaacttatccaccacaattattggtgctggtatcatggccttgcctgcaaccttgaaacagttgggaatgatacctggtcttcttgccatcatcatcatggctttgttgacagagaagtcaattgagcttttgattcggtttacccgggctgggaagtctgcttcttatgctggtctcatgggggattcctttgggaattatggaaaagctctggtgcagatatgtgttataatcaataacatcggtgttctgattgtttacatgattataattggtttaggtttcaaccatcaacccctagaagcaagatctgtatttgatttagttttgtgttgttcatcttgccggtga

SEQ ID NO: 5232 - DNA, 690 bp, Glycine max
  Peptide Sequence Number=SeqID_122010
atggcttctctcttcgccagaaccaagtggttctcgttgcctactctcctgcttcttctggagctattcacaataaaccttagcactgcagatgctcaaattggggtgtgttatggcatgattggcgacaatctaccaccggcaaacgaagttgtacctgctttacaagcacttagaaattcgggcattgagcttactcttggggtgctccagcaagaccttcaaggccttgccaccaatgcctccattgctcaacaatgggtgcaaagtaacgtgttgaacttttggcctagtgtcaaaatcaagtacgtggtagttggcaatgaaattgatcctgttggaagttcttctcagtttgcccaatatgttctacctgcaatccaaaacacataccaagctataagggctcaaggccttcatgatctaatcaaggttacaacagctattagcatggacctattaggaaactcctataccccatcacaaaactacttcaagcctgatgtgaggtcatacatagaccccataattgggtacttgtttcctatgctcttttcaacaaatgttgtggtttgggatggtcaatatgggtaccaaaatttgtttgatgctacgttggatgcagtgcttgttgcaattgataacacagggattggttatgtggaggtagttgtatccgagagtggatga

SEQ ID NO: 5233 - DNA, 189 bp, Glycine max
  Peptide Sequence Number=SeqID_122011
atggcgataataaaggagggaatggatgcaaaagtatccaagagagacccacctgccatgcgaaggtttcctgtcaatagttccagaagaagcaggagagtagccaatgagaacctctggtttctagcgaagagagaaggcatggtgcaaaattccccttgtagacggcgtatatatacacctccttga

SEQ ID NO: 5234 - DNA, 828 bp, Glycine max
  Peptide Sequence Number=SeqID_122012
atgagactctatgatcctaatcaagctgctctagaagcacttagaaattctggcattgaactcattcttggggtgccaaactctgaccttcaaggccttgccaccaatcctgacacttctcgtcaatgggtgcaaaaaaacgtgttgaacttttggcctagtgtcaaaatcaagtacgtggcagttggaaatgaagtgagtcccgttggaggctcttcttcggtagcccaatatgttctacctgccatccaaaatgtataccaagcaataagagctcaaggccttcatgatcaaatcaaggtttcaacatctattgacatgaccctaataggaaactctttccctccatcgcaaggttccttcaggggtgatgtgagatcatacctagatcccataattgggtacttggtatatgcaaatgcaccattactagtcaatgtgtacccttattttagttacactggtaacccccgtgacatatcacttccctatgctcttttcacagcaccaaatgttgtggtatgggatggtcaatatgggtaccaaaatttgtttgatgctatgttggattcagtacatgcagccattgataacactaagattggttatgtggaggttgttgtatccgagagtgggtggccatcagatggaggatttgctgccacttatgacaacgcacgcgtgtacttagacaatttggttcgtcgtgctaatagaggaagcccaagaaggccttcgaagcccactgagacttatatatttgccatgctagggaaagttgttattgacgacttcaatgcaacaacttccattaagagtgatgtgtaa

SEQ ID NO: 5235 - DNA, 309 bp, Glycine max
  Peptide Sequence Number=SeqID_122013
atgtggaattttaatttccttctaaaagaagaaccttccaaaacgttcatgtatttcctttataaccttcatcttctcttccacctcaaagttcctcaaatctcgttctcaaactcgcgactcttccctcacgccgatgatcctcttcttcaagaaacaccgtctgagctcgcggagcgtcgatcggatgtgggcgtagggggacacatagaactgcacccgccagtcaagggaagagtcgtcgatgcctatcacgcggtggaggtgctcgccggcatggaggacctgggtcatgtcttgtgtcattga

SEQ ID NO: 5236 - DNA, 126 bp, Glycine max
  Peptide Sequence Number=SeqID_122014
atggctaaacagcagagccagcccaacagagctatgtcgtctacaaagtttgacgttgagaaatttactggcaaaaataacttcaacctatggcgggtaaagatgctcgctctcctcacgcaataa

SEQ ID NO: 5237 - DNA, 144 bp, Glycine max
  Peptide Sequence Number=SeqID_122015
atgattgatgcccatcagatgagaatgattaaccaatatgacataagaggaggtataggatataatacggagattggagatgtggaagaatacaagaataagggccatgctgccagcttgatgcctatcccctcggtcgtttaa

SEQ ID NO: 5238 - DNA, 462 bp, Glycine max
  Peptide Sequence Number=SeqID_122016
atggctgatcaaagcgatagcatcactctagctaaaatcaccgtgacccaagacttcagaactatacaacaatacccattgagagcaacacggagaaaaatttcaataactacagtccacactgattcagtgcaaatgcttcactcaaagatgcaggcagaatccaatattcagtcacaaatctatatgcttcagccctgtagaagcaaaaataggccaagtcaattttttttccaagttgacacagatgatgatgttatagaggttctccatgatagatatcttaaccaggaagaggatttaccaatagttttaactgaatgttgggtcagcaatgcactgccaaaggaacacttatcaagaaacttctttttggattggtgttttgcaaagaagaataagaataagcgcttacttgtacaagtgcacttaagatgcagcacctgtatcagaagaatgtag

SEQ ID NO: 5239 - DNA, 1119 bp, Glycine max
  Peptide Sequence Number=SeqID_122017
atgaagggaatatttgaagggggatctacattgttagcagtaggggaaagtacagcactcagattttcatccaaaaaggacttatttgcttatcaaatgtcacttgtcattaattttttaaaggatatggcactgaagttttcaggtgcctacaagcagtgcaaaccttgcacagggtctagtacctacaagaatggacagaggtcatatcctgactttgacaccatttcagaaggggttccatacccttatattggaggtgcaagctcaacttcaacccctgcttgggacttcacaagctccaatttccctggtggtagatcagaccaaagatttatggggagattcagtggtgataggacccctagagggcctcaatcagcaccagcctctgatgtagtagttgttgaggatgaggatgaaaccaaggagtggatggcacaggtggaaccaggggttcacattacctttgtgtctcttcctaatgggggaaatgatctcaaaagaattcgcttcagccgagagattttcgacaagtggcaagctcaaaaatggtggggtgagaattatgacagaatcatggaactttacaacgtgcagagattcaatcgacaagctctcaacactccttcaagatctgaggatgagcgaagagattcttcttactcaagaatgacatctggacaagatagccccatgcactccatgtctttaaagggttggacaccaaggaatcactataaaccctcagggaataacccttctgaagctatggaacaaggtagtggtggtggccaagacttccatgcagcagcttcatccgtggaagcatcaaggacaaccacctcttctagagacgagcgttcaatgagcaatgccagtgacttggagactgaatggatagagcaagatgaacctggagtctacatcacaatcaggcaattagctgatggaacaaaggagcttcgccgtgtcagattcagtggttcctccacaaaatcatgtgacatgttcctaggaacatccgggagagatttggggagggacatgcaaagaaatggtgggaagacaacagagaaagaatacaagctcaatatctttgaagtgttgtggcattga

SEQ ID NO: 5240 - DNA, 693 bp, Glycine max
  Peptide Sequence Number=SeqID_122018
atggacagtaacaacctcttctccgattacttttccgacgacctcgattcctcccctaccgtccccactgtcgtgaccacgaccacgaccaccactgcgacctggtggctcgaagaagctgatcatcgaggagaggccgtgctttatacggcccgttcatgcagcagcagcaggatacctgccagtgccaaatttgcaagttccgttgccacacaacaatcctcttctggtttgggtggtttatttggatggctcgctggagaccgatccaattctttaccatctctagatttccggcttctgggcgttatacttcccccttcattgcctaattttgttgcgcccggaaaaactattattactacactcccaaatggactcaaagtggcctctgaaacatcaccggttaacgagcagcttctgaaagtgaaggctgagattggtgaagcttccaaaaatccccaagacttgcttttggaagcaattcattctgctggtttttctggtgccttggcaaatcctcttttagcttcagaatcagctctaaatagactaaatggtatatgttggcaatcacttgctttgaaagatcctgctagccaagagcttgtagctgcagtggaagatgagaaatgcatgagatcaagaaacattgctaattctcgtgccccccttggaattattcttttgtag

SEQ ID NO: 5241 - DNA, 1191 bp, Glycine max
  Peptide Sequence Number=SeqID_122019
atggatgtctttgatagtcggcatttggttagaccgtttacttcttcatataagaattttaaagttgggtttttcaaggtgccaaggaggcatgataactaccctaaggaatatttaactattcaggaacgacacaacccgacccttttgagtaagctaccttggaggctgctggctaagcccctcgtttcacttttcaagttcttggatctttttaaggacttaagagctatgctcctatcatttggtatggacgctcttgattttgccaatatgtgccaagaagttggcctcactgctgggaacgccttagaggcttggcccactgatcctttcccaccaccgtgcccttttcctagggatattgtccctcccgccgacaagactaagaaaaaggggccacatagagatggaggaagaggttcgaccttcgaagaggttgcagcaaccaacccttcatcgattttcttcttctcctccttgatctttggatgctttattttgcccatggtagtggcaacaggggacacatcgagggatgctaataaagatggatgtctgaagtttgaagaaaagcccatggaagtagatattgaacctgtgcaaatcatgatggtcgacattactgagcatgtcaacccaaggcacgataagactccaattgctaaggagaatatgaataaagctttcgatgagtttgagaatgaggttgaaggggtgttccttcgagctagagacacattagcccaatttctgattcaaaagaaggtttgtgacagggacatcatgttgtgtccttgtggcagtgcagttttcgacaggtctgttgaagggcttttgaatcatttgagatttgaagaaatatgtcagcctctcaagggtcttcgattcaagacaagggaaacctatccagatggaaggactacctatttgccaagtgctcaagtacctcctaacaagtggattaggcagtcaaatgctcttaatcagctcaaatggcaaacttttggtcctgacattgtaggaagttctgtgcaacataatgaaatgaataaccaaatcaaaccactcaacccatatgggttcaatttcgcaaagatggcttactatggtgctcttgggtttagaaacatgagcaaaactcaatggaggcgaaatcagaggatgagaaagttgactttggagaattag

SEQ ID NO: 5242 - DNA, 237 bp, Glycine max
  Peptide Sequence Number=SeqID_122020
atgaagccaggtgtcgcttggcccgacaactctggtgattccgaagggttaggtgtgcgaatggaagggtttggatatgagatggatgcttacaagaggctggattgggtgttcttagggaaggagttggttgctgacatgccacctacaagggactttttctacatttatgatggcatcttttgcgatcttaacatggagctcccttttgatgatttcactatgagtgtcctctga

SEQ ID NO: 5243 - DNA, 798 bp, Glycine max
  Peptide Sequence Number=SeqID_122021
atggggaatcttctcaaggaaacttctcaaggagcatcctctccaagcttcttatccaacaacaacaacaacgacaacaatgacgacgacaacaacaacgacaacaacaacaacgacgacaacaacaataacgatgatgacaacaacaaaaacagtgatgataacaacaatgacgatgacaaaaacaacaacaacaacaacaacgacaacataataataataataataataataataataataataatgaggttccaagaactcagatttcgacccacagtctcgctcccttgcgatttcgacccacactcttgctgtgccacggtggttcatacattgcagaaggatttcgttgatttcttgctcattgctcattgtgctttgttgttgttgcatttttcccgcaacgccgattccatcataaagaggcctcgagtagcatacgaccctacactaggatatgcgttcgaaaaacacaatttatacactgtagaagcaaagcttcatgatgaatcaagattgattcaaagatgttttgatgacaacaaagatgatgacaaaggtgatgacaaaaagctcaaaggtcaatcaaagaatgagttcaagatagaatcaagaacacttcaagattcaaggggaaagttgaagaacacttcaagattcaagaggaaagttgatttcaagaatcaagaatcaagattcaaggatcaagcttccaagaatcaagatcaagattcaagaatcaagagaagacttaatcaagataagtatgaaaaggttttttcaaaaactgagtag

SEQ ID NO: 5244 - DNA, 1308 bp, Glycine max
  Peptide Sequence Number=SeqID_122022
ccaaagccttatgttaaggaacctcctgaattggagttgaagccccttctttccaacctcaacattcatgacataaagggtttggaccccataatttgcacccaaagaatcaacactaatgtggggtttctacccaaacggttaccccaaaggagggttaatgccaacatgatggaggtgtccaaggagagtcctattcaatgtgtccctaaggagggggacactactgtgatggaaaatgagcaccataagctcacagctggttggatagaggttgatcctaccaagttggaggtggttgcaaaattaccacagccaaattgtgtgaatgctgtgatgaggagatttttgggacatgagtgcctacggacattcaatattcctaagcagactctagtgagtgctcttgtgatgacaacccttgacttgtcactacccctcaagctcatgtgtgatgctagtgatatagctgatattaactttgacttttctgaggagtgcctacggacattcaatattccaaagcagactctagtgagtgctcttgtgataacaacccttgacttttcactacccctcaagctcatgtgtgatgctagtgatatagttgtgggagtgtttttggggcaaagaaaggataggtttgacctagaaatcaaagatatgaaagggtgcgagaatttggtagttgaccatttgtctagattagaccccttagtcatgcaatcaacaaatgatggaagaataaatgagactttgcttgatgaaagtcttctcactatagttgtagatttagagacatattggtatgctggcattgtgaattatctagcatgcaaggtgttcccacctaacattaactatcaagccaaaaagaggcttatgtttgaggtcaaaaaatatttttgggatgatccatacttcttcaaggtatgtggagacaatctggaagtagaggatgatgaggaagaccagctagagcctccttcttggttggacccaatgtatgtgtctatcaaacttcaatgttttgttcagtttgagaccattgggttagtccagactgaggagtatcatatggttttcctaaagcatttgaagtgccgatatcaggaggcacaattcattagagagatcatagggtctcctacccttacacctggcacttccaaagctaggcttctacctagtccaacactacgagtcatccataagtggctcatatggagctttcaggggaaaaaggaaagcacaagggtggttacctttgttggatcaaagcttgaagccttgaatatttgtctttag

SEQ ID NO: 5245 - DNA, 363 bp, Glycine max
  Peptide Sequence Number=SeqID_122023
atggcagacttgatgaaaagaatcctcgaaatgattgaggccgagcaagctaggaaagggtccaatcatggtacctcaaactcacataacacctatggcagcggaagccagaatggatcaaccatcaacagcggcaatcatcataacaacggcaactggtatgacgactcataccactatggtgaacgccctatttataacgacggtactttcaatggtaatggcaacggggcacatgttgagggtggctttgactcctcaacaaggaactactatggtcgccgttatgtgagaagggagaagctctgtgaaatgggggaaaccctagaaaagttcacacatgttgacattccactcatgtga

SEQ ID NO: 5246 - DNA, 321 bp, Glycine max
  Peptide Sequence Number=SeqID_122024
atggagaacgagaagaagaagtgcggttgctgggctgtcctcaaacccgacgttagaggtgcgtgcaaaccttcttcagcttccagagactctcttaacactattcctcgtactagtcttgtttatgatgcagcaatagagaactatgccctccaaattaatgaagctcgattatcttctgataatcctgatcccccatctcaggagaataaggttctttgccagctccttcaatttacatttcaacaactaaaggctgcaactgagaatttcagacccaataacatttttggggaaaatggttttggttacatggactaa

SEQ ID NO: 5247 - DNA, 229 bp, Glycine max
  Peptide Sequence Number=SeqID_122025
atggatcttctggagcctgagcaggaagcagccaaagggtccaagtcaaactcatataacagatatgacagtggaagccagaatggatcaacagtggcaattatacaaacaacaataacaggtatgacgattcataccactacggtggacgcgctatttataacagcagtactttcaatggtaatggcaacgagagatatattgagggtggctctcatttcacaacaag

SEQ ID NO: 5248 - DNA, 279 bp, Glycine max
  Peptide Sequence Number=SeqID_122026
atggttcttaaatggagtggtggaacggtgtggagtagaaagttgttggagacaatcataaagaactgtggagatattgttcacatgcatgttgcagaaagagatgtgcttcatgagatggtgaaaatagtaaagaaaaagcctgattttcatgtcaaagaaaagatactggttcttgtagatacttggcaagaagcttttggaggcccaagggcaagatatccacaatattatgctgcataccaggaactgttggtaatgtttattataaagttttaa

SEQ ID NO: 5249 - DNA, 723 bp, Glycine max
  Peptide Sequence Number=SeqID_122027
atggatgtgaaaacagctgccagagtcctcgatgtcctgaacctctttgccgaggcgcagaagccattgctgtacagcgaaatcgccgcgcagatggagattccgctgtccagctgccatggcctgctcaagaccatggtggcgcgcggctatctctacgagatcggcaagaaacacggctattacccgacgcagaagctgatccacgtcgccaccctgatctgccgcagcgacccgctgaacgcggtgatcgagccggtgctggcgcgggtgcgcgacctgaccggcgaaaccgccctgctggccaagctggcggacgacaaggtggtctatctgatcgtcgccgaatccaagcagaccatccgcttctcgcaccaggcgggcggattcaaggcggtgcacgccaccagctcgggcaaggccctgctatcggtgctgtccgaggacgaacgccagaagtggttcaagacctatcccgggttcgcctcgtacaccgagaccaccctcaccagccaggccgccttcgagcgcgacctgcaggccggcatccagcgcggctggcaacgctcgctcggcgaaaacgtcgaggacgtgatgtccatctcgctgggcttcaaggcctatgaacaaccctttgccatcgtggtggcccggccccctggggcgcatgcagaagaacgaagccaccactgggcagcaactcaaagaggtcaaggcgctgct

SEQ ID NO: 5250 - DNA, 246 bp, Glycine max
  Peptide Sequence Number=SeqID_122028
atgtctctcaatcaagttcttgtgaaaagaaagaaagcagaatggtgtgataaaaatactgagattatgttgaatgtgtgcatagaagagcttattggaaaggacacgggtcttggctgggatggggagaagaaagccattgctgctagtgatgaatggtgggaagccaaaattcaggctttgatggttgtcgtagtcattatgatacttctagttcaaaagaaatgcaagtcgatctccccatag

SEQ ID NO: 5251 - DNA, 315 bp, Glycine max
  Peptide Sequence Number=SeqID_122029
atgaaaaaaaccaaaggcaagattacttacgacagcatcggcggtatcgtcgcagcgacaacatcgccatcacgtttcgatgcggcaagcgacgatttgagtgcaagttggtttctgtggaaagtggtgagtgcggagaaaagagaaggtggtggctttgggaagaagtttaggcaccaaagtgctgataaaaaccaaacacgtgaatcgctaccaaacacgtggctttcaagacttaaacggctgagattgaatcaaggtcagacaaagaacttcgtggacatgaatggcttcaagcatctctccaacaggtaa

SEQ ID NO: 5252 - DNA, 696 bp, Glycine max
  Peptide Sequence Number=SeqID_122030
atgtgcactttcgaaaaaaaaaaacatgagaatgtgaatggcactcatcatgaggataatgagaatgagaaggaccttatgtatgaggaactaaaggaattgactcttggccatgaaagtccatacctctctatgtcatgcgatgtaaatgacactccagatgagaatatatgcaccatggaaaatgattttctgaatgtgacagcaaattcagaaaaaaaggaagagagttcaagtcctccagttgagcaccacaacaccattgaccagttgatgcaagaagttgtagaactaacaactttcaagaaaatacaaaaacagaaaaattgctgcctggagaagaagctgagggaagcagagttgaaaattcaacatctatgggatcgttgtacaatgatagaatcaacacttaatcttcttctaccacatgctgagaacacagtcattgcgtcatatgctgagcagagtatagaccctaaagagacatcatttttaaaaggaaatttggatggagaatcatggttaccaactatagatttgtattgtccttcccaacaacttagctcattaatgtgcttcaatggtacaactaaatgttggatcttattgtccaattttagaccagtagaccttatgcccctctttgaatcagagcaaaggaaacttggcagtgatttctctggccaatggaattga

SEQ ID NO: 5253 - DNA, 236 bp, Glycine max
  Peptide Sequence Number=SeqID_122031
atggctaagtttgaccctgaggtagtcttggagttttatgctaatgcttggcccacagaggagggagtgcgggacatgcgttcatgggtgaggggtcagtggattccttttgacgtagattccctcagccaattcctgggtgacccgctagtgttggaggaaggccaggagtgcgagttcagtcaaaggaggaacagggccgacgtgttcgatgaggaggccattgcccagctatt

SEQ ID NO: 5254 - DNA, 1602 bp, Glycine max
  Peptide Sequence Number=SeqID_122032
atggcaccggaaactctccgttttgtcgccaccatcttcggccgcgatgtggtgctgctagtggacggcggtagcacctacaattttattcaacgccagttggtaactcagttgggcttaccctcttgggccacagctcctttaagggcaatgctgtttccgttatcattcagtcaacgaaaattagcttgtgactcggtatgtgaagctgtttccgttatcattcagtcaacgaaattccatgttgacctttacattcttcccatttctggcacgaatgtggtgctcggtgtgcattggctcaaatccttgggcccggttttgacggattacaatactctagccatgaagttcttttatgagggaaaattgattaccctccaaggggatatggatgcttccttgtgttccctttctgccttccaacgactctccaggacgcacaatgacgctctctactaccacattaccatgctccctgacattacttcttccccccaggagttgccatctgccatcaacactttattgcacaaatttgaagctctttttcaaactccccatacattacctcctccacgcgtgactgattaccgcattcatcttcttcctcaagcaactccggtgaacgtaaggccctatcgatatcctcattaccagaaacaagagattgaatcacaggttgactccatgctccagaaggggttaattcatcccagcacaagccctttttcctccccggttttgctggtcaagaagcatgatggtgcttggaggttctgcattgactatagggccttgaatgccctcatagtacgtgaccgcttccttattccaacgattgatgagcttttggatgagttgggaggcgcacggtatttttccaagctcgatttgctccaaggctatcaccaaatacgtatgcactccgatgacatccctaagacaacgtttcgtacccaccatggccactatgaattcaaggtgatgccattcgggttattcaacgcgccttcttccttccaagcaactatgaacatgatattcagaccgtaccttcgagatttcatcatcgtcttcttcgatgatatcctgatatacagtgccaccatggatgatcatttaaagcacctgaagctaacattcaaggtggagtacttgggccatctggtttcgcacaagggagtcgaaccactggaatccaaagttcttgcaatccaacaatggcccgtacctcgcaccacgaaggtcgtcagaagtttcttgggccttgcaggtttttatcgcagattcataagacaatatgccaccattgcagtcccactggtcaaggctacgaccaaagaaccccttcagtggaacacagacacacaggcagctttcgacactctgaaacatgctttgtccacagctccggtattggccttaccggattttgaccttcccttcacaatcaagactgacgcgtctggagtcggtatgggtgttgttctttctcaacacaaccaccctatcgccttcttcagcaaaccattcagctctaaattgctctgttcttctgcctatgttcgcgaattgtttgcaatcactgctgcaatataa

SEQ ID NO: 5255 - DNA, 243 bp, Glycine max
  Peptide Sequence Number=SeqID_122033
ggactagctcctgatgagacctcttgggaagattggtctcagctttgccacgattttcaccttgaggacaaggtgcttttccaagggccgtggagtgataaggaagcagactcagttgaagggaacataaatgctaatgcaggaggtgctgaagacatagcaatagtaacagagcaggcgcaaggagcagaaaagcccgaaagagtagtgaagagaccatcttacctcatggactttgtctga

SEQ ID NO: 5256 - DNA, 147 bp, Glycine max
  Peptide Sequence Number=SeqID_122034
atggttattgcttataccctcagctggcacattcttatgcggatgagggctccaaaacaaggtccctgtgatccaatccctcctcttgagttaccacattctttgcatgccttccatcgtgtatcagaggcagatgaacttaataag

SEQ ID NO: 5257 - DNA, 138 bp, Glycine max
  Peptide Sequence Number=SeqID_122035
atggacgtgccttatgcagatgatgtggtgaaggttgagtatgtaaggcaagtgtttgatacattcattgcatggcagagacatcttgtgagacatgtttcgcatgaggattcacatgtgtccaaagaaataggttga

SEQ ID NO: 5258 - DNA, 282 bp, Glycine max
  Peptide Sequence Number=SeqID_122036
atggctatggataacaacaaagatgaagggaatggaggatgtaccactgtatacatggtgtatggatccatctttggctctaaaccagttgcggtaattttgatgatgcaggggaattgttctgtctgtggtgaagaaagttttgggactggttcagaccgtattcgtgagaaagatggaatctgggaagttttggcctggctatctatacttgcatataaaaataaagataaacttgaagacaagcttgtcactgttgaagacatagttcgccagcattag

SEQ ID NO: 5259 - DNA, 1002 bp, Glycine max
  Peptide Sequence Number=SeqID_122037
atgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgattgtgaaagagtttgaagaaatcctgggatgcccactgggaggaaggaagccatatcttttctctgggttctatccctccacgacaagagttgccaaggtggtgaaaatctcagcacaagagttggaccgtgcgaatgggctttcttttattgacatcttggcgcttttgatctttggagttgtcctctttccgaatatggaagggttagtggacctagcagcgattgacgctttcctcgcctttcatcatggcaaggaaagcccggtcgtcgccattttggccatgtatgacacgttcgaccagggatgtgaaaagagcggcgcaagaattgatgtcctcatgagaggagtgccatcagacgaaagcatcacgcctttcatcgcacggggtttcagtgaccacaacgcgagggacagagagcttaggggaagccgtaatgggatcatcggcggctatcataagtggctgagagtccgaacacaaggattggattggctcccaaatctaaagactgtgagagacgatgaggttaaagcttcggaagaaagtgatgaggtacaagccctaaaagcagagcttgaaagagcccgagtagtcgaagagaagttcaagtccatagccatcaaagaatcatcacgggtcaaaggcatgatcttgaaggacgagctaaaggcttaccttaggtcgaaaagaaatttgtcccaacagttaagcgagactgaagggaatatgtgggccgtcatcgatgagtgcaaagagaagctaaatctagcggcgactcacgagcaaaggctagaggatgagtacgccaagatatcagcagaaagcgaagcaagggagagg

SEQ ID NO: 5260 - DNA, 150 bp, Glycine max
  Peptide Sequence Number=SeqID_122038
atgggctcaggcgacctcgtactaagcggaccttttgggcttaacaagtatggtcgtgatcacgcccttagcgcaggattcgcgctaagcgcacctttgaccttcttcgtgagccttcttcgcgctaagcttgaactgaccgctaagtaa

SEQ ID NO: 5261 - DNA, 264 bp, Glycine max
  Peptide Sequence Number=SeqID_122039
atgaacagttggtcattgttgaaacattatgcatttggaccaaatagagaacagagggaagagcttgtagcaatcggcaaagagattgtgaggaaatgcgttgcttcgccacttgcaatccaaacatacgggaaatcattttttcaagaagcaaagtcagatgagtttggtatcattacaagtttcaagatgcatgatctatttcatgatcttgcccagtctattatgggtgaagaatgtgtggttcatgagcattgtggttga

SEQ ID NO: 5262 - DNA, 336 bp, Glycine max
  Peptide Sequence Number=SeqID_122040
atgattaattccagctggtcaattctccacactccacagtcaccaagaagcattaaaacgacatggggcaaaaagctaaggtgtgacaaccgagagaaaacaatagacaggaccatcatccccaacacggaaacaagggttctctggctctgtgtctggttgaaagaaagtgaagtggtaaaaggggtgttgcctaaaacactggcacggaatgtgaatgcgaacgtaagcgagagagaagaagagaaagtgaaggaagggccaaggttgaagagaccaaccaataagtcagatttgtgtgaggctcaagcaaacatagatcaaccatttatataa

SEQ ID NO: 5263 - DNA, 333 bp, Glycine max
  Peptide Sequence Number=SeqID_122041
acagcttggatccttgtcaagcgcagtgctgaatataaacctttgcagtttttagcctttgcctttgtttataggctttttgagaagttaaaaacctttgaatctcctgtaacccccaaatataatgaagagggtgaagacacaggcgaaggactccgcatgggaaaacgattgcttcgatcactggccttggtttttggatgtgtagctatttcatctttggcatacactttcattttgaacataattgagtttgcaggtggttttattcctactcttttgtacaacagtcagttatgtgatgtgaaggagttggttgccattgaagtctaa

SEQ ID NO: 5264 - DNA, 183 bp, Glycine max
  Peptide Sequence Number=SeqID_122042
atgagggcttggcctaagaagggagtcacgatcaaagaggtgggacagggacggtatctcttccagttctaccatgagttggattgcaatcgtattatggaaggagggccatgggtcggttgcaggagggtgcaactccaactcaagttcctttattccatattgcgtgttgggtacaagtga

SEQ ID NO: 5265 - DNA, 189 bp, Glycine max
  Peptide Sequence Number=SeqID_122043
atgactcatgaaggtggaggggcaccatgcccagagcaaattttgtcgacacctagtttcatgaaggtggaggagcatcatgcacaacagatctggttgccgatggtgtatgtgatgaatttggttgatgacaaacccttcctgagtctcttctctaacaacaataacctccttgattggctcctatga

SEQ ID NO: 5266 - DNA, 828 bp, Glycine max
  Peptide Sequence Number=SeqID_122044
gtcagctgcatgttagaacggctacgtggagctgcaagtgcttctgaacctcggacacagaaggctatctatgatctaggattctctctaatgaatcccatactagttcttcttgaagtgtataaacatgagtctgcagttgtctacctgctacttaaatttgtagttgattgggttgatggacaaattacgtacttggaggcccaagaaactgcggctgttgttaatttttgcacgcgtttgcttcagctgtattcatctcacaatattggcaagatatcactaagtctttcaagcagcttacttagtgaggctaaaacagataagtatagagatttgcgagcccttcttcaacttctctcaagtctttgctctaaagacatgattgatttctcatcagattcgattgaagcccaaggcactaacatatctcaggtggtttactttggtcttcacatggtcacaccattgatttctatggacctcctgaaatatcccaaactttgtcatgattatttttctctcctgactcatatgttggaggtttatcctgaaacatttgcacaactaaatagtgaagccttcgctcatatacttggaacccttgattttggtcttcaccatcaggatgcagatgtggttagtaagtgtctgagagctctgcaagctcttgcttcttaccactacaaggagactggtaatggtaatattggcttgggtgcccacactgtgggtcataaggatttgagtgggaatgttcaggaaggtcttttgagccgtttccttcgttcaatgctgcagctactcctttttgaggattacaggtga

SEQ ID NO: 5267 - DNA, 132 bp, Glycine max
  Peptide Sequence Number=SeqID_122045
atgcggaaattgattaaggaaaggatggaaaataaggtggttaatttcgtgggtcttaataaggttaagtggtggctggacagaaatatagaaatggcaataactgaagctacagggctccaaatgaggtga

SEQ ID NO: 5268 - DNA, 414 bp, Glycine max
  Peptide Sequence Number=SeqID_122046
atgaagttgctgcaaacccacaaccagaggacaaaggggacaacacatacgaacaaatcgaggaggaggacccacacgtgcttggccttgttgttatggttgcggagctgctgctggtgttggggcttgagcgaaacggcgtcgtcggagatgtcaagcatggcaagcgcgtcattaggccttttctttttcttcaagccttgggttggagggttgagaggaggaaagggttgtttttcttcaagccctaaggaggaaatggttgtcgtgaagcgcattttggaagatggtgtggaattggggtgggattggaaggagagaggggacaaagtggtgattgttgttgttgatggtgcattggaactcgaaggaagtgggtggaaggggaaggttttggagaaaagagtagagtga

SEQ ID NO: 5269 - DNA, 1131 bp, Glycine max
  Peptide Sequence Number=SeqID_122047
atggccgtgtctctgacacagggggcgataacggagatttgcagaggcaattgctccgaaaacttgcaaccggtgctgcaggtgatcgagttgaagcaggtgcagtcgcagcaaaacagcaccgtcgagaggtactgcgtggttctttccgacgggtccttttaccagcaagggatgctcgccacgcagaagaatgacttggttcattcgggaaagttgcagaaaggttccgttcttagactcactcagttcctctgcaatgttgtccagaaccacaagattattatcatcattgacctagatgttatactggactattgtgagctgattggacaacctgtctcaacaccaaaacacacacctaaagaaccaggagtcaactttgggaattcacaatctttaaatagcagttcacatgcaggtggcatgaatgctagaccaaatgtatctgggtcatctatctattatccaaaagcgaatcctcctgctcgtaatgaccctcctgcttatcctaaagcaaagactctgacgcagggggcgataatggagatatgcagtggcaatgaccccaagaatttgcagccggtgctgcaggttatcgagtttaagctggtccagtcgcagcaaaacagcaccattgaaaggtaccgtgtggttctctctgacggttccttttaccagcaagggatgctcgccacgcagaagaatgagttgatctattctggaaggttgcagcaaggcgccattattagactcacacagttcatctgcaatgttgttcaaaaccgcaagattattatcatagttgacctagatgttatatgtgaaaaatgtgagctgattggagaacctgtcgcagctccaaaaggtgcacctgcagaatctgccactggtcaatctggattcacctttggaaatttgcaatatttggataggagttcacattcaggtggtatgactactatacaaaatttggctggtcaatctctggacttgaagccagtgctgcaagttctggagttggagttggtgaactcccaacaacatagcgcctccgtgaatttccatttggttctctccgatggttaccatttccagcaagcgatgctcacgacgcagaagaatcaattg

SEQ ID NO: 5270 - DNA, 470 bp, Glycine max
  Peptide Sequence Number=SeqID_122048
gtgttgatattaggtcatctaagatatgtgaacttggattgttagattataaagcaaaggatgtgttccatcattttgaaagaagcaaatttcgctgccgttatgattactattgggcttcagtattcaaggtggaatataaagatcacttttctggtcagacacaagttgcatttgctgaggctcccaatgaggcccttcctctttattgcaggcctaattttggtgctgcatggttgacacaatataaatttaaggtcaacgagacttatgattgttggtacacatctggcatttccaaagttcgtttacatcaagatagtctttttggttgtgatgcccatgagcagtctactcttgagaagagtagacaatattctaccatttctttgtggccactcaaatgtgtgaccaagtttactgatttgaagatggcaaataaacttgggcataggttggtggggatttag

SEQ ID NO: 5271 - DNA, 1461 bp, Glycine max
  Peptide Sequence Number=SeqID_122049
atggttgtgaaaaaggacagaaactcattccagtaccataaggaggccttagttatcaatcttaacagtgctggaaaattcctaataaaaatttatatcaagggatacaattcaccaagcataggactgaacagtcgattatcaaagaggatctccaccgaactagctaataatgtgtctaatcagaaacatgttggtgtaacttcagagggaagaaacaatgacaaactatacatgcaaaataaccttttggcaaatgatgtttcaggtgacatcaattttccaatcagagatcctgttaatagagaactgcaatctagtactgacctgtttctggccaaggcctggtatcttagtgatcaaagagtaacaagaagccgatcctctgaattgcggcggaggtatactgaaatgcaaaattctcaaacaaaacaaggaatggaatctatgagcatggaccctcagcatggtgtggacactacaaaacaaggaattgcacattttaatggttttgattacattactatgaccgagcttccaagccaaaagggatcattcatttctccatccaactcatcttcatctaccttccacactcatcaattggttgatgcagataaagtctcatcttgtgtaagtatgctaaagggtacattacaacgcaagagactcagcaaccaagttgagattgagagagaagctgcagcagatagcttaaatggactttttggtcctcaagaacctcttttccaaaatggttttcatgaaggactagaaaattggagtcatcaaaagccaataagttttcaaggagcctctactggtcaaattaagaatccaggagtttacattgtctcagatggttttggaaatcagacaaaccaagcatatgtgggaaatgcttcccaagaaccttctcaaagtgaatcttctgctgctgcaccagtaatctcctctggtttggatgcatgtgaaggtcccagcaattcaaatcaaaatctttgcgaaagctcatggaaaccagtgggagtgagtagaagttcagaaaatactcaaaatcgagtcagaggtgtcagagaacagataatggataatataaaagatgatcggaagaggaaaagtttagaaagatatggatctataacatcagctgtttcagaggagaaaggagacaccacaaaaaaacgaagagtggagcgctcaaggaaaatggctgaggcaaaggaaagaaacttgacaccatcagttccctctgatatgcaagctgtcttgaggcggtgtgaaacccttgagaaggaagttcgatcactgaaacttaatttgtccttcatgaataggaaggattctgaacaaacaaagcagatagaggaccttcagaagcagaatgaagacttggcagatgaaaaggagcgcctccttgaagagattgaaagaattgtttcagaaactggaaagatctaa

SEQ ID NO: 5272 - DNA, 816 bp, Glycine max
  Peptide Sequence Number=SeqID_122050
atggtcgaaagaaaaaatccctatttgacaaggcttcttactatacctatgaattccattggacccaaaaatgatacattggaagaatcatctgagtcttccaatatcaataggttgattgttccgctcctgtatcttccaaaaggaaaaaagatctctgagagctatttcctggatccgaaagagagtactcgggttctcccaataactaaaaagtatatcatgcctgaatctaactggggttcgcggtggtggaggaactggataggaaaaaagagcgattctagttgtaagatatctaatgaaaccattgctggaattgagatctcattcaaagagaaagatatcaaatatctggagttcctttttgtatattatatggatgatccgatccgtaaggaccatgattgggaattttttgatcgtctttctccgagaaagaggcgaaacataatcaacttgaattcgggacagctattcgaaatcttagtgaaagactggatttattatctcatgtttgcttttcgtgaaaaaataccaaaggaagtggagggttttttcaaacaacaagggactgggtcaattattcaatcaaatgatattgagcatgtttcccatctcttcttgagaaacaagcgggctatttctttgcaaaattgtgctcaatttcatatgtggcaattccgtcaagatctcttcgttagttgggggaagagtccgcacgaatcggattttttgaggaacaacatgtcgagagagaattggatttggttagacaatgtgtggttggtaaacaaggatcggttttttagcaag

SEQ ID NO: 5273 - DNA, 1212 bp, Glycine max
  Peptide Sequence Number=SeqID_122051
atgtcgccggaacataccacccgcacccgtcgccccgtcgacagccgcagcgatctctacagcctcggcatggtgctgtatgaacttctgaccgggcgcctgccgtttgaactgggcgcggacgatcagaccaactgggcacactaccatattgcctcggagccgctggccccggacgtgatacgcccggacgtgccgggaatgctctcgaccatcctcctcaagctgctggaaaagcatcctgataaccgctatcagacggtggacgggctgattgccgacctgcgacgctgccaggcgacgttgaccggtgagggcgagatcgccccctttactcccggtcagcaggatcgcaccccggcgatccatctggcggattccctgttcgcgacgcatccgcaggcgaatgacgtcattgccgcgtttgagcgagtcgggcagagccgggtgccagagctggtgacgatcggcggaccgtcagggatcgggaaatcctcgatcatcgcgacggcgcttaaaacgctgcagcagcgtacggtgctgctggcggtaggcaaggtggaccagttttcgccgtcactgccttacggcgtgctaagttccgcgtttcgcaccctgacgttgcacctgctggggctgcccgcagacgacgtggcgaagtggaaaatccgcctctcgcgcgccctggagggccacgaggcgctcgctgtcagtcttgtgcctgaactggggctgctgcttgagagcaaaccgcgcttctcgccggatacgttttccattgatgcccgggcgcgcttcagccatatggtgctggcgctggtcaaaacctttgcctctcagggctgcccgctggtgctggtgcttgacgatcttcagtggagcgacgccgccagcctgcatacgctcaaatacctgctggtgaacagcggggcaatcccgctgctggtggttgttgctcaccgggatatctgttcgttatccgatgccaccttacaagcgctgctgacgagtcttccggaagcggcgctaaacgcgagcgaaattgtccctcaggcgctgtccgtgaaagcggtagcgcgctggctggcgacgctgtttcgaacccgcagcacggcgacgtctgacctcgccacgctgatccatgaaaaaaccgggggcaacccgctctttgtgcatgagtttttccgccgcattgtcgatgacgggctggtg

SEQ ID NO: 5274 - DNA, 588 bp, Glycine max
  Peptide Sequence Number=SeqID_122052
atggacctaacctccagcactacccacaacacaaacacaacacaaaccttagaagctgctaatactattactattactactaaagccaccccaccaattcccaccaccaccctaaagtctctatctttcaccaacggcacactcaagcgccaccccatcaccaccgttgctccgccgccgtccatggtggtttcctacaaagaatgcctcaaaaaccacgccgccagcatcggcggccatgccctcgacggctgcggcgagttcatgccgtcctcctccaccgtcccctccgatccccgctctctaaaatgcgccgcgtgcggctgccaccgcaacttccaccgccgcgaaccccaagaaaacaacctcaacaacaaccttaaaaacaacaaccccacctccagcaccactttcacaccgagccatgagccaaagcacatcaccgagcctgagttcaagcccgagccacagcccaagcccgatatcaagcccatcaccgccgccactctcgcacgtgccaccctaccacgcttcagcgccacacatgcttctagccctcggcactgcttattctcctgcaccctctga

SEQ ID NO: 5275 - DNA, 174 bp, Glycine max
  Peptide Sequence Number=SeqID_122053
atggtcatggacatggctgacacatttggagaaggattttggaaatgggcttctttatacgaggaccctatacagctgcaatgtgacatcttgaaggaaatgggcttgtcttataaggaagaagatagcaaggttaaggggctgctgctggatatggagaataaaatgatttga

SEQ ID NO: 5276 - DNA, 138 bp, Glycine max
  Peptide Sequence Number=SeqID_122054
atggcttttaaatcgggtacctttgacatcaattcgagggtgaattcttcccaagaaggagaagcgaatgatataggactattcaaggaggaagtgtttgacttggatgggttcaacataaatggatcaattacttga

SEQ ID NO: 5277 - DNA, 123 bp, Glycine max
  Peptide Sequence Number=SeqID_122055
ggagcccgtgaaattgtctccttcttagatacaacgtcttggggtaccacagtgcccgacgggatcaagatggaacccatgcataatgcatatgcgaaaggcacaacacagggatgtacatag

SEQ ID NO: 5278 - DNA, 507 bp, Glycine max
  Peptide Sequence Number=SeqID_122056
atggaagaatcgttgaagaagagaaagggaatgtcctccaccaccgctgctgttggccatcgccgccacggaccttctgaagcacccacagcaccaattcatccttccttatcatctccaagatcatctactctattttctttagatgatcaatgtctacggtacaactctcaattttcttctaggatcatcttagaccctaagtaccgagacacagatttctttaacgatgagacatttgactattatcaagtgtttcaaaactctggattggttgattttatgtctttaaaattgtcttactatcctaaacttgttaaagtcttttatagcaatttaaaaattcaggatggtattatttcttttgaggtccatggtatttctatgatcattgatcaatctctgttcctttcattgacaaaattactcagtcaaggtgcaccttttgagggcaccattgttgatgactggaaattcgattattctagtcatgatgcttgccgtatg

SEQ ID NO: 5279 - DNA, 591 bp, Glycine max
  Peptide Sequence Number=SeqID_122057
actcatcttctccttgaagtggcgtctcctctctctcttcctttctccattccgctgccattcatcttccaagaagcaaaggaatccattgatgaagaagatcctaggcctacaagctccaatggagcttgcatcacattcggtggcatatacaaggatcaagatgagtttgttgtgtctttgatccgaaaaatagtagaatccgggggaggattcgaccttgctgatgtctttccttcaattccattcttatatttcctaactggaaagatgaccagattgaagaagttgcacaagcaggttgacaaggtcctggaaaacatcatcagagagcatcaagaaaagaacaaaattgcaaaagaagatggagctgaattagaggaccaagattttattgatcttctcagaatccaacaagatgacaccctcgacatccaaatgacgactaacaacatcaaagctttgatattggacatatttgctgctggaactgatacttcagcatcaacactagagtgggctatggcagaaacgacgagaaatccaacagtgagggagaaagcacaagctgaattgagacaagctttttga

SEQ ID NO: 5280 - DNA, 399 bp, Glycine max
  Peptide Sequence Number=SeqID_122058
atgacaattgatccaactaagacccttatgcactacctcactcctaccttaggggaagccaataccattcagcttcttgatctacctccctcatatttgacttcaagcatggttcctttagatgctagagaacaacccatagggagtaagagagtctacctgaagaatggaaaaggtagcaagatattatcaaaagttgtccacaccatgccattactcaacatagattggtccatatattctatggggaaaccttatgttaaatccaccgccatcattaataatgcattcccctacaacaactcagggaataagaggattatgaaaagcaatgttaatcaagtggggatagatgaatcccaaactgaattgggaaagcaaaacaagctctatcaatga

SEQ ID NO: 5281 - DNA, 661 bp, Glycine max
  Peptide Sequence Number=SeqID_122059
atggccacaatgatggaagccatgatgagtatgaaaaaaatgatggaagtcaatgcggctatagttgttgccgcaagtatcgccatagaagtggacccggctcccccatctggcctcaaccaaataaatcatccaacctcggatatagttggtcagggaagcaaagacaagcatgccttcccgccatatggcttacctcccaactatgcaccacccaatgtggcacacactctcgatgagaatgtcaataactccactcccatactcattgacagccaacaacctcaatctgatcatgcacatgtctttcaacccatgggggagacacatgaagcaccccaccacaatctagttgacttcgagccttgtcacggacacgccactaaggggcaagcagttggtggtgtacccctgccaaacactttggagggccctcagtttcgcccacaacccttgtattttgcggtgagaagaatccctcctgttattgcggaaaagggaaaattggatcatatagaggaaaggcttagggccattgaaaatgtactatcggaagatgggggcgcgaggctcacgggtgcactttccaaaggaggaaagatgcgcggagtcgccaccaacgcttatttgtggaaatcgtcggaaaaaccaaaggaaaccg

SEQ ID NO: 5282 - DNA, 144 bp, Glycine max
  Peptide Sequence Number=SeqID_122060
atggcgtgggcaagaactagtgcgctcaatggcgagggcacgacagtgtgggctcaacggcatgggcgatggcggcatgggctcaacgaaagtgtggtctacacaatgagaaagcaagtagtaatgattcataactacacataa

SEQ ID NO: 5283 - DNA, 315 bp, Glycine max
  Peptide Sequence Number=SeqID_122061
atgcaaactgtaaatgacaaactacttcaaagagctaccagttctttagatgaaaaacctttgttggagaaagaattgataagggcacttaaacttgaagtgggagcaggcacgtttgagttagcagaacttaaacttgcagtggttgagtttcttctacccaattgcaaagtccaactacaacctagcagaatcactagttcaacaaagaacaaaaaccttgtccaattgtacaaggtcaatctgaggacaaaaactggtagaagagtcaaagatgagacaaatggtgctggtagtgggatgaatagtggctag

SEQ ID NO: 5284 - DNA, 1107 bp, Glycine max
  Peptide Sequence Number=SeqID_122062
atgaagagaacaaatgaaagggccattgcaaccgccactgattttcaaattgcaaacggggtttacaaacctgcacagctttggcaacttgaagatcaaacaccacgacctacaaaaaggctacatggatcatctgtttacacactgaaggagatggaggaggcaacatgttcattcagtgatgagaatctgcttggaaaaggaggatttggcaaagtctatcggggcactttgcggtcaggagagatacatactaatacaacaagtctccttctgaaggttgtagcaatcaagaaaatggagttgccagcaattaaagcagctgagggggaacgcgagtttcgagtcgaagttgacatcttgagcagacttgaccacccaaatcttgtttctttgataggctactgtgctgatggaaagcatagattcctagtatatgaatatatgcgtaaagggaacctgcaggatcatttgaatggaattggggaaagaaacatggattggcctcgaagactccaagtggcactgggagctgcaaaaggacttgcttatctccattcaagttctgatgttggaattcctattgttcatagggatttcaaatcgaccaatattctcttagacgataactttgaagcaaagatatctgattttggactcgcgaagttaatgccagaagggcaagagacacatgtgactgccagagtgcttggtacctttggctattttgatcccgagtatacatcgactgggaaactcactctacagagtgatgtttatgcttttggtgttgttcttttggagcttttgactggacgtcgagctgtagatctaaaccaaggtcccaacgatcaaaaccttgtactacaggtgaggcacatactgaatgaccgcaagaagcttcgtaaggtgatagatccagagatggctcgaaattcttataccattcagtctatagtcatgtttgccaatctggcatcaagatgcgttcgtactgagagtaatgaaagaccttcaatcgtagaatgtataaaagaactcctaatgattatctatacaaattcaaaaggcttgggaatggttatgcatagtttgagaatgatctag

SEQ ID NO: 5285 - DNA, 609 bp, Glycine max
  Peptide Sequence Number=SeqID_122063
atgctaattcccagcacaccatatgctcgatccatctcattatcgaaagccttgcaggagactcttcaatatttcaccttcacgagacctgatattgcttgtgatgtgcaacaagtgtgtttattcatgcatgacccgagggaagaacacatgcacgctctcaagcgcattgtgtgctacattcagggtacttttgatcatggcttgcatccctatccatctttcacatctactcttctctcttatacagatgctgattggggtgggtgtctggataccagacgctctacattgggttattgtgtgtttcttggtccaccaaacggcaagctacgttgtcacgatctagtgtggaggcggaataacgaggtgttgccaatgtgtgcgatatatctctttgaaaatcctgttcaacatcagcgcactaaacatattgagagggatattcactttgttcgcgaaaagattgctcatggggaagttcgagtcttacatgtcatgtcacattatcatattgcagaaattatcgatgtttggactagtgagttagacattcagttgtttttgacaaatgttatgagctggaacccaagttcttgtcaagaatga

SEQ ID NO: 5286 - DNA, 159 bp, Glycine max
  Peptide Sequence Number=SeqID_122064
atgggagctcaagttcgatatcggcttgattggcattctatatcagatgtcaaccgcttaagtgatatgaagactcaaaatgagaacttcaaattcaacgtctttcgattcgaacctgacataaccgtcaaaaataaagttgataaatatttcccttaa

SEQ ID NO: 5287 - DNA, 324 bp, Glycine max
  Peptide Sequence Number=SeqID_122065
atggcgagatgggtgaatggtaggggaaatttactcccatttctgggtatggtgttggttatgctagctcaaagtggaagcatggtggttatcaaagttgccatgagtgatgggattaacaagtatgtcatggttgtctactctttggcactttccaccatcttgcttcttccctttgctttgtttcttcacaggagttcaggacagataatggcttacgttggcatagatctaagctcggctactcttgcatcagccatgcttaatctcattccagctttcacttttatacttgctctcatatttaggtttttttttttctga

SEQ ID NO: 5288 - DNA, 594 bp, Glycine max
  Peptide Sequence Number=SeqID_122066
atggaaaatctgaatctgaaactgcgtagcagccatgcaaaaattattggcacagtgatctcgattgcaggggcattgataatcactttatacaaaggaatgccattgactggcagttctatgagaaacttagtattgggtggaagtgaagcttacctctcagtgcaattagattggataattggtggttttcttcttgcaacatctagcttgtgcctttcagttttgtttattgttcagacttggattatcaaggactatcctgaagagttagtggtaacaaccatttgttgcagcccggtggcaatatttgttgtatcaatgcggagtgttgtatacacatgggcaatgcgaaagaagggacccgtttatgtagctatgtttagccctttgggaatggtcattgcaattggaatgggggtaatatttctgggagagagtctgtatcttggaagtatgattggagctgctacaataggtattggattttatgctgtgatgtgggctcaggctcaagatgaaaaactggtaaatgagaagaatgaaaaccatgattttgtcacatcttcttcagctcctcttttgtctacctaa

SEQ ID NO: 5289 - DNA, 1143 bp, Glycine max
  Peptide Sequence Number=SeqID_122067
atgcaaggcgcagggataacctttgtaatggttgtggcacaggtcttgagtgtgggtttgaacactctcatcaaagcatcaatgtccaaagggatgagcatttttgtttatgttgcgtattcaaaccttctcggattctgttttctgctcctagccaccacaattcgtcacagaaacagagctcccacaccgatcaataattccatactcttcagaatttttgttcttggcttgctcagcgtcaccatacagacgcttatttatactggacttgggtatagttctcccactctgacgtcaaccatggaggatattgttccagcttatactttcataattgccattatttgcaggatggaaaggttggatctaaaactacaaagctgccaagcaaaatccattggaactgtggtctcaattgctggagcattaattatgaccttatacaaggggttgcctatgacaattgatgtgatgccaaacaatgcttttctatcatctcaacagtccaaatggctactaggaggatttctccttgcagttggttgcttctgtggttcagtctcgctagttattcagacatggactatcaaagactaccctgaggagctaatgctgataaccattagttccagtttttctgttatcctatctttcattgtcgctttcattgcagaagaaaatcctaaggcatggatacttaaacttgatatggagttggtgtgcatattttattcaggcattgttgtgatgtctacacgaaatgtggtgtatgtatgggcgtgtcgaaagaagggccctgtatatgttgccatgttcagtcctttagggattgtcattgcacttgccatggggattgtatttttgggagatgctctatatcttggaagcatcataggagctgctataatagctattgggttttacgctgtaatatggggtcaggctcaacaagaaacaatggcttacgaaaaatatgggaccagtagtagcattatctcatcatcgccttcttctgaagcccctctattgccgaacaaaatcaaagatacaagttcttttatatgcggcgacggccgtgacggtgtcaagacgagagatctatgggatggaaggggtgcaacggtgagggtggaggggtga

SEQ ID NO: 5290 - DNA, 345 bp, Glycine max
  Peptide Sequence Number=SeqID_122068
atggtgggtgtaggagtgagtgtatccgcagcaatggttgcaactcttttcttggaagtgggattgaacactctaatcaaagcagcaaacaccaatggaatgagtaattttgttttcattgtctactcaaacttcttggctctcttcttccttataccctccaccttcctctaccacaggttagcttcctttcacaaactttcttgtcattccttgactcttaaaaaatcacaggaaaagagctcctcccccaattccaagctcaattctctggagaatttttcttctttgttgcctcaggtttgtcctcttcctcctttcaaccatgttgatgtgactgaataa

SEQ ID NO: 5291 - DNA, 192 bp, Glycine max
  Peptide Sequence Number=SeqID_122069
atggcacgttctacacgtttggtggcggtgtcactccctagggttcctttcaaatccaagggtagcctttgttatataaattctttcgggatcaacacatgtcatcaagctttagcaagaccgacagttccatggcatccctctatgatcttaaaccaggaaagtttcacttggtcatatactaaagtgtaa

SEQ ID NO: 5292 - DNA, 1173 bp, Glycine max
  Peptide Sequence Number=SeqID_122070
atgtcgcaacatcagcaaacgtgtacaaatcacgataaaatagttgcttatgtggtaaccatcattacgaaaatagcattaactattaagtgtttgtccattggagtaccatattcagtcaaccaggattgcatgaaaagagagaatgtacatgaaaagagagaatgtacacagttggaggtgcttctcaattctcaagcctctaatccacaagtagcttacttgtcaatatcaatgccacctctatgccatggagtcatacaaaatgaactttcttcttacaccattgaaatggtaaagggtctttgtccaaatgttgtggggattgcagagccagccaaagaaggatatcaacttactctgaagcttaaccttaatcagattccacaaaacaaagactatgataaggtcattaaggagatttcaacagtacattcagtaattctgagttcacagctgaaagaaatattgtggaacgtgaattttgatgatgcacttcaggggatgtacaaacccatcaaactagtctaccatccaaaagaccatttctttctcattaggcagccacaaagaatcatagcggtattcccaattcgttttagagaaaagtcagatgtgatcattgcaacggctttctttcaggagcttgtggatgtgggaagttcagataaatgggccaaggtaccaccttgcaactggtcagccattcctccaccagagttaagaggagaagcttttgaggatttgagtaccaatggagggttttttactttcgatatctcttctcgccatgttgaaggcaataggctagacaaaactgtctggaatctattaaattttaatgcctatgttagataccatgtaaagagcaccaaaggttttattcaaagaaggatgaggaagcgtttggaaagtttagttgaggtcctgcaccaaacaaacttagaagaaaatgaacaaaccaaacaacatcaagtatataggtacacaaagaaactagtgcgatcagcaaagtatgccgtcttgaaacaaagatggggcacctttggaagaaaaataaagaggatccgtttccgacttaaaattcatggatttacacgatttcgtcaacaatggtttaggttcccaaaattttcaacgggatatacaaaaatagtggaaaaatctgcgtag

SEQ ID NO: 5293 - DNA, 117 bp, Glycine max
  Peptide Sequence Number=SeqID_122071
atgtttaatgaagagggattctctcccatcttgcagaaatatggacactatgaaccgcaggaatcctgtctcactgtgaatcatgccatcacagagcctcattgtcccactttctga

SEQ ID NO: 5294 - DNA, 765 bp, Glycine max
  Peptide Sequence Number=SeqID_122072
atgcatgcggatatgcaaatcactcccacgaaaccattcatcctaaggtgtttcctcatctccctcttcctctccctccccttcctcttcctctacctcttctacccacaacaacaacaacaacaacaacatcatatcacaaccaaagacctcagaatccgaccagggtactcctcctacgaatcctacattcaacgccagctgaacaagacccttaacccaaaactccgaaaaatatggacaacccgcgactgggaccgcaagatccccgtcttcgcgcgcttcttcgaagaccttaaggttaataaaaagcttctcaaaaacacgtccaaggcgctgtgcatcggtgcaagagtggggcaagaggtggaagcgctgcggcaaattggagtcgttgattcagtgggaatggaccttgttccgtaccctccccttgtgatgaagggtgactttcacaaccaaccgttccaaaacgacacgttcgacttcgaattctccaacgttttcgatcacgcgctgtacccgcaaaggtttgtggcggagatcgaacgcacgttaaaacctgaaggtgtgtgcgttttgcacgtggcgttgtcgaggcgtgctgataaatactctgctaacgacctctacagcgtgcagccacttgtggagctattcaagcgctctgctttggttcacgttcgcagcgtcgatggttttggattggacaccgaggttgcgtttcggaagaagggagaacctcttcgtcgtcaccgtttgtga

SEQ ID NO: 5295 - DNA, 813 bp, Glycine max
  Peptide Sequence Number=SeqID_122073
atgggtaatccacggaaaccaagtactgccgacgagcttcacatggcggcaaggtccggtgatctcatcgccgttaactcaattttggcttcaaatcctttggccgttaattccagagataagcattccagaacaccgtataggtcatttggagtggtgctatatgcggttagacatgagcttgcaaatttggaccatagtctacatttagcagcgttttctgggcaagcagaggtagtcacttatctctccaagcacaaggctgatgttggtgcttctgcaatggatgacatggctgcaatacactttgcttcacagaaggggcatttggaagttgttcgcgcgctactttcagctggggcctctctcaaagccgccacccgcaaaggcatgacttcattacactatgctgttcaaggttcccatatggaactcgtcaagtacttggccaagaaaggggcaagccttggtgccaagacaaaggcaggaaagacccctctagatcttgctaccaatggagaaatccgctcctttttggaggactttgagaagtcgacaaagaatggagaattgggaaacaaagacaaagataaagctgaagaatctgatctaaagacatccacattgggatctgaaggtgatttgagttctgaacctgctgcagctgctgttgatgaagacgacaatgaaagagagaagaggaagggtaacgaagttgatgcaacagaagagtcatcgcaaccaaaaaaggctagagttaacttaagccatctccaaagttcagacgatacccaagaagaagaaagcctgtag

SEQ ID NO: 5296 - DNA, 189 bp, Glycine max
  Peptide Sequence Number=SeqID_122074
atggagaagaaggtctcgacagaaggtcatgggatcgaggttggcattgttggtggcaaagaagaaggcctcgaaggagggaacatgatggttgggttagaattgatgttgggagtggacattaatgagagaggaagaaggagaaggaagaagaaccgaaggaagatgatggatagaaaacttacttga

SEQ ID NO: 5297 - DNA, 558 bp, Glycine max
  Peptide Sequence Number=SeqID_122075
atgaagaaaaccggaaagaaaaccaaactgacggtggcggatcttctgaaaacaccgtcgccggtggcttcaccggcggcggattctccggcgattttcaagagagcggcttcctcctcgaagggcgcgaagagaggttcgagagttgctctcgccaccagcacttctccaccttgcggccacagagctccgagcaacatctccgacctaaggaacttggcttcttccggcgtcgacgatctcaagcgccgcatcgatcgctctcactccgagatcctcaaggatctcgaggcttctaactctcgtctccacaaacgcttcaagatgcagaatcaagcgtaccagcaggtaatggatgaagcagagaaggaatacaaaaaggtgtctgaacgaataacggaaagcagagatgcaacgaagtcttcttatgaagaattcatggcagaagcacaagccagcgcatctcgtgcatgcaaaacttctattgctgagctttcgcagtcgtttgcgaaggcaattgactctcttcgaaaccgttatggaatttcatcaaattag

SEQ ID NO: 5298 - DNA, 2334 bp, Glycine max
  Peptide Sequence Number=SeqID_122076
atggagtccagtgaggatgggagcatgtcatatagagagttccatgcgaatggaagccgcatggttacatcagaagttgaggccaagcttgatgaaggaaatattcaagaggcagaagatgcattgcgagaagggttgtcgctcaattttgagctgtttctggattgtgcatttcatattgcaaatagaacctatcgagacttgggggcgcaagtaggcatgacaatggggcgaggcggggtcgggtttagtctctccacccgactccccaagtccttcccgcccccaattcccgtcgggatccaaaaattagactcatcccgccttcgcttggggatcggaattgcagtggggtgggggcagggaccaacatacccgatcccatcctcgaacccgactttctcaattggaaaaaacctgaccccgatcaactcagttttttcctgtcaaagttgggacggatccgggttggtccccgcggggatgggtacacttgccatgcctaggtgcaaggaagcaagagctcttcttggaaagttggagtatcagagaggtaatgtagaaggtgctcttcgtgtgtttgatgggattgatctccaagctgccatacagagattgcaaccttccttttctgaaaaaacaccagtcaagaaaggtcgcactcgcactgaatcaccctcctcagtctctcagcatgctgctagtttggtgcttgaagccatctacttaaaatcgaagtctctgcaaaaactggggaaatttactgaggctgctaatgattgtaaacgtattcttgatgccgttgagaagatattttatctaggtgttcctgatattcaagtggataatagattgcaagaaatagtcagccatgcagttgagctccttccagagctttggaaacaagctggttgctacgatgaggcaatctctgcttataggcgagcccttcttagtcaatggaaccttgataatgattgctgtgcaagaattcagaagtcatttgttatttttttgctatacagtggggtggagacaagtccacctagtttagcagttcagattgatggatcatatgtgcctaaaaataatcttgaagaggctattctgctattgatgatttttttgaaaaatttttgccttggcaagatgaaatgggatccttcagtcatggaacacttgacttttgcactttctatatgtagtggaactactgttttagcaaagcaacttgaagaattgaatcctggagtataccatcgaattgattgttggaatactttagctttatgttatagtggagctggacaaaatgacagtgctttgaatctgctaaggaagtctttgcacaaacatgaacgaccaaatgaccttacatcattgttgttagcagccaggatctgcagtgaggatccctatcttgctgctgagggagtgaaccatgcacagagggcaatcagtaatgctcacggcccaaatgagcatttaaaaggtgttgctcttcggatgttgggactttgtttgggaaagcaagctaaggtcgcttcctctgactttgagaggtctcgccttcagtccaaagctctggagtcattggtggcggcaattagattggagccaaacaattctgatctgatttttgaattggctgttcagtatgcagagcaccgaaatttgcctgctgctttgcgttccgcgaggcatttctttaacaaaacaggtggttctgtatcgaaagcttggagattgcttgctctaattttgtctgcacaacaaagattttcagaagctgaagtggtgacagatgctgctttagatcaaacttcaagatgggagcaggggccactgcttaggctgaaagcaaagttgaagatctcccaatcacgacccatggatgctattgaaacttatcagtaccttcttgcattggttcaagcccagaagaaatcctttgggtctctccaaattagttcaaagggccaagtatgttgcactgggaaaattgtggggccaggtgttttgtttgaaggacgtgggcaaaatgaagaagctctttgtgctactattaatgctatactactcgaaccaaactatgttccatgcaagatcttgatgggtgctttgattcaaaaattgggtacaaagcatttggctattgcaagaagcttactgtctgatgcactccgaatagaacccacaaaccgcaaggcttggtataacttgggattgcttcacaaacatgagggccgaataagtgatgctgccgactgcttccaagcagcttccatgctcgaagaatctgatcccatcgaaagttttagctctttaccttga

SEQ ID NO: 5299 - DNA, 209 bp, Glycine max
  Peptide Sequence Number=SeqID_122077
atggaaaggttagaattagatatgaagagtacttttgcatcaatgtgcaaagagcataggaccaaagtatttagcgagtggcaggttgaaaagggttcggcgcagccattgtcagttgcagtaaaactgacatattccaagagcaagcttttcaacgctggacaaagtgagagggtcaaaacaattgagtatgtttgtaaatttgtaag

SEQ ID NO: 5300 - DNA, 207 bp, Glycine max
  Peptide Sequence Number=SeqID_122078
atgacgtggcgcgttgtgaacggtggtgctatcctgcgccgggtctgcgcaccaacttttatgcgtgaaaacgatgcgcactgttccggtcatcatcatgattattctcgccaccatcatcatcatcaactacagtaccaccatcaaggtggtgttgacgatgacaacgacaacactcatggtgatagaggtggtggtggtggttga

SEQ ID NO: 5301 - DNA, 575 bp, Glycine max
  Peptide Sequence Number=SeqID_122079
atgactaagttcaggaaattgggtcgacccaccggtcaccgaatgtccatgctccgaaccatggtctcgcagttggtgaagcacgagcgcatcgaaactactgttgccaaggcgaaagagatcagaagactcgcggataatatggtgcagcttggaaaggagtgcttgtacggttgctacttggcgttgtgggggaatgacttgacgggttttggtcattctgccattcaaatttcctggtatgcaatggttgaacgggaatatatgggactgagtattgggaaaaatccaagtctcacattggctagagataaagccaatatagagtatataagtggggggaaagcctcaccctatgagctagcttttggggttgagttaggctcaaacccttattctaagatgggatcccaacatgctgcaagacaagctgctagttttgtgcgaggagatgatgtcattcacaagttgtttacagaactagcttatcggtacaaggatagagctgggggatacaccagattgcttcggacccgtattcgagtgggtgatgctgcaccgatggcctatatcga

SEQ ID NO: 5302 - DNA, 216 bp, Glycine max
  Peptide Sequence Number=SeqID_122080
atggagtgcagcatctacggtgtaaaaataaaatctgttggtcctggagatagaggaaatggaaaaacagatatggatgcaggtgggatagatggaataggtgttggagctgaggaagggggaacctcagaagatgggggagcctcagacctcttccctttggccttgcgctgccctctaaaaagtggactccccgagctttacataaagcagtga

SEQ ID NO: 5303 - DNA, 552 bp, Glycine max
  Peptide Sequence Number=SeqID_122081
atgggcgacaatgaaggtcatggtgatctcttatcaaacaacctcgtcatcctactcattgccatgggttccgcagctttcgttgtttcaatgtaccatgtcatagctatttgctggtgcaaccagcgcatcacaaaccaaaaccaacaacaacaacaacggccatcacaaacgacggagggtacttccttggcgtcggtggcgaacatgattccaacccacaggtatagcaagaagaaagttgatagtgtggttcaaggccgatccaactgtgatggtggagacgatggcgacacgtgtgcggtgtgcttgggagactttgaagatggtgaggagttgaggacgatgcctgagtgcatgcattctttccacgtggcatgcattgatatgtggctgagttcgcattcgagttgccctatttgccgtagcagtgccacaccttctcaagaggtgcttcactccgaccatgatttcaattatgcatatcagcatcaacacagcttagatatgtccacgcatcagttcgctgtcacacatgtgatgcgacgatga

SEQ ID NO: 5304 - DNA, 1386 bp, Glycine max
  Peptide Sequence Number=SeqID_122082
atggaggtgcaaacattaactacagtaaatgaattatacaaacgaagacttccaagaagcaaagtcaaagatgcagagaagcctttccacttatctgtccaagataggagctcaagatgcaaattgtctttcttaaaacttatactattgataaccatatgcggcacttttgtaacactcctgtactctccggaagtttacaataccaaccatttatcaagctctggctctcggtggatatggggtggctcagatcctcgttacatgtccaatgtagccactgactgggatgacatattgaaaattacagaaaagctgacaggggaagatgaacttgaaggaattgggcttgtaaatttcaacaagactgaactagcacaatgggagcatcttattcctgaggcaacacatgttgttctgcctctggagtatgctgcaagaaatgtgacatgggagtccttgtacccggaatggatcgatgaggaagaagaaacccaagttcccgtttgtccttctctgccaagtctaaggtcccctggcataagacttaacctcattactgtgaagcttccttgtaggaatggagggaactggtctagagatgttgctcggttgcaccttcagcttgcagctgcttcccttgcaacctctttcaaaggcaactaccccgtttatgtgctcttcgttaccaactgctttccaataccaaatttgtttacgtgtaaagaactcgttgcacgccaagggaatgcgtggttatacaaaccaaacttgagtgttttgagagaaaaggtccagcttcctgtagggtcttgtgaacttgcacttcctatgagaggaaaagagttggtttacaatgggaatgctcccagagaagcatatgcaacaattctgcattcagctcatgtttacgtttgtggggctatagctgcggcacaaagcatccgcatgtctggatcaactcgagaccttgtaatacttgttgatgagacaatcagcagctatcacagaagtggtctggaagcagcaggttggaaggttagaacaatacaaaggatcagaaaccccaaagctgaaaaggatgcttacaatgaatggaactacagcaagttcaggctatggcaactgactgattatgacaagataatattcattgatgcagatttgctcatactaagaaatatagattttctatttggaatgccagaaatcactgccactggaaacaatgccactctctttaactcaggtgtcatggtggttgagccatcaaattgcacattccagctcctgatggatcatatcaatgagattgagtcttacaatggaggggaccagggatatttgaatgaatattcacatggtgcacagataccagacacatga

SEQ ID NO: 5305 - DNA, 762 bp, Glycine max
  Peptide Sequence Number=SeqID_122083
atgggcaaaactgtcattacgggatcagctaacgtgggccagcccgggatgacaacctacaactctgcaacagtaggggttgctggggatggatttatagcaaaggatctcacaatccaaaatacagccggtgctaatgctcaccaagcagtggccttcagatcagacagtgatctttctgtcattgagaactgtgaattcattggcaatcaagatactctttatgctcattccctgcgccaattttatagatcttgccgcataattggcaacgtggacttcatcttcggaaactctgcagcaatcttccaagactgcgaaatcctagtccggcccaggcaagccagaccagagaagggagagaacaacgcaattaccgcacatggcaggacagaccctgctcagtcaacagggtttgttttccagaactgcatggttaatggtaccgaggaatacatggcattgtattatagcaagcctaaagttcacaagaactatctggggaggccatggaaggagtattctagaacagttttcatccattcattcttcgaagcccttatcacaccacagggctggatgccatggagtggggattttgcactgaaaacactttattatggggagttccagaactcaggacctggttctaatctgactcagagggtgccctggagtaaccaggtcccagccgagcatgtgttctcgtattcagtgcagagttttattcaaggagatgattggaatcatcatctcagttag

SEQ ID NO: 5306 - DNA, 672 bp, Glycine max
  Peptide Sequence Number=SeqID_122084
atggcggaggaggaaaaacaccagcagctccaacaagagcaagaccctcacaagctcttccgctcctacataggcctgagcttctccatgttcctcgcaatgctggccaacaactccgtcccggcgctgcagggcaaggtacgctcactctccctgcgcgcggcggatgcggccgaggagctccggcagatgaagtcgcggcggcaggaggactccaaggccaacgcgcgcgtagtggagatcttcgcctcgcaccggaacgcgtggcaggcggaggagaagcgcctcctgcaccagatcgacgccgcggcggaggagatcgcgcgcctgcgtggccgcgtggctgagctcgaggacgccgccgcgcgcgccgagagggacgtcgccgagcgggacgagatgatcgggttcatgtcgcggaggatcgaggacgagggattgggtgggagggagagggagagggagagggaggtgtacggtaagaagagtgaagagtggtttcaaaaagaagaagatgaaatggtggggtccactgctaggagcttggaagaagaggtcgaggttatctatgaagaacaacatagtcagcattttgggaacaataatggctttgattcagagtttatggcctctgcttctaagttctgggctgagaaagcctcgctttggcag

SEQ ID NO: 5307 - DNA, 180 bp, Glycine max
  Peptide Sequence Number=SeqID_122085
atggtgtcctctagagggaatggagcccgcagaagatactttagaagcttggaagaaagattagaacttgagaacgctgatctagaaatgaataagaagcatgttcacaaaggtgatggcaatgatgatgaagatcatggcaatgaggatggtgcagtgatgacggcaacaataggatga

SEQ ID NO: 5308 - DNA, 552 bp, Glycine max
  Peptide Sequence Number=SeqID_122086
atggaggggaccagggtatatttgaatgaaatattcacatggtggcacaggataccaagacacatgaacttcttgaagcatttttggattggtgatgaggaagagaagaaacaaatgaaaactctgttgtttggcgcagaacctccaattttgtatgtccttcactatctaggtgtgaagccatggttatgcttccgggactacgattgcaactggaatgctgatatatttcatgaatttgcaagtgatgttgcacatgcaaagtggtggaaggtacatgatgcaatgcctgagcttttgcagcagttttgcctgttgaagtcaaagcagaaggcacagttggagtgggatcgtaggcaggctgaaatagcaaactacacggacgggcattggcaaattaaagttaaagataggcgcttgaagaaatgtatagataatttgtgcaactggaaaagcatgttgcggcactggggagagacaaattggacagatgatgagttttatactccaacaccacctaccgttaccacaacatctctttctgctctatga

SEQ ID NO: 5309 - DNA, 294 bp, Glycine max
  Peptide Sequence Number=SeqID_122087
atgaaattggtgaaggatggccctgaagttcagaaaaggtctatggctatgccattgcctgttttatgtgtggaagatggtgtggcaattttacgtttctctgaaatctttggcattcatgaacctctcagaaagggagaaaagagagagcatcgacattctattcctagaggagagaaagcaatgatgttgacttggagtttccaaaatttggatttcttcatgcggatgcctcagtggacaggaaagatgatcaacaatcaaaggactcgtgtcatagtgctgaaccgatga

SEQ ID NO: 5310 - DNA, 741 bp, Glycine max
  Peptide Sequence Number=SeqID_122088
atgggttacgattcggatagcccctcgcaagatgggagggatgaaggtgagtttttctttgatgaaatttggtttgttaactccatgtttggtgaatttgaaatgatagacgacgaagaagaatatgaggattctggcaagggtaatcgttttcttgggttcatgtttggaaatgtagataactctggtgatctcgatgttgattatcttgatgaggacgcaaaggagcatctttctgcattagctgataagctgggtccatcactgacagatatagatttgtcaggaaaatcaccacaaacaccacctgacgttgttgaacaagactgtgatgtaaaagctgaagacgctgttgattatgaagatattgatgaagagtatgatggtccagagacagaagctgccaatgaagaggactatttattgccaaaaaaagaatttttctcttctgaagcctctgtatgtttggaatccaaagcttctgtctttgatgatgaaaattatgatgaagaatctgaaaaggagcaagactttgtgaatgacgattctaaagtttataacatccctttagctggggagcaggaagagagttttgtggatgcatctaaagaagagagttcgcttgaacatgaattacatgttgactcaccgcagactgaagagttggatgctgatgtacaaaaacttgaggagggaaatgacataaaagagattgaatgcattgagatcaatattttttga

SEQ ID NO: 5311 - DNA, 450 bp, Glycine max
  Peptide Sequence Number=SeqID_122089
atggccgttccagcagccgtattggtagccgagggaggcgctcatccaggcgcgggcgtgtttggtggcgccgcgggggagggcggaggcggcgagggaggtgcggtggtgggagtagtggaggacctggaggcagctctttgcggcggtggagcgggtgtggttgtctggggaggcgtcgacgatggactgcaccttggatcgcgcgaggaggaggttggaggtggaggttgtgagggcggaatggatgatttggaggggggtggggttggaggggaggttggggaggagggaggagtggcattggagagggaagcgcgtggctttgcaggcttggtggatctgagccacggcggagtgagggtggtggaggaagaagaagatgaggaagagggtgaaaatggaggccatggagatgagaaggaggaggaagctggatctgagaattga

SEQ ID NO: 5312 - DNA, 1788 bp, Glycine max
  Peptide Sequence Number=SeqID_122090
atgaggaactctgctaggacggtgcagaggagatatgattctgatcacagggtgtgcaaagatagaatccaagagctttgcaaagaggtgttgtgttggggtatccctcttcgtgcttgggatacagagaacgccaagaagatagtagggagtgttggagaatttaaagatgttgatgatgatgtggaactttctagattcattggagaaaatctcgttcgcaagagtgatgtctgtatggaggtggcgtcggtgttctctcagttcgacgtaaaacttcaaccggtcagggttaaggccagcggtggaaaagtggttcaaaattttgtgacatgtgagcccacacaaactgtgcgaggaggagtagaaaaggaagagcaagtgcatgcttttggcggggtacagggtgaccatacctatacagagaaagacatggcgacatcagcaggcgagcctgagtctaaaagcaatggaagtgaggacaaaaggggagagagaactcaatcaggtgttttagtggggccaacaaatgttgagttagcagacaaggaaagtccttttaagagaataacagctttggagcaaagggaaaataacatagtgaccaaaaaggagaattgggccaactctgaaggccctgttgcatcaaaagaaaatggatcacctattttgatgaaaggcgggagtgggcttaaagaggaagcaacaaacacttggactatggcaaaagatatgggggtcagttatgaagcagaggaaggaaaaatgatgtccaagattgctatcttagaaggaaaaaaacagaggagtggtggaaaggttgggaagcagtatgggaaactaagcgagattgggtggataagtgggtatgtcaagcattgtggggggattcagaggaagatcattggtactagattcattgtattggagggagtgtggaggggacttcaacagtataagaaggccatcagaaagagtgggcctcaatcagtgggagcacgaaggaggacctatgaaggagaaaagctgaagaggctcaaacaacatctaaaagcgtggaacaaggaccaatttgatgatgttcagcaaaaattctccaccattgagaaaaagttgaatgagcttgaggtgaagggggaaaacggcccactgagtggtgaagaaggcgattgcaactcatggtattaccacttgctagtcaattggaaacatcgtcataacatgccgagaggtgtgtctgttggaggagcttggattgaggagcctaaacgcgtaaaggaggcagtgaggcaattttttaggaccagatttcaagaatctcctgagttgaggccactgctggatggggttgatttcaagactattgatcagtcagataatgtcatgctgatagcccctttcgaggaagcagaggttcttaaatcagagtttcttagatttcttggggaatttcatgcaaacggcatcttttcgaaaggaagcaatgcatcttttttggccttgattccaaaagttcaagatctacaggtgggtgtgatagatcgcaggatgcttgaagtcttctacagtctcagtgttgggcctgatgggattgatgagggacagaattccaacaagggtgaatctattaagaagaaatgtggatctacaggattccagatgtccgtcattattgccacaagcaccaaaggaacacttcttacagcactcatactgctgtatggaagtgctggaggaggtggttttcttttgttggttgtggctgaaaaacatggaaaaggattttga

SEQ ID NO: 5313 - DNA, 624 bp, Glycine max
  Peptide Sequence Number=SeqID_122091
atgacagttttgaatttaccagtgtttggttctggatctgcgtatctgttaatagggtgctgggtattatcagtgtttctcgttccacctccccatttcgataatgctccaaggtcttactttcctttaggatctgtaattactaaaagcttagaatttctttgtatgacacaatcaggcaccatggacagcatagttgattctctgaataatgcctatcaagattttgttgttgcagcagcaaatgtgttggaagccaaagaaaatgctggttccattaaaacaacagcaaccgatactgctctagaaaactttaagcagaagtgggaattgtttagagtagcatgtgatcaagctgaggagtttgtggagtctgtgaagcaaaggataggatccgagtgtctggtggatgaggcaacaaggcctgtagcaggaaaacctggacaagctaccatgactggtcttcctcccatcagtgcagttcggttggaacagatgagtaaagcagttcgatggcttgtgattgaattgcagcatggctctggagctggttctgctaattcagctcttacccacccctcagctcagtttgatgccaggttttctgaagatgctgctcagtag

SEQ ID NO: 5314 - DNA, 820 bp, Glycine max
  Peptide Sequence Number=SeqID_122092
atggccaaggctgtagcaatattggatcaaatgaatgtggcaggtgttggaccaaatgagcatacatatacaactcttatgcaaggttatgcttcactgggtgacactgaaaaggcctttcagtacttttcagtgttgaggaatgagggcctggagattgatgtctatacttacgaagcgttattgaagtcatgttgcaagtcaggcagaatgcagagtgcccttgcagtcacaaaagaaatgagtgcaaaaaatattccaagaaacacttttgtctataacatactaattgatggaggtgatgtttgggaggctgcagacttgatgcaacaaatgagaaaagaaggagttctaccagacatccatacctacacttcttttgtaaatgcctgttgcaaagctggggatatgcagaaagcaacagagattatccaagaaatggaagcatttggtataaaacctaacctcaaaacctacaccactctaataaatggttgggcgcgtgcttctatgccagagaaggctttgagttgctttgaagagatgaagctagctgaattgaaaccagacaaagcagcgtaccattgtcttatgacatctttgctatcaagagccacttttgctcaatcttacgtttacagtggtctcttgtctgtatgtagagagatgatagagtctgagatgactgtcgacatgggaactgcggttcactggtcaagatgtttacgcaagattgagaggactggaggggaactaacagaagccctacaaaagacctttcctcctgattggacctcacataatgctcttgatgtcaata

SEQ ID NO: 5315 - DNA, 1092 bp, Glycine max
  Peptide Sequence Number=SeqID_122093
aggactgcacgtcctcactttcggaggactacacgtcctcgccttaagagggctacacgtccttgccatcagagggctgcacgccctaaccttcagagggttgcacatcctcgccatcagagggttacatccccaaacttcagaggactacacgtcctcgccttcatagggctgcatgccctcaccttcagaggacttcacgtcctcgccttcatagggctacatgccctaaccttcagaggacttcacgtcctcgccttcatagggctacatgccctcaccttcagagaactacatgccctcaccttcaaaggactgcacgtcctcaccttcggaggactacacgtcctcgccttgagagggctacacatcctcgccatcagagggctgcacgccctaacctttagagggttgcacaccctcgccttcagagggttacatccccaaacttcagaggactacacgtcctcaccttcagagggctacacgtcctcaaacttcagaggactacacatcctcaccttcagagtgctacacgtcctcaccttcagagtgcttcacgtcctcaccttcagaggactgcacgccatcgcctttagagggctacgcgtccttactttcagtgggctccatatccatgccttaagaggatttaagcgaccgcagtgccgatctccccctgcggaagtatcagttggtctgtgtcgtcatgacataggggtagcgcccacaagacacccagtggacccgaaggagcccaacagggccctggggtttccagctctagttacgggcctctgtcagtcctacagggcgcccgttcccccagcaagttcatgccatcgtgacatagggatcgtgctcgcaagacacccaatggacccgaagaaggccaacaggttctacggagtgcccgttgcccccaacaagttcatcagaccccctattaaccgggctttcatcaagaagtactgcgcccccaggcaggcacaaggtgaaacaccacagcagcctggggagggccggcagcgggcaacagacgcaccgccaccacctctagagttcacctcagctcatcgacaaaaaggttag

SEQ ID NO: 5316 - DNA, 147 bp, Glycine max
  Peptide Sequence Number=SeqID_122094
atggctaccattgcgttatcaagtagatatgggagcaagttagcatatgacaccggaattggggtggtgttcgtcattggaagtgcggtagacagactttgtggtagatttagggatggcctttgtggatacctgggtggtgggtaa

SEQ ID NO: 5317 - DNA, 1239 bp, Glycine max
  Peptide Sequence Number=SeqID_122095
atgaaggctaacatgcaggccatgaaagagcaaatgaccacaatgatggaggccatgatgaatatgagaaggatgataaaggttattacggctacaattgttgccgcaagtactgccacagaggtggacctgactcacccacctggcttcaatcaagtaaatcatccagcctcgaatatggtaggccaaggaggcgtagcattgggaaatgcaggcggcccccattttgagcagattcagaacaaacattccttcccaccatgtggactgcctcccaactatacaccacctaatgttgtacacgttcctgataagagccaacaactccaatgtgaccatgcacatctctctcaacccatggaggagacacatgaagtaccccgaggccacattctagatgacttcgagcctcacctcagatatgccattgagggggaggcattttttagtgtacccccgccaaacatttcggaggggcctcaatatcgcccacaaccacaacctttacattttgtgataagaagagtgcctcctaccatggtggtaagggaaaaattcaatcatatagaagacaggctaagggccattgaaggagtgttcgacatcgccatacctccgaagttcaaggggactacttacctcaagaatcacttgaagatgtactgcaggaaaatgagggcatacacgaaagatgaaaaattattgatgcatttcttccaggaaaatcttactgaggcaactgccacctggtatactaatctagaaccttcccggtatcaatacaattctaatatggctctggatagaatgtatctacaaaacatgtgtaagagggagcatgaatctttcaaagaatacacccaaaggtggagggatctggcagctcaagtagtgccctcaatgatggatagggtgatgataacaatgatagtagacacattacctgtgttctactatgagaaggtggtgggttacatgccttcaagctttggagatctagtgtttgctggcaagaggatcaaagtgggtctgagaaggggaaaatttgattattctgctttgatggataggaagtccggggaaaatagagagaataagaaggaaggagaaacccatgatgtgactatcgttcttacacggccaaatttcccactagctcaacaatatcaatactcagccaatatcaatccttcttattactcaccatcctatcagccaagaacacccaatcatccataa

SEQ ID NO: 5318 - DNA, 414 bp, Glycine max
  Peptide Sequence Number=SeqID_122096
atgattgaactgactctaagaccaactccaagaaaagtaagtattttcttagacaggtttgacgttgttgaagttggaggaattgaagtgggtcaaggtctttggacaaaggtgaaacaaatggctgcatatgctcttggtgatattcaatgtgagggaactgaaggtcttttggacaaagtacacattgtgcaatctgatacggtgagcttgactcaaggaggcttcactgcaaggagtactacatcaatgttaggctgcgaagcacttaggctttgttgtaatatgttggtagagaggctaaagcctcttaaggaaatgttgcaggaggaaatggactctatcaaatgggagaccctaattcttcaggcagctagaataaataaagttaaagagctcaattttgaacattga

SEQ ID NO: 5319 - DNA, 480 bp, Glycine max
  Peptide Sequence Number=SeqID_122097
atgcaagctgtgaacttatcaacatcttcattttatgtacctagtaatgattccacgggttaccttagttatagtgctgcagtaagtgaggatgatccctcacattatttccaagccaaggagtcccatcttgcatggtccatcgatccatcctcaggaaccttttgttctattgcaaaagcgaaagcggaagcagaagcggcacgatgggcgaaaatggaagttgtggaaatcctaactgataggaggttagggaaaatagaagcctcactgacagtagagggtaggatgccaacaacgaattcaaacaccccaacagcacatgcgaagacagtatctgaaacaacaacgatgcatgtgacatcacttgctatgtcttgtattatggttgttgttcttatcgaggttgagattgaggttgaacatgaggcggggaaggtggtcatggcaatggtgctagcggtggagagtgagatatga

SEQ ID NO: 5320 - DNA, 555 bp, Glycine max
  Peptide Sequence Number=SeqID_122098
atggagaaccagaaaattcatgcatgccctaatgattgcattttgtatagaaatgactttgcagaaatgcattgttaccccacctatggggtatcacggtacaaagtgaacgacgaggaatgcagtgttggtgtaatcataaacaaccggcgtccaacaaagcgaaagtacataatgctgagtatgatgatagcgggtccaagacagccagggaatgatattgatgtgtatctcagtccattaattgaagacttgaggaaattgtgggaagagggggttgatgtgtgggatggaaatctgcataagactttcaagatgcatgcaatggtattttgtaccattaatgacttccctgcctacgggaacttaagtggatatagtgtcaaaggacatcatgatgtagctccatgtggagcttgtaggccttggatcttcttcatcaatggattcctttgcttcttgaagttcaatggcagtggaatagaaaaggaagaaagattattggagatgccacttcaaggagaagatgagtcaagaacaagctcaccaccatag

SEQ ID NO: 5321 - DNA, 454 bp, Glycine max
  Peptide Sequence Number=SeqID_122099
gttcccttttcagtatgtcagcaatggaaagggtggggctgatgtggtgcaatgggtggaaactgcaatctctgagggaagggaattagaagtgctagatcctaagattgcaggctctgggaattggcttgctgagatggagcaactcctccacattgttgctgcttgcactgaaagcaaccctcaacatcggttagacatggcagaagccattagaaggataatggagattaaatttgaggcccctacaacagtgattaatagacttactgccattgaaagacaatttctttggggtggcaacttagaagggaagaagatcgcttgggtggcttggagtcaagggccaccaaagcagcatttctctcactggtggtctgacttgaggtccgttaaccatcatagaagtatggctgatagcagctacaaggtcaatatggaagctcagaaatga

SEQ ID NO: 5322 - DNA, 1490 bp, Glycine max
  Peptide Sequence Number=SeqID_122100
atggaagaattcaagcaagttcatgcccatattctaaaattgggtctcttctatgattctttctgtggcagcaatcttgttgccacgtgtgctttatccagatggggcagcatggagtatgcttgctcaatcttcaggcagattgaggaacctggtagctttgagtataataccatgattagaggaaatgtcaatagcatgaatcttgaagaagctttgttgctttatgttgagatgcttgaaagaggaattgaacctgacaacttcacctacccttttgtgctcaaggcatgttctctattaggtgctctcaaggaaggagtgcaaattcatgctcatgtttttaaggcaggtcttgagggtgatgtctttgtgcaaaatggcttgatcaacatgtatggcaagtgtggggcaatagagcatgctagtgttgtgtttgagcaaatggatgaaaagagtgtggcttcatggagttccatcattggtgctcatgctagtgtggagatgtggcatgagtgcttgatgcttcttggggatatgagcggtgaggggcgccatagggctgaagagagcattctagttagcgcgctttctgcttgcactcatttggggtctcctaattttggaaggtgcatacatgggatcttgttgaggaacattagtgaactcaatgttgctgtgaagacttcattaattgatatgtatgtcaagagtgggagccttgagaaagggctttgtgtattccaaaacatggctcagaagaatagatattcttacactgtaatcatcacggggcttgccattcacgggcgtggtagggaagctctaagcgttttctctgacatgctggaggaaggtttggcaccagatgatgttgtctatgtgggtgtgttaagtgcttgcagtcatgctggtcttgtcaatgagggtcttcaatgtttcaaccgcctgcaatttgagcataagattaaaccaacaattcagcactatggttgcatggtcgatcttatggggagagctgggatgctaaagggggcctatgacctcataaaaagcatgccaattaagcctaatgatgtggtttggaggagccttcttagtgcttgtaaggtacaccataacttggaaataggggagattgcagctgagaatattttcaagttgaatcaacacaatcccggggactatttggtgctagcaaatatgtatgcaagggctaaaaaatgggctgatgtggccagaatcagaacagaaatggcagaaaaacacttggtgcaaacacctgggttcagtttggttgaagcaaataggaatgtctacaagtttgtttcacaggacaagtctcaaccacaatgtgaaaccatttatgatatgattcaacaaatggaatggcagttgaaatttgaaggttatacgccagacatgtcacaggtgttgcttgatgtggatgaagatgaaaagaggcagagactgaaacatcatagtcagaa

SEQ ID NO: 5323 - DNA, 522 bp, Glycine max
  Peptide Sequence Number=SeqID_122101
atggagctcctgggaaatttgttggtgactgtgttcattgtgaggtggaggatttgtctgacaccatttgggttggttctatttccatggagctttcaaacttgcagtgctagagcagggtggtttttgggtcttggagcaaacaacaagaagaccaatttacctgataccgtcaaagtcggtgaccccgttctgcatgagccagcccaggatgttgatcctatcgaaataaagttggagagagtgcagaagatcattgatgacatgatccaggtcatgagaaaggcttctggtgttggtcttgctgctccccagattggaattcctttgaggataattgttttggaagatacaaaagagtacattagttatgtctcaaaggaagaggctaaaactcaagatagaagacctgctgatcttttggtctgttactttaatacaccattcattagttctcttgaggcaggtgatcctgaatcccaagctagacaagaagggcaagaggattgctctgttttttga

SEQ ID NO: 5324 - DNA, 1695 bp, Glycine max
  Peptide Sequence Number=SeqID_122102
atgatggagggctcctggttagacaagataatatgggaggagcttgatcagccttcagtgaaaccgaagcttatctttgatcttcaggatgatcaaatgcactttgaagttttagataccaaggatggtacacatctttgccttcatgctggggctatgattttaactcattctttaaaattaagcagcggggattcttctgagttaccaggacatggaagtcaatatggatggcgatatgttgctaatgacaaacactattcaaaccgtaaaacttctcagcaactgaaatcaaattccaaaaaacgctcagctcatggtgtcaaagtttttcactcacaacctgcactgaagctgcagacaatgaaattgaaattgagcaataaagatattgcaaattttcaccggccaaaagcactatggtatccccatgacaatgaggtggctgtcaaagaacaagggaaattgccaacacaaggacccatgaaaattattataaagagtttgggtggcaaggggagtaaactgcatgtcgatgttgaagaaactctctcttctgttaaagcaaaagcttccaaaaagctagattttaaggtatcagaaacagtgaaaatattttatttagggagggagcttgaagatcacaagtcacttgctgcacaaaatgttcaaccaaactccttgttacatcttgttcgtacaaagatacatttgtggccaaaagcacaaagggttcctggtgagaacaagtccttgcgtcctcctggggcattcaagaaaaagtctgatctgtctgtaaaagatggacatgtttttctgatggagtattgtgaagaaaggcctttacttttgagcaatgttggaatgggtgcaagactttgtacatactatcaaaaatgctcaccagatgaccaatctggctccttattacgcaacacagatagtagattggggcacattatttccctggatcctgctgataaatttcctttccttggagatttaaagcctggttgcagtcagtcatcactagagacaaatatgtatagagcacccatatttccccataaagttccattaactgactacctgctggttcgttcatcaaagggaaagctatcattaaggcgcattgataaaattaatgttgtcggacagcaggagcctctcatggaggtattatcacctggaagtaaaaatcttcagacttacatgatgaacaggctattggtacacatgtgccgtgaattccaagcagcagagaagcgacatttgcctccgtatattggtgttgatgaatttctctcacagtttccttaccaatcagaagcatcattccgtaagaaaatcaaggaatatgccaatttacagaggggaacaaatggacagtcaattttggttaaaaagcgaaattttcgcatttggtcagaggatgaattgagaaaaatggttacaccagagcttgtttgtgcttacgaaagcatgcaagctagcctctaccgtctaaaacatttaggaattactgaaacacacccgactaatatttcatctgcaatgagtcgtcttcctgatgaagcaatagcattggctgctgcatcacacatcgagagggaactgcagattactccttggaacttgagttgcaattttgttgcctgtacaagccaggttcttcatacatttgcacttgtttaa

SEQ ID NO: 5325 - DNA, 417 bp, Glycine max
  Peptide Sequence Number=SeqID_122103
gttccgaaggttcttccgcaggatccagcggaagaaggttccgaaggttcttccgcgggatccaatggaagaactatgtcttccgcgaatcccgcggaagaacctgcggaaccttcttccaccgtcaacatttcctggtcgcggaagaacctatggaaccttcttccaccgacaacatttcctggtcacggaagaacctgtggaaccttcttccgcaagctacctatctttctcgcggaagaacattcgaaacttcttccgcggagcatgttttggtgttttttggagctggtagagggagagggcattagtgaggatacgcatgaggctgatgttcctctgcgtcgcagacctactgcttcagcacgtaagcaacgggttcgtctgcgtgaggatgtgacagagagacctgaggat

SEQ ID NO: 5326 - DNA, 3629 bp, Glycine max
  Peptide Sequence Number=SeqID_122104
atcccacgtctttagtgaaagatctccattatagtggttttaaagctatttggatgcttgatcctggaataaagcaggaagagggttattttgtatatgataatggttctaaaaaagatgtttgggtccaaaaggaagatggaaatccttatgttggagaggtgtggcctgttcgatgtgtcttccctgactatacacagtcaaaagttcgtgcatggtgggcaaatttagttaaagacttcatatccaaaggtgctgatggtatatggaatgatatgaatgaaccatctatctttaaggatgtaacaaaaacaatgcctgatagcaatgttcatagtggagatagtgaacttggaggctgtcagaatcattctttctatcacaatgtgtatggtcttctgatggcaagatcaacctatgaaggcatgaaactggctaatgaaaagaagcgtccttttgttctttcaagagctggatttgttggcagccaaaggtatgctgcaacatggactggagataatctttcaacctgggagcatcttcatatgagtatctccatggtacttcagctgggacttagtggtcagccactttcaggtgcggatattggtggatttgctggaaatgcatcacctagactttttggaaggtggatgggtgttggttccttgtttcccttttgcagagggcattctgaagcttgcaccactgaccatgtaccttggtcttttggggaagagaggcgctaccgcctgatcccacttatctacactcttttttattttgctcatacatggggcacaccagtggcaacccctactttctttgctgatccaaaagatcctagcctgaggaagcttgaaaattcatttttgcttggtccaatcttagtgtttgcaagcaccttacgtagacagggtttggataagttggagattactttacctaaggggatatggctgaattttgatttcaacgatgcacatccggatttgccagctttatacttaaaaggtggctcgattattcctgtgggcctccctcatgaacatgttgaagaggctaatccttcagatgacttgactctttttgtggctttagatgatcatgggaaagctgaaggtgttctatttgaagatgatggtgatggatacgaattcacaaaaggcaattatttattaacacattatgtggctgaacttaaatcatcagttcttactgtgagtgtccagaaaactgaagggtcatgggaaagacctaaacgccgcctgcatattcaattattgctgggtgggggtgcaatgcttgatacatggggaactgatggagaagttctgcaactaattttgccttcggaagatgaggtgtcggagctagtatctactagtgagaagaattacaaggaccgcttggaaaatgcaactccaattcctgatgtagaagtagaagtagaagtagaagaggtttctggacccatggaaacacagattttaagaattcccattgaacagcaaagtgacatagaagaccatgttagtcagacgcctgaggaggcaagtacgccaactgatggagcgacaaatattgctgattgtagtgacgcattcaagactacagagcttttcccttcccgagatgctgtgctgaattgggctcgagaagttgcaaaagagaatggatttgtccttactattttgaggagtggaaaatatagaccatacaagaatacattatctaaggtgactagttccaaaaaatgtgagtgccccttcaagctaaagggaaaagctttgaacaaggatgaagggtggattgttaaggtaatgtgtggttatcacaaccacgacttaggggaaacattagtggtgggtcattcatatgctggtcgactaactgctgaagagaagtcattggtcattgatatgacaaagaaaatggtggagccgagaaacatactactaacattgaaggatcacaataatgacactactatcaggcatatttacaatgctcgacaagcatatcgatcttctcagaaaggtcctaggacagaaatgcaacacctactaaagttattggaacatgatcaatatgtgtgttggagtagaaaggtggacgattctgatgctatcagagatatattttgggcacatccagatgccatcaaacttttaggttctttccacactgtcttgttccttgacaatacttataaagtcaacaggtatcaattgccactgcttgagattgttggtgttacatccacagagttaacattctctgttgcatttgcttatatggagtcggatgaagttgataacttcacttgggcactacagaagctaagagaactgattgtcaaagacaacgagatgcctccagtaattataactgttagagacattgctctgatggatgcagtgcaggtggtctttcctagctcttctaatttgttatgtcgttttcatataagcaagaatgtgaaggctaaatgcaagttgatagttcatccgaaggagagatatgacttggtgatggatgcatgggatagtgtgatgaattctcccaacgagggtgagtatatgcaacggttgacattacttgaaaaggtttgctcagattttcctacttttggcgattatgtgaaaaatacatggctgattcctcacaaggaaaaatttgttatggcatgggtagatcgagtgatgcatttgggtaacactacaatcgacaggtttgaaacagcacattggaggctggagaacttgcttcaagatagtgggggggatatgtgtagttgttgggatgctgtgaacaacatgattaaattgcaacacacacagattaaggtgtcgtttgagaaaagtataaacattgtggaatacaatgatccattctatagcaagctgcggggatttgtatcaaggaatgcattgagttatatagctgaccattatgaccgagttaagaccgttggtattgatattgatggttctttatgtggatgcacaattagaactacacatggtctaccttgtgcgtgtgaacttgctaagtatagtaggacgtggcacccaattcccttgcaagcaattcatgttcattggaggacattaaacttcagtgaccaagaaatgaacaatgaggggctcgagttagcgttgcaacgtgaagtggatgctttgcacaatcaatttcaggaacttgattatgctggaaaaattactttgaaggccaaattgcgtgaactagcatttcctgatgcaattttaatgtgtccgtctcctgaaaattactttgatgctccaaaggctctggcccatgagagttttgcccaaattccggttgagattcatccttttattgaagacattgtagatgtgaaacagacgagaaatgtgaaagggttggtggatgattcttctgttgctgatggttggtgtggaagcgaaaaggagtggtgcattgagaaggaacaatgcaaggggggtggtggtgctgctgcacattgtgttgcgctgcttgctatctctcatgtgttgtgtctttgttgttgtttctcgctaaatgtgggagagggagatgaagatttgtttgagagtgggaaaaaggttgaatcagatggataa

SEQ ID NO: 5327 - DNA, 411 bp, Glycine max
  Peptide Sequence Number=SeqID_122105
atgaaccatctcgagaatccggcgctccccggtctgcgcggccttgcggaagacgaggaaggcggcgaggaggaaggcgaggaggggccagccgccgcgctcgcagtggaggaggatcagggcgccggggtcggcgaggcaggagtcgcaaaggcggaggaagtggtggaggagggagagggggaggagggggcagccctcgtactgctttgggtagtcgacgacgaatgtggcgtccaggtcgcagaggacgcgggagaaacggctgcggtggtcgccgtcgcgaaagttgagggccacgaaggaggattccgggaagtcctcgtggaggtcagagaggatttggcggaggtagaggctgtacattccgtccgggagtgcctccgtcgagaagcaggaatcgaagactga

SEQ ID NO: 5328 - DNA, 2946 bp, Glycine max
  Peptide Sequence Number=SeqID_122106
atgtggccaggaggaacattggggcggagtggcccccaccggagagggcactgtctttggattgtgttattctcagaggggttcctgggtttgatgggggcaatgggtgcaggccactgtttaggatttttggccggaatttgcttagcagactgtgatgtgattaagattgatattcaatgcctagtgaaaggggatgtggtgttggagtgtgtccatttggatttggatccggagagggaagtgatgatgtttcgggtgatgttcaacacggcgtttattcggtccaacattttgatgctgaattctgagaacttggacattctttgggattcgaaggagcggtatccgaagggcttccgggctgaggttttgtttggggaggttgaaagcataagtcctccaagggctcaaacaagtattttagatggtgaggtgaaaggtggattgcctattgaggcattttcgagggttcaagaactttttagtggtgtagaatgggttgaaagtggggatgctgctgctgcctggctgctcaaacagcttacagtcttaaatgatgccaaagagctttcaaggtttcaaggtagaggaagttggtattcatcacctgctgactctgactctgaaaataatgaatcaagcacagctgatagttcagatgaggcctttgatgttattcccaagtcttatgctgatccttcaaaattattgatatctgacaaccctgatttggtccatttagcttttgagaacaatggtggagattatgtaaatctcacttcaagaacacctgatcagtcattgactgataatgtttcattacctcatcatgctcccagaaaggaatattctccttgttcctctccaccatcaccttcaccagttcccgctactcaaccttttccaacaccggcaccaccacttcccacatcaatgcctatacagccagatttagctcctcccttgcctccgcatcagatagatcagaatgtgaacagtgcttctacattgccttcacctcctcctcctatagtttccaatgctcctagtcaatctccaccgcctcctcctcctcctccacttcctccacgatctgtacaaactggttcagctccacctcctccaggacctgtacgaacaggctcggtaccaccgcctccacctcctccaggatctgtaaaaactggttcagctccaccacctccacctcctccaagtccagtacgaacaggttcagccccaccgccacctccacctcctccatgtcctgtacgagcaggttcagccccatctcctcctcctcctcctcctcctcctccaggtcctgtacgaacaggttcagccctacctcctcctcctcctcctccacctcctccaggtcctgtacgaacaggttcagccccacctcctcctcctcctcctcctccaggtcctgtacgaacaggttcagctccaccacctcctccccctccaagtgtacgaacaggttcaactccaccaccaccaccaccggcaccaaaacctccaggtgttcttcctcctccacctggccgtggtgcatcaccgatgccacctccaccacctgcagctagggcccctggtgtggcaccaccaccaggcaaagcttcaacagcaaatgttggaagaggtcgtggtactggtggtactgttaatgctcctaagaaaactttgctaaaacccctacactgggtgaaagttgctcgagcagccaagggaagtctatgggctgattcacagaaacaggatagtggaacaagggctcctgagatagatatttcagaacttgagagcctgttttcagcagcatctacttctgatgggagcagcactaaaggtggaggtcggcgtggtcctaatattaacaaacctgagaaagtacaattggttgatttgcgtagagcatataattgtgaaataatgctctctaaaatcaaaattcctttgccagatatgcttaaagcagtcctggcattggattctgcaattctggatattgatcaggttgagaatctcatcaagttctgtcctacaaaggaagagatggagatgttaaagaattatacaggaaacaaggaaatgcttggaaagtgtgaacagttttttatggagctgatgaaggttccacgtgtggaatccaaattaagggtttttgcttttaaaatcaccttttcttctcaggtgaatgatttgaagttaaatttgaacacaatcaacaatgcagccagagaggtactgtttaattgctcttggttgacaaacatggaggtgaaagaatctggaaaattgcgtcaaataatgcagaccattcttactctgggcaatgccttgaatcaaggaacaacacgaggatcagctgttggattcaaattggatagccttcttaaattatctgatacccgtgcaagaaataacaaaatgactttaatgcattatttgtgtaagcttcttgctgagaaaatgccagaattgctagattttgataaggatcttgtccatttggaagcagcttctaggattcaactaaaagcattggctgaagaaatgcaagctgtgagtaaaggtttagagaaagttgagcaagaactcgctgcttctgaaaatgatggtgctatatctacaggatttcgtaaggtgttgaagaattttcttgatattgctgaagctgatgtgaggtctcttatatcattgtattctgaagtgggaagaagtgcagactctttgtcccagtactttggagaggatccagctagatgcccttttgaacaagtgacacaaatccttgttgtctttgtcaagatgttcaacaagtcaagggaggaaaatgaaaggcaggcggatgctgaaaaaaagaaattagagaaagaagccttgaaggaaaggacagcaaataacttgcattccaaaaaagatggtgttcgatag

SEQ ID NO: 5329 - DNA, 864 bp, Glycine max
  Peptide Sequence Number=SeqID_122107
gttacagcagcagaccagagagaatgccaggagatttgggttcgacaagttcaaagtctgtcagctgtaaatggtgatgaaaatgagagtgattcagaagggaatagtgatttggattcttttgctggagatctggaaaatttacttgatgctgaggagtgtgaagagggagaagagggtaccaatgacttaaaacgtgataagggagatggcgttaagggtcttaaaatgagaagacgcccaactttagctcaggcagaggaggaaatagaagatgaagcagctgaggctgctgaattatgcaggctgcttatggatgattatgaagctgacagaaagaaaaagaagaaagctaaagttatggtgggagaagcaagattggtaccgaagatgcaatcaaaattttcctttgacaatgctgaacaagttaagcaaataactaatactttacaattagatggaactaatcacttgaaagaggatgcaatcacagatcttagggaggaggaaaacgttcctgctaaaaaaagcaaatcactgaaggtcaataaagccaagaagaatgatattatgcctattagaggtcagcaagaggaatggtgtaaggaattatggaagataaaaatccctagtaagattgcggtttttgcttggtggctgttaagggacaaattaccaacaaagaagaatctgctcaggagacaaatgcagattcaggatatgtgttgccctttttgcagaggtgctgaggaggaggcctacacaacattttctccagcatataggtatacagacagaaggattaagaggcaagagatggaggtattggtggttggcgataacatgggctatttggaagcttag

SEQ ID NO: 5330 - DNA, 174 bp, Glycine max
  Peptide Sequence Number=SeqID_122108
atggcaagcttcttcttcaacgctttgaaatttggttcccttcttctcctccacagcgttaatggccgtaggatagactacatgagtgatgtgtggtggctgaggttgaagacgaaggttcttccgcgagaagaaccttcttccacgcatgtggaaggggcagttggatattga

SEQ ID NO: 5331 - DNA, 1044 bp, Glycine max
  Peptide Sequence Number=SeqID_122109
atggagatatggaagcaaagtccattgccctgtttacgacatagtcgtcggaactggggtgaggtcagcaaccccaaattcgcatcatggttcccttgtagttcaaccaactgcccctcatggaataactgcatacaaaacgtgttaaacctcacaaaagctagtgcattccaggtgttgaccgtttcctaccatgaccttcaatggtgtggtgtcacgacagggaagaccgagctgggtaacgagagcctgttgaataaaattgtgggtgctccccccatccaccaacaggagcacgacctggccggcgattgttgcaatcaaacaaagtgtttccggtgcaacgtggcccgcgagcgaattaaagttgatttaggtcaggtgaaccaaagcccacgctcggggcgtgaggccaattccttcagtgtcaagcatcaaattgtcagagctggaggtgagcgcgatgaagaaggcaacagaggcggtaaaggcggaagacaaggggagggtagtgaaagtggtggcgagggtggcggtggtgacggtcgggatcgtggtggcaggcgggaatcatggagcttctcttcttacaagcgcgcaaggcctgcagcctggaccaacctcagaagaaacggagccggaataccaacgacgcgattagccaagtcttcaaactcatacagtttgaacaatgagcctgtggggtcttcgtactgggatggggcaaacctagtttgcagagcttgtagaaaaataggtcaagaagtaaattggtcgttgcttgtcatccattggaaccaagcaaaggcccttccttccatatccaaccaagtgggtcagtgccatcgaatctgggcacctctaacttcattttgtgggttgatgcaagaacaggttggcggtggtggaggtggtggggagaaggtgaggcgaaacaaaacatccccaaggcggtctgatggaggagaaatgtttgcagaatcagtcatgggagcaacaacgagaacaccaaatgataggcctcatggtgcctgctgtatttga

SEQ ID NO: 5332 - DNA, 1371 bp, Glycine max
  misc_feature (1318)..(1318): n is a, c, g, or t
  Peptide Sequence Number=SeqID_122110
atgggattcgactacaccattcagtatcgttctggcaaccataatcaggaagctgacgccttgtcgcgattgccagagcaagaccaagcaacatttatgattttatcaatgccctgtttaacattcatggaggaacttcgcagacagcttgctaaccaccagagtaccaacatcagcttcaacaaatccttaccacgtggacttccattgatcgccactttgcttactgaatatcatgccacacctaccagaggtcatactggagttgctaagaccatagcttgggtgttagagaacttctactggtcaggactccacgaggatgttgctcaatttgtggctaagtgcgtggactatcaagtaacaaaatatgaagccaagaggctagcgggtttattgtgtcccctttccgttccttctcgaccatgggtggacctgtcattagatttcatcgtcggcttacccccttatcatggtaacaccgtgattctcgtcattgtggataagttctccaaggggatccatttgggtatgttaccagtgactcacactgcactcatgggacccgttgttcatcaacagattttggcaagaactcttctgtttgagtggcacccaactgcgaatgagttgaggctatcaccctcaaatgcttggggcaagcttctcccatgggtcgagtggtcccataatacatcatggaatgcaggtacaggcaccactccatttgagataaccttcggccggaagtcctttaattttccagaatacattgcggggattgcaaaggcaattcgaaagaagctcttgaaagctcaagaacgcatgaagacatatgctgatatgaagcgccgggaggcaattacaggcaaattggtgaagaggtattactggccattccaaattaaagagaggataagcccagtggcataccgcctacaattgccgaagggagcgcgaattcaccctgtcttccattgctccatgctcaagccattcaaaggatcaccggaaaagacaaagccaatagagctacccccaacttttactaacaaccaacttcttatctctcccttggcaattctggactatcgtcgcagatcttcagaacctaacgccacttggaaagttttggtgcaatggcacggcctatcctcatacgagacatcttgggaggattggccccagctatgtcaggactttcaccttgaggacaaggtgactttgcaagggtcgagggatgatacagaaacaggggcagcaaagggaatcactcaagcaatgaacacaaaggcagaaacaggggtgcaagtagcanacaaacccaaaaggaggatcactaagcctacatacctcaatgactacgtttga

SEQ ID NO: 5333 - DNA, 1767 bp, Glycine max
  Peptide Sequence Number=SeqID_122111
atggagaataacgagattctagaggagcttctcaacatcgaggttgaaattcaagatgtccaagaacaaataagggctttgatcgagaggcaagagagtttgtacgagagaaaatcggagctgagtgctattctggaagcgtgtaaggaatctggaaacgaggccaataatgcggcttcgagcgctgcggaaaattggagtggggaatttgaatgggattctgaagctgatgatgttaggttgaatgtttttggcatttcctcctaccgtgcaaatcaaagagagataattaatgccattatgagtggaagagatgttctggtgattatggctgcaggtggtggcaagagcctctgctaccagcttcctgctgttcttcgtgatggaattgctctagttgtcagtcctttgctttccttaattcaagatcaggtaatgggtttgaccgctttgggcattccagcgtatatgttgacttcaactaataagggagatgagaagttcatatataagactttggagaagggagagggggaactcaaaatattgtatgtcactccagaaaagatttcaaaaagcaagaggtttatgtcaaaacttgaaaaatgccatcatgctggtcgtctctctctaatttcaattgatgaagcacattgctgtagtcaatggggtcatgactttcgacctgactacaagagcctcagtattctcaagacacagttccctcgtgttcctattgttgctttgactgcaactgctactcagagggtccaaaatgatctgatagagatgttgcatattcctagatgtgtcaaattcgtcagcactgtcaataggccaaacttgttttatatggtaaaggaaaagtcatccgttgggaaggtagtcattgatgaaattgcagaattcattcaagaatcttatccaaataatgaatcagggattgtatattgcttctcaaggaaggaatgtgaacaggttgcaaaggagttgagggagagaggaatttcagctgattattatcatgccgatatggatgtaaatgctcgggaaaaagtccacatgcggaaagtggtcgagctggccgagatggacttccttctgaatgcctactgtactttagacccggtgatgctccacgtcaggcatattgttccattgctgaattatgtgatcaaatgtcataacaattttctcagagctcaatggtcttctacgaaaattcaggactgcagaatctctatgacattgtacgatattgtctgtccaaaagacaatgccgacgaagtgcctttttccatcattttgctgagccacttcaagagtgcaatggctttatatactctcaatgttacagggatgtgcgacatctgtgcattctcaagtgaggtgaaggaagtagatgtctctgaagaatttcagcatacaccttatgccacaaatgcttacattgctgtggggtcattggccaagcaaatattgcaagggaagaaatctgtgaaacttgagatttacactgaacagagaactaaagatggtgtaaggtcagcgaaacagtgtcttgggtcctctggtttggagctaaagcttgatgagctgagaaaagaactgtcctctgctcatggaggaatactcccacactctgtcttgtccactgaacaaatcatccaattagcttctcaaaaaccaaactcgctggaacaggcaagttctaagctatttggagaagctgattggaaaattgaggacagaaaagtatggaaatag

SEQ ID NO: 5334 - DNA, 201 bp, Glycine max
  Peptide Sequence Number=SeqID_122112
atgtatgtgatagtgtcattgggacgctccttaacattcaaggcaaaagtaaggcttcaagaagattttgatgatgccaatagtcaagcatatccaagaccaactcaagaagattttgatttcaagaaagatttgtcttcatggataatttcaagtaaacatcaagcaatccaagatattcaagtaagattgactagatag

SEQ ID NO: 5335 - DNA, 306 bp, Glycine max
  Peptide Sequence Number=SeqID_122113
atgtttctatctttctcagcaattaaagcaaaaacgaccacaaagaaaaaagcaaaacgaccaagtaaagtaaccccgaaaatcggagaggggaattggtatttagcgagaggaaagggtgtgattggcgatgcaataagaggattcggagaaggtgaaagtgaaggaggagaaggggcgaaggggaatcggattcagatgaagcctggtttcattgcgacggaggtgatggaagaagatgaaaccctagcagagcagaaacgcaccgatggaatctatctatctcacgcctcgctagtggaataa

SEQ ID NO: 5336 - DNA, 537 bp, Glycine max
  Peptide Sequence Number=SeqID_122114
atgcaagaagatgaggttttcaaggtttcctcaatgctggaagaggttcagtatacaacattttacttttcatatttcccttggaatgatagactattagctcctgcctttgtcactgaaactgtattttatctttctttgcttgctggacctgaaagggagaggcaactatcagatacagatgtccaatcagcagtgtgggaggtctgtggtgattctggagctttacaatcgcttgttgatcttcttcatgtgaagatgatggatcttgaagagagttctggaacagaggaaaatgaccttgattttctcaagaaaacccttattattgataaccatgaagatagcaaacaatgcacgagcaatttaagcacaaagtcaaatgacttagaggaaccaaagttgatgactagaaacaagtggtctgctatagtatataggtgtggccagaagcagctaactcggttattcttagaagaagcagaacatgctttgcagttatcactgggtgaagaaaaggtcacttctccctgttaa

SEQ ID NO: 5337 - DNA, 456 bp, Glycine max
  Peptide Sequence Number=SeqID_122115
atggatgtcaatgtgtctgcttggggccccaaatcaaaaggggtgacccctctccaccttgctgccgaaggtggtcacattggagtgatggatgtactacttgagcgtggtgctgacattgatgccagaactaagggtgcctgtggctggacaccgctccacattgcagccaaggaaaggaggagggatgctgtgaaattcttgttagagaatggagccttcatgccacctgatatcagtgatagcagatttaacccaccgcttcattactgtcccgggctggaatgggcctacgaggagatgaagcgacttcgtcaagaagatttgtctgctggagagacatcttacagctccgaaaactatgttcagaattcagagccagttcagaaagtattgctattgttatgctgtggtaatatgttttacaaacctgagttcagaattcatgtcttttga

SEQ ID NO: 5338 - DNA, 231 bp, Glycine max
  Peptide Sequence Number=SeqID_122116
atgacgcggggaaagcagaagatcgaagcgcagaagcgaaacgcagagaggaatcagaagggaaagggctctcagctcgaggccagagccgttggcctcaaagtcatctgccccatctgcaaggattacctttgcaatgggtgttgttgggtttcctatccaatggcgtggccccaacccagaattaagtgcatgttacatttgcattttgcaatgcttattggagattag

SEQ ID NO: 5339 - DNA, 375 bp, Glycine max
  Peptide Sequence Number=SeqID_122117
atgcagggaaaagagacatctgacccagagcatggcaagcaatgtccattttttgaagaattgcatgcagtctttacccaaagggcacataacatgcaacgattacttcttgaatctgaaactcgttcagctcaaaccaataaaggggtgaaaagatcaagtggagaacagtcatcaggggaactctcagaagatgacgatgaggttgaatacgacagtgaagaggaaaaaccttccagaagcaatacccgcaaaaggaaagttgacaaagttggagtggagaagtcttcaagggcaaacagtccatcaaatgctgccaagaaaattggaaaggagaatctggttgatgaaaggagtatttataggggcatatga

SEQ ID NO: 5340 - DNA, 507 bp, Glycine max
  Peptide Sequence Number=SeqID_122118
atgcctcgttcttatgtatttccagaaatgcaagatgctcatgacatttgcattcgagaagctgatgaaaaaaggaagttaattgcaggaagccatgttaagaaatctgacaatcagaccaaagaagggacatgtaacccaatgacaggagacactgtttgggttgagggtcttgtccctggcattgacttttgtaaccatgcgataagggtatcatatatagttacatacaatctgaagccaatagcaacatgggaagttgatggaactggtttagcatcgggagttcctttctccatgtatcttatctctgctgctcaaagtcccttgcagattgatcaagaaatctacattagttatggaaacaagggaaatgaggaacttctatatctgtatggttttgtcattgatgataacacagatgactatctcatggtccactatccagcagaagcaattaatacaatttctttttctgagtccaaaacccagcttcttgaagtgcag

SEQ ID NO: 5341 - DNA, 1050 bp, Glycine max
  Peptide Sequence Number=SeqID_122119
atggggctttacttgctgcaagactatgatggtttggctttggggagtaaatttgtgggtatttctgcaatccacttaaaggatttggaagatgtgtcaatagcatggattgatgctgctgctacttgtagcacttggatgacaatcattgtccctactagcatgactgcttacctctatctctattctcatggggaagtgcttctctacattcttgttgcagtaattttgatctttccctttgatattttctatttgtcttctcgttacttctttttgaggacattatttcggatagctttcccttttcagccaattacatttcccgactttttcttggctgatattttaacctccatggcaaaggtgttttcagatttggaacgttcagtttgcagaatggtaaacagacaggtcgcgacaattgcttggcttgaagctgattcagtttgtggtagtcactcagttgcaataccaatagcccttgttcttccttatatatggcgtttattccaatgtcttcgccagtacagagataccaaagaaaaaaattgtctcttcaatgctttaaaatattcaactgcagtcccagtaatttttctttctgccctcaagtaccatgtcctccatgagaaatggacaactctttatcggccactgtggcttctctcaagtgtcattaattccctatattcgttttactgggatataaccagagattgggatttaagtggcttttcccgcatattcaagttcaacaaatcaaatccaatctccaacctgttatacggtcgacaatgggtatacttttgggtgattggaagcaactttgttctgcgctgctcttggacatacaaattatctgcccatctccgccataactacctgacagtgtttactatcactcttttggagatgtttcgacgcttccagtgggtattttttagagttgaaaatgagtggaataagatcacgcggtctggtgttcaactcacagaaattccaagagaggaggagaaattgctaggttccaacattcacgatgtatag

SEQ ID NO: 5342 - DNA, 417 bp, Glycine max
  Peptide Sequence Number=SeqID_122120
atggcaagctcagaagaagcaaagctcgaaactttcatgcagtggctacaggcaaatggggtggagctacgaggttgcaagatcaagtggtgtgattccaaacgagggtttggcatcttttctgataaagatgtttctgatgatttagcaattactccaatgagggtgttgcaagatcctcttctaggaccagcatgtagagcaatgtttgaagaaggagatgtagacgacaggtatcttgatatacttccaaccacttttgggaatccactttggtttagtgatgatgaacttcaagagctaagaggaacaacattatatcgtgcaactgagttgcagtatattttcttgatgaatactaaatacttgaatgacattgaaggagcatgcactagatacaatatgaaaattgcctag

SEQ ID NO: 5343 - DNA, 192 bp, Glycine max
  Peptide Sequence Number=SeqID_122121
atggattatggaggtggattactgaaaattttggatgggacaacccctccttttaagaggcgaagctttagtttacagatgtgtatggtgctcatcctcatcctcgccctcctgcgactgcctctggctgcggcgacgctgagaaaatttgatttcaaattcatcctcgtcctcgttgtcgcagagcattga

SEQ ID NO: 5344 - DNA, 219 bp, Glycine max
  Peptide Sequence Number=SeqID_122122
atgttgcggaactttacggattacctaacgatagaggttaagtacctcgaggcggtcaagcgaaggtttcatgccaccaaacaatggtccccgaatgaaattagggtgagcaggtctatggacacccccttgaagcaacaacctagtttgggggaaaacctagaaaattttctagctcctgcgggtgtgatcaatgtaggagatcatcaagatcacaat

SEQ ID NO: 5345 - DNA, 228 bp, Glycine max
  Peptide Sequence Number=SeqID_122123
atggagttcgtctttgtcgagttcgtctctgccacttatcaattgagctcgaagaaaactaggaaaggaaagagtcccggaaaaggtgggaatcgattttggaagtccattgtggttggctttaagactcccagggaagtcatcaaaggtgatttcttcgtcttctttagtcgctgtcaaggtttgttgttgattgtgttgtgtgtgctggttagtgatcagtgctga

SEQ ID NO: 5346 - DNA, 459 bp, Glycine max
  Peptide Sequence Number=SeqID_122124
atgacttcacattcatcatcggctacaagcaagggcctatcaaactggttggcagcaatatggttttcggccgcattccgtgtttccaagaacatcattgaggttccattgtcttaccatagacaatggaggccatattacccgacccgatactttttttctgatgggctaaagcagtttagaagaactcacgacattgacgacagtgtcatcatgcggttttttattgctgacaaaaatacttccttcgaggtggatgtcattggacctatccataggcagggctgtccaaggtcggttctggcaaccaggagacacatctttacacccgatgtcactgaacacatgatgcaacacaacttccctttggtccttccaccagcagctttaaattttttgtttggatcacaaaaagtaattcctgttcggagaggctatggcaaacgcaaccaatggtag

SEQ ID NO: 5347 - DNA, 873 bp, Glycine max
  Peptide Sequence Number=SeqID_122125
atgctggatgaaaacaatgctcatgcaaagagtttcaggatggcaagggatagattgacaggcactgaagtgcataatgtcaaactcaaattgatctttggtcgggaaaaagatggtcgtacatataatgtaccaagtgttccagatgttgctgcacttattgcagaagatggatataggcctgacattctacatcgtgatacattaagtgggaaaaaaagaaaaaggaattgtcttacaatgagagagtggtttgcttatagactgcaatgcagacccaatgaaggtcaaactctactgcattctagaaaactattccaacaatttgttgctgaaggatacacaatgattgaatcagaaagactttcctatgttagaaaaaaccaaaagaaactcagagttgacaagttctgtagcttgcagcagtcatcggatgctggaaatacaaaaggtttaagtaaaggcaagaggatcatcttaccttcaacctttgttggcagcccacgttacatggatcaactttattttgatggcatagctatatgcagtcacgtaggcttcccaaatctttttattacttttacctgcaatccaaattggcctgaaattcataggttgctgacacctttgaatttgacagcaatagataagccagaaataatctcccgaattttcaagcttaaatatgagcatatgttatcagaccttacaaagaatcacttactagggaaagtcgttgcatacatgtacacaatcgaattccaaaaacgaggacttcctcatgtccatttattgttatttttacacgccatcaacaaatatccatctccaaacgatattgatcatattatatcagcagaaataccttcatag

SEQ ID NO: 5348 - DNA, 384 bp, Glycine max
  Peptide Sequence Number=SeqID_122126
gaactgcaaaaggccgttgagaatgcctcggagttgctgaaggagttcaataccagcgtggcggagtacacaagcttcgctgacacgaaatccattcctgggcattacgtgatttactgggagctcatgatgaaggactcgtctcaccctccaacgaaccaagttctgaaccagtgctgcttggtgatggaagagtcgctgaactccgtctatagacaagggagagttgccgataactctattgggccgttggagatacgagtggtgaagaatggaacgtttgaggagttgatggactacgctatctcgcgtggtgcgtcgataaaccagtacaaagtgccaagcccagctgcaccgcactggaccccagaacgacgtcgttga

SEQ ID NO: 5349 - DNA, 180 bp, Glycine max
  Peptide Sequence Number=SeqID_122127
atgggcaccatcaagtgcaatgaccatggacaaattaaagcgcctaagcatcccgacagcgaatgcttagattttttaaccacactagtcccccacgaatgggccatccaacaaggaaaattcaacatgcaacagggacagacaattattctcatagctaagttccctgaccttaactag

SEQ ID NO: 5350 - DNA, 306 bp, Glycine max
  Peptide Sequence Number=SeqID_122128
atggcggtttccaaactcataaatgatgtaaagaactatggttaccttgaaggaaaacgaaaggttagatcaggcttcgctctcaaccgaaatcgcaaggcaagttggaagattccacttcggttgaagggtttctctcggtgtggggtttcaacggagaacaatggcggtttgtggtggctactggttgctgtggatgatggagaaagtgcttgggatgttggaaatggttttggaagaaagaaggagaagaaatggcgtttttccaattctaattggactacaaggctcaaaacgcacaagtga

SEQ ID NO: 5351 - DNA, 2051 bp, Glycine max
  Peptide Sequence Number=SeqID_122129
atggcgctgggctctgctatcggtaccggtcttttttatggctcggcagatgccatcaaaatggccggtcccagcgttctgctggcctatatcatcggcggcgtggcggcgtatatcatcatgcgcgccctcggtgaaatgtctgttcacaatccgtccgccagctcattctcgcgctatgcgcaggaaaacctcggcccgctggccgggttcatcaccggctggacctactgtttcgaaattctgattgtggcgatcgccgacgtaacggcgtttggcatctatatgggcgtctggttcccggcggtgccgcactggatttgggtcctgagcgtggtgctgatcatctgtgccgttaacctgatgagcgtgaaggtgtttggcgaactggagttctggttctcattcttcaaagtcgccaccatcatcatcatgattgtggccggtttcggcatcatcatctgggggatcggcaacggcggtcagccaaccggtatccataacctctggagtaacggcggcttcttcagtaacggctggctggggatggtgatgtcgctgcagatggtgatgttcgcctacggcggaattgagattatcggtatcaccgccggtgaagcgaaggatccggaaaaatccattccgcgggcgattaattcggtgccgatgcgtatcctggtgttctacgtggggacgctgttcgtcattatgtctatctatccctggaacctggtggggactaacggcagcccgttcgtgttgaccttccagcatatgggaattacctttgccgccggcatcctgaacttcgtggtgttaaccgcctcgctatcggcgattaacagcgacgtattcggcgttggccgtatgctgcacggaatggccgagcaggggagcgcgccgaaagtgttcgccaaaacgtcgcgtcgcggtacgccgtgggtgacggtgctggtgatgaccgtggcgctgctgtttgcggtctatctcaactacatcatgccggaaaacgtcttcctggtgattgcgtcgttggcgaccttcgccacggtgtgggtgtggattatgatcctgctgtcgcaaatcgctttccgtcgccgcctgtcgccggaagaggtgaaagcgctgaagtttaaagtaccgggcggcgtggccaccaccgtggtcggcctgctgttcctggtctttatcatcgcgcttatcggctaccatccggatacccgcatttcgctgtacgtcggctttgcgtggatcgtgctgctgctggttggctggaaaattaagacccgccgcgatcgccagttagcgcaggcgcattatacgcctgttcactgtggcaaggtgtggccattacgcaaaaagaggaatgatgatgttgaaggcctggcacctgccgaagaagacaatgaagagctgtcgttgcccatgcagcgcctgcgccaatccccacacgccgatgtcgtcgcctggcgtggagagataaacctgatgaacggccagccgcgccgccgctatagctttaagctgctgtgggcggaccgtcagttgtggtttacgccgcagggattccagcgtttcccgcccgcgaggctggagcagtttgcggtcgatgtgccggatagcggcccgcagtgggtccccgatcaggtcttttatcaaattttccccgatcgtttcgcccgtagcgaggcgcgagaagccgggcaggacgaggtttattaccaccatgcggccggtcaggatattgtgctaaaagcgtgggatgagccgttaaccggcgaggcgggcggttcgaccttttatggcggcgacctcgacggtattagcgagaagcttccttatctgaagcagcttggcgtgactgcgctgtatctcaatccggtattcgtcgcgcccagcgtacataaatacgataccgctgattaccgccgtgtcgatccgcagttcggtggcgatgccgcgctgctgcgcctgcgccacaatacgcagcgtgaagggatgcgcctgatcctcgacggcgtgtttaaccataccggtgattcgcacccgtg

SEQ ID NO: 5352 - DNA, 1938 bp, Glycine max
  Peptide Sequence Number=SeqID_122130
atggcgtcgctatggactcaactaatctccatggcctccctacttctatcccttgcgcggtgggtacctgtctccggtgactccagcaacgtgttactcttaccaagtcctcatcacgagggctctcgccctgccatgattctccccctacatcactccgttcccgattcttccttctctcactttaatccacgtcgtcaactcaaggaatccgactcagaacaccatcccaacgctcgcatgagactgtacgatgatctccttcgaaacggctactatacggcgcggctttggatcggcactcctccgcagaggtttgctcttattgttgatacggggagtactgttacctatgttccgtgctctacttgtagacactgtggtagccaccaggatccaaagttccgaccagaagattcagaaacctatcaacctgttaaatgcacatggcagtgcaactgtgacaatgacaggaagcagtgcacgtatgagagacggtatgctgaaatgagtactagcagtggggcccttggtgaggatgttgtatcctttggaaatcagactgagctttccccccaacgtgccatttttggctgtgaaaatgatgagactggtgatatttataatcagcgtgctgatggcatcatgggtttgggccgtggagatctaagtattatggaccaactggttgagaaaaaggtgataagtgattcgttctcactgtgctatggtggaatgggtgttggtggtggtgctatggttcttggtggcatatctcccccagctgacatggtctttacacgttcagatcctgttcgaagtccatattacaatattgatttgaaggagatacatgttgcggggaagcgactgcatttaaacccaaaggtttttgatggaaaacatggaactgtcttggatagtggcacaacttatgcatacctaccagaatctgcatttcttgcatttaaacatgctattatgaaggaaacacattcgttgaagcgaataagtggtccagatccacgttataatgatatatgtttttctggtgcagaaattgatgtctctcaaatctctaaaagctttccggtggttgaaatggtatttggaaatggtcacaagttgtcactgtctcctgaaaattacttgtttcggcattcaaaagtgcgaggtgcgtattgtctaggggttttttcaaatggcaatgatccaactactcttttaggaggtattgttgttcgtaacactcttgtaatgtatgatcgtgagcatacaaaaattggtttctggaaaactaattgttctgagttatgggaaagactacatgtgtcagatgccccaccacccttgttgcctccaaaatctgagggaacaaatttaaccaaatcatttgagccctctattgctccatctccatcacagtataatttacagctaggtgaactccaaattgctcaaataatagttgttatttcgtttaacatcagctacatggatatgaagccttacatcacagaattgactggactcattgctcatgaattagatgttaatagttcacaggttcacttaatgaatttttcttctcttggaaatggttctctctctaaatgggtcataacaccgaggccatatgctgatttcttttctaatgctactgcaatgagtatgattgcccggctttctgaacatcgtatgcaacttcctaactcagttggaagttataagttagttgattggaatgccgagcctccattgaaacggacttggtggcagcaatattatttggttgtggctttagctgttttgcttacattcgttctaggaatatcaaccttaggaatattcttaatttggaaaaaaagacagcaagctgagcactcatacaagccagttgatgtagctgttcaagagcaggaacttcagccattatga

SEQ ID NO: 5353 - DNA, 369 bp, Glycine max
  Peptide Sequence Number=SeqID_122131
gcgcatggtggcgacccgcaggccccagatgcaccgccaccacctcatcaggctgatccagctgggtcatttgacacggagtggtatttatggcatttggttcgcccgcaggcggccaaccacagggcgcacatgcagacccatgactgtctctaccagctcagcctcagtctgcagagccagggtttcgctccttttccgtgccttactctggatcagttcagggcagaggtcgcatggcccggagattggcctgaggcccaggcaagggaggcgcccgcagaggctcccgacgatgcagatgaggcccgcatggacgaggagatgacagatttactcgatttcttgggacggagcggagccacatga

SEQ ID NO: 5354 - DNA, 546 bp, Glycine max
  Peptide Sequence Number=SeqID_122132
atgcctctcactgacgaccaagaacacatcctcgcgttaagtggcctctggaaaatcgccataaccaaccccaatgatccagagtttccttcccttggcatcttcagatgcatggtcaagttgattcaaaaaggggtgaatcacaaagattggctccttaggtgtcagaacatgtataccccttattacgcagcgcatatcattggttcttacaccatgaacaaacccaagtttgctgacaagtctgttaagtccaacgtggttcagccgctgattgagcttctccgggcaagattagttggcttgagcaaagagttgcacttcgcgcactgggtcatttggccagccatgaagcaacttttgaagccgttgctgaacacgaagctgaagtgggaaagatctctgggactaatctgcaaaaaaaaattcttgaaggacttgtgtggaatgtggggtggtttggcaaacccaacatcacctgctggaataggacttctcagaactctgtgtgacacccaaatagcagagaaaatgttgcagatttag

SEQ ID NO: 5355 - DNA, 681 bp, Glycine max
  Peptide Sequence Number=SeqID_122133
atggaatcctggcttgatcccggagctcctaccggaggagcgggagggccaagcaatgacggcgacggtgctggtgcagtgtgcttcttactcttctttgtcttcttctttgacttgggagcgggtgccggaacctcagcgctgggtgctaccacgggtgcgggagttgtcggtgcgagtgcaggtggagagctcaccggaacaggagcaggtggagaactcaccggaactggcgctggcggcgaactcactggagtcacggcaggaggtgtggctgccggtggtgtagccgcaggaggagtggctgcgggaggtgtagccaccggagctggagcggcagctttagacggaggagatgctactgtgggagatgaagcgggtggggttgcggttgcagcattgggggacgaagctggtggagatgatgacgtgggagaagcaactggcgccggtgattttggcttagaaggggctgtggctggggatgcaaagggagtggtggtggcagccggaggagaagtggtgggcgacgccgctggagactgtcctccgacggcggcgacgacaatggcgatgattgcgagggagaggaggcttttccgatccattatagaagtgtgtttgagtttgagaatagagcgagtgagaagatttataaacagaggacccttccctccctag

SEQ ID NO: 5356 - DNA, 294 bp, Glycine max
  Peptide Sequence Number=SeqID_122134
atgatgctcaatgccttgtggtattacgatcagccgctaaggtgcttcacgtttggggactttcttctagtaccaactgtggaagagtttgaagagatcttgggatgtccgctaggaggaagaaagccatatcttttttctgggttctatccatccatggtgagaatagccaaggtagtcaaaatctcggtgcaagaattggaccgagtaaaacaaaatagaaatggggtggtcggaataccgaggaagcacttggaggagaaagcgaaggctttggcggatcaaggtgaatga

SEQ ID NO: 5357 - DNA, 1530 bp, Glycine max
  Peptide Sequence Number=SeqID_122135
atgggattatggttttatcttcttgcatgtatttctacctatatacttcttcaatcccttcacaaagtcatccgcaataagaggctaccaccaagccctcctgccatacccatcttaggtaacatattttggctccttaagtcatcaaagaattttgctgatcttgaacctgtccttcgctctttacgttccaagtacggtaacattgtttccattcacattggttctacaccttccattttcataacatgtcacgaagctgctcatagagcacttgttaaaaatggcactatctttgctgatcgtcctttggctcttcaaaccacccaagttttcttccctaaccaatacaccgttactacttctccctatggccacaattggaggtttatgcgccaaaacttaatgcaagtaattcaaccttctagattaagtttatattctcattgtcgaaaatgggcattaagtatattaaagaaacatattctagatgaaattgagctggggaataaggccatagcaattgatagttatttcaattctacattatatgctttattttcatatatatgttttggagacaaatttgatgaggaaaccgttaggaatatccagagggtgcaacattgttttcttcacaatttcattaaattcaatgtgttgaatttcgtaccggtcttgtctaagatcgtgtttaggagattgtggagagagatcttgggaattcgtcaaagtcaggtgaatgtgttcctccctatcataaaagcacgccatgagaaaataaaaggcaaggtaggtgttaaagatgagaatgaagaagagtttaagccttatgtggataccctttttgatatgaaactccctagcaatggatgcaagctaaaggatgaagagttggtgagtatgtgtgctgagtttatgataggtggcacagacacaacggttacgacgtggatatggaccatggcgaatttagtgaagtaccaacacatacaagagaagttgtttgatgaaattaaggaagttgtggaacctgatgaggacattgaggtggagcatttgaaaaggatgccttatttgaaggctgtggtgttagagaccttaaggaggcaccctccggggcattttatattgcctagggcagtcacacaggacactgttatggacggtcatgatataccaaaaaatgcaattgtgaattttcttgtggctgaatttgggtgggatccaaatgtgtgggaagatcctatggagtttaaaccagagaggtttttgaggcatggtggagattctaaatttgatctgaaagggactatagagatcaaaatgatgccttttggtgcaggaaggagagtttgtcctgcaattagtatggcaacacttcaccttgagtactttgtggccaatttggtgagggattttaaatgggcacttgaagatgggtgtgaagttgacatgagtgagaagcaggccttcactattgtgatgaagaatcctttgagaccatgtgtgtctctaagaagcacttga

SEQ ID NO: 5358 - DNA, 420 bp, Glycine max
  Peptide Sequence Number=SeqID_122136
atggtgaaaaattgggacttgaaacagacccttgctcggattgggactttggttgtttgtggaagaaaaagtgagagctttggttttggagggagggaagaatttgaggttgcggaaacggtttcgaggtgggaggggagaagggattcgtcggtgaagccggagaagttgatggcggagacttgctccaaaacgactgcgtcttgggccagcgaggatggcggagtcgttgtcgttgtcggtgtcggagaggtcgtagaatcccaccatcgttgttgttttgttgtggagtgtggggtccacccgcgcattcttagggacacactacccctcttcctacttggggattttttttgggtggcaaactcaaaaatagaagattttgggaaggcaaaactttctcaactcactcctaaataa

SEQ ID NO: 5359 - DNA, 988 bp, Glycine max
  Peptide Sequence Number=SeqID_122137
tgcatcagcaactgtgggagctctacttttggtggcacttatgtgcttctggggttgttttctttataagaagtttggcaaaaatgacagaataagtctggcgatggatgttggttcaggtgcatcaattgtgatgtttcacggagacctaccatattcttcaaaagacatcattaagaaactagagactttgaatgaggaacacataatagggatagggggatttggaactgtttacaagctagcaatggatgatgggaatgtatttgctttgaaaaggattgtaaagctgaatgaggggtttgatcgtttttttgagagggagcttgaaattcttggtagcatcaaacaccgttatctagtgaatttacgaggatattgcaattcacctacgtcaaagttgttaatatatgattacctaccaggtggtagtcttgacgaagcacttcatgaaagagctgatcaactagactgggattcgcgcttgaatataatcatgggagctgcaaaagggcttgcctacttgcaccatgattgttcccccaggatcatacaccgagacataaaatctagcaacattttacttgatggaaacttggaggctcgggtctctgattttggacttgccaaacttctggaggatgaagaatctcacatcaccactattgttgctggaacatttggttatctagctccagagtatatgcaaagtggcagagcaactgagaagtctgatgtgtatagctttggtgtgttgacactcgaagtgctgagtggaaagcgaccaacagacgcagcattcattgaaaagggcctcaatattgttggggtgcaaatggagagccttgatgccttgctctctgtggctattcagtgtgtttcctcaagtccagaggatcgacccactatgcaccgagtggtgcaattgcttgaatcagaggtcgtaactccatgccctagtgacttctacgactccaactccgattag

SEQ ID NO: 5360 - DNA, 216 bp, Glycine max
  Peptide Sequence Number=SeqID_122138
atggacgaattaaagcgcctaagcatcccctcagaaatgcttaaattctttaaccactctattttcccccaccagggacatccgacaagggacatccgacaaggtcaatgcaccccccatgaacatacacaacatgcacatgtcaatgcatttccaacatcatcaacattccatttccatatcatactcaacataaacatcatctcatctctatga

SEQ ID NO: 5361 - DNA, 308 bp, Glycine max
  Peptide Sequence Number=SeqID_122139
catgttgcttttgcttctcctcctccaccaagaagagtgttgcaaggaatggtaaaagaagcactggagtgttgagttcagaacacgttgttgagtggggaaagaatgatgaaatactctcagacatgagcaccttttcggtgaaagaacaagaaagtaggttgaagaaagcgttggaagaggaagagagggtaagcaaggaagcagagaggcttgtcaaatgggtgaaacaggaatcagctagaattgatgtttctacaatcaaatcaattctcagtgacgatgaaaatgaagcaaatgttaagtaa

SEQ ID NO: 5362 - DNA, 942 bp, Glycine max
  Peptide Sequence Number=SeqID_122140
atgggtcagctccaacatcaagccttctgcaaggcctatgggaagatttgggacctagctacggtagaagtctttgtggaagcaattgcatcccttaccaagtactatgaccagcccctaaggtgcttcacatttagggacttccagctagtaccgactatggaagagtttgaagaaatcctgggatgttcgcttggagagagaaagccatatctctttttggggttctatcccttcatggaaagggtagcaaaggtagttaaaatctcggtgcaagagttagaccgtgtgaagcaaaataggaatggggtagtcggaataccaaggaaacatttggagggaaaggcgaaggcattggccgatcaaggagaatgggttccatttattaacacctttgcactattgatatttggagtcgtcctctttccaaatatggaagggttagtgaacctagcagctattgatgctttccttgcttatcaccatagcaaggaaagcccggccatcgctattttggccgatcactatgacacgttcatccgaagatgcaaaaagagcagcacaagaattgtttgttgtataccagctctctatgtgtggctcatctcacacctttttcgccaagaaagtaggccaatctgtccactacaaggtttcaatgaccccaacgcgagggtacttcaaggagtccgcaaggcatgggatgcggcacaaaagaaggacaaagagcttaggggaagcagtaatggggtcatcagcggctatcataagtggctgagagtccggacacaagggttggattggcccccaaagctaaaggctgcaagagaggaagaggctgaagctccggaagaaagtgaagaggtacaagccctaaaggtggagctcgaaaaagcccgagcagtcaaagagaagttcaagtcaacgaccatcaaagtctga

SEQ ID NO: 5363 - DNA, 1731 bp, Glycine max
  Peptide Sequence Number=SeqID_122141
atggcggggcaatcgcggaagtggatgatcctggtggccagcatatggattcaggcattcaccggcaccaacttcgacttctccgagtactcctcttccttgaaatcccatctcaacatctctcagctgcaactcaactacctcgccaccgccagcgacatgggcaaggtcttcggttggtcctctggcctcgctctcatccacttaccgctctccctcgtcttgctcatcgcctcctccatgggcttcatcggctacggcctccagtggctcgccatcaaaaatctcatcaccttgccttattctctctactttcttctgtgtctgttgagtggttgtagcatctgttggttcaacacagtatgttttgttctctgcattaggaatttcccggttaacagaccccttgcattatcactcactgtgagcttcaatggtgtgagtgcagcactctacacacttgctgccaattcaatagacccttcatctgatgcactgtatctgctcctgaatgcccttgttcctcttctcacttcccttgtagcactagtcccaattcttctccaaccccctttagactctctcaatagatctccagaagcttctcgcaggaactctgtgatatttctagtactcaacttcctagccattttcactggtatttacctcctcctctttggctcaacaacttgtgatgaatccacgtcgaggctctactttggtggtgccattttgctcctcatttccccactatgtatccctggaactatatatgctcgagattggtttcaccatgccatccattccagctttcggatggaaggttccggcttcattcttgttcatgttgatgatcttgagcttcataaggaactcctcacatgtcaaaacagcgctctaagtctcagtaatggggacagtcatggcctgctgagtgagaatggatccatttatgtaattagtcagagtgcaaaatctagtgatttgtgttgtgacaagatgtttggccaggatcagttggcaatgctaggtgaagagcacactgctgcagtggttgtccggaggttggatttctggctctattatgttacatacttctgtggaggcacaattggacttgtttacagcaataatctggggcagatagctcaatctttaggcctcagttcaagcatatctacccttgtcacactatactcggcattttccttctttggccgcttgctttcagctgtaccagactatattcgaaataagttctactttgcaaggaccggatggctagccattgcacttgttccaaccccagttgcgttcatattgcttgctgtatcagacagtgccgctgcgcttaaaacaggcactgcattgattggtttgagttctggcttcatattcgcggctgctgtggcagttacatcggagctatttggacccaacagtgtgagtgtcaatcacaacattctcataacaaatatccccattgggtcgcttctgtatggttttctggctgcgttgatttatgatgagaatgcttacaatgtcccgggagagttaatggctgacacactggtgtgcatgggaagaaagtgctacttctggacatttgtctggtggggaggaatgtctgtcctaggacttacttctagtgtgttgttgttcttgagaaccaaacacgcgtatgatcgcttcgagagacatcggatttcagcgcaatcagttgtgtcttag

SEQ ID NO: 5364 - DNA, 2838 bp, Glycine max
  Peptide Sequence Number=SeqID_122142
atgaggggtagtgggttgaaggaagttgttggatgggaggaacaaaacagtgaacaacatgtaacaggggcttcaacattagttccaagtcctacaacctgttaccaggagggttcaatggtctctaagatgattagtatggaagaaagagataaggaagaggctcgaaggttgggaaatagggaggagactaagaaggaacaattagataaggttgtatgccaagctttgtggggtgattgggatgtcagctgggaattgcagccaacatgtaatagaatttgggttgctgatggtgcgaaagcgactatactgaacatctactcaccatgtgactttaataacatcaaaagaacatcagaaagagtaggcatttgtcaaagggggcaagatgagaggattatgaaggaattcaatgaatggattgcagacttagaggttgaggatgtgccttgggaaaagattaagggagtaaagcagaggttaaaagcttggaaccagactcggtttggtgatactcagcataagctaagaagaattgagctggagttgaacaagctggaaaatgaaggggatgaaagacaatggaatgatcaagaagctgctaaaacaattgcaggaggatttcaaaatgagttattggtggagcgctttgatgagaaagaagtcaaggttgcattgtgggaatgtggcaatgagaagagccatggaccagatgggctaaattttaagtttatcaaggaattttgggactttatcaaacctgacttgctccgttttttggatgaattctatgttaacagagtatttttgaatggaagcaatgcttcattcctagcattgatccctaaggctgaagaagcttttatttccatattggttaatgggagcctcatagctgagttcactcctcaaagaggactcagacaacgggatccactagccccacttctgttccatattgttgcagaagggttatctgatgatacaattttcttcgaggcaacaacgatggaaaatgtaagagcaatcaagcaatggatgaatagtgctgcaagttatttaaattgcagaacgatggaaaatgtaagagcaatcaagggtgactttgataaagttgtagcagtggtttttgtggggaggagacacagagcagaagaagattgcatgggtgaattggggttcaatctattgtctaccaaaggaaaaaagggggtgatgttttgggaggatgatggaaggaagatggttggaaatggaaattgcagtggaggagattccttttcaaagctgaaatggcttctaagtttatggaggacatatacaatagggaatgcgaacatgttgcttgacagggattcaacagatgagaaccaggatgaagtctttactaaattatggaaactcaaaatcccaagtgatgttttaggaggatgggtgaaaggaatatggtatattgctgatggagaagtacccaagactctaccacatttctcaacagcagtaccagtatatctagtagacggggataatttcagatgtaggttgggaatggaaattgcagtggaggagattccttttcaaagggattcgacagatgagaatcaggatggagtctttactgaattatggaaactcaaaatcccaagtaaagcctctttctttgcttggagattaatccaggacaaactcacatttattcttcagttgtgcttaaatcatgccgctttgatgggaatcggtgtcttggataaacatggagaggaggaagcagagctgctgtaccatgttatatctctaggcacatttgaaagagtggcaccggaatggatgaaggaggacatcatgttcagccctagcatgtgccccatcttctttgaaaggatatctcgtggtatcgttgattccttcaactccatcttcatacccgataacaacaattatcacgacaccaattctccttcttcttcttcttcctcaacgaatcgaatggaagcttctcctcctcctcctcctcttcctccttcggtttcgaacgagcgcgttgcctacaagctcaaaggctacttcgatttggcgacgcaggagatcgcgaagggcgttagggcagaggaatggggcttgatcgacgatgcgcttctccactaccgtaacgcgcactcgatcctcctcgaagctaattcaactcccgttccgtcctacatcacttccagtgaacagcagaaggtgcaatcttatcgagagaagatatccaaatggcagagtcaggtttctgagagattgcagactctcgctagacgagctggtagctcatctgctaatcagagcacctcaaaacttgcccaaactgtggcagttccgattaagccatcgagtactagaaaaaatgtgttacaaaagccccctcaaagaacaggtcaggtgaataaagttggaagcccaaaatctagtcaagggtctggtgtaaattatgatgacaaactagttgaaatgattaacactgccatagtagatagaagtccttctgttagatgggaagatgttgctgggcttgaaaaggcaaagcaagctttaatggaaatggttattttgccaactaagagaagagacttgtttacgggtcttcgaaggccagccagaggtttgcttctctttggtccccctggtaatggaaaaacaatgcttgccaaagcagtggcttcagaatcacaagcaacattttttaatgtcacagcagcttccttgacatcaaaatgggtgggtgaaggtgaaaagcttgtccggacactattcatggtagctatatccagacagccatctgtaattttcattgatgag

SEQ ID NO: 5365 - DNA, 2994 bp, Glycine max
  Peptide Sequence Number=SeqID_122143
atgactgtcattgcttcgggaaatgagactgatcatttggcattgttcaatttcaaaaaatccatatcaaatgatccatatggaatcttgttctcttggaatacttccactcacttttgtaactggcatggaatcacatgcaatctcatgcttcaaagagttacagagttaaacttggacggataccagttgaagggattcatatctcctcatgtaggcaatctctcttatatgagaaacttgagcctctcaaacaacaacttccacgggaaaatcccacaagaattaggacggttgtcacaactgcagcatctctccattgaaaataactcattgggaggggaaattcctacaaacttgacaggttgcactcacctcaacagcttattctcatatgggaacaatttgattggcaaaataccaattgaaattgtctcacttcagaagcttcaatatttgagcatttctcaaaacaagttaaccggaagaatcccatctttcataggaaatctttcatccctaattgttctaggggtgggttataacaatttagagggagaaattccacaagaaatatgtcgtcttaaaagcctgaaatggttatcaacaggtatcaacaaactgactggaacatttccttcttgtctttataatatgtcatctcttactgtactggcagctacagaaaatcaacttaatggcactctcccaccaaacatgttccacaccctccccaatctccgagtatttgaaattggtggcaataaaatctcaggtccaatcccaccttccatcacaaacacatctatcctttcaatactcgagatcggtggccatttcaggggacaagtcccaagtctggggaagctacaaaatcttcaaattctaaatttgtctccgaacaatctaggtaacaattcaactaatgatttggagtttttaaattcattgacaaattgtagtaagttgcaagtgttatctatagcccacaataattttggaggtcagttgccaaattccttgggcaatttatccacccaacttagtgaactagctcttgggggtaatcagatatcaggaaaaattcctactgaattaggaaatttgattaacttagttctcttgggtttggaacagagccattttcaagggattatcccaagtgcttttgggaagtttcaaaaattgcaacttttagaattgagtgcaaacaagctttcaggagatttaccagccttcctagggaacctcagtcaattgtttcatttaggtttaggagaaaataagttagaaggaaatattccttcaagtataggaaattgccaaatgttacaatatctatatcttaggcaaaacaaccttagaggaaccatacccttagagatttttaatttgtcatctctaacacaggtgttggatttgtcacaaaactcattgagtggtagtatcccaaaagaagtaaacaacctaaaaaacatcaatttgctagatgtgtctgaaaatcatttgtctggtgagattccgggaactatcagagaatgcacaatgttggagtacctctatttgcaagggaattctttacaaggaatcataccatcctctttggcatcactcaaaagtcttcaacgtttagacttgtcacgaaatcgcttgtctggatcaattcctaatgttctgcaaaatatgtctttcttagaatatttaaacgtgtcttttaacatgttggatggtgaggtaccaactgaaggtgtctttcaaaatgcaagtgggttagtggttactggaaatagtaagctttgtggaggtatttcaaaactgcatctaccaccatgccctgtcaaaggtaagaaacttgcaaaacaccataaccataagtttaggttgatagcagtgatagttagtgtggttggttttcttctcatactgtcaattattctaactatctactgggtgaggaaaaggagtaaaagaccatatttagattcaccaacaattgaccagctggctagagtttcataccaaagcctacacaatggaactaatgggttctcagctacaaacttgatagggtctggaaattttagctttgtctacaaaggaactattgagttagaagaaaaagttgctgccataaaagtcctaaagcttcagaataaaggagctcacaagagtttcattgttgaatgcaatgcacttaaaaatattaaacatcgaaatctggttcagattttgacatgttgctccagcacagattacaaaggtcaagaatttaaagctataattttccagtacatgacaaatggaagcttagatcaatggcttcatcctagcacaataagtgcagagcatccaagaacactgagcctcaaccaaagattaaatatcatgattgatgttgcttctgcattgcattatcttcatcatgaatgtgagcaaatgatcattcattgtgatttaaagccaagcaatgtccttcttgatgatgatatgattgctcatgtgagtgattttggcatagcaagacttatctcaaccagtaatggtactaattctgagcaagcaagtacaattggaataaaagggactattggctatgctcctccagagtatggagtgggttctgaggtgtctatgaatggcgacatgtacagctttgggattcttatgttggaaatgcttactggaagaagacctacagatgaaatctttgaagatggtcaaaatttgcgtagctttgtggaaaattcatttcctggtaatctttcacagattttggacccatcacttgtactaaaacaaggagaagcaccaatagaagaagaaaacaatcagaatattagtccagttgttcaaaagtgcttagttacactctttagtataggacttgcttgttcagtggaatcaccaaaacaaagaatgaatatggtgaatgtaactaaagagctgaacaaaaccaaaagagcctttcttaccggtaagataaatgaaaaatga

SEQ ID NO: 5366 - DNA, 1743 bp, Glycine max
  Peptide Sequence Number=SeqID_122144
atggaagaggcaaaagtggaaactccgatgacagcgtcgagaggcaacattggcagtggtggtgacaattgctcgcagagtttgagccctagagcgcgcattgtctccgtcgcctccaacatcgcctcgcagcctcttcacaactccgatcctcaagtttggggcgttctcactgctatctccaacaatgcccgcaaaaggcaccaggtaagtggaaactgggttctcctgtatgagggtgagccttggctcaatggtaaggttgctgccttagtgccttatgacatagaggtcatgtcatgggtacaaatcatggaaacgatctctgcacttgcagcaggaattaacattttattaactgctgatgagcatcgtattggtcgattggtagaggatgtgcgtttccagattgattcaaattctgttagtgcaaatcattgccgaatatacaggatgaaagttactaatgaaaatatggagaataccacatcaatattcttgaaagatacaagcacaaatggaacttaccttaactgggagaaattgaaaaagaatggtgctgctgtgaaagtctgccatggtgatattatatcatttgctgctcctccgcagcatgatctggcatttgcttttgtatatcgagaggtgcttgtgtccagccccatgccagataatgcagttgctaaacgaaaagctgaggattttgtttctgaaaacaagagattgaaaggtttaggcattggtgctcctgagggtcccatatctctagatgattttcgaagtcttcaaagatcaaacatggaattgagaaagcaattggagaatcaggtggttacaattgatactttgcgtagtgacaatcgtgcagctgttgaacgccatgaaagtgaattaaaatcagtcaaagagtcagttgaaaaatgttaccttgatcaattaaaagaattacagcaaatggtggatctcaaacagaaggaattaggggatcttaacagagcatctgctgaacaaaaacatgccattgaagaccttgatgagaggcttagtgcttctatacagtcatgtgctgaagcaaattctataataagtagtcaaaaggtaaatatagctgaactgaaggaacaattggatgaagagcggactcaacgaaaagaagagcgagaaaaggctgctggtgatttaaaagctgctgttcatagagcccagtctgaggctcaggaggaattaaaacgactctcagatgcttccttaagaagagaaagagagctacaagaaacaataaataagctacaggagtcagagagagaaatgtctctgctggttgaaaccttgaggttcaaactggaagataccaggcaaaaattggttgcatctgataataaggttcgccaattggagacccaagtacatgaagagaagcttgccactgaaaatgagatgaagaaagtagaacttgaacaacaggaaacaagaagattaaggaaagagcttgagagcgaaaaggcagctcgagaagaagcttgggctaaagtttctgttcttgagcttgagataaatgctgcaatgcgagatcttgattttgagaggcggaggttaaaaggtgccagggaaagacttatgcttcggatttccaacatagactgcacatactggcatagaatatcagaggacacagggcagcaccctagctgctacttcttccagctacttgtttgttgcattctttggatttttgtgttataa

SEQ ID NO: 5367 - DNA, 1998 bp, Glycine max
  Peptide Sequence Number=SeqID_122145
atggcgactaatcttcctgcaacgaagtccaccacgacgacgtcgtctcaggagaaacgacaccgttcgatcttcgaagttccaccgaacttcttcgactcttgtcgtcttctcccttctcctcactcatccgtttccgaccaccacagcgtaggccaaacccaaatcatcgaaacatcctcaaacgacgacttcgttttggatgcccctcaaaacgccgtcgtttccgcgcctaggtggacctgcaatacctgcaagactcaattcgattcccttcaggaccagcgttcccatttcaaatccgacattcatcgattcaatgtgaagctgacaattgctggaaagaatattgtgaaggaagaagattttgaggttctaacatctgaatttgtcaaagactatgatgtgtcaagtatatcgggatcagaaagtgacgatgatagtgaaaccgagtctcagagtcaaagtgcattgcatgacaaattgagcgaaagttttaaacataaactattcttccgtcttcagacagggcagagagtttctgtctggaagtgcttgattatgaatgtgactgaaaatgtattatatgataatgaaaaggcagagaatgaagtggttgagaagttgaaatctttgactgctgagcccagagacaatacccatttgagaattgttctgcttgtgtccggtggacactttgcaggttgcgtctttgatggtgatgctgttgtggctcacaagacatttcacagatatgttgtaagggccaaggcaggaaaaaaacaatcgtctaaagatgcttctggaagggctgctcattctgctggggcttcacttcgtcgatataatgaacttgcattaaagaaggaagttcatgaactgtttgctgcttggaaaccttattttgatgcttccaatagcatttttatacatgcaccatcaagtagtcgtcaacttctttatgatggagagagatcatactttaccaatcagcaatgtgatattagaaatattgctttgactgttcggaggcctactttcagggaagcaaaacgtgtatatagccagttgacccaggtaacccatgaaggcgatgagaaggaagttttgcaaagaaaccaagaggattcggtatcaattcacatttctaaaataaatgtcagtccaaccttaagcaagggggacatggctgagttggatgacaaaaataaagctgaagcttgttcaagtaaacaaaatgatgaactcccaattttgagtaatggagaaagtgaggatgagctatttggtaaatcaactcctttacatcaggcagcacaatcgggtgactctctaaaggttttagagttcttggaaaagggtttggatccttgcatcaaagatgaaagggggaggaccccgtatatgttggcacatgacaaagaagtgagggatactttcagaaggtttatggcatcaaatcttgacaaatgggattggcaagctgcaaaagtgcccagtgcattgaccaaagaaatggaagaatcacaagctgctaagcaggcagaaaaagatgctaagagaaaagctagagcaaaagaattaaagaaattgcgtaaagcaaaagaaaagaaggctcaggttgaagccaccttgcctaagaatgattccaaaactatagagaagcaagtaactgcttcaacatcgattaagggacaatctcaactaaaaagtggtgtgcaattatccaaagaggaccaaataagaatggcacaggctgctgaaagagaaaagagagcagctgctgcagagaggagaatagccgccctcaaaattcaagctaatagtgcaatcactgcagctagcatgtcagaacctaaatgtggattagcaggtgacatttactgttcctgttgtaattcatcacttgatggtaaagttccattccaccggtataattacaaatactgcagcacatcatgcatgcatgtacacagggagatcctagaagatcaatga

SEQ ID NO: 5368 - DNA, 303 bp, Glycine max
  Peptide Sequence Number=SeqID_122146
atggacgaaaaagagaaagaaaacgcacgaggtggtgcaggcggcacggcggcgtcgttgaaggtgcaagggtgcatgtgtttggaggcgaaagggtcgcgcgcgatcagatctggaggtggaggcggtgcgcgacgtcgaaggagggtggcggggttggtacacgacgtcgaaagagggaggcagttagagatgtcaaacaaaagcagagcactcagctttaatactcagccaatttctcatagttccttctcatttctcttgcattgccatctcaagcttagtgcaataaacgacctttga

SEQ ID NO: 5369 - DNA, 597 bp, Glycine max
  Peptide Sequence Number=SeqID_122147
atggcaacaggtccttctcaatggcgagccaccttctatgtccaccaccaaaccttcaacctcagcactcctgtctcagttacatgcaactttgctcacgattccttcaccaaacaacgccacaaaatctatgcattcacactgccaacactcttgtccttccttcaagttcaaagtgcagggaacacagcttccccgttccaattgcaccctttgaccacaaaagcttctgtgtttggcatactatgctactacttgaccttcagggcatggctatgttttcccttatatgccactcagttaagcattgccatggcactctttggctcgttttccttggcttctttggtgtcacttcttctttctgactcgtggtggcacatcaagtacatgctttattttttacttgtggtggttgagttgcatcaaatgattaacattgctatggagatcatggcgcaccaactctattcaaaggggtttgccacttacatatatggatttgatagactacaacaaggcctaattgtggatatgggaggatctatacaagctactctttcgatcttcacgactcatacgttagaggatgtttag

SEQ ID NO: 5370 - DNA, 446 bp, Glycine max
  Peptide Sequence Number=SeqID_122148
gacaagcaatcacgcagactctcttacaggattaccacaaagtcaagtttggtgagttgaagagtgaaagaaccaagagaacattaggagagctatgggacttgaaggtggaaagagtgaaaaaagaaagcctaatgagtgagcaagaaataagagaaaaacaagtgttggcaggtattttgaaaaaagaagggaatcgggaatttgggtcaagggagattgaaaaagctgtggtgaagtacacagaggctttgagtttgtgtccattaaagtctaagaaagagagaatagtgattcatagcaatagagttcagtgtcacttgcttcttagagatccagaagctgcactcagtgatacaactcgagcactgtgcctatcgaatgtggcgagtgttgcgtgtcttcatagcaagagtttgtggagaagatcagaggcttggacatga

SEQ ID NO: 5371 - DNA, 765 bp, Glycine max
  Peptide Sequence Number=SeqID_122149
atactaaaagaggaccctgcatatcccgaagcactgataggaagagggactgcttatgcattcaagagagaacttgatgctgctatagctgatttttcaaaggctatagaatttaatccatcagctggtgaggcatggaagaggagaggtcaggcacgggcagccttgggggagtttgtcgaggctattgaagatttgactatggcattagagtttgaatctaactcagcagatattttacacgaaagaggaattgtcaatttcaaatttaaagagtttgatgctgcagttgaagacctttcagcatgtgtgcagctagacagggataataagtctgcctatacatatttgggtttagcattatcttcaattggtgaatataagaaagctgaggaagcacatctgaaatcacttcaaattgatagaaattttcttgaagcatgggcacacctgactcagttaattgttatctggaagcttgattctgaaaatcctgaatcatctttctatcaagatttatcaaagccaacaaaagctcaggaatgtctaaatcagatgctgcaaattgatgggaggaaggctatcagtgatttgacaatgagcttgaacgttgatggtgccaatgtcgagtgtttatatttgcgaggttcatgctaccatgctgttggacgatacaaagaggcggtcaaggattatgatgctgcattggatttggaattggattcaatggataagtttgtgcttcagtgccttgccttttaccag

SEQ ID NO: 5372 - DNA, 885 bp, Glycine max
  Peptide Sequence Number=SeqID_122150
atgcttgctttcagtaacagggccttctgttacagccgattggagctgcacaagcacgtaattaaggattgcaacaaagcgcttcagcttgacccctcgcgacttcaagcctacattctcaaaggtctcttgcttgttaaattcatccaattcttgatgaatctttttaactttttgtaccctgggaagtgcgatttaagttcttttaagaataacagaggtggtcacgccctttctgcattgggaaggaaaacagatgctctgttagtatgggagcaaggttatgaacacgcccagcatcagtctgcagatttgaagctgttgctagaactggaagagcttttgacgacaacaaaacaaggcaacagtgcattgtatgaaacaaatgggtcgcccgtttcacaatccgaatcagattctccgagtgatgggaacttgactgaaatttgtgagaatcaagataggttgagtgttcaagatgaattatgtgacaacgcaagtgataaatcattgatcttgctgaagtctgctgataattttgacttgcgaaatgaattaaatattgaagatagggagtctaataaatctgacagccaagtgaatggaagccctgacgttattgataaactgagttataattctgaatcatgtaatgactcaagtgacacttcagaatcatgtgataaagataaagtatttaccaatagtggggagtctagtagtgactcacttgatgttgctgaaattcttagaaagctaagtagtaagtttaattttccccatgaaaaaattggtgaagcaaggaaaaataagttttgtgttgctcggatttcaaagactaagtctataagtgtagattttcggctctcacggggaataggagag

SEQ ID NO: 5373 - DNA, 321 bp, Glycine max
  Peptide Sequence Number=SeqID_122151
atggttaagcatgtaggtgttaaatttaaaaaagaacaaaaaggaagaagtacaacaagagttccgagtcctgaacttcagattcctttcttggccatagaactccaccgcaatgctaacgataagaaagggatagatgagcacgttgttttttgttttttgacttcacgtccatcatcatcaatactttgcatccatttgatttcatgcaatattggtgaatacattgacgaggcaaagaaggatcagagcatggcgacgctgataagagaccttgtaacgggttcgggacttatcaaatggatactccctcataattga

SEQ ID NO: 5374 - DNA, 438 bp, Glycine max
  Peptide Sequence Number=SeqID_122152
atgaaagatgatgagaaaagaaaagtgcaagatgatcaaaaagctaaaatcattctaccttctagtttatgttcttatgaatttttccacactgcaaggagtaaaagtgtaaaggagataatgcttgaagtcactctggatgtaagaagagcaagaaagaacactcttgtatccaaatgtgaagctttccgaatgaagaatgatgataagctaaacatcaagatccttaattgtcttacaagaacttgggaaccaaaaaacatagctatcaaggaatcaaaggacttggcatcaatgtcaatggaagctctcaaagctacagaaaagaaaaagaaaggggttgcactcaaagctagttcctcaaaggaaggccacaaagaagactctattgatgatgaaagatgcacaaaatttgaatttgattgtcaagaagtttga

SEQ ID NO: 5375 - DNA, 873 bp, Glycine max
  Peptide Sequence Number=SeqID_122153
atggggatagcagctgaagctcataacgtgaaaattttgggaccaggcactgaatgtatagttttggctcacggatttggcacggatcagtctgtgtggaaacacttggtaccttatctcgtcgacgattaccgtgtcattctctatgacaatatgggtgcgggtaccaccaaccctgactacttcgattttgagcgccactcgagcttagaaggctatgcctctgatttgcttgcaattttagaagagctccaagttgaatcttgcattttcgttggccactctgtttccgcaatgatcggcgctattgcttctatttctcgccccgatctcttcaccaaactcatcatggtcagcgcttcccccaggtatttgaacgacgtggaatactatggaggatttgagcaggaagatctgaaccaattattcgacgctatggcggcgaattacaaagcatggtgctatgggtttgctcctttggctgtgggcggggacatggagtctgtggcggtgcaggagtttagtcgaacgttgttcaacatgcggccagacatagcgctaattgtgtcgcgaaccatttttcaaagcgatatgaggcagattctgagccttgtttctgtcccttgccacatcatacaagctgagaaagacatggctgttccggtgatgatatcggagtacctccaccaacacattggtgctgagtccatcgtggaggtcatggcaacggacggtcatttgccgcagctaagctcgccggatatcgttattccggtgttgctcaaacacattcaacttgatattgagtcaagaagctgtgctactccagctaaggaagcattgagaattgatattggacttgagttttcttag

SEQ ID NO: 5376 - DNA, 1014 bp, Glycine max
  Peptide Sequence Number=SeqID_122154
gaggaggaggaggaggaggaggaggaggaagaagcagaaatagaagcattgtcactttgcgatcttcctgtcaatctggtcgaccacgaagtccaatcaaaagcaaaaccagattctcaaatcattgaagcccaagaagaagattttgatttccgcttatggggtggccccttctccacagaatcagaaatgtgtgctgcagatgaagttttcttccaaggccaaattctcccattgcatctctcacttaagcgatgtgaatccttggaccacgtttccgtgagagaatttcgtagcaatagcagtagaagcagcagcagcattagaagccagaattcgtctagtagcagctgctccaccgccactacaaccccaagaatctccaaacccagacttcaaaatcaaaatcatttccacgcgcatccaagtccccaacctcagttgaaggtaaccgttccaagacaaacaagcttcagcaatcacggtagaaaatcatcagcatgggactttttccgtctgggtgtggtgcctgcacctgagatagcattgcaagatctcaaggttcgtagtaccaacggtgttagtaaaaatcacatgggtcgcagcactagcattggcagcaacaatagcaacgccaatgctaatggctctgtgaaaacgagttacagcggcaacaaaaatcaggttttcaaaaaatttggtggcttttggagtggttgcaaatgttctgttgaaacagtgcaatcgggcatggccatgattaagggtggtattaaaagcgccaacacaacgcacgcaacgaaagaaaaagtgatcgaaaggaagaggcagaaacacagacaaaagcaaggaaagagaaccatgtcgcgtcgtcgaacgtttgaatggataaaggagctttcgcataattacatcattgtggtggagactggagactctgtaatcaaaacttgttaccctcgtgagaatgatagttttgctttttcgttcctctttttgactgatggtgattga

SEQ ID NO: 5377 - DNA, 483 bp, Glycine max
  Peptide Sequence Number=SeqID_122155
atggttaagtgcaaatgtgaggtacctgctattatgttcacgttgcgtagtatgaaccatccggggaaaaggttttggagatcatacactggaatgaatccagttcttgcagatttttttcaatggattgttgatattgaggctggtaataaggtttccgcaaaagggagtgagttgattcggtatgttcacgaaaatgaaaaggtgaaggtgaaacttgcttcattaatggaggaagctaaaacaaatgtagaagagatagcaaatttgagggaaagaattgttgcacatggagaagaatgtcgtgcatccttggctgaagttgtgcacttgaaaagtaaaattggaaggaaaaagaaaaatattgttgttgaaaggaataaagtgaagctattaggttttgtaattgtagttctttggatgttcatttctttactaaacattgtaattataatgaatgttggtggtcatagaagaaactga

SEQ ID NO: 5378 - DNA, 474 bp, Glycine max
  Peptide Sequence Number=SeqID_122156
atgacaacgacgatgatgacccaccctttttccttcatcctttcacccatcaaccaaacagcctccgttaggacgaagaggacgtcggaggtagtcgacgatgtagaagatgacatcagagcaggaggcgacgacatgggggctgagaagtggcctccagggtcaacgagtggttgggccttcgaaggagtgtcattgaagatggcaatgcttgcggcttctacaaatcacatggatgattcttggtattcggacaccagtgctacccaccacctaacacatgatcttggcaatttcatgataaaaaatgaatacaatggaggtgatcgtgtgcacgtgggagatggtactggtctaaccatttctcatgctggacattcatctttttactctaaaaattcaaatattcgttttaccctaaaaaacctcttacatgtccctgatataaccaaaaatcttatcagtgtttcctaa

SEQ ID NO: 5379 - DNA, 310 bp, Glycine max
  Peptide Sequence Number=SeqID_122157
atggtaatcctgtcaaccacatcactgctgccaataaccacccataaatctctaggattgatcctcctcagtattaaaaagactagagatttggatcaagtaaagtgtgttaaggatgaagaaggcaaaatcttagtgcatgaaaaagatatcaaggaaaggtggaaggcgtatttccacaacttatttaatgatggatatggatatgactctagcagtctagacacaagagaagaggaccggaactataagtactatcgtcggattctgaaacaggaagtaaaggaagcgttgaaaagaatgagtaatg

SEQ ID NO: 5380 - DNA, 237 bp, Glycine max
  Peptide Sequence Number=SeqID_122158
atggtcgaagattgtggaggttctgttgaggttagagacgtgagggaaaaggaagatcgagaagcagcaacaaacgaagatgaagatgtatgtggatggatttggctcccaaacggagctctcaacgactactcccatcagctttttataatttcgtccctccccgtggctccttatatactgctgatggagctaaaaacaggaggaatgaatcatggtccgttgcttaatatatga

SEQ ID NO: 5381 - DNA, 574 bp, Glycine max
  Peptide Sequence Number=SeqID_122159
gatgaacaagctcgacttgccttccgtcttccttatttgcatcttcttctttctcgctggattctctgcttccagtctcttctctccctctcaggaacatgaatatgacctgaggctgataccgagagcgaggttacttgaaaaatcgacgcacgagaagacggagcatcatttgttgaaagccggagactccggcgacgattacattacattgattccttttcaggggaggactcaagccgtcaacattggtgttacgcaagggagaaacggaggagagtacaaagggaatcagaacaaggcagcttcttttttgctgtatttaactgatgttccagaaggtggggagaccttgtttccgtatgagaatggattcaacagggatggtagctatgattttgaggactgtatcggtttaagagtaagaccacgcaagggggatggacttctattttattcattattacctaatggtactattgatcagacatcagtccatggaagctgccccgtcataaaaggagagaagtgggtggcaacaaagtggataagggatcaagtgctggacgattag

SEQ ID NO: 5382 - DNA, 474 bp, Glycine max
  Peptide Sequence Number=SeqID_122160
atggaatgtgattctagagagaacaaagttgaagaggttgagatctcgcagtgcgaaagatattataatgagattgaagaatctagtatgaacgaggaaatgggtgaaaacaagggctcggtggtggatgaggatgattgggaaggaatagaaagaactgaattggagaggcgctttggtgctgcagttgtatttgtcggttccaagagcaatgctaatcttagtaatgatgtgaagatgaagcttcatggttatcaccgaattgctactcagggtccttgccatgaacctcagccaatggctctgaagttctctgctcgagcaaagtggattgcatggcgacagcttgggattatgagtccagaggaagctatggagcaatatatcagccttctatcagaaaacattcctgattggattgtagaaaatccttatgataatgctaaaccggcttctgcaaaactaaccttatga

SEQ ID NO: 5383 - DNA, 1146 bp, Glycine max
  Peptide Sequence Number=SeqID_122161
atggaaggtctctggtcggtgttcggggagtatgaattagcttcttatggaatcggaagggaaaatatggttaagtctctctgttacggatatacgacagctctctttgctgctcctttccttggcgtgctttcggatttgataggtcacaagaaagttagtttaatcttttgcatcctacacttcattgttggtgtgtggaagaagatttcagagccaccaagcatgttcatgactagcatatgtctctctctcaccaatacaatattttcattcagttttgagacctggatggtcactcaacatgaaaagcaagggcacaggcttgattcacttaatgacgcatattggttaatgactttctttgagtctgcatgttttattgccagccaaatgtttgcaaattggctgattggtaataatacagaaaaaaacactgctccttcgtctgcagctatcttctttgctgccatatgcttcacttttatcaccagaggatggacagaaaatccaggatcagcatctcttaaggagtatagtcacgcattctatgcatacattttaggtgataaaaggatatggctgttggcgtgggcacaaacttgccttcacttctctactggaatattttggatcctttgggcacctacagtggtggccgatggccgagaagtgcagctgggattgatatatccgtgctttctgggctcaagaatgctaggaagcactgcatttccgtgtctcactagtgggccatcatcgcttagaactgaggactgccttgttattgcatacattatactggctcttctcctttctattgtggcttatgactatcaggaaattggggttctggtgacactattttgcttgtttcatgcttgtgttggatttgttttgccatcacttgctagattgaggaccatgtatgttcctaatgaattgcgtggagggatgatgggcttctctcttgcccctgcaaatgcagctattctgctttctgtggtgcagggtggctattatcggaatgtaggaaatgcagcattaatggcatttggcgtgtgtggtttattgctagcagctggttgcatgcatgccctgaagcaatgggggaagcaaccatataacaactggcataaacagtga

SEQ ID NO: 5384 - DNA, 801 bp, Glycine max
  Peptide Sequence Number=SeqID_122162
atgaactccattaccattaaagatcgttttctaatgccaacaatcaacgagcttttggatgatctcgaccatgtgtcgtggttctccaaacttgatttacgtcaaggttctgatcaaattttaatggtcgacgatgacattgtgaaaactatgtttcaaactcatcaaggtcattacgaatatcgggtcatgtcgtttgacctctgcaatgcaccttcgaccttccaagcaacaatgagtacacttctccaaccatttttgcacaaattcgttattgtgttcttcgacgtcattctcatctatattggagtatacttaggtcacgttatctttggcaaaggagttgaacttgagcaatcccagatcaaggttatgttagactggcctattccttccaatcaaaaggatttatgtggattccttggtctcacagacttttatcacaaattcattaacgggtatgcttcaattacttctcccctcaattctctcttgtgcaactgtacacctgaggctcaacttgcatttgataatctcaaacgcgccatgaccaaggcactagtcctggttctcccaaatttttctttgcctcttgtgttagaaacagatgctttcgggcttgcactgatgcaacacggacatcccattactttttatatggcgtcaatacttacttggccacagttcaccatccttactgaccacaatagcccaaaaggatcactaaatgaccagctcgactggaagatcctgtctagctgttacttggctgctttgaaggagttagttgcaaccacttag

SEQ ID NO: 5385 - DNA, 138 bp, Glycine max
  Peptide Sequence Number=SeqID_122163
atgtggcaaaatcagcccaacaattcttcttacagtgattccgtcaaggctctcgaagatgatatgcaacatgctaataccctagaaatgaattttagtcacaagccatggcccgaaatgccaattttaatcatctag

SEQ ID NO: 5386 - DNA, 255 bp, Glycine max
  Peptide Sequence Number=SeqID_122164
atgggaggaggcaatgggcaaaaggcaaagatggcacgcgagaagaacctcgagaagcagaaggccgcctcaaagggaagccagctggattcaaacaagaaagcaatgtcgattcagaacattaaaactaattggaacaaaaaggaaaatacagcaaagaaaagactaagagtcatacttgctgtttgcatcaaagtcatggtgcaaggtgtgcatgcaaacatttatgtgcaccacatcggaagtgaagtgtag

SEQ ID NO: 5387 - DNA, 1745 bp, Glycine max
  Peptide Sequence Number=SeqID_122165
atgtctgagaatcacgtagcagagcaggtttcggattctggtcatggtgttgtgcacgacgaatcaaatgtggataccgaatcaaacattgatacttataatcaagatcagggagagcgtgctgatctcagaggtcctgaagatggaaaatctacagaggatgctgccagagatgacatgtttgttgattgccctgatgagttaagcacatttgatggtaggcaaagggaggaagacgctgcagctgtggaaaatgaagatgaccggtcggaggaaaatgaagttatgcaacaacagcagagtcattttgataaattgggcaatggagtgggagatgcttactcctcaggccagctggagaaagttgttgccgagaaggaatgtattttgaaggaatatcaggaagaaagacaaactgttactcaaggtgtgcttgatcttcgatgtcagctgaagactctcactggtcaacataatgaagctcaagttgaagatagggaagcgactgatgttccgttgagggagatgataaaggaatgtttggagtctgtgaagactgcctcagaagaatggtcaaacagtgaaactactataaataatcttcgcgaacatctatctacgaaggaccgtgagatagaagatcttaatgcaaagcttgcccaattaatggtatctaatgaaagtttgcaagtttcatccaaagctcaacttgaaaaggatcgtattgttgagattgtgatagataagacgatatcctctcttgcaacagttgttactcgagagcaagtattggatgattctattagtgggaaaatagtttatattgaggaaggcactatgcatgtagttgaaaagtataatcagatgctttctgaaatttatcaacttgggcaatctttctctgaggtaggcttggagactaacgaccaggaatacgggaacatactcgctgatgctcgtggtgggttactggagctcaaaagaaaggaaacagaattggttgaaaaactggctcatttagaagatgaaaatcagaaactagttgatgagcttgacaaggaaaaggtgatgatagggacattaaatactgaacttggaaaactgaaaatagaactcgagcaggaaaaggctaaatgtgctaatacgaaagaaaagctcagtatggctgtgacaaaaggaaaggcattggtacagcagcgagattcattaaagaagtctctggctgataaatccggtgagcttgagaaatgtttgattgaattgcaagagaagtcagttgcactacaagctgctgaacttgctaaggaggagttatcccaaagtaaaaatatggttgcatccctagagaactcattactagaaaagaatgcaatttttgatcaagtggaagaaatcttgtctcgggccaaacttaatgaacctgaaatgtttgatatgccagagaaactaagatggcttgtggatgacagaaacactctgaaggaagccttcctagagctatgcaaattgaaggaagctatatctctagtggacctaccggagcctgtttcatcatctgatttggaatcacaaatgaattggcttgcagattctttgcttagtgcccggggcaacatgcatactctacaggaagaaatttccacaatcaaggaagcatcccgtgactatgttgatcagcttagtgtttctcttttgctggcattgcaggaaaaagattaccttctgtcagaattaactgacttgag

SEQ ID NO: 5388 - DNA, 333 bp, Glycine max
  Peptide Sequence Number=SeqID_122166
atgcaccgtcttagaaactacatatttccacatcattcttggcatcagcaccgatgtggaaacggacatattctacatcgtttaccaagggatgaccgacatagaagatgtaatttctacatcggtggtgggctgagtgatgaggacatgaccaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaaggttgtgagttgtatcatggcccaaatggaggaggactaa

SEQ ID NO: 5389 - DNA, 1814 bp, Glycine max
  Peptide Sequence Number=SeqID_122167
atgcttaaagttatcaaaggacagggtggtcccttgtctagagcatcccatattgatgctgagttgtttgaaaggattcaaagtctcttgtatgttagagatcagggattaatactctatgaagatatactggaagaggagatgctaattagatcagatgagaataagctgtcaaatgagttgaaagtggcatctgaggaaattatagcactgaaagaggaaaggagttctctgctgcaagatcttgaacgatcagaggagaagactgccatgcttagggacaagttgtccatggcagttaagaaaggaaaggggctgtttcaagatagggacaatctaaaaggtcttgtaaatgaaaagaaatcagagattgagcagttgaaggctgatttgcagaagcaagaatctgcagtttctgaatacagggatgagatcaatagattgtccagtgatgtggaaagcatcccgaagctggaggctgattttctggaaatgaaaagggagaagaatcagtttgaacagttcttaatggagagcaataacatgttacagaaagtgatggagtgtattgatggtgttgctcttccagttgctccagtttttgatgaaccaatagagaaggtgaagtggcttgctggttatgtcaatgaatgccaagatgctaaggtacacatagaacaagagttgcagctagtgaaggagagtgccagtatacttgaaattcaattagcagaagcccaagcaactgtaaaatcccttgagcgggaattatcttcttcagatgacaatgtttctcaacttgctgaagaaaaaacagagttagaacatggcaaagagaaagttgaggaagagttacagaaagttaaagaaaaagtcgctgaagtttgtaatacgactaagtcacttgaagatgccttatcacaagcagaaaaagatatttctattctttccgaagagaaagagcaagctcaagttagcagagttgctgcagagagagagttagagatttttaaagatgaagcagctatgcaaacaagcaaactggcagaggccagcaagaccataaaggatctagaagataaactatctcaggttgagggtaatgccaatttattgactgaaaagtataatgctgatcaagttgtcaaaattgacatggaaaatgaattgaagaagctacaagatgaagcttcaaatcatgctagtaaattggcaggtgcctctgcaactataaaatcactggaggatgcattatcgaaggcgcaagatgatatttctgccttagaagatgcaaataaaattgctaaacaggagatatcttcacttggctttaagttaaattcatgcatggacgagttagctggaaagaatggcagcttagaaaacaagtccttacagctcattggactccttaatgatcttcaggggctcatgaaagacactactctatttcccagaattaaacaatgctttgagagcaaatgtgagacactgaagaatatgactctcattctgaacaaaataagagataatgttgccatgactgcaaaggattcaaaggggcagcctgtgatggaggaaaatccacttatgagagaaacattcttggatggccctgaaaattttgaagttgaactggacattacagagattgatggtgctgatattgacaccataatctcatcatttggaaagattgtgaaaggatttcagtcaagaaacaaacacattgcagataagtttcatgaattttcagattgtatggatgagtttatttctcctctccatgaaaaactactggaaacagagaccat

SEQ ID NO: 5390 - DNA, 532 bp, Glycine max
  Peptide Sequence Number=SeqID_122168
atgaagcctctaagcagtcgctgtcacatgaaagctcaatggaccatcccagttgtatgcctccattcattgtatattgccattttggttggggttacagctgcagttcatcacatagagttcagttcccagcttcttactaacctgtgctccaaggctgttattaaggctagcatacttgtggtggctttcttttcaatatcaagttcacaaccacttctctcacaaatcagcttgaggagaagagaatccagagaatttcgcacaatgagtcaggctctgggcatacctgatagtggggtactagcagaaagtgaacccatttcaaggatagatcctaatgaaccattggataagcttctcctgaataagagattccggcagtcttttatggcgtttgctgatagttgcttggctggggagagtgtgcacttctttgatgaagtatatgagcttagtaaaatacctgaagatgactgtgttaaaaggatctacatggcacgacatattattgagaaatacatagttgcag

SEQ ID NO: 5391 - DNA, 246 bp, Glycine max
  Peptide Sequence Number=SeqID_122169
atgcagtacgatgagaaacaaggaaagcctttacccaagtttggggaatgggatgtgaatgatcctgcgtcagctgaaggattcactgttatattcaacaaggccagagatgaaaagaaaattgcctcagcatcaggacgattcccttctcagcgaagatatgattctcgaaagcacaaggatcaacaaaagtgcaagagttcctcctccacctcaaagaaaaaatggttttgttttggcccttag

SEQ ID NO: 5392 - DNA, 303 bp, Glycine max
  Peptide Sequence Number=SeqID_122170
atgaacagtagaggagagtgtggaggtataaggaagaattcccttatcaaatttctcaagtgggtatgggtgatgttcttgaggacaccaaagaatctcatcaaagagtatggttcatgggctatgatcactggcttcactgatggaattggcaaggccatggcctttgaattggcatctaagggactcaaccttctcttggttggtagaaaccctctaaaacttgaggcaacatcaaaggaaataagagatggacatgatgttgaggtcaagtttgtggtcatagacatgcaaaaagtttaa

SEQ ID NO: 5393 - DNA, 294 bp, Glycine max
  Peptide Sequence Number=SeqID_122171
atgaatgctttgaataggtatcaaacaaggtgttttagaacacatcaagttgagccgctataccgcacaaaacaccgcaatctatctgaactattcaccaaaaacaaaaaacaaacaacacattataatgatgatgatgatgatgacgatgagaatgagaatggacctggtgtttctagtgttcgtgaaattggaggggcaaacgggaaaggtggatcctctgaagcagacgctcttgagtgtggccatgacttgaggaagaaaaaaggaagatcggaatccgacgaagcctaa

SEQ ID NO: 5394 - DNA, 846 bp, Glycine max
  Peptide Sequence Number=SeqID_122172
atggggtccagtgccagcaaggcctcgtcctcatcgtcgtcgtcgtcttcggggagtttcaggaagggtcgatctaagggataccgaggtttcccatcgtattgtctgggagccacgtctggatctcgtggcattgatagtgacgaccagaataaagtaaatggagatgatgtaacatacagcagtggcaatgaaatagattcagatgaggggaagacagagtcttttagaaaggttaaatctgatgaagtgccttgtgtgccttctaacattgaccttgaggggtggggtcacactacatccagaactggtagcagctctgcacattcttcttcaaatcagtccttgaacccttcaagccgattcctttctcgctttagccttgttcctggtaatataagcttcagacttagcagaaccacaagtttggggtcatctaggccttgcccggtttcttcagagagtctctcaatatttaacaatgaagatgagcttaatctgcctccagggcttcctggcagcttgatcaatagaaatgaaactcaacaccgtagtgacttgcttaatgcatctcttgctagtcaagtgcctatacagtgtcatcaagaagcttccaataatttaagatccaataccccgacactggtttcccctggcaacttggttagcagtcgcacactttcttctgttcaggatgttgccagagatggaaatggtacaagagaagtgctggatgtgaacttgttttctcctagaattcatactgattcagaaaacattgagcctagacttactgatagacgaaatggagctcgagagcctgttgaacgtaatgtgtcgttttag

SEQ ID NO: 5395 - DNA, 786 bp, Glycine max
  Peptide Sequence Number=SeqID_122173
atgggtttgccacggtttgggcgtcctaagaatgacggtgaattgagttcgaaccttttcgtggccaattgtgggtccgcagtggggctctctgacgatgacattgcatctgtgttctgcaaatttggagagctgaagggagtttatgcagcagatgagagtgggacacgtgtcattgtagcttatgttgaagagggttctgcacaagctgccttaaaggcattacatggacaatcatgtcctgaacttggaggtcgatctttgcatatccgttactctgtgcttcagccaactccacaggatcaagctagtgacttggttcctgtatctatcacagcatcagatgtgagcattccaggccttttcctagtgcatgacttcattagtgctaaagaagaagaggagttgcttcaagctgttgactgtaggccttggaacagtctttcaaaaagaagggttcaacactatggttatgagtttcgttatgatgtaaatgagtacccacctggagtgggtttgtccccccatatagacactcactctgcatttgaagatttaattttcagcctttcattatcagggccttgtataatggagttcagacgatatgaaaatggtgattggcttcccagagttgcctcaagtgctgttgcaaaaatagaaaatccagaagaccaatcaaattttataagaagggctatctatcttccccctcgatctttgcttctcttgtctggagaagcacgttatgcatggcatcattacattccacaccacaaggtgtga

SEQ ID NO: 5396 - DNA, 519 bp, Glycine max
  Peptide Sequence Number=SeqID_122174
gtccgtgctcttcagaggttgggtagccggtttgaaaatctttctggacatgacagatcatgtatcttatctggtcaacatagaaatggtcgttgtgcatgcagaatcaatagtcgtgataccaattcaaatgatgataccaatgcaagagctagcatatcaagaattgttatgctagctgaagctttatttgaggttctggatgaaattcaccagcaatctgtggttttatcatctcgcccttctgtgtcatctatcggttccgttcctgcacctaatgacgttgtggaatccttgcctgtcaaattatacacaaagttgcacaaacatcaagaagaacctgtacaatgttatatatgccttgtggagtatgaggatggagacagcatgcgagttctgccttgtcatcatgaatttcatacaacatgtgtagacaagtggctgaaggagattcacagggtgtgcccactatgtcgaggggatatctgtgtatctgattcactgccaagggagaactaa

SEQ ID NO: 5397 - DNA, 504 bp, Glycine max
  Peptide Sequence Number=SeqID_122175
atgcgtagagcacgaaaaactgaatggggtagtggtgctgggacttgtcgtcgatgttttgtagtcgcgagctctttccgcaaatccttacttccatggttgtctcctcttgttctcccttctccatggtcaccaccaacccaaccaccgaccattgttagtgccgccaatcacgccgttaccagccactgcttgcgccatcgccacccgccatcaccaacttctctctgtatctctctcacacttgggcctcaaacccacttgagatttgttgtcgccacggaagagaaggaaaaagaagaaaatggattggtgttaatttttgtgttgttgtcgtgggatttcaaggaaggaataaggtgggtccatttgatccaagacacaacgtcgactttgctgtcaccacgatctgtaactgttggattgggagatccaaatcggtcttattttggggttttggataagcagcgacgatgtggagctggaggagtgagtcaggaactg

SEQ ID NO: 5398 - DNA, 2028 bp, Glycine max
  Peptide Sequence Number=SeqID_122176
atgaagagcgtaaacgacgacgcttcaacccaagatctcgaccctcagagcgaccacagctccgattacttagctcacccccaaccccaccctcagccccgccgtcctcggggtttcgcggcggcagcggcggcggccaccaccaattccgccggcaaggggaagaaggagagggagaaggagaaggagcgcaccaagctccgcgagcgacaccgccgagccatcaccagccgcatgctcgccggactccgccagtacggtaatttccccctgccagcgcgtgccgacatgaacgacgtactcgccgcgctcgcgcgtgaggctggctgggtcgtcgacgccgacggcaccacctaccgccagtgcccccctccttctcacatggggtcatttgcggctagatcagttgaaagtcaactctctggtggttctttaaggaattgctctgttaaggaaacgattgagaatcagacatctgtgcttagaattgatgaatgcttgtcgcctgcatccattgattctgttgtaattgcagaaagggactcgaagactgagaaatatacaaatgctagccccatcaatacagttgactgcttggaggctgatcagcttatgcaagatattcattctggggtgcatgaaaataactttactggcacaccatatgttcctgtttatgtaaagcttccagctggtattattaacaaattttgccagttgattgatcctgaaggcataaagcaggagctcatccatatcaagtctttaaatgtagatggtgttgttgtggattgttggtggggcattgttgaaggctggagctcacagaaatatgtgtggtctggttatagggagctttttaacattattagagaattcaaactgaagttacaggttgttatggcatttcatgaatgtggagggaatgattctagtgatgcattaatttccctcccacaatgggttttggatattggaaaagacaaccaagatatattcttcacagatcgtgaaggacggaggaatactgaatgcctttcttgggggattgacaaagaacgagttctcaaaggcagaactggaattgaggtctattttgatatgatgagaagctttcggacagagtttgatgacctgtttgcagaaggtttgatttctgctgtggaggttggacttggagcatctggagagctaaaatatccttctttctcagaaagaatgggatggaggtatcctggtatcggtgagtttcagtgctatgataaatacctgcagcatagtctgcgcagagcagccaaattacgtggtcactctttctgggctagaggacctgataatgctggacattacaattctatgccacatgaaactggattcttttgtgagcgaggtgattatgacaactattatggacgcttcttcttacattggtactcccagacattaatagaccatgcagataatgttttgtctcttgcaacacttgctttcgaggaaacaaagataactgtcaaggtagtcttcctggttcccgctgtatactggtggtataagactcctagtcatgctgcagagttgacagcaggatatcacaatccaacaaatcaggatggatattctcctgtgtttgaggttctgagaaaacatgctgtcaccatgaaatttgtctgcttaggatttcatctttccagccaggaagctaatgaatcattgattgatccagagggtttgagttggcaggtgctaaactcagcttgggatcgcgggttgatggctgctggagagaatgcactcctttgctatgatagagaagggtacaagaaattggttgagattgcgaagcccagaaatgaccccgatcgccgacacttctcattctttgtttatcagcaaccatctttgctgcagacaaatgtttgctggtccgaactggatttctttgtcaaatgcatgcatgccttcaagaggtggccagcccccaagcagcaccgtaccatattagatcagtgctttttgcaagcttggtaa

SEQ ID NO: 5399 - DNA, 186 bp, Glycine max
  Peptide Sequence Number=SeqID_122177
atggtgctggaaccctatccggcaacaacaccacatcctggaaatcatgatgactctgttctttacagtgtaacctatggaagagcaatggtagatgtcctgttgctgactccagtaactgcttggttgctgcatcaatgtggagcactggtttctcagccaattgctcctgtaacctacatgtag

SEQ ID NO: 5400 - DNA, 2316 bp, Glycine max
  Peptide Sequence Number=SeqID_122178
atgtcatgtcttaccacaatctcagcagcagacaatcaattcaatggctctctcccgccaaacatgttccacactctccctaatctccgagaatttctagttggcgggaatcatttttcagctccacttccaacttccattacaaatgcttcaatcctacaaacacttgatgttggtaaaaaccagttggtgggccaagtgccaagtctaggaaagctacaacacctttggttcctaagcttgtattacaacaacttaggtgacaattcaacaaaggacttggagtttttaaaatccttggccaattgtagcaagttgcaagtggtttcgatttcctataataattttggaggtagtttgccaaattctgtgggaaatttatccacccaactcagtcaactatatcttgggggtaatcaaatatcaggaaaaattcctgcagaattaggaaatctagttagcttaactatcttaaccatggaaattaaccactttgaaggaagtattccagccaattttgggaagtttcagaagttacaaaggttggaattgagtagaaacaaactgtcaggagatatgccaaattttataggcaaccttactcagttgtattttttgggcatagcagaaaatgtgttagaaggaaagattcctccaagtataggaaactgtcaaaagttgcaataccttaacctttataacaacaaccttagaggaagcataccttcagaggtttttagccttttctcgttaacaaacttgttggacttgtcaaaaaattcaatgagtggaagtctacctgatgaagtgggccggttaaaaaatattgggaggatggctctatctgaaaataatttgtctggtgacattcctgaaaccattggagactgcataagcttggagtaccttttactgcaagggaattcgtttgatggagtcataccatcctcattggcttcactcaaaggtcttcgagtattagacatatcacgaaatcgtctggttggatcaattcctaaggatctgcagaaaatttctttcttggaatacttcaatgcatcctttaacatgttggagggtgaagtaccaatggaaggtgtctttgggaatgcaagtgagttagcagtgattgggaacaacaagctatgtgggggtgtttcagagctgcatctaccaccatgccttatcaaaggtaagaaatctgcaatacacctgaatttcatgtccataacaatgatgatagttagtgtggttgcttttcttctcatacttccagttatctactggatgaggaaaagaaacgagaaaaaaacatcatttgatttgccaataattgaccaaatgagtaagatttcctaccagaacctacaccatggaactgatgggttctcagttaaaaacttggtaggatctgggaactttggctttgtatacaaagggactattgagttagaaggaaatgatgttgttgccataaaggtgctaaaccttcaaaagaagggagctcaaaagagtttcattgcggaatgtaatgcattgaaaaatgttaggcatcgaaacttggttaagattttaacatgttgttctagcatagatcacagaggccaagaattcaaagctctagtttttgagtatatgacaaatggaagcttagaaagatggttgcatccagaaacagaaattgcaaatcatactttctcattgagccttgaccaaaggttgaatattatcatcgatgttgcttctgcatttcattatcttcaccatgaatgtgagcaagctatcattcattgtgatttgaagccaagcaatgttcttcttgatgattgcttggtagctcatgtgagtgactttggtttagcgagaaggctctcatctattgcagtttctccaaagcaaactagcactattgaaataaagggaacaattggttatgctcctccagaatatggaatgggttcagaggtgtctacggaaggcgacttgtatagctttggaattctggttttggaaatgttaactggaagaagaccaactgatgaaatgtttgaagatggtcataatctccataactatgtcaacatttcaattccacacaacctttcccagattgtggacccgactattctccctaaggaattaaagcaggcttcaaattaccaaaacctgaaccctatgcatcttgaagtagaaaaatgtctactttccctttttaggattgctcttgcttgttcaaaggagtcaccaaaagaaagaatgagtatggttgatgtcactagggagctcaatctgatcaaaagttccttttcatcatga

SEQ ID NO: 5401 - DNA, 414 bp, Glycine max
  Peptide Sequence Number=SeqID_122179
atggcatatttttcttcatggcattacaatattttagagaattattggcaattgaagaaacatgtgcctatcgaagaagagtttgtttctcagatcagaaattcatccatactgagaaatgaggattatttttcttcatgtgctatgctatctcttaatgtcaaggatcctcgagaattgccatggaagaagactgttgttctagtggagtccatttcaactaagactccgagtgatgcagaagaaaagaaatacaaagaggttgctgaattgggaggaatattggaagagaatagagatttatcttcattatcaaggtctaaacttgtagacagccagtttgatattgatggatctatggtatgctaccaccagaggcttgaggcctctagtggaagacagttatctttctaa

SEQ ID NO: 5402 - DNA, 495 bp, Glycine max
  Peptide Sequence Number=SeqID_122180
tgattcttggtgcgtctcttgcattgaatagttctctttgccatacagggaacggtgatataggagcacctcttgcaatctcacccaccatggtgagaaattggactagcccgagcgagtcacagattgtgtgcttcatgcgtgcagcaaaaacaaatcctccacgtgttagacggggcgtagtggtgaaggaactggagtggatggtggtggtgacagtgacagcggcagagaagcataacgggaatctgagcgtgaatttgagcagcgaggggagaacacggttgggttttcgtgggatctatgatggtttcggtggacctgatgcacctgattaccttctacccaatcgctacacagtggtgcataaggagcttaaagggttgttatgggatgacgagtctacaccggaaaattcgatgataaaggaggacatgttgcaagatgttactgcaaatgttacagtcactaatgaaaatgatgcttgttctcact

SEQ ID NO: 5403 - DNA, 321 bp, Glycine max
  Peptide Sequence Number=SeqID_122181
atggagataagcaaatcacttgtctccaacaacaataataaaaagaacaactgcacaccttccaggttagtcgggcctgatggtgttggactgttggtactgcctcgcaaagttgaacttaaggatgactcaagcttgctagttgcaacctatcaaccactaccagcagcattcacaaagaattctgaaacaccaaagaaagagaaagacctcaagttctctgagcaaagcagtgcaagtagagcttgtgcggatactagtgccatgtcccccaatggccagcattgttaccaaaaatatgagaccatctttcagaggtag

SEQ ID NO: 5404 - DNA, 225 bp, Glycine max
  Peptide Sequence Number=SeqID_122182
atgagtgcggagtacgtgagttctgtggtggatcttatggttctcaagggtcggcccaatcctagctacggaggacctgcaggggctataccttttgttagcttttatggacggtttagagatagtgaaggtgaggattgggttgtagtgccaattttgttgccacaccatgtcatgaagaagttcctctttgaactagtgaagatcacagtgaggtccctgtga

SEQ ID NO: 5405 - DNA, 2431 bp, Glycine max
  Peptide Sequence Number=SeqID_122183
gaacaatctgattggcaaaataccaatccaaattggttcacttcagaagcttgaacaattgagcacttctcgtaacaagttaactggaggaatcccttcattcacaggtaatctttcgtccctaactcttctcgatatcggtaataacaacttagagggagatattccacaagaaatatgtcttctcaaaagcttgacatttttagcattgggtcaaaacaacctgactggaacattacctccttgtctatataatatgtcatctcttactatgatctcagccacagaaaatcaattaaatggttctcttccacccaacatgttccacaccctctccaatctccaagaattttatattgctgtcaacaaaatctctggtccaatcccaccttccatcacaaatgcatcaatattctttttagcacttgaggccagtaggaacaatcttacgggacaaattccaagcctggggaagctacaatatcttgatatcctatctctgtcatggaataatctaggtgacaattcaactaatgatttggattttctaaaatcattgacaaactgcagtaatttgcatatgatatctatctcctacaataattttggaggtcatttgcccaattctttgggtaatttatcctcccaacttagtctactatatctcggaggtaatcagatatcaggagaaatccctgcagcaataggaaatctaattggcttgactcttttgacgatggaaaataacagcattagtgggaatatcccaacaagttttgggaagtttcagaaaatgcaaaagataaatttggctggaaacaagttgtcaggagagattagagcctacataggcaaccttagtcaattgtttcacttggaattaaatgaaaatgtgttagaagggaatattcctccaagtttaggaaactgccagaagttacaatacttggacctttctcataacaaccttacaggaaccataccctcagaggtttttatgctttcctctctaacaaaattgttgaatttgtcacaaaactcattaagtggtagtataccagacaaagtgggcaacttaaaaaatcttgatttactagatatgtctgagaatcgtctatctagtgaaattcctggaaccatcggagaatgcataatgttggaatacctttatctgcaagggaattctctgcaaggaatcataccatcctctttggcatcactcaaagggcttcaacgtttagacctctcacgaaacaacttgtctggatcaattcctaatgttttgcagaaaattacaatcttaaaatatttcaacgtatcttttaacaagttggatggtgaggtgcctactgaaggtttctttcaaaatgcaagtgcgttagtgttgaatggaaatagtaagctttgtggaggaatttcaaaactacatctaccgccatgccctctcaaaggtaagaaacttgcaagacaccaaaagttcaggttgatagcagcgatagtcagtgtggttgtttttcttctcatgttatcctttattctaactatctactggatgagaaaaagaagtaacaaaccgtctttggaatcacctacaattgaccaccagctggctcaagtttcataccaaagcctacataatggcactgatggcttctcatctacaaacttgatagggtctggaagtttcagctctgtctacaaaggaactcttgagtttaaagacaaagttgttgccataaagtacatgagaaatggaagcttagagcaatggctgcatcctagcacactaaatgcagagcaaccgagaacattgaatcttgatcaaagattaaatatcatgattgatattgcttctgcaatacattatcttcatcatgaatgtgagcaatcaatcgttcattgtgatttaaagccaagcaatgtccttcttgatgacgacatggttgctcatgtgagtgattttggcatagcaagacttctctcaactatcaatgagaccacttctaagcaaacaagtacaattggaataaaagggactcttggctatgctcctccagagtatggaatgacttctgaggtgtcaacttatggggacgtgtacagctttggaattcttatgttggaaatgcttactggaagaagaccaacagatgaaatctttgaagatggtcaaaatcttcgtaactttgttgcaatttcatttcctgataatatttctcagattttggatccacaacttattccaagtgatgaagcaacgacattgaaagaaaaccatcataatcttaatccaagtgttgagatgtgtttagtttcactttttagaattggacttgcttgttctatggaatcacagaaagaacgaaagacaatgaatgatgtcatcatggaacttaatcgaatcagggaggtcctttctacctgttggtga

SEQ ID NO: 5406 - DNA, 1953 bp, Glycine max
  Peptide Sequence Number=SeqID_122184
atggcttccgctgcgccaggtgcaaccaatgatgctttatacaaggaattgtggcatgcctgtgctggaccccttgtcactcttccgcgtgaaggggagagagtttattacttcccgcaaggtcatatggaacagcttgaggcatctatgaatcagggattggagcagcaaatgccttccttcaatctgccgtctaaaattttatgtaaagtggtcaatgttcatcttcgagctgaacctgaaacagatgaagtatatgcacaaataactttgcttcctgaagcagatcaaagcgaggtgacaagccctgatgatcctttgcccgaatctccaaggtgtacagtccattcattttgcaagacactcactgcttctgacactagcactcatggaggtttctctgttcttcgaaggcatgcagatgattgcctgccgccactggatatgactcaacagccaccatggcaagaattggttgcaactgatctgcatgggaatgaatggcattttagacatatttttcgagagtgtggatgtggtcgttgcatatttctacagattgaatatgctgagggtgaaaatggagagctgcgagttggagttaggagactcatgagacagcatagcaacatgccatcttctgttatatccagtcacagtatgcatctgggtgtcctggctactgcatctcatgccattgccacaggaacattgttttctgtattttacaagcccagaactagccggtctgagtttattgtgagtgtcaacaagtaccttgaagctcaaagtcataaactttctgttgggatgagattcaaaatgagatttgagggtgatgaagttcctgaaagaaggttcagtggtacgattgtgggtgttgaagataataagtcattagtctgggctgattctgagtggcggtcattaaaggttcaatgggatgaaccatcgtctattttgcgtcctgatagagtttctccatgggaattggagccacttgtgtctaaccctcctacaaactcccagccatcccaaagaaacaagagatcgcggcctcccattctaccttcaacaatgcttgattcttctctgcaaggtgtatggaaatcaccagttgaatctgcaccattctcttatcgtgaccatcaacatgggcgagatgtctatccatcaaccaatttcaattccactgcaactggttttcttggttttggtgggaactgctctgcttccaacaagtcaatatattggtctagtaggatcgaaaactccacagaatctttttctcctgtagcagttaaagaatttggagagaagagacaagggactgcaaatggatgtaggctctttgggattcagttacatgacaattctaattctaatgaagaaagtctaccaatggtcagtttgtcaggaagggtgggtgatgatggcctccttccatctttggatgctgagtctgaccagcattctgaaccatcaaatgttaatcgatctgatttcccttcggtaagttgtgatgctgaaaaatcatgcctgcggtctccccaggagtcacagagcaggcaaataagaagttgcacaaaggttcacatgcaaggtatggctgttggaagggctgtggatttaacacggttcgatggatatgaggatctgctaaggaaattggaagagatgtttgacatcaatggtgagctctgcggatcgacaaaagaatggcaggttgtgtacactgataatgaagatgatatgatgatggttggggatgatccatggcttgaattttgtagcattgtgaggaaaattttcatctacactgcagaggaggtgaagaagctttcacccaaaataggacttccaatcagtgaagaagttaaaccctgcaaaatggactctgaagcagtagtcaatcctggggaccagtcatctattttggggcctggttgctaa

SEQ ID NO: 5407 - DNA, 1500 bp, Glycine max
  Peptide Sequence Number=SeqID_122185
atgagttggatgtcggtagatgagttcctggtgcagtgcaagaagtcaggagacgctgcctacgcctccttgcggtcgctgctggagcgcctagacaatcccgagacccgttctcaggctcggatctttctttcccaccttcagaagcgttttcccaccaaggactcctgcgatcaatgctttgaaacctaccattttcgcatcgaagatgtttccttgggccaatacgaggggcatcacgggagaaacaaattgactatgatggtcattccaagcatttttctccccgaagactggtccttcactttttacgaaggcattaatagacatccagactccattttcaaggagaggactgttgccgagttaggttgcggaaatggatggatttccattgccatggccgagaagtggttaccatacaaggtctatggccttgatatcaatcctagagcggtcaaggtttcctggataaacttatacttgaatgctttagatgaaaatggccagctaatctatgacgaggagaataaaactttgctggatagggtagagttccatgaatctgatcttctatcctattgcagggaaaaagacattcaacttgaaagaattgttggatgcatacctcagattcttaatccaaatccagatgcaatgtctaagatgataacagaaaatgcaagcgaggaattcctgcattcattgagtaattattgtgcacttcagggttttgtggaggaccaatttggcttaggtttaattgctagggcagttgaggaggggatagcagtaatcaaaccaactggaattatgatctttaatatggggggccgcccaggtcaagctgtttgcaaacgattgtttgaacgtcgaggttttcgcattacaaagctttggcaaactaaaatcattcaggctggtgacaccgatattgaagccttagttgagattgagaagaacagcccacaccgttttgagttttttatgggactttctggagatcagcctatttgtgcaagaaccgcgtggacttacggaaagtctggtggcagcatttcccatgctttatcagtatacagttgtcaacttcgtcaccctaaccaggttaaagctatttttgattttctaaaacatggatttcaagagatcggcagctccctcgatttgtcttttgaggacgattctgttgctgatgagaagattcctttccttgcttatcttgcaagcagattaaaaaataattcttattttccgtatgagccaccagctggtagcaaacatttccgtaatctcatagcaggatttttgaagacttatcaccatattccactcacttctgataatgttgtcatttttccttcaaggactgcagcaattgagcatgctcttcgcttgttctcacctcgccttgcagttgttgatgaacatctgactcgacacttacctaggcagtggttaacatcttcaacccttgaggtatggaatagcatgccttga

SEQ ID NO: 5408 - DNA, 1725 bp, Glycine max
  Peptide Sequence Number=SeqID_122186
atgacttatcttctctattgtctttggcccattcaagtctccctcaagagtgctactaggtgcacccagcattattgctgcatcttctccttccgcgagactcttccgccggcggccctttcttccttcttcctcattcttccgcgaggtggttgtgcttctccaacgcgagctactgcttctccctccttcgagtgcgcttcttccattcttccacaaggttctgctcttctgttcttcatcgagatcatggttaggacgagaggattaggtcgtgttttaggtcaggttactggcagaggagatcgtgatgattctgatgatgctccgcagcgtcgacgacctactgcatccgcacggaggcagcgagtcgctggatttccgggtggtccgagcgacccatctgtgttgacaacgtatgcagatcacgttgcttgcagcgtatggacgggagaggagcgtcctgaattgaagttatcctcgcatgggaggaaggtccatagcttaggcaggcctgtccctgccattgagggactcatcgctggtacaggactaagtcctctgatcgcgtgttcggtagacaccgacgatcggggacttttgtccgccgactttcacgcatttgagccattgcacgtggatgatgtggttcagatgctggtggacttgctgatggtgtctccagagtttgctagggctgagacagtccagtgttgcggaccgtacgtacgcctgcaatgggtacgtgatgtatatcagcgccgatgccaggcaggtcattggacagctgcggctcgtgcatatcttcttcacctgctgggttgcactttgtttgctaacaagagtgcaaccaatgttcatgttgtctacttggaggcccttcgggacctcagtatgatagataggtacgcttggggagtggctgctttgtgctggatttacgagcacttttcgtcagttgcggagtccaccgctgatcaggactacgacgaggcttctccgcgtgcgtgcagatggattgtgacgaagaagaccgtgaagagcatttgcatgccgtcgtatagggagcacctgaaccgactccggattccggatgtctgttggatcccgtatggggagcatcgggaggtccgggacttccacgtcagatcatgctactccggtctcttgcgctgggggcatgttgctgtgtattaccgaccggagagggtcgtgtggcagtttggttacacgcagaccattcctgctcctcctgtcgattcatgggtctcgtatgatgatatacacgataggtggatgcactacgaggatcatatcgtatctgcaggtgaggtgtgtgtggtgccaggggcgtgttccagtgactacatcgactggttcttccgcatctcccatcctttcatgacaccaggccacacagtagatcctctgcctcatggtcatgccccgcagccccgagtcgtccctcaggccccgcagacggatatccctcgcgtgccggagccagaagcatcgtcgacatctacggaggagcccagacatgcagtggaagtttgtgatgacattgctgagcggttggagcgtcatctgagtctaggggtggtcacgcctggctcatcgacacatgaggtgatcgaagaatgtctcagattggccaggagtgtcacacaggaccatctagtatacgttaggtgtagacgcagacggcacactgatcaggcttag

SEQ ID NO: 5409 - DNA, 1626 bp, Glycine max
  Peptide Sequence Number=SeqID_122187
atggagcaaaacctaatgctggccgcagaagcagagcgcgaaaaaagcaaagccatgtctgattccgacgagaggatgaaggaaaccctagccctgaccgcagaagcagagcgtgacagagacaactccatgtctgatttcgacgactctgattctgaggacgaagctcagcagaacctccaactcgaatctctccagaccgagcttgttactaatccctctaactacgatgctcatttgcaatttggtgttgatgatcctccttttcagtatataacgcttctgaggagaatgggtgatgttgataaactgtcaagagccagggaagctatgagtgaactctttccgttgagccctgcaatatggcgccaatggatcaaagatgagctttctctcaacactgctactcgacccgaggctttctctagaattctgaagctttacgaacgaggggtgtttgattatctgaagaaggtttatcttttaaactgtagatccttaaattggatacttaagggtttagatgtgtctgtctctctatggtgtgactacattaattttgtacaagagtttgatccaatggtacgccaatgttcacctactggtatttccaaggcaagggatctgtttgagagtgcccttactgcagccggtctgcatgttgctgaaggcagtaaaatatgggaagcatacaggaaatatgagcaggctatacttctaaccttcgatgatattgatgcacaggccaaagaaaagcaagttcaaagcattcgtagtttattccaccgccagttgtctgttccccttgctggtatgagttcaacaattactgcctataagacttgggaggtggaacaaggaagtcttcaagatgttgaatccattgacttggttgatatttatcctcatgttgcggcttcataccagaaggccttggatatgtataatgctcgttttcatcttgaagaacagattttgagcccgaatgtttctgattcagaaagattacaacactacatgaactatttgaaatttgagcagtcttctggaacgccagccagaattcaagttctatatgaacgagccattactgactttcctataacacctgatctttggctggattatacttgcaatttggacaacactttgaaggttggtaatattgtcaacaatgtttattctagggcgactaagaactgcccttgggttggagaactttgggttcgatgtatgctttcattggagcgtggtcatgcttctgaaaaagacttgtctgaacgtgcatcggattatctgtcgccatacttgaagaatacagagggtttgctacatttacatgcttattgggctcgtttggaaacaaaacttgggaaagatataactgcagctcgtggagtttgggagaattgtctgaagatatgtggttcaatgttggagtcatggactggttatatagcaatggaagtggaattgggtcacataaatgaagcaaggtccatatacaagagatgctacagtaaaagattttctggaactggttcagaggaccataatgatgaggagcgtcagaagggagaagtgagggcagcgagctgtgataagagagggcagacacagggctga

SEQ ID NO: 5410 - DNA, 375 bp, Glycine max
  Peptide Sequence Number=SeqID_122188
atgcaacatttaatctatgatcaaggctcaatgtcctcgtatgctctgaaagggaggaagccaggcagaattggaaggaacagaaatgcaaagcatagccaggtggcttccatcaccccaagtacaaaacagttgtctttcgtatactacaagaaagaggcttctttaccaatgtatagtggtaggtcgggtattcaagatggacttgtgaaggactggaagcagctatattctcatggaaagagagaattgcagaacaagtttgtggaaaatccccagttcgatcctcatgatcatttattattggacggagcagaaacacttttgcagcttcttaagactagatactcaaacatttctgggtgttacatgtaa

SEQ ID NO: 5411 - DNA, 297 bp, Glycine max
  Peptide Sequence Number=SeqID_122189
atgaatgaaaactggcaattagagcctgagccagaggaagctgtagacacaaggaagaatgaacagggagtagtggaagtcttggtgaaatggaaagaccttccagactttgaaaattcctgggagccagtggaaaagctcagatcagaatttcctggatttcttcttgagggcaagaagagttttgaaggcgggggaattgataagcaacagatagtatacacgaggaaacatggtaagggaagtgtaggggatcatcccactagaggagtaactaacttagtggggaatgtgtga

SEQ ID NO: 5412 - DNA, 462 bp, Glycine max
  Peptide Sequence Number=SeqID_122190
atggttacccctcggctggaagagctaaagttatttaggatacagcaggaatccaagacagcagaggaaagtgaaaagaatcctaagagaaatgctcgtgaaaagagaaagctgggatccgatataactgaagaacagtatccaacaaagagatttagagatgttggaaatccaaagaaagcacctgaggagaataaatatcaactgcagaacacttctcaggtgacaaaagtggaaggggccaattggaagaatactaaaattgatgataacccaagtgagcaacagtttaaccacgaaaagaacagggcatactctgaccagtgcaccgtttttatatcaaatcttcatcctacggcaaattatgaacatattcgtaatttcttcggcgatgatggtggaattgttgccatccgcatcctacatgataaattcactggaaaatcaagggactcaatctga

SEQ ID NO: 5413 - DNA, 1185 bp, Glycine max
  Peptide Sequence Number=SeqID_122191
atgggtcggaatcaaagggagagggagaaagaggaaggagagaagcacgtggggcttctgagattggcccaaatcctaacatttttggtggtgtttgcgggaggagtggtgattggtctgaccacaagctctcacattaatggccatttcatatcgcagccgtaccagtacatctccttgcgtaatgttccatctcctcctcctcctgagcccaccgccatggctgctgcagatcctcctcttcctcctaatctggacttggaggccttccttcatccccttaacctcacccactgcctgtccgacgaggagcttttctggagagcctccttgattccgaagaaagaatcataccctttctccagaatccccaaggtcgccttcatgttcctcacccgtggcccccttcccatgttgcccctctgggagcgtttcttccacggccactcctctctcttcaacatctacatccattcccctccccgcttccttctcaacgtctcccactcttcccctttctatctccgccacatccctagccaggacgtctcttggggtaccgttaccctcgctgatgctgagaggcgccttttagccaatgccctcctcgacttctccaacgaacgctttgttctcctttccgagagttgcatccctgtctacaacttccctactgtttaccgatatctcactaattcttccctcagctttgttgaatcctatgatgaacctactcgctatggccgtggtcgctacagtcgcaacatgcttcctcatattcaacttcgacactggcggaaaggctctcagtggtttgaactcaaccgtgctctcgctgtttatattgtctccgacaccaattattattccctgttccgaaaatactgtaagcctgcttgctaccctgatgaacattacattccaaccttcctcaacatgttccatggttcgcttaattcaaacagaactgtcacctgggtcgactggtctatgctgggtcctcatccggcaacctatggcagagctaatataactgcaggttttatacagtctataaggaacaatggttccctttgtcgttataattcagagataacgtccatttgttacctctttgctcgcaagtttgatccaagtgcactcgagcccttgcttaacctttcttcagaagtgatgaacttttga

SEQ ID NO: 5414 - DNA, 261 bp, Glycine max
  Peptide Sequence Number=SeqID_122192
atgattaaaaatcaggaattgaagattaatacttatgtcaataacaatagagataacagagcagggtcacagagactagaaagagaacagaagcgagcaggggctttgctagaaaatgctgaaagatgcctgaatacatgttggagaaaaagaaccgaacagagcaggttgcagaggtgggtaggaaaatgctggaaatcatcagagaagaacggtgtttgtccagggagacaacacaaaattaggtcactgaaagcatag

SEQ ID NO: 5415 - DNA, 315 bp, Glycine max
  Peptide Sequence Number=SeqID_122193
atggtggagacgaacattttcacactgaaattcatagcatttcccgactccaaaacctatcttgaggaatctagtgtcgtagatctaggcttcaacgaactcggtgtcattgtagatttggtgcgagcgtaccatgaagatgaggattttggagcgttaaacatttggtgcagctccgataaagttgatgacgtcgtgtatatctgttgcggatttggtgtggcacaccctaaactagtcaattccagagacacgaaaatcgtgatcatcagcattagaaagatctctggaaaaggaggggattacgataattga

SEQ ID NO: 5416 - DNA, 576 bp, Glycine max
  Peptide Sequence Number=SeqID_122194
atggagaagcttattaggccatgcgataaagaatacatgagaattaccatgctaaaacaccaagacactttcaaagaacaggtgtacgaacttcaccgtttgtatcggattcagaacatattgatgaaaaatatggaagccactagaggcgcgcagcaaaatcctaagttgaactttgatcttgaaagacctgctaaggaggacatggcagaagctgacagcgatggagttctggaggttataaatgagactgagattgagctgacactaggcccttcaagttacaaacgtaaaaaagtggagacaccactaacttcagattcggcacataggttgtcttcttcttctactggatctagccttataaacaagacaagattgaagacccgtcatagcagttattcagctgcagaagaattaagtggaggcttaattggccttgtccatgtgcgacattcgaccgcagggtgccaaagtggaattagaaggagttatgaaattgaagaacgatcaagagatgagagaacgaaacagccaccttggttttttcaagtattgagtctgaacacgaactaa

SEQ ID NO: 5417 - DNA, 1554 bp, Glycine max
  Peptide Sequence Number=SeqID_122195
atggaactctcttcctcctttctattctcccctaaaccatgctcatgcccgccacctaactactccctctcccccttgatcagaaacagaaaccccaatttccgaattgtcgcggtggccttagagccccaacagcaacaagacttccccagcgggaacagtcctcagcgactcctcaaggaactcgccgaacgcaagaaagcaacttcccccaaaaaaggacccccgaggaggttcattctaaggccccctatagacgacaacaaattagcagaaaggtttctcaacagcccacaactttgtctcaaattgtttcccttgttgagttcgtgtttgccttcgtcgcgcctcaacaatgcggataaattgtggattgacgagtacttgctcgaagcgaagcaagctctggggtactccctcgagccctcggagacgctcggggacgataaccccgcgaagcagttcgacacactgctgtacttggcgttccagcacccgtcgtgcgagaggacgaaggcgcggcacgtgcggtcggggcattcgaggttgtcttttctgggacagtacgtgctcgagttggcgctgacggagtttttcttgcagaggtatccgagggagtcgccgggtccgatgagggagagagtgtttgggttgatagggaagaggagcttgcccaagtggattaaagctgctagcttgcacaatttgatatttacgtttgatgatatggataagatcatgaggagggagaaggaaggtcctgtcaagtcagtattttgggctttgtttggggctatctatctttgttttggtatgccagaagtgtatcgtgttctttttgaagtcttcggaatggatccagatgccgaagattgccagcccaaattgcgtagacaacttgaagatgtggattatgtatctgctgagtttgaaggcaagctaagctggcaagatatcgttgcatataaggcaagctacacatatgctctgtttgaacacccaaggctattcagagcttgtgttcccccaggaatgcatcggtttaggggcaatatatgggattacgatacaagaccccatgttatgaaaacacttggatatccattagaaatgacagacagaatcccagaaattactgaagccaggaacgtagagcttggacttggattgcagggagggtttgtttgtttgtctgagttgcagagctatttagcctacagtgatactttcaaggatttggtgatggctgaaagattattgatgaagcatttagatgctccggggttgtggctacaagagaagcaccgtcgccttcttatgaacaagtattgtggaagatatttgagggccaaacatcttcaccgggttattatatttgatgagaaggttcaagacacttatgagcataaccggagaaagagaaacccagccacgacagctgttcaacaagctcttcatgggctttcgtatcttgtttatgggaaacgtgatgtgaggcgtctgatgtttgaggtttttgactttgagcagatccagccaaaagaagtagtttaa

SEQ ID NO: 5418 - DNA, 165 bp, Glycine max
  Peptide Sequence Number=SeqID_122196
atggacatggaatggaagcacgcgttgccggggcagaaaggtgcatttgtatggagcagtgggtcctatgctatgggtgtcctaaagggaaaagccagagttgcacgggcttatgctgttgtatatattcctgagcagtgtgacactgtttttattccgaattaa

SEQ ID NO: 5419 - DNA, 1038 bp, Glycine max
  Peptide Sequence Number=SeqID_122197
atgaatgaagcatccatcaacaacacggagagttatcaatacctccatccaagcaagaacccggccactgccctcgtttccccagtcctagactcaactaactaccactcatggagtaggtccatgatcactgcattaagtgccatgaacaaagtagagttcatagatggtagtgcgcctgaaccactgaaaacagataggatgcatggagcgtggcgtcgatgtaacaatatggttgtttcgtggatagttcactcagtggctacctcgatacgtcaaagtatactttggatggacaaagcggaggaaatctggcgcgatctgaaatcaagatattcacagggtgatcttcttcgaatctccgacctccagcaagaagcttcgacgatgaagcaaggctcactcacagtgactgagtatttcactcgtctacgtgtaatttgggatgagatcgagaactttaggcctgatcccatctgttcttgtaatatcagatgctcctgcaatgcattcaccgttatcgctcaacgaaagctcgaggatagagctatgcagttcctgcgaggcttgaacgaacaatacactaatattcgttcccacgttcttctcatggatcctatacccgccatatccaaaatattctcctatgtagctcaacaggaaaggcaactgctgggcaacaccggaccaggtattaacttcgaacccaaagatatctccattagcgctgcaaagaccatttgcgacttctgtggacgcattggtcatgtggaaagtgtgtgttataagaagcatggtgtgccctctaattacggttcaaggaataagagtaacagtggaagaaaaacgtgcacccactgcggcaagataggacatacagtggatgtctgctatcggaaacacgggtacccgccgggatacaagccttacaatggaaggaccaccgtgaacaatgtagtggcagttgaaagcaaagctactgatgatcaagctcagcatcacgagtcccatgagttcgtttgcttctcccccgagtaa

SEQ ID NO: 5420 - DNA, 2004 bp, Glycine max
  Peptide Sequence Number=SeqID_122198
atgccattttctcctagcagttcacatgcatctcacgttttcgatttacttcacatggatatatggggttcgtgctcgaaactatcaatgcatggacacaaatatttcctaaccatagttgacaattgctcacgctttacatgggtacatctcatgaagtctaaagctgaaacacgacaggtcattataaatttcattgcattcattgaaacacagtataatggcaaggttaaaatcataagaagtgataatggggtcgaattcttcatgcatcattattatgcatcaaaaggtatcatacaccaaactacatgtgttgagaccccagaacaaaacggtgtcgcggaacgaaagcaccagcatctactcaacatcacacgcgcactcctatttcaggcgagtctaccacctagtttctggaatttcttcataagcatctcctcaacagcagaaccctcctcatatgccgaagcttcccgccatgactgttggattaaggcgatgaaggtcgagttacaggctctccagtcgaataacacatggagactcacacgtcttccccctcacaagacagctattggatgtaggtggatatataaaatcaagtatcgggcagatggttccatagagagacacaaagcacgattagttgcaaaagggtacacccaaatggaggggttggattacctcgacacattctctccggtggcaaagcttactacagtttgtcttctccttgcgttagccgcactcaaccaatggcatctacggcagctggacgttaacaatgcatttctccatggagagcttgacgaagaagtgtatatgcaaataccactaggtctttcagttgacaatccacagcttgtgtgtcgtcttcaacgctcactttacgggcttaaacaagctagcaaacaatggttcatgaagttatctagcttcctatgctctcatgggttccaacaatcaaatgcagatcattcactctttctgcgcttcaccggagtcatcactacaatactcctagtatacgtggatgatatcatcctcacgggaaacaacatggctgagatacaaactatgatcacgctcttggatcgcgagttcaaaattaaggatcttggagatttgaagttctttcttggactcgaaattgcacgcacctctaagggaattcatctgtgtcaacgtaagtataccttggatattttatgtgattcaggaatgttaggttgcaagcccaactcaacacctatggattactccacaaagctgcaagcaaatttcgaaaatcttctttcagcagattcttcttcctcctatagaagattgataggcaaactcatataccttaccaacacgcgacccgacataacatatgcagttcagcaactcagccagtatatggccactcctaccgatacccatcttcaagctgcctttcgcatccttcgataccttaagggtacgccaggctcaggactcttcttcgccgccacaggcactccccaacttcaagcattcagtgactcggattgggcagggtgcaaagattcaagaaaatctactacggggtacttggtttaccttggctcttcccttgtctcttggcaatcaaagaagcaatcaaccgtgttgcgcagctcctccgaagctgagtatcgagctctcgcttccaccacctgcgagctacaatggctaacttttctgcttcaagattttcgcgccacattcactcaaccagcaaccttatattgcgataaccagtctgcaatccaaatagccacgaaccccgtttttcatgaacgaaccaaacacattgagatagattgtcacatcgtccgacaaaagcttaactcaagtctcatcaaacttcttcccgtttcatcatccctacaactcgcggacatattcaccaaggccctaacacctaccatttttcagcatttttgtaacaagctgggaatgatgaatatccattcccagcttgaggggggctcttaa

SEQ ID NO: 5421 - DNA, 186 bp, Glycine max
  Peptide Sequence Number=SeqID_122199
atgtggaatatgaaaagtggatgcggcaagcaaaattattcgaaggagagcaaaggtgtgacgcggatttcaccaacgttccctttcaagtttcaacaattaattttggcgaacacgacaaattccaagcttcttggtgtggatgcagtctcgctattgaacaaaaagatatcttctgacatctaa

SEQ ID NO: 5422 - DNA, 138 bp, Glycine max
  Peptide Sequence Number=SeqID_122200
atgccgattgatttgaagaggaaggacaaccaagcaagttactttatgttaagagacatggggaccttgccatcaacatcatcattcgtgagtggaatcgtactcaagctaatccaaatttcatcaacgccacattag

SEQ ID NO: 5423 - DNA, 1215 bp, Glycine max
  Peptide Sequence Number=SeqID_122201
atgaggtatggtgttgggctcacgtcttccttgcgggaatttgtgactgaggttttcaagaaagctgggaggagtgacgagattgagaggctgctagatatgaacagatttgcatacactcctcgtccttccccaccaagacctgcttaccgtccaccaccaccaccaccggtcaggttcccctcccaaatggcaggggcagcacataacccaccttctgggtttcaaacacaaatggcagcacagtggcatccaacacctcctcctcaaatgacaggagcacattatccaccttctcaaatggctggagcagcacataacccaccttctggttttcaaacacaaatggctgcacagcagcctccaacacctcctcctcctcaaatgacaggagcacattatccaccttctcaaatggctggagcagcacataacccaccttctgggtttcaaacacaaatggcagcacagcagcgtccaacacctcctcctcctcaaatgacaggagcacattatccaccttctcaaatggctggagcagcacataacacaccttctggtgctccacatcaggtgttggggcatcaacgcccgccactgccttctcaaatgacaggaatgcatcaaccttcatggggattatctcctccaatgactgggcctcatcctggatcgtcacctcatatgacaggacagtcataccaccctaatacatctgaacatcctcctcacatgagcagggtagccccgcaaatgacagagcagcattatacaccatctggatcttcacctcaaatggcaggacacggacatcagccttatggaacaccacatgggccccaacaaatggaagaacgatggtatccatcgtcagggttgtctcctccaatgtcagggtcctctattccttggaatggagcatcagctaaaatgtcaccaccatatcatagatctgcagcaccatcttctcaggtgactggaccatatcacccatcatcatcatcatcatcccctcctcactttgaggaatctcatcaacagcaatcagaagtccctgaacagagaacagttgatctatcattgccatatcttaagtgtcttgtgacaccaatttctctgctgtttggaatcaaccaagtgtttggggtatatatgtcttgtgtatggatatgcatactgtctgggtctgggaagtgtgaagaagcagatttttaa

SEQ ID NO: 5424 - DNA, 291 bp, Glycine max
  Peptide Sequence Number=SeqID_122202
atggcggagatcagaaaaaagagcatggcaatagacacatgcatgatattttgtccggagaaagaaaaagaaaaaggaagagagaaagaaacggggaaagaagatgaagggttccattattttttgattttagattgtgcgccattttttgttctatatctgattatgatttggtttaattttatttgtgcgtcatacaagcaaccgctttacattgacctgaccttccaaggccaacttccttctcgcaaccctcaactgactctaaccaacttcccttattccctttaa

SEQ ID NO: 5425 - DNA, 276 bp, Glycine max
  Peptide Sequence Number=SeqID_122203
atgtggttgttattcatctcttccatatttcagggcgatcgaatgagaaatgttggtgtggttgattctgagtacatagttcatctgggtctgcctactcatgggggctcaaatggcaacgaggcaagtccaggctccccaggagataatagatctaaagttaggatgcagtcatacattgaaatgcaggtttttggtaaaaggtggaaagatgcagcagagaaagacaaatgttggatcgatccgtatgcacaggaaaacaagacgagccattag

SEQ ID NO: 5426 - DNA, 1185 bp, Glycine max
  Peptide Sequence Number=SeqID_122204
atgtcactgttttctacttattccctgcctctctcttctctccatcccctgtcttctaggcatacaagtcaagtttccctcttgattgcctttcatgcgatcaggataactacttgtattcattatttagtagttaaagggaataagtggagttggttagagtcagttgagggttgtgagaaggaagttggccttggaagggagagaatcaggtctcttgaatacctgggaggaattttaaagcgcccattgaacttgttggctatggcagtaggacttgagcaaaaagaaattgtcaacaaaattgttgaaaagttcttgtcaagtgactttgttgtgatgctttttcactatgatggttttgtggatggatggaagagtttagcttggagtagtcgtgccatacatgtatctgctatcaatcaaacaaaatggtggtttgcgaagcggtttttgcatccagacatagttgttgaatacaattatatatttctttgggatgaggaccttcttgttgataattttgacccaaaaaggtatttatctattgttaaagaagagggacttgagatatcacagccagctctggatcctaccaaatctgaagtacatcatccactgacagtccataaagcaggatcaaaagttcacaggttgaccttattttcccaaccttttgcaataaacagtgttccactggtagtggaaggtgtgatgacaaaagcactgctcctccttgcattgggtaaaaacagttgcacaccttgggtggaaatgatggcaccagtgttttctaaaaagtcttggcagtgtgtatggcatttgatccagaatgacttaatccatgcctggggcctggataggcagcttggctattgtgcacaggcaccatcaggctcctcaggagataatagagctaaaatttatgcacctttagctccaattctcacccttgacaaaggaatatactacatgcaggtgtgggatttcgtaagagtttgcaggaacattgcttccttgaccattattttactttcgttttgccttcacgccattcatttccttaaacattggtgtgcattgggttgcatagagttctttatatggcagcagaaaaatgtgaggcatagatttttttttttcctccgtgaaggtcaggtcaatgtaaagcggttgcttgtatga

SEQ ID NO: 5427 - DNA, 264 bp, Glycine max
  Peptide Sequence Number=SeqID_122205
atgaaggcgatgtgtggcaaagaaatccattggcaggaagagaggagagtaaccaacacttacattgcatacagaaaggaagggatagaaacagtggagcagaagaaaaagccgaaagagaaagacaaagacaaaggaaacgagcataccattaatacgacggtagcatgctgtataaaagattggattggattaattgaagaaagaagatggtcacgtcatttcccagattgggagctacgtgtcttgttgaagctctcatga

SEQ ID NO: 5428 - DNA, 894 bp, Glycine max
  Peptide Sequence Number=SeqID_122206
atgggatttgcagaaccgtgcctcttcctcacacttgtatttctccttcgtgcacctttacagaatttggagactggaattatgagcagaaaatggaatgtgaaaacttcgggatatattcttctttactgccttccaatgtttgttcttcagctttttgttattttggttggacctcagttagacaagaataagggttttggaaaaatgttgcctcattatttttcaagtgcagtggttgcctctggggagaatgataccaccctctgtacttaccctttactcagcactattctccacggcctttttgccattatcctgacttcctaccttttttggcttggtagtcggattttgaaattagttattaacaagggtttgcagaagagggtttacacattgctattctcagtttcatgtttccttccattaagggttctttttcttggtttatctgttttgtctggacctgaacatgttatgtttgaagccttagttttcttggcttttcttgcactagtatgttgtgttggcttgtgcatgtgcacacttgtttaccgtccagttgcagattgcttagcgctgggaaatctacaagacttagaagccaggaggcttaatgatgatcataatgatactgtgtctcttattgctaatcagagttatctggaagataatgttgaagataatgctcggtctagtcctggtagatattctgatgcatcgacaaagcgtggatcaatttcatttcggacattggaaaagggggttacatcaactggaacatttgtagaactaagcctcttctctcccagccgcagtgcaacccctccaggatcgcctcctcttctaggttggcctatgcgatccccaacacaagttattggaccatag

SEQ ID NO: 5429 - DNA, 363 bp, Glycine max
  Peptide Sequence Number=SeqID_122207
atggaagctacagtaatcatcgccaaggctttggccaatggaggagttaaacctcttgactggcgggactttttgttgagattatcagattctcttgtcaattcaacaatgagtttcataaaggagaacaatgctaataatgttgttgcaactcacatgggtaaggtccctaccattaaaattgcccggaccttttcgttgctcttctcgcagcgcatcgatgacaggtgtgtttgctcttctcgcaccgcaccaacgaccggtgtgttacaggattttctaattgaaaatgcagagggaggtcgatgcggtgcgagaagagcaaacacacctgtcatcggtgcgatgcgagaagagcaatga

SEQ ID NO: 5430 - DNA, 855 bp, Glycine max
  Peptide Sequence Number=SeqID_122208
atgaaactgtcacaggcattggtgcgaacacccttctcaacaacatcaccagcgttactccgcactcaaaattctatcttgtcctcaaatggcaaaagggtctttgtgttgggttaccaaagcctccggctcccgagttgcgcgtgtagcaactcgggatccgctgtttcttcttctccggcggcggcggcgaaagagactaatccttcgccgctgcctcatgttgcttccaattctggatatgattctgcggtgactctggagctgccagggaagttggaggccttagaggaaggcattgagaaggtgatttatagatgccggtttatggctattctgggagtatttgggtctttaactggatcatttctgtgttttatcaagcctcttgtatgtatatgtgcttcccctgatccattcagatttctatgtggagatgaaagcggatgtacatttgtcacagcatcgtttatgcaatactttgtaaaccgcagtaaagtaatccaaacgctaatagaagctattgatgtctatctcttaggaactgtgatgctggtctttggaatgggtctctatgagctctttgtcagtaatcttggagtggatcaaaaaccttctcacagatcaagtctctttggtttattcactctaaaggaacgaccaaaatggctggatataaaaactgtggatgaactgaaaaccaagcttggtcacgtcatagtgatgctgcttctgattgggttgtttgacaaaagtaagaaggctgctatacacactcctgtggatttgctttgcttctgtgtttctgtcctcctttcttctagttgcctctttttgctgtctaagctgaattag

SEQ ID NO: 5431 - DNA, 900 bp, Glycine max
  Peptide Sequence Number=SeqID_122209
atgggtgcaatacggcaacaacccagtgaatgggtgaaaggtaaacttgttggttgtggatcttttggcactgtccatttggcaatgaacaaatacacgggtgggctttttgttgtgaaatcaccacattccggggttggacggcagagtttggacaaagagtacatggctggggggaatctggcagacatggcgcacaagtttggtgggtcattagatgaagaggtggttcgggtgtacacaagggaaattcttcatgggttaaagcatctccaccaacatggaattgtgcattgcgacctaaagtgcaagaacgtgcttttgagctcatctggcaacatcaagttggcagattttggaagtgcaaaaagggtaaaggaggcaaattgttggcagtctattggtgggactcctctctggatggctcctgaagtattgaggaacgagtctctggattttgctgcggatatatggtccttgggatgtactgttattgagatggctactggcacccctccttgggctcatcaggtttcaaatcctacaactgctgtgctcatgattgcccatggtcatgggatacctcactttcctccccatttctctaaggagggtttggatttcttgaccaggtgcttcgagagacatcccaataagaggcctactgttcaggacttactcacccatccatttattgtttctacaaaacaatatgcttcttccccgacaagtgtcttagaggttcaaaatttcaaagattcagatgatgaattagaaacttgttcagatcaggggaatcatttctcaatcacaaacactacatttgcatttcatgatgatgaccttaaaggaataccaatatgtaaacccgaagacatctcatcagggaattggattact

SEQ ID NO: 5432 - DNA, 654 bp, Glycine max
  Peptide Sequence Number=SeqID_122210
atgccgtcccacgatcacgtggccgaacgccagcaccatagaccaatcagaagaagattggtgaacactcaccacagcggcaaaacacaccctctaatctggctagcagccattctctgcaccatcatagccataggagtggtgatagccggcatagtagtgttcgtgggttacatggtgatccaccctagaatcccagttatgagcatcaccaacgcccacctcgatcttctcagcaacgactacgcagggctcctccagacgcagctcaccatcatcgtcgtggctcagaacggcaacgccaaggcccatgcaaccttctccgacattaggtttaacctcagctaccagggacagagaattgcgctcatgcgcgctccgccgttcgatgtccccaagaacagctccaaatcactcaactacgttgttcgggcggcttccattcccttaactccccaacagatggaggaggtggacgagtcgtggaagcgtgacgtcattggctttgacttgaagggcagcgccaggactcggtggagggttggccctttaggttctgttaagttctggtgcaatttggagtgtcagctcaagtttcatccttctaatggctcttacattcatcactctcgctgcacctctaagtctaaatga

SEQ ID NO: 5433 - DNA, 846 bp, Glycine max
  Peptide Sequence Number=SeqID_122211
atgacctatcccaaggtcaccaccgacccgaccgccggccagggtgccgtcccgagctcgccgcgcttccccgcgatcgaggagggggtcctcgcctactgggccgaggacgacaccttccgggcgagcgtcgcgcagcgcgacccgggcagcaacggcgagaacgagttcgtcttctacgacggcccgccgttcgccaacggcctgccgcactacggccacctgctcaccggctacgtcaaggacatcgtcccgcgctaccagaccatgcgcggcaagcgcgtggagcgccgcttcggctgggacacccacgggctgcccgccgagctcgaggcgatgcgcctcaacggcatcaagaccaccgacgagatcgtcgagatgggcatcgacaagttcaacgacgcctgccgcgcatcggtgctcaagtacaccggcgagtggcgcgactacgtcacccgccaggcgcgctgggtcgacttcgacaacgactaccggaccatgaaccccgagttcatggagtcggtgctgtgggcgttcaagagcctgttcgacaagggcctggtctacgagggcttccgggtcctgccgtactgctggaacgacgagacgccgctgtcgaaccacgagctgcggatggacgacgacgtctaccagatgcgccaggaccccgccgtcaccgtgggcttccgcatcaccacgccgggcccgttcgagggcgccaagctgatgatctggacgacgaccccgtggacgctgcccagcaacctcgcggtgatggtcggctccgacatcgactatgtcgtcgtcgagcacgacccttcgacaggctcagggaccgagcggctc

SEQ ID NO: 5434 - DNA, 429 bp, Glycine max
  Peptide Sequence Number=SeqID_122212
atcatttttttattaactctcaccttcctccgctcctctccttacttctccctcaccctctcccttccacatttaccccctttttttctctctcctcttcttcctccggtcctccagggacaacaacctaaccttctatgcttcctcgcactcgtccggccacaagaacctcactttctatgtcgaccgcggctaccaagtcggcgccgccttctgccgcaacccctctggtggcgccttcggaaaccgcctcggcgtcatggtctgctctatgctgacatcgagagcgggatcgcggtgttgagggacatcgacgacgtgtggaacaacgtcacggcaggactcagcattagagtgttgtatctagcggcgattgtgagcccgcgacagtgcccggcggcgttgggaactattgccgggagaagttga

SEQ ID NO: 5435 - DNA, 102 bp, Glycine max
  Peptide Sequence Number=SeqID_122213
atggcaaagaaaaccatgaacgatgaaacgggtgatgatgcctttcgtccaacaagtccaggtcatagccccggggtgggacatcaaacaccaccaccatga

SEQ ID NO: 5436 - DNA, 213 bp, Glycine max
  Peptide Sequence Number=SeqID_122214
atggatgcgtattgtacaattaagatattgatgttctcaactaatgctaatgcaaatgtaatgaaaaatagaactgacctattaattattcctttgagattgtgcttgcctagatctctgtatggactatgggtcgaggaatccatacacatcgacattccctgctcgcatacttgtctcagccatatacctattgttgttaaaataaagtaa

SEQ ID NO: 5437 - DNA, 219 bp, Glycine max
  Peptide Sequence Number=SeqID_122215
atgggcgttttagggcgggatctaaaagttctccaacgtgttgcggagccttcggccccacgtgatgattcaagattcgtggtaggcgtaggagctgggcgaagcggtagcgaagctcaggtggtgatgcaagtgcgcggtgagcgtagtagccccctcgggcatgctctttgtacaaccaagcgaagagctagtgagggccggaaatatcgtatgtag

SEQ ID NO: 5438 - DNA, 744 bp, Glycine max
  Peptide Sequence Number=SeqID_122216
atgggcaaagagaagagacgtggaatcatcctcgccttcaccggagctgcggcggtgctcgcaattgcggcgaacctagccatcaccgcaatcaagtaccagaaggcaaaaaatgctaagaagaaagatcttgcaggttctatggtgcgcgttaatctatctgcatctgagattcttaagctagcagagcaaatcattgctaactcaaacaaggtccataattctgttgcgtcggtgcctctcgacaagaactgcaagcgcagcaattcccactggtccagtgtgtttccgaagatggtatctactcgggaggatgtacgcaaagcaagtgcagaagcagtgcgaagactagatgctcattttgatacgtgcagcaaacgtgaagatgtgtatcttgtcattaaagcatttgcagtaagtggggagtggatgaatgctgaagccaagctttgttcaaattctgactttgagcgaaatggattgaacctcacagcaagcaaaagagaagagttgcagcgtctaagggatcagattgatgaattaagctttaaatatatccaaaatctcaatgatgatagcaggtttattctcttcaccaaggcagagttagctggattgcctccagagtttctcaagcagaacattttggcatcacttcatccatgtagccaagcccatcttgtcggaaaaggcttggctgtgttgttgtattcttccatcaatccacttaactatgaactttga

SEQ ID NO: 5439 - DNA, 1365 bp, Glycine max
  Peptide Sequence Number=SeqID_122217
atgaaggttggaaccaccaggcaggtggtatcaggggcatatgggaatcggtgtggagaaatcaatgtctctatcttagaaagactggtgcaacagcgccataaatatgctcgtttacttggctattcatgctatgcagagtatgtcatcgatgttagaatggcgaagacaccaaaaaaggtgtttgagttcctgaaagacatatcgacaagtttaactggcttggccttgaaagaacttaatatcttgaaagatgtgaagaagaaagaggaaggggagtttccatttggaattgaggacctactgtattatgtaaaacgggttgaagagcaggattatgatttggactttggagagatcaagcaatacttgccaattagtgtggttttatcggggatcttcaaaattatccaagatctatttggcttaaggtttgaggaaattgcacgagctgatgtttggcatggttattgctaccttgatttgttctcaagggagggaaaatatggtcatacttgtgtgttggctctccagaacagtgcattaacaagcagtggggcacatcagataccagttgcattgctaatatctcagtgtcagaaggatgctgatggtagttctggattattacggttttctgaagtggtcagtcttttccatgagtttggccatgtggttcaacaaatttgcaaccgtgcatcatttaccagaatttctggattatgtgttgatgctgactttgtggaaatacctgctcaactgttagaaaactggtgttatgaaagctattctctcaagttgatttcgggatttcatcaggatattacaaaaccgttaacggatgacatatgcaaatcaattaaaagatggaggacttctttttctgcacttaaattgaagcaagatattctatgctgtctttttgaccaaatcatacattctgcggataacatagacattcaggaattattcaagtatcttcatcccatgagtgaaaggaaattctatgtaaatttcatttcccaggagatgttaggcttgccgatattagaaggaaccaatccagcgtcatattttccttctactgtcgttggttatgaggcagcttgctacagtcgtatatggagtgaggtttttgctgctgatatattcacctcaaagttctgcaacgatgtttcaaaccagcaagccggcatgcaattcaggaacaagcaatatattggtttgttaaagcaaatttcagagaaagcaattgtattggcctcggcaggagtgaaagatcctattgatgtgttattagacttcctaggaagagaaccatcaatccaagcttacattgagaacaaagtcaagtatgttttgtaa

SEQ ID NO: 5440 - DNA, 867 bp, Glycine max
  Peptide Sequence Number=SeqID_122218
atggatcataggcttgatagctgtattgtctctatgcatttgatttttttgacaaaggaccatataattctcaacaatttaaaagtgggatttaactcctatgaaatactgttaaactgtcactctcaagcaagtgcaaagacgtcagaggatgagaaaactcctgataatgcacatggagaaggaattgaaatggtgggtctcaatgactgccatggtgcggggttaggaggaggagagaatatggtattgacgataccagtatctcttttgggcctgttgaagatcttgattcttctactggtagctactggaagaccaacactgaatcttgagagaagtttggatcatgatggacatcctcttgccattaccacagctgatgctgttgcagcaagtggagtccctccttggaattggagagagactcctggaaacggtggagaaagtcagtcatgttgtggaagggttatatcagttaaatggggtgattatacaaggcgaataggtattgatggcaccccagaagccattaaagaagcaattagggctgcttttaggttgagaactaaacgtacattttggttggaggatgaagatcagattatcagaagtattgaccgtgaaatgcctttaggaaattacactcttcacattgatgaaggaatggccattaaattacctctctatgatgagcctgaccatatacctgtgcatactgaagataagatattttacactgaagacgatttccgtgattttctgacccgccggggttggatatgtctaagagaatttgacagctacagaaatattgacaacatggatgatcttcgacctggtgccatatatcgtggtgtgagttga

SEQ ID NO: 5441 - DNA, 255 bp, Glycine max
  Peptide Sequence Number=SeqID_122219
atggattccggcatgtcctgggctgatcaatgggacaacaacccagacccttctcctgcatcagacaaagacaagaagggaaaggatggctcaggcaagaacaataaatttgggaagactatgctgagcttcaaatgggtgaaagaactccgcaagaaaactcaaaatcggaaaattcaagtcaaagttagagttggtaccgataaaatgaattcaagtcattggattggcatttggcacatgtttgggtggtag

SEQ ID NO: 5442 - DNA, 594 bp, Glycine max
  Peptide Sequence Number=SeqID_122220
atgggtgcgattgttttaagttcgagatggtgggaaacaaccaagggaggcggagctgacgtgggtgctattgttggtggtggtttaggaggagatggagtgggtatgagcgcggaaagccggtcaaggatgattttgggtggtcatggaggaaaggttgagggtgaggagggattgtggcaagtagaggcagccatgggtggtaggtcggaccaattattacgagcagagcgcaagggaaaggaaagggaaggaggcgcaagggaaagggaagggaagggcatatttgtccattcaagttcattggtggtgcagaaagatgaaaatgaggtgcaggaatacaacataaatgcaaccaaaacagatgattttgtaaggattaagcatgtttatggagtagaggtgaaattggtgagaggagagatccaaaagacaaagatccctacctcagtagaaagcgacagaccacggtctccaacccaactaaatttgaggggcaagaggcctagccttctcctttgtcgggaattcatgtgcctttcactttttaaagaatattttcctcacttagtcacgtactatatcaacggttga

SEQ ID NO: 5443 - DNA, 348 bp, Glycine max
  Peptide Sequence Number=SeqID_122221
atggcatgggacactctgcttatacgtttctttgtcctcgttgttggagaactgaaactgaaaacacaaattaaacggtggtgtacagctttgcatgatggggggtgcttggcagaggaaggagacaaaggcagagatgggatcaatttggtggtggtgaaggagttatcaattgatcatgtatattgtatgctaagtgtccgacaccagggtgcggatacctggctcgaacggttccccaagaaatttgtgcaccgtgcttccctcctcacctttttaatttcccatttttatccaatcacccattcctcgtctccttcgtatcttttgttatctagcgttatctaa

SEQ ID NO: 5444 - DNA, 1545 bp, Glycine max
  Peptide Sequence Number=SeqID_122222
atggcttatctgaatttgcagatcaagttccccgccccatcttccaaattagaagagcaggtttttagtgatccagctattattcagtcggaatattctgggttgctaagttctccagtggttgggttgctaagttctccagtggcctcagttggtggtagaagtttgacagaatcaattcaaaggcaagatagccctgcaatatccagtaaagcctttcctgctgggttgccttctcatcagtctgtaactcagccgggaccttcaaattcatctgctgctactcaagttgctagtcatccatctttttttgcagcaatggattggcaaggacccagtcggatatctagcagtagttctcattctctgctacaatctagttctcgtcaacccccatcactggcagcatccttagctgtgcagaatcagatgcaaaatgcagaaactcaggtacctataaaagggggatggacagctttatcagactatggtctacctgtatcttctgccatggcttctctcgtaaatcagactcatccaccttctcttacctctttaaaaaattctgattctcttgatattccatcccttttgtctactaagccacctgtatcatattctgcatccatgacttttgatggatcaaacatgcctcagttttcttcaacgctccaagacataaattctattcaagctcaaatatctggaaacatttgtcctgacccaaggtcaattcatcctcaacattctgtccatcgttcagctccttcatttgttgattctacttcaggttccttgccaacagcaccatctttattaaccccagatcaatttgcttatcctagagaacagttattgtctttaactcatttgaatcctactcagaaggatatgggttctctgactctaacatcctctggttcctctgcattaatgccttctccagcatctcaggcaccactgcttccactaccaacttcagtgcaaaagcttccatgcacagctccacaatacactgaagagtctgatttagaggccatcaatgaaaagttcaaaaaaaatgtagtatggggttcttttggaaaggcaaccacaaaaattgagggagtggataatgcttctctcccagctctacaatacactgaagagtttgatattgaggccatcaatgaaaagttcaaaaaaaatgtagtatggggttcttttggaaaggcaatcacaaaaatagagggagtggaggataatgcttctcttagtttgggtgacagagaatgtcctggggtgataccgaaccctaagactggatacaagaaagatgacttttttgatacaatttcttgcaactcttcgactggtggatcaaggagtggaccaaatcttttctctgagagaatgaaacaggatactgagacatctgacagtttccagcagaggcctaattttacttctggtgctggacggggtgcggatttcaggggcgcaaataattggggaaggggttatggctacaataggagagggcgtggtccaaactttcctttttag

SEQ ID NO: 5445 - DNA, 576 bp, Glycine max
  Peptide Sequence Number=SeqID_122223
atggtggaaactcctccaaaatgcaaactcacattcacattaatcttctgcatcgttatctcccactctcttggcttagtttccttcaccttgtgcatagcctccgagactaagaggaacaagaagggggatctcagatggaatgggaaactatgtcatttaccatcaagtcctgcatttggattgggtgttgcatctttggtttgtttggttttgtcccaaatcgttgggaattctatattattcaggacttattgttcaggagggaaaagaaacgcaaagtttgagatacctttcgttgcaaggattctgcttttgatatcttggcttagctttggaattgcagttattttattaattgttgccacaagcatgagcagaaggcaggcctatggggaagggtggttgaatggtgagtgttatcttgtcaaaggagggatttacgttggtttagcaatattgatcatagtttcagtagaatcgttaatgggttcagctttgttaacaatgaagaccaatgatgaagcagatcagggtaacaaaatacatgcacaaacggaacggagtgacacttga

SEQ ID NO: 5446 - DNA, 1953 bp, Glycine max
  Peptide Sequence Number=SeqID_122224
atggggcataatattgtccatataattgtggataagtaccctgatgatgtttatcacataaaatcacaatggcgccggatgtattatgttagctgggtggttaagaaagaagggaaggagggaagggacccagatgatagtctgaaacgaaaaacttttgaactgttatacaaaatgaccaagtcctccaatgtggaagtgattgttgacagaatgattgattacatgattagcatgagtgatgaccattataaaacttatatagcatctcgatgtgtggaacttgctgagcaatttgcaccaagtaattattggtttatacagaccatgaataaagtttttgagcatgctggagatcttgttaatattaaggtggcacataatttgatgcggttgattgctgaaggatttggagaggatgatgatgctgcagacagtcagttgagatcatctgctgttgagtcatatttgcgcattataggagagccaaagcttccatcagtgtttcttcaagtcatctgttgggttctgggggaatatggaacagtagatggaaagtattctgcttcctatatcagtgggaagttatgtgacattgcagaggcatattccaatgatgaaaatgttaaggctaatgcaatttcagcattgatgaaaatttatgcatttgaagtagcagccgggaggaaagtggatatcctatctgagtgccaatcgttgattgaagaattattggcatcccactcttcagatctgcagcaacgtgcttatgaattgcaagcctttataggtttggatgtacaagctgttgaaacaataatgccacgagatgcaagttgtgaagacattgaggttgataagaatctttctttcctcaatgggtatgttcagcagtctttagaaagaggtgctgaatcctatattcctgaggatgtgcgtgctggaatggggaatatgaaaaatttcagaagccaagatcatcatgaaactttgcagcatggtctaagatttgaggcatatgaagttccaaagcctccaatgcaaccgaaagttactccagtttcatttgcatcttcagcagacattgttccagtgcccgatgtattgtcttccagggagacccaccatatctcgtcagtgggatcaacttctgaggttggatcatcagagcttaagctacggcttgatggtgttcagaagaagtggggtaaaccaacgtattcatcttcaacatcatctgcctctgcctcgtattctacttcccaaaaaccaacgagtggggcaactctggtggatggtgctacaactgtcaattcaaaagtgcatgatacttatgattcaagaaagacacaggttgagattactccagaaaagcaaaagcttgctgcttcattgtttggtggttcaactaaacctgagaaaagatcatctacaagtcacaaggtttcaaaatctagtgcaagtgctgcagacggatctcggggatcaaaggctgcggttgtacccaatgaagtagctgtggaaaaagcaattcatcaaccacctcctgctgatttgcttgacttggatgaaccaactgtcactacggctcctccttctgtggacccattcaaggaattggaaggacttcttgacccaagcactaattctgcaacaaatcataatgtagctgctgctacaaatgcccctgatattatgtcactctatgccgagactactgtcagtggtggcgactctatacccgtgagtggggggtatgatgtaaatcttttatctgaattgtcaaatgcagctacaaaagctactcgtgaagaaacaattgtgaagccgttgccacaatctattaagggtccagatgctaaagattctttggagaaggatgctttagtgaggcagatgggtgtgaagccctcaagtcagaatcctaacttgttcagtgacttgcttggctaa

SEQ ID NO: 5447 - DNA, 171 bp, Glycine max
  Peptide Sequence Number=SeqID_122225
atggtgaggccaggcttgagcgtgatgcttgacatcagtcttcacgttctgttaatcaataatcatatgcttcaagttcagtatttatataccaagataggaataccaaggttatgctgcatgcgaggcatggagcatgaactcaccagtgaaactcccaactttatttaa

SEQ ID NO: 5448 - DNA, 1681 bp, Glycine max
  Peptide Sequence Number=SeqID_122226
tctcattcgcgccggctacggcgggtggctactctacactgctgcctcggccggtgacgtggatttcgttaaggagctgttggggaagtaccctgctctcgtgtttggtgaaggagagtatggagtcactgatatactgtatgctgctgcgaggagcaattcttgcgaggtgtttgagcttctgcttcgttctgctctctcgccgccgcaaatggaggatgtttatgagagggacatgatgaatagagcggttcatgctgctgccagaggagggaactgggagatgctgaaacggcttgtgaggaacggttctggcgttttggggtttagagatactcaaggatgcactgttcttcatactgcagctgctagaggacaggttgaggtggtgagaaatctacttgcatcatttgatgttgtaaacttaacagatgatcaagggaacacagcattacatatagcttcttacgggggtcacttaccagtggttgagattctgattcttgcgtctccctcgctagcattgtttaccaatcactacggagatacttttcttcatatggcggtggctggtttcagaagtcccggtttccgtagactggacaagcacactgagctcatgaagcgattggtaagtggaaagattgtgaacttacgggacattatcaatgttaagaacaacgatggaagaacggctcttcatgtatccgtgattgataatattcaatgtgaacaagtggaattgttgatgtctgtgtcatcaattgatttgaacatttgtgatgctgatgggatgacccctttggatcttttaaagcaaagggcgcgatcagcatcatctgatattctaatcaagcaaatgatttcctctggaggggtctctaaatgtctggatgttgtggcaggaaatgccctttgcactcatcaaaaagctcatgtcattggaggcagtcctggaacttcatttagaataccagatgcagagatattcttgtacactggcattgagaattcatcagacgccaccaattatgatcaagcaagtgtggaatcatattcctgctcaaacgaactaaacaattctgactcagccaattccccacataacaagaagtctaattctgtcaatgcaaggcgctcaaagtttcgtctccactggcctaggagaagagagacaaaagcagctgcctcagaattggaagatgatgatgattctcatgatcctttcagttcaagtagaaacctggaagagtttccaatcccgttgcggcaaagatactcacaaccatgctcccttccaaacaacaaaagaacacaacctatgaggacttctcttcctagcccatcctccaatgtgaaattcagtgcaggcttaatgcaaggtgtaattcagctaaagccacattctgctcattcaactcctagtcctttccaggaattatcagtgtcttctctttcatacatcaagaaacaaaagggtgttgaaataatgggaccctcttgctctaatcgatcaatagatgacggcacacttctattgaactacaaacagtgttccttcaataagaaattgatgaatgggtatttttcttttggagcacagggccttgctgttgaagattccaatagctgcgcaaagtcaaacagcagctacaaacgtttaagttccatagttgcctaa

SEQ ID NO: 5449 - DNA, 210 bp, Glycine max
  Peptide Sequence Number=SeqID_122227
atggagcaaattaccattcttgggtgcatgtgtcatactcgtaaagtgatagttcatgcacttgatgaaaaggctagagcttactacaatttggagggtctttggaccccagggacaattcaaaatgaacgtgaagaggatttacaaaaagctttggtgaaggttcgtcggaaaaacaattcaaagaaacctgcacaaaagaatgcttaa

SEQ ID NO: 5450 - DNA, 1707 bp, Glycine max
  Peptide Sequence Number=SeqID_122228
atggacgattattttgacagacagctgaacgaaccagtagtacaaaatgctgaaattgatggctttctgttgcatctacaaaatgagaagaaagaggatgttataaaggagaaggaggaagctggcttgcatatttactctatcggagacgtagaaatgatcttaaataatgatgatgatacaaaggacaatactcccggaactccaataaatcatcatcaagatcctttatctcctgcacctgatacaccatctttaatgtatgagaatgttttatcttctggaaaaccatcaaaatcaaaactagtaacacccttttcaaaaagaacagataagtttgcagtgaaatttagcatcaacactgtccctaatgtagagaatgatgaaaatgaagatgatgttgttagaagagttccactctttgaaaggagttcattgtccattcacggatcaggacccaaaccaggttgcagattcttgtatgatagaacagaggataggcttaatgcaatagaaaaccgacttaggaaacatacaagggcatttgtagcttctgggctccatgaagaaccaacagaccctacaactgcttcacagagaagcatttttgctgttggcatgatttgttgtgatggagaaggccgtttaaatgagaagtctgtcatgctgcagagcagtattgagcattctggaggagaatgtgttcgcctagacttgcaacggttaagccattattcaatttttcctggccagatagttggtattggagggcataatcccagtgggcattgcttcgttgcaactaaattggtggattctatacctacctccgttgctgatgaggattcaaatcctgcaaagaagcaagctgttgataaggagaatcagccaactgatctgctttgtaaacaaagaaagttatcaatgattattgctgctggcccctttactacaacagacaatttgttgtttgagcctcttatagaactgctgaaacatgcaaaactaagaccaccacagttgcttgtattgctgggaccatttgttgactctgagcacccagacattaagaaaggaactgtagacactagttttgatgaaatatttgaggaaatcctgaagaagttggaagaatatgtagattcagctacacgtgtccttcttgttccatctatacgtgatgctaaccatgattttgtttttcctcagcctgcattcgacatcaaatctcagatagtcagtctcagtaatcccggaatctttgaggcaaataaggttaaggttggctgctgcaccgtggatattctcaagcaaatcagtggggaggagatatcacgaactgctgcagatggaaaacccattgatcgcttgagtagacttgcaaaccatattcttaaccaacaaagaaatgatcagaatgtctttcaatttttgagccagcttctatccactttacacaccagcagaaagtgttcccttggacttttcgcttgctccagaagcccttcaactctcgtttgttccagacatacttatcctaccttccgacatcaagtgcttagtagcgaaaatgaagggataaaccacacgaaatgcatagctatcaatccgggaagactagctaagggagaaggagggggaacttttgttgagcttgattactgtggggcttccgaccaaattaacgcttcaattgttggcatatga

SEQ ID NO: 5451 - DNA, 303 bp, Glycine max
  Peptide Sequence Number=SeqID_122229
atgccatcactacctcacatgcgtttcgtcttcttgaaaccaaataggacatatttgtcgcgagagagaaagagtgagtcactgaccagagaatggagagcatgcaaaaaggaagacgaagagaacgagaatatgatggcaagaacgatggaagagagaacggaaatggagagcgcgacaagaggaagaaggagaaaaggtgagaaacaccgatggagagacgacgacaacgcgacaacacaaggcaacaacgaaagagtgagaaggaaaaaaggcgagaacaagaggaagagagaaagataa

SEQ ID NO: 5452 - DNA, 1761 bp, Glycine max
  Peptide Sequence Number=SeqID_122230
atgggtgtcattgaattgtgcgttgaagtagatgttgtcggtgcttctgcattgaatgtgacaaattcggactcgttggatgaggaggaagatatcgatgatatatgtgacacagatgaagaagtttccattggtgtgattgtgaatgggggactcgaaacgatggacagtgacctacacaaaacacatcaagcagaaacgcaaggtgtatcaagatggattcctacagctccacatttccaccggcaagtcacaaattctcacgaggagcggacacggaagtcgattttaaagggaatagctaacagcctcgctgtgcaggttaagctgtatgatgagtgcgagaaattgttggagtgtaggctcttgaagaacgacgtaactgttacctctggtgaaacgttgattttcaaaggttaccttgttgacgtcggcgatcccgagggaggcatcaagcctgaatctgatttaaatgttgataggaaactcaggaatcattcgagattcaggactccttctgatggtgtaaaagattccaaaatgaatgagaaggagaatgttggacaagtgcgaaggcctcttagtccttcacaaaaagttatcagagaatttaagaagagagaactgctcaagtatggatcaccaaagatcagtcaggaaacaccaaaacctagtaccgaagaatggcttgttctatacaccacacaagtgactcaaaaggcaaagaagtaccatgatggttttttacgcctggttcttcatggatccagcggggcgcaggttatgctgtttgacacaagcaggaaactcttagatagtagattccttaagaaagatgatgtaattaaatctggtgaatcaattgcatttgattcatatttgattgacattggcaagcagcaaggaagttgtaccccagattccaatgttctagcagacaagtgtactgatgttaaggcaatgaagatggacagacagaagacttctctcaaaaccgatacccatgttgttttgtatgatttgagcaaaagacctatagaacgcaggtttgtaaggaaagatgaagttataagggaaggtgaatcagtatattttgatggacatttagtagaagtaggacaacctgaaggaagtcatcactctccagcgaagttaaatgaacgagggactggcaataatgttgaaaggagacaactaggacatggacaaaatggctttcacaaggtcaatccatcttttgctaaaggaaaaccgccaaatgagctttgtctggggaaagattcaggattgaactctctgattaccgagctagaagagataaaatcaaacaggataaccccaccaatcaagcctttacgcgatgccaatcaaatactgtcccttttacagaatcctaacctgaagcctcaggagagccatgtaacaggccgatcgtccaatgggtctcgtcaaaatattggggatagggaatcagccgcaacttcgaaatgccttgatattacgtcttctgaagatgttagtaactcttggttgactctgcttgaaatgggttctgcagcagcatatagtggtggtagtttccaattcaccgagaatgtcaacatgtcccaccagtccgactcgcagaaggatgcccagacaaatatgagtagtgaggcagattttggttgtcaaccctgcctcattaccaatggagggaagagtggtgaggagttctcgtgtgaaagcgaaacattcccaagctttgaccttggattttaa

SEQ ID NO: 5453 - DNA, 2349 bp, Glycine max
  Peptide Sequence Number=SeqID_122231
atggaagttaacctctctctcaaccaccaccgcgccctcactctaaccacctcccgcactccctccctctccgctctccgcacacacttcctcggttccacacacactctccgccctcctcctccgacgccactctctcttcgctccagaaacagaaacaaacgcaacaacaacaacaacaacaacaacaacagcaacttaggtcttcttcgcttccaatccccgcgcttcgtcttcaaggcctccttccattcccactccgtcatcgtcgttgttatcgtcgtcactctctccgccgtttcctggctccacttcactctcaacaagaaaaaaaataagaccactcttaaccaccagagacggggacatgcgaaatttgcgttatcatcgcaaggatttaatgttgggaaccggatcattgatagggagattcttggttatacagaatttcaaagggaaaaaaacacactgactgagattggcaagttgaaggatcaccatggggaagacttccgtgtctttgaggacaacgaaatccacattccgtttttgaaatcatcagtggtgcaagaagtggcccttgccgccaccgagacttcggagtcgccatcttcttctgttcttgactctggtgccaataataataataataaggataataatggttccaaggtattggatgaggcttttttatctgtgcctttctcaccaagttcattacaacctctagagtttgctgaggaaatggctatacaagtggaagaaagtcaagataaagttgactctgatgatgagttgcctttgaatatggttgaatctgaacatactgcttcttctgtttctgtaaacaatgcactgacaacagtcgatgaacatactaaagaaaaaattgaacttggtgctatcgacaatgatatcctttttggtgaatcagttagggaagggctgtacatgttttatgaggttaacaagcctgcaaccagatccatgacaccacttagtagtttaaagtcattatctccccgtgcttcttttatgaataaaaaaggattggcctcagtgatgggaaatggcgcactaaaaggatcagggttatctacagatattcctctacaaagtgcagaacatgtcaaaggagcagttaaaatttccagtcataataaagaaggctaccctccacaacatgtgagtaaaaacttgaggaaaggtggcatctctttaagagaaatggaaaggaacagtatggatcacaacagtaaaatttttttgcctctgaatgctcactcgatcaacgtgcatgttgatcagacaaatggtcaattcagggtgcatgatggtccaaaaatggatccttcagagcttctaagcaaatataataatttgctaaaagttgaaaggttacatgaatgtgtagaattgcttaaagatatggaaacaaagggtttattagacatgactaaggtttatcatgctaagttttttaacatctgcaagaaacgaaaggctgtcaaagaagcttttgatttcattaggctcattccaaatccaatgctgagtacatttaatatgcttatgtcagtgtgtgcaagctcccaagattcagaaggggcttttcaggttttgcagcttcttaaggatgctcgactagaacctgattgcaaactttataccactctgatattaacttgtgcaaagagtgggaaagttgatctaatgtttgaagtgtttcacaagatggttaattctggagtggaacctaatgttcatacctatggagcacttattgatggttgtgctagagctgggcaagtggctaaagcatttggtgcttatggaattatgaggtcaaagaatgtgaagccagatcgtgttgtattcaatgcacttatagctgcttgtgcccaatcaggagcattagatcgtgcttttgatgtgttagcagaaatgacagctgaaacacagcccatcgaccctgatcacgtaactataggagcattgttgaaagcatgcacaaaagctggtcaggttgaacgagcaaaagaagtgtacaagatggtacaaaaatataacataaagggttgtccagaagtttacaccattgccattaattcttgcagccaaactggagattgggaatttgctcatactgtatacaatgacatgacccagaaagggatcctcccagatgagatatttctgagtgcactaatagatgttgctggtcatgctaaaaagctggatgctgcctttgatgtcctgcaagaagcccgtaaaggaggaatacttattggaataatgtcatatagctcattgatgggtgcctgtagcaatgtatgtctggttaagtaa

SEQ ID NO: 5454 - DNA, 150 bp, Glycine max
  Peptide Sequence Number=SeqID_122232
atgggtaagtgggttgaggaagagtgggagtggagggagaacatgtggagacgaagggtggatcaaggtggtaattactcggtgaagtcaacatacataactcttcatgatcgagtctttgcaaatgaaggtgatgagatttacaaggag

SEQ ID NO: 5455 - DNA, 436 bp, Glycine max
  Peptide Sequence Number=SeqID_122233
aaatggaattctagaggcatactcagggatcttccaaggatttaaaggttccccaaagacccagcttctgatgtcttatgctcctcatgtgctgcaattcttggatagtttgtatatggagaaggacatggatgatgttgtgactaagacagcaattggcgtgcttggagatttagctgatactttgggcagtagtgctggccccttgattcagcaatctgtgtctagcaaagacttcctcaaagagtgtttatcatctgatgaccatttgattaaggaatctgccgaatgggccaattcttgcatacatctgcatttgttgcgtgggggtctcaactgcatacatgagtcgggtcatcaccatttttgggaacaggaggagaaacagggtgaaatgggggaaggagcaagaaaggagatagatgatatcccatga

SEQ ID NO: 5456 - DNA, 239 bp, Glycine max
  Peptide Sequence Number=SeqID_122234
gtgatggagatcaatttcagaaggctttggaggttttatttgaaatgaaaggattaggattgcgcccaaacagtatcacattctcaatacttatagtggcaagtgagaaaaaggatgatatggaggcagctcagatgctcctttctctagctaaaaaagatggtgtagtccctaatctcatcatgtgtcgatgcataattggatatgaaaaattcttaaaaattcaagatatgatatga

SEQ ID NO: 5457 - DNA, 252 bp, Glycine max
  Peptide Sequence Number=SeqID_122235
atggaaacttcaagaagctcaaacctctgttcattaatggatggatttggtgaatatgatcctcgtgctttttcaatacttgaggaatctgcttcacacggagttgttccatctgtatcccttaaagtgagtcctgttgttattgatgctaaggaattgaatgcttctactgctgaggtgttggaaaagccacctaaattgtggtcacccctatatagaggaggtgtgttgaaagtcccacatagcggctag

SEQ ID NO: 5458 - DNA, 2358 bp, Glycine max
  Peptide Sequence Number=SeqID_122236
atgaaaatcgatatcgagcaagcatttcaaaatagagccgttgatgggaggatcgtagcgtggagattaaccctatttgaatcaacggcggatattgtccgggtgtgttgtacagcgaatataaaaaagcaagtattgaagaaccgaaaaaacttgaaacattggcgtctctgctttttcccacactctgctagggtttcagagtcgccgcgctccctcacttggcttcgactcgctctctcaatcgctgattccactcgttatctcgtcgtcactaagaaatgtagaacatcgatatgtagttcttcttgcattttcgatctgttgggacatctgcaaacagtgtttgaatgtgctgaagcgtattttctgagcaatggggttcagatggccatggaggttactcaaatccttttaaacgcgcaagcagtcgatggcacattaaggaaacaagccgaggaaagcttgaaacaatttcaggaacagaatcttccaagtttcttgttttctcttgctggggaactggcaaatgacgacaagcctgcagagagtcgcaagctagcaggtttaattctgaagaatgctctggatgctaaagagcagcacagaaaaatagaatttgttcaaagatggttgtcattggacccaactttgaaatcccagattaaggcattcttgttaaggacactttcttctccttctcttgatgcccggtcaactgcatcacaggttattgctaaagttgctggcattgagttgcctcataaacagtggcctgaattgataggatccctcttgtctaatgctcatcagcttcctgcccctacaagacaggcaacacttgagacccttggttacatctgtgaagaagtttcccctgatgtagtagaccaggatcatgtaaataagatactcactgctgttgttcaagggatgaattcaacagaagaaaacaatgatgtcaggcttgctgccataaaagcattgtacaatgcattgggttttgctcaggcgaatttttctaatgacatggagcgggattatatcatgagaattgtgtgtgagacaacacaatctcctgaattgaagattcgacgagcagcttttgagtgcttggtagctatttcttcgacatactatgaaaaggaagatgaggagccggttgcacttcaggcaattgagttttggagttcaatatgtgacgaagaaattgatatactagaagaatatggtggtgattttagtggggattcagaggttccctgcttttattttattaaacaggcactttcatttcttgtccccatgttattggagacactgctgaagcaagaagaagatcaagaccaggatgaaggagcatggaacattgctatggctggaggtacctgcttgggattagttgcacggacagttggtgatgacattgtacctttggttatgccgtttattgaagagaatataaccaaaccagattggaggcaaagggaagctgcaacttatgcctttggctctattttagaaggtccctcccctgataaacttgtgccactggtgaatatggctttgaatttcatgctcactgcattgatgaaagatccaaataatcacgtgaaggacacaactgcatggactctagggcgaatgttcgaatttttgcatggatcagctctggatactccgattattactccagcaaactgccaacagattattactgtgctgcttcagagcatgaaggatgttccaaatgttgctgagaaggcttgtggtgctctttattttcttgcccaaggctatgaggatgctgcatctgcgtcctctccattgacccccttctttcaagatattgttcatgctcttctcactgtaactcacagagaggatgctggagaatcccgccttagaacagcagcctatgaagccttaaatgaagtagtgaggtgttctaatgatgaaacagctcctatggtggtacaacttgttcctctcatcatgatggagctccatcagactcttgagaatcagaaggtttcatctgacgagaggcagaatgagttacaaggccttctatgtggttgcttgcaggttatcatacagaagttaggatcatctgaaccaacaaagtatcatttcatgcagtatgctgaccaaataatgggtttatttttgagagtgtttgcttctcaaagtgcaacagaacatgaggaggctatgcttgccattggagctttggcctatgcaactggtgctgattttgcgaaatacatgacagaattttacaagtacttggagatgggtctccaaaattttgaggactaccagagccttggaggagaaagtactgccttattgtga

SEQ ID NO: 5459 - DNA, 222 bp, Glycine max
  Peptide Sequence Number=SeqID_122237
atggtcaaaaggattaggaaggtagcaaaggagactcttggtgaatcaagaggctacggacttaaagtttatcatagaattcaagagcctaaggctaaacaagcattaaagaggatgaaaaatggcaaagcacttgatttacataatatacccattggtgtatggaagagtctaggtgagaaaagtattagttggctcacaatgttgattaatgagatctaa

SEQ ID NO: 5460 - DNA, 558 bp, Glycine max
  Peptide Sequence Number=SeqID_122238
atggctccgagaaagctttctgcaaagagatctaggaaggacaccccggctgaagggaccagtgccgctcccgagtttgacagccatcatttcaggagcgctgagcaccagcagggtttcgaggccatcaaaggatggtcattccaccgagagagacgcgtccagctcagggatgatgagtacgtagatttccaagaagagatagctcatcggcattggacgtcgctggtcactcccatggctaagtttgacccagatgtagtcctagagttttacgccaatgtttggcccacggaggagggcgtgcgggacatgcggtcatgggtaaggggccagtggattccttttgatgcagacgccctcagccagttcctgggtgacccgctagtgttagaggagggccaagagtgcgagttcagtcagagaaggaaccgggccgatggatttgacgaggaggccatcgcccagctgttatgcataccgggtcaggattttgcccgaactgctgccaggaggtgggtgcggatcatgcgcaccagcatgaccacgttgacttag

SEQ ID NO: 5461 - DNA, 294 bp, Glycine max
  Peptide Sequence Number=SeqID_122239
atggaacgagatgagaaaaggtttgagtatcgtatctgctgtttttcggaagaaaacaatgtggaagaggataaggagggtgaaattggtgttgtggatgcgctgattgcaatcggtgaaatcaaaagaaaaatgaaaaagaagaagattgcaagttacgagagtcgatttgatgaagaaatgagtaaggtaggaaggtttgaaggtttgggaatggagggacgtcgcaaggaggaagaggctgcgcaggggtttctgaaaaacgtggtatttatagaccaggacgcattgtaa

SEQ ID NO: 5462 - DNA, 348 bp, Glycine max
  Peptide Sequence Number=SeqID_122240
atgaaaatcgggattccttacataacacacacgaaagaaggaaaaggaaaaaggtctatacacagcgcagcaacgacgtcgtcgttatattgtctcaaacggggagggagggctagtggtggtggtggatgcggcggtgggagtggcggtggtggtggagtaataatcgtcgtcgtcttcgtcgttgtcggggtcagaggtggcgacgttgacgcaggaaaagcgttccaaagaggaaaagaaagcggaagagacggcggagccgagccacacggccgcctggtcgatcttctcccgcgatatgatactgtcgttgttctccatcgtcgccgcccaatcagatcttaa

SEQ ID NO: 5463 - DNA, 1800 bp, Glycine max
  Peptide Sequence Number=SeqID_122241
atggccgagtacgctcaaaattataaagtgctcatcctcacatggctctcactaacactagtcactgtaacagcatcacactgtgtaatggccgtgacgccctcaacccctcttctctccttcctcgaacgcctccaagaaacagccttcgaaaccttcgcccattccaacttcgatcccaaaacctacgtggacatgcctctcaagtccgccctcacggttaccgaggacgcgttccagaagcttccgaggaacgccaacgggtccgtgccggttgaggatttgaagcgtttcatagaagcctactttgaaggtgcaggggatgatctggtgtaccgggacccacaggatttcgttcccgagccggagggtttcttgcccaaggtgaaccagcctcaggttagggcctgggccttgcaggtccattcgctttggaaaaacttgagccggaaaatatccggtgcggtgaaggcacagccagacttacatacgctgctccctctccctggttcggttgtcattcccgggtcgcgttttcgcgaggtggccttgactttgaccttgcttctgcactttgttattattgctacttggcctgccactgcttacctgcttttgttttttggcttcaggggcctgctggccagtaaaatgcatgacacagctaaggctattgtcaccaatctcatttccttgatagataaatatggctttgttcttaatggggctagagcttactacactaacaggagccagcctccccttttaagcgccatgatttatgagatatacaatagcacgggtgacttggaattagttaaaagatctctacctgccttactgaaagaatatgaattttggaattcagatatacataaactgaccattttggatgctcaaggttgcactcataccttaaatcgttattatgcaaagtgggacaaacccaggccggaatcgtccataatggacaaggcatctgcttccaacttctccagtgtttcagaaaaacagcagttttaccgtgaactggcatcagctgctgaatcaggatgggatttcagcaccagatggatgagaaatccacctaatttcacaacattggctacaacatctgtaatacctgttgatttgaacgcatttctactcgggatggaacttaatattgccttatttgcaaaagttactggagataatagcactgctgaacggttcctggaaaattctgatcttagaaagaaggcaatggactctattttctggaatgcaaacaagaaacagtggcttgattactggctcagcagtacatgtgaggaggttcatgtttggaaaaacgagcatcagaatcaaaatgtatttgcttccaattttgttcctttgtggatgaagccattttactcagatacttcgcttgtgagtagtgttgttgaaagtctcaaaacatctggcctgctccgtgatgctggagttgcaacttctttgactgattcagggcaacagtgggactttccaaatgggtgggcgccgcttcaacacatgctagtggaaggactgctaaaatcgggattgaaagaagcaaggttattggctgaggaaattgccatcagatgggtcacaaccaattatattgtttataagaaaacaggtgtaatgcatgaaaagtttgacgtggagcattgtggagaatttggaggtgggggcgaatatgtaccccagactggttttggctggtcaaatggagttgtgttggcattcttggaggagtttggatggcctgaagatcggaacatagaatgctga

SEQ ID NO: 5464 - DNA, 228 bp, Glycine max
  Peptide Sequence Number=SeqID_122242
atgttgcttcttagcaacattcttcccagtgaccacaatgccgatcaccctgcggaagtatcagttggtctgtgccatcccaacataggaaaggatcgcgcccacaagacacccagtggacccggaggagcccaacagggccctggggtttccagctctggttatgggcctctgtcagtcctacagggtccccgtcctccccagcaaggtcatgccatcgtgacatag

SEQ ID NO: 5465 - DNA, 357 bp, Glycine max
  Peptide Sequence Number=SeqID_122243
atgggttttcatttacgcggtatcaaaaaggcatcatttgcagcagaccaagcatcttcaaatggtgtggatgtgccaaagggctgccttgcagtctatgttggagagaaaatgaagcggtttgtgatccctgtatcatatttgaaccaaccttcatttcaagatttgttgagtcaaactgaggaagaattcggttatgaccatccaatgggtggtctcacaattccttgcagagaagatggctatgagataagagtcatgggaccaacagggagacaaggacatatgatgtggccttggaggactttctcgggaatcaatgtggcatgtccaacctttcaaagtgagtccacttga

SEQ ID NO: 5466 - DNA, 318 bp, Glycine max
  Peptide Sequence Number=SeqID_122244
atggattttcgtttacctggtatcaaaaaggcattatttgcagccaatcaagtatcatcaaaagcaggggatgcaccaaagggctaccttgcagtctatgttggagagaaaatgaagcagtttgtaatccttgtgtcatacttgaaccaaccttcattccatgacttgctgagtctagccgaggaagagtttgggtatggcatcccatgggtggtctcacaattccttgaagcaaagatgtcttccaacggtagtagaacaatagggagtataactgaagatagttactatgtgttccttaaagcaggaactcaatga

SEQ ID NO: 5467 - DNA, 240 bp, Glycine max
  Peptide Sequence Number=SeqID_122245
atgggtttccgtttacctgctattcgtcgggcctcattcaaggctagccaagtagcgtcaatatttgcacaagtcccaaagggctatcttgcagtatatgttggagagaaacagaagcggtttgtgatccccatatcatacttgaaccaaccttcgttccaagagttgttgagtcaagctgaggaagagtttggatatgatcatcccatgggtggcctgaccattccttgcagcgaagat

SEQ ID NO: 5468 - DNA, 396 bp, Glycine max
  Peptide Sequence Number=SeqID_122246
atgggttttcgcctacctggtatcagaaaggcatcattagctgcaaaccaagcaccttcaaaatcagtggatgtgccaaagggatatcttgcagtccatgttggagagaaaataaagcggtttgtgatccctgtatcatacttgaacaaacctttatttcaagatttgttgagtcaagctgaggaagaattcgggtatgaccatccaatgggtggccacccatgggatgatcatatctatactcttcctcagcttgactcaataattcttgaaatgaaggttggttcaagtatgatatgggaatcacaaactgcttctgtttgtctccaatgtacactgccagatagccctttggaacttcagctgatttggaagatcttggtcagtgttgaatga

SEQ ID NO: 5469 - DNA, 477 bp, Glycine max
  Peptide Sequence Number=SeqID_122247
atggcttttcgtttacctggtatcagaaaggcttcccttgctgcaatccagggaaattcaaaagctgtggatgttccaaagggctaccttgcagtctatgttggagataaaatgaagcagttcatgatccctgtaacatacttgaaccaaccttcatttcaagatttgttgagtcaagctgaggaagaattcggtagaatatgggaatcacaaaccgcttctgtttctctccaatatacactgcgagatagccctttgggacttccaaagattttgaagctgcttggcaagctgcaaatgatgctcatcgaatatcaggatgcaaatggcttgggttgtttgagccaacctttatttcaaggtttgttgagtcaagctgaagaagaatttaggtatgaccatccaatgggtggtctcacaattccttgtggagaagctgtgttcattgataccatttctcgcttgaatagttgctaa

SEQ ID NO: 5470 - DNA, 243 bp, Glycine max
  Peptide Sequence Number=SeqID_122248
atggaatttcaatttccttctaaaagggtaaggagatatcatggtttttcacttaaggcttgtagtgagcttcaaaacaaggaaagggaaaacataggctcaaaagggctatcaaaggaattaattcaaggtaggctcatttggctagagacttataagaatgaaatgcctaaatcatctcccaacatggatgtgaaccaagaagtatcaacaagaatcaagccaaggctattgtgcaagtaa

SEQ ID NO: 5471 - DNA, 261 bp, Glycine max
  Peptide Sequence Number=SeqID_122249
ctgaaactggctgcaaaggataaatcattcatacacaagggaaataaaaatcctgatcctgtgtatgctcattcgggtccagtgctggtgcagatgatagatcctaagaaagaggcaggtccaacactggtgcagatggctcaggctgaggagatggctctggctcgggtggagtggactctaaggtctctagaatgtcgtcctcctggtcctgctgaggctcatgggctgcagaggcctcaccccctcccaaaggagaag

SEQ ID NO: 5472 - DNA, 204 bp, Glycine max
  Peptide Sequence Number=SeqID_122250
atgaaagttggatatgtattacgaaatgcaattgcgcacactttcaccgttgggatttgcgagataatattcgtggagggagaaacagaatcacatgaagacagtacaagtggaggtttcaatcccttctccgtctctctgacgtttgagaactctatcggagcagtcagaggaaaaattggaggaatctcagggaaccgctag

SEQ ID NO: 5473 - DNA, 1046 bp, Glycine max
  Peptide Sequence Number=SeqID_122251
cggcaatacatttcttggagaaggtatgtcaattccttctttccttgggacaatgacctccttgactcacctagacctctcttatactggattccatgggaagattcctcctcagattgggaatctctcaaatttggtgtatcttgacctgagttatgttgttgccaacggaacagtaccctctcagatcgggaatctctctaagcttcgatatcttgacttgagcgccaattttttacttggaggaggtatgtcaattccttctttcctcgggacaatcacttccttgactcacctcgacctctctggtactggattcatggggaagattccatctcagatttggaatctctccaatttggtgtatcttgacctgatgtatgccgccaatggaacaattccatctcagattgggaatctctccaatttggtgtatcttggccttggaggtgattctgttgtcgaacctctgtttgctgaaaatgtagaatggctatcaagtatgtggaagcttgaatatcttgatttgagtaatgcaaacctatccaaagcatttcattggctacacactctccaatctcttccttctttgacccacctatatttgtcagactgcacactccctcactataatgaaccatccttgctcaacttctcatctttgcaaactcttgatctttccggtactagttattcccctgccatttcttttgtccccaagtggatattcaaattgaagaaacttgtttctcttcaattacggggtaataaaatcccgattcctggtggtatccgaaacctcacacttcttcaaaatcttgacttgtctttcaattcattctcatcttctatacctgattgcttatacggttttcatcgtctcaagtctttggacctaagttccagcaacttgcatgggactatttctgatgccctgggaaatttgacttctcttgttgaacttgatttgtcatataatcaacttgaaggaaccattccaacttctttgggaaatttgacttctcttgttgaacttgatttatcac

SEQ ID NO: 5474 - DNA, 463 bp, Glycine max
  Peptide Sequence Number=SeqID_122252
gcgttttaaactcatgatcaacaaccttgtgttggaaattcaagaatttagagagagccttttagatttagggatcgaggttagatcagttttgacgcctattggacaagggagttcacaggtttcaaggtcatctcaattatcatcaaaagatgtgtttctgtcaaaggctgaagagaaaaatatctctcagattaatgccacttccgagattacaacaatggtgatggacaactattcatggtgctatctggcttgcggtcaatgttataaaaaagctgacatagaaactgtgtcgttcacatgtccgtgtggcaaagacaacgatcaacctttactaaggtatagagttgaagtgatggttaatcaccagggtgaacagaccaaattttttatctgggaccgtgaatgtgcacagttaattggtcaatcaacggatgaagtcaatagactcaaaatagaa

SEQ ID NO: 5475 - DNA, 1332 bp, Glycine max
  Peptide Sequence Number=SeqID_122253
atgtcgaaaagcgaaaagcgtcagagggaaaagctggtgaaatgccgctgcacagaagcagagtttgaggctatcaacaagaaggcctcagccgccggcctgactacatctgaatacctgcgccgtacggcgctcaacagaaagattaccgtgcgtacagacattcgcatgatgaatgagctgcttcgcctgggcggcctgcagaaacatctgtttaaccagatgcagcagaacatgaccaccgagctgagcctgcaattttcagaagttcttaccagcatcaagcttgccattaacgcactggacatgacgccggttccgaccagcttcagaaagctggttgagtacgtcagcacgcgtgaggaaaagaaaccgggtgaagctgtaactcacgatgcggcccatacccccggcactgaatacgtcgccacgccaggatttggccagctggtcgattatgtcggacgtaagagtgccgcaccgtcttcacagattctcagcatttcaccggagggcattcagcgcgtgctctccggtgaagtgctgtgtgaaaccaactgcttttctctggacactgcggcgtcagaaatgaacctgacggcagcgcagaaccgtcactgtaaggatgcggtgtatcacttcattctttcatggcagagcgacgaagacccgtctcctgacgcggttttccgttcggtccgctacagcctgaagcagctgggtatggaagaccatcagtacgttgccgctattcaccgcgataccgacaacgtccactgccacgtttctgctaaccgcgtacaccctgcaacgttccgcgcgcagaatatgtggaacgatgccgacgagctgcagaagtgctgccgtatccttgagcgtgaactcggctttaaagtggataacggcagctggcagatgaacgagtacggcgaacttcaccgcacccgtcgcgacatgccggccgcaccacgcggcgcagcgaagcgtgaaatcttctccgacagggaaagtctgcacggctatgccgtacgcgaaacccgtcatatgcttcaggactttgctgatcaggactgcctgaactggccgctgctacacaacgtactttactcccgtggactggggctgcgggaacaacagggagggctggctgtttacgatctgcttaatcccgacggcgtgtgtgttaaggcctctgatgtgcacccggctatcggtcatacggcgatggtgaaacgctggggtgatttccagccggcgccaccgacctccgaacctgatgatcatgagtcaggcatactcctgattgataaattttatatgccacagctgcac

SEQ ID NO: 5476 - DNA, 1126 bp, Glycine max
  Peptide Sequence Number=SeqID_122254
atgctaagaaaatccatgctcgccgtgctgatcttcagcactctgctgcagggctgcgcccttgagcgcatcaacgacgttcagcgctctgccggcaataccgccgatgaggcttcatcgctgatccgccaggccgcagaaaaccgcccggtagtccagtttcaaaacagtcagtacgtaagtcctgtgccgctgccggtcgcgaaatatgatgctccccgggaagtggtgaactgcaacatgccttaccgggcaatcaaaccacaggatatctggcagttcagccaggatattgcgacggtctgccacatccgcacgcgcgtgacgccggacgcggcggccatgctgggcgggcggggagctgaaagtggctccccgacccagcgcctgaccagcgtgccatcgcccgtacttccgaccgccggtgatatgcgaccgctggattccttcggtaccggaaccgcgtccggtgctgcagcgggttcgcccggcacgtcacgtacgttttcagatgtcacctataccggcaacctcggtggtctgctggatatcgtgaccgcacgcctggggatttcatggaagtatgaagacgggatggtcacgttcttctacctgcagacggcgcgctttgacatagagccttcagacgcgaaatacgcgctcaacggctcggtggtcagcggggtatccaacagcagcagctcgaacggcggcacgggttccagcagctcaggctcgaactccggcggcgtctccggtgagagcgggaccagcctgaagtcagacgtttctatgggcaacaacctgtatgacgatctgaagtccacggcagaaagcatgctgacgccgggcgtgggccgcctcgacatgaacaagacgacgggaacggttgttattaccgatgtgcctgaggttgtgcgccgcgtcggcgaatacctgacctctgaaaacaaggcgctgagccgtcaggttagcctcaaggtggtgatttacaccgttaataccgacaccagtgatgccattggcattgactggaacgtcatttacaaaacactggccggcaagtacggcattaacctcaccggcccgtcagcacggtgtcggatgcagctcgctgagcttctcg

SEQ ID NO: 5477 - DNA, 681 bp, Glycine max
  Peptide Sequence Number=SeqID_122255
gtaagccaggcaacccgggcggcggcgtcgaagcttgcgggcggcagcggggtctcgagtgcggccgtgcgcgagacgctggccagccttcccaccacgccgcgacagggcggctaccgcagcgcgctcatccactcggcgtactgcacggcggaggaggcgaagctctacggcggcaccgggctgtgtccgggcgtgtcggcgctgccgggcggtgataccgaagcgcgatcgctctacgacggcgcggggcagccgggcaaggcgccggagctgacgttcacgcaggcgcagacggacgcggccatggcctacgtcagcaactcggcgaagcttgatgccgggcggacgccgggcaagggcgaaatccagaccgcaaccgggcaggagtatcagggcctgctgacgcagtacaaggcgatgcagagcgcggcgatgcagccgcagctggacatggtcgccgccagccagccgcaggacgccacgcgcgaaccgctgaccgaggcgcggcagtcgccgtcggcggaaagctattttcagcagaccgcctcggcgcaggcaaagcagaccggcgccatgagcgagcgcgagtttgaggcgtttgaggtcgggcgccgctacgccaacaccgcgtgggtcaccgacctgcagggcatggacggcgacaacctgacgcgcgag

SEQ ID NO: 5478 - DNA, 2259 bp, Glycine max
  Peptide Sequence Number=SeqID_122256
atgagccttgccggctttatgacgctcattcccaccgcgtcaggctggtcgctgtcgcagctgataatgctgtgggcggcgtccaccatggggatcggcagcgcgaacctgttaacagacaaggcggccgacatgataagcagcggcatgtcgctggtcgtgcagcccacggcgccctccacgcgctcggcggcgcgcgcggtgtttgagatgaacctgtgcaagtacgccacgaaccgggagctgtcatcgctgtaccaggacggacaggcgcgaaccgcgctgatgcagacgaagggcgggaacggcgactacaccacgggcaacggcagcgcggtctgcggcagcgcccgcattcctgaaccgtcagaaggcgttatggacagcctgttcggctccgccgtgaacaccgccagcgtgacggccgcctcgcgcagcgcgctggacacgatgcagtctacgctggacgcggcggcgcaggcatacgttgatgcgtacttgagtaagcgcgaccaggacagcggcacgctcatcgatccggaaaccaccattcagaacgcggcggccgcgtatgaaaccacggtcaataacgcgctgaaccagctcaactacaaagactcgctgcagagccagctgaccacgcaactcagggcatatggctggatttcgctgggcgcctggtacaacacctttgcgacggccaacagcaaaacgaatgaagtggccaacgcatcccctgtcacgtcaggcacgagtctgcacggcgaaaccggcaccggcgacctgtatcaccaggtgtttacggcctaccggtctcaggtgcagaacagtacttacacggcaccactgggcacgcagacagcgaaggatgatggtgcagcttccagtgctgttaatccagacgcagtattcattagtatttttaaaaatccaatgcagaggattacaaaggcaattgcaacggttcagattggcaccccggctgacttttcgagtcaggttaaccctttgataaaaatgcagactattggtaattacactctattggcgacagaaggcgcgctgactacgtatacgctggcatatgccgcggcatcagccacagacaattcagtgctgggaagcgtcggaagaatacttccttttaacctgacagcagccgctaaagatgtcttagctcaactgtcaccacctttttactttttgttattactgttgtttgcagtgggtttttcactggccgtattcctgccggcggtaccgtttctgtactggatggtgggggtgttcaactggctggtcagcgtcatggtgggatgtgctgcgggcccgatgtggtctgcaactcacctgggggctgaggaggataaaggcagccgcagcgcgtacggctacatctttcttattgatatgatgctgcgcccctcgctcatggtgctcgggttcttttttgcctcggttgccgttatggcaggcgggacactactgaacctgctgtttggtactgcactggctaacgcaaacgccgattcaatcgttggggcgtttataatggcggggtggctgttgatttatgcccgcatagcgaccttcggtgtgacacgcgtattcggactgcaggcagcgctggctgattatgtcattacgtttttaggcggtgcaggtatggcaggcatcatgggcgggcttgttgatgacgttaaggggatgttcgcatctgcaggaggcggggcacggaggacgcccggtctacagaaagccaccaattctgaaggtcccgggatcatcattccattaggctatcgtcgtttcagtattatccgtcgccgtagccagcttaaaaagatggtcgtgctactcaccagtgacgagcgtttcagcccgctgaagcagcatcaggtgatggatgcgggccgtggcaaatacctgggcatcgatattaaatccggcaatattctgtacatccacatggtgaaaaaaggcgtcgtcgacgttatcggtctcaccatgcgcgactggaaggaacgcgagctggaagacagcacgctgcggatcaacaccaaaaatcctgaggtacctgtgctgagcgttaacgcgcatccgacggtgactaaggagctgtttgatacgctcggtgcgatgagccacagcagctaccctgaatcgttcccccaggagccatggccactgcacgtgagtatccagagccgcttcgttgagtttgaacacgacgtggtggttcctcaggccagcaactga

SEQ ID NO: 5479 - DNA, 418 bp, Glycine max
  Peptide Sequence Number=SeqID_122257
atgcgtaccggggaaagatttcgcccagaccaccatagggagacgagtgtggatcatgcgcactaccacaactccgatctccccctaccgaagtggatcgtgcccacaagacacccagtggacccggagaagtccaatagggccctgtcgtttccagctctagttacgggcctctgtcagtcttacagggtgcctgtcgcccgcagcaaggatcacgcccataagacacccagtggacccagagaagtccaacagggcccaggggtttccagctctagttacgagcctctgtcagtcctacaggatgcccgtcccccagcaagggatcgcgcccgcaagacacatagtggatccgaagaagtcccacagggtcctggtgtttccagctctgattatgagcctccgtcaattctacgga

SEQ ID NO: 5480 - DNA, 486 bp, Glycine max
  Peptide Sequence Number=SeqID_122258
atgggtgacctagaggaagtacaggaacaaatgaaagccgacatgtcggctttgaaagaacaaatggcttccatgatggatgccatgctgggaatgaaacaacttatggagagtaacgcggccaccgccaccgctgttagttcaactaccgaggcagacccgactcttctgactgctgcgcaccaccctattccaaatatggtgtcatacgtgactacgcgagtcatgttcctcccctcctacttgaaggggagcctcctcgacatctggacgtggtccacgaggatcattgagagcatgctcagggagacatcgactcctactccccgtttcccgctgaggggccagcgtccaatgcactacctcaacccaacatcacgggagaacctcgaagccaaccaacgcagccaatatttctgtccgtgggagggccacccctggcagcagaaggaaaggggaaactcgatctcatcgaagagaggttga

SEQ ID NO: 5481 - DNA, 738 bp, Glycine max
  Peptide Sequence Number=SeqID_122259
atgcatgtcggaaatgcaagatatgtgaagagcgacgacctgccggaaaccgtgccggtttttccccttcccggtgctcttctgttgccggaaggccatcttccactcaatatcttcgagccaagatatcttgccatgatcgacacggcgttagcgggtcaccgtctcatcggcatggtgcagccagcccttcatgtcattgaatcgggcctagagggcgggccgttgagtgcggttgggtgccttggccgcatcacctccttttccgaaaccggcgatggccgttacatcatctcgctgactggtgtgtgccgtttccgtctgctggaggaggtggaggccggcaagccctatcgcagtttccgtcacgcgcccttcatcgccgatctctccggcgaatacgatgaggaggccgtggaccgtgaaaacctgctgcgggtgttccgctcgtttctggatgccaaccagctggaagcggattgggagagtgtggaaagggccggcaaccgtgttctggtcaattcgctttccatgattaggatcgccgccatggacgacaggatgaacaacgtcgatccgaagcttctcgaattgcttgtctgccctttgacgaagggccgcctttcctatgaccgtgcccgcaatgaactcatctccgaaaatgcgcggcttgcttatccaattcgtgacggtgtgccgatcatgctcatctcggaagcgcgtaaaatagaggactaa

SEQ ID NO: 5482 - DNA, 261 bp, Glycine max
  Peptide Sequence Number=SeqID_122260
atgaagattgggctttgtttgatgcgatttggtgaagaaatgaataagatacgagaatttgaagatttgagagaaaggggcgccgtcacacgaaagggaagggttttgcaaactccattggagcttgtaggcctaggatcttcttcatcaatggattcctttgctttttggaagatgaatggcagtggaatggagaaggaagagagagaggagatgccacttcaaggagaagatgagtctagaagaagctcaccaccatag

SEQ ID NO: 5483 - DNA, 417 bp, Glycine max
  Peptide Sequence Number=SeqID_122261
atggtaaaatcgtcgaagaaacgaaagggaacctcctccaccaccaccgctgctggccaccgccgccatggaacctctagagacccaccagcaccagttcctccctctctttcacctcctcggtcatccatattattttccttcgatgatcagcgtcagaggtactactctcaatttcgcaatagagtcattctagaccctaagtaccttgaccttgaatttttttatggagaaacatttgattgttaccaagtgtttcaaaactctggtttgtttgatttcatgtctctaaaactaccctactttccagaattagttaaggtgttcctcttgagggcactcttgttgatgactggaaacttgattattcaagtcatgatgctcgcagaattgtctgcaatgatcaggctgacatga

SEQ ID NO: 5484 - DNA, 604 bp, Glycine max
  Peptide Sequence Number=SeqID_122262
atgtccaaatgccctacgtgtggggcgtcacggcacaaggtgaaggatgatgaggactgtagttctgatgaaaactcaaagaagggccctctagcaaaggtgttgtggtatcttcccatcattccaaggtttaagcgtctttttgcaaatggagacgacgcaaaagacctgacctggcatgcaaatgggagaaactctgatggaatggtctatcatccagctgattgctcccagtggaagaagattgatggtttgtatccggattttggcaaagaggcaagaaatcttaggctaggattagccagtgatggaatgaatccatatggcaatttaagcactcaacacagttcatggccagttctactgccaggaaatgacattgatgtttatctaagtccgttgattgaagacctgagaaaggtttgggaggagggggttttagtgtttgatgggtttcgcaatgagacttttgaaatgcgtgcaatgtttttttgtagcattaatgactttccagcatatgggaatctgagcggttacaatgttaagggtcattatgcatgccccatctgtgaagaagacacaagctacatacaactaaaacatg

SEQ ID NO: 5485 - DNA, 393 bp, Glycine max
  Peptide Sequence Number=SeqID_122263
atgaaaataaaaggaaaaaaaaaggcatatgctgccctaatcagttggaatatttgtctctttgctaaagcatgtttgcattttagtggagaaaacaccgagactttttcaagtctcacaagttatccagaactacgtaggtctgagttcctcattggaggatacgtaggagcaagagccttgcttttgtcgaccacaccaccttttgttgtcatgacccaagagctggtagcccgcggagacaccttacggttatccgcacctcgtcattcagtgaccccaagtgtgattgatgagcagaggccaatatggtcatctgcgctctttccggagatgtcaacatcttccggtggagactttttcaagtctcacaagttatctagaactacgtag

SEQ ID NO: 5486 - DNA, 574 bp, Glycine max
  Peptide Sequence Number=SeqID_122264
atggaagggttagtggacctagcagtgattgacgctttcctcgcctttcatcatggcaaggaaagcccggtcgtcgccattttggccatgtatgacacgttcgaccggggatgcccgtctatccgctacaaggtcaccgctcgtgcgtcgaaaatggaaaggcgaattgggaccaactcttggctagcatggaggggcgacagagagcttaggggaagcagtaatgggatcatcggcggctatcataagtggctgagagtccgaacacaaggattggattggctcccaaatctaaagactgtgagagacgatgaggttaaagcttcgaaagaaagtgatgaggtacaagccctaaaggcagatcttgaaagagcccgggtagtcgaagagaagttcaagtccatagccatcaaactgaagccttggaacgagaaaccaagaaagcccgaaaggaagaacacgtgcaagcaaagttttgaggggctttatagggcagcaatagtaagctcaagctccgaagaggtgaaaggaatcatcacgggtcaaaggcatgatcttgaaggacgagctaaag

SEQ ID NO: 5487 - DNA, 243 bp, Glycine max
  Peptide Sequence Number=SeqID_122265
atgcagaactatcaacatgcaaagagatctgattctgcaaaagccaggatcaacagaaaacgtattatgcagcagaagcgacatggtcatgctcagtcatcttcacaaccaacacttaactgcacttcagaatataatatgactgtttctgattcatcagaaagtgaaaattctgaatccacacaaggttcaggctctaattttatgactcccttcgaggattgtcaatctccaactaattag

SEQ ID NO: 5488 - DNA, 495 bp, Glycine max
  Peptide Sequence Number=SeqID_122266
atgtcgccacacgggggcgacatggatgggggtgaaaaaaggaaagagagggatggggtttctcttgcttttggcatagcgggccccggcgggaggcccgcacgacgggctattagctcagtggtagagcgcgcccctgataattgcgtcgttgtgcctggactgaggatagatggggcgattcaggtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacacgtatcttcacagaccaagactacgagatcgcccctttcattctggggtgacggtgggatcgtaccattcgagccttttttcatgctttcccgggggtctggagaaaattgcaatcaataggatttactaa

SEQ ID NO: 5489 - DNA, 322 bp, Glycine max
  Peptide Sequence Number=SeqID_122267
atggtgggagcaggtttgaaaaaggatcttagagtgtctagggttgtgccaggagggtctcttaatgccttcctttttcttctcatcggagttatttcacaaagacttgccatggaatctattgattctctcccaattggttggactgtaggtgcgatgatttacttcacgggcgaggtctctgctcagttggtagagctccgctcttgcaattgggtcgttgcgattacgggttggatgtctaattgtccaggcgaggaccgaaacatgccactgaaagactctactgagacaaagacgggctgtcaagaacgtagaggag

SEQ ID NO: 5490 - DNA, 866 bp, Glycine max
  Peptide Sequence Number=SeqID_122268
atggtcaagactacatgtcctcaccttcaaagggctacacgtcctcgcgttcagagggctgcatgccctcggcttcagagggtagcacgccctcgccttcagagggctacacgtcttcgcctcagaggaccacacgtcctcgccttcagagggctgcacgcactcttctttagagggctacacgtcgtcgcctttagaggactacatgtcgtcgccttcagaggactgcacgtcctcgcctttagagggctgcatgccctcgcctttagaggactacacgtcctcaccttcagagggcagcacgccctcgccttcagagggccaaatgccctcacctttagaggaccaaacgcccttgccttcagaggactacacgtcctcgccttcagacgactacacgtcatcgccttcagatggctaccctcccatgccttcagaggactacgcgtcctcgccttaagagggctacacgccctcgccttcaaagggctacacgtcctcgccttcagaggactacatgtcttcgccttcagaggacaacacgtcctccccttcagagggctacacgccctcaccttcaaaggactacacatcctcaccttcagaggactacacgtcctcaccttcgaagggctatacgcccttgccttcagaggactgcacgacctcgccttcagagaactacacatccccgccttaagagggctacacgtcctcgttttcagagggctgctagccctcgccttaagaggactccatgtcttcgccatcagagggctacacgtcctcaccttcagagggcaacaccacctcgcgttcagagaactacacatcctaaccttcagaggggccctcgccttcagagg

SEQ ID NO: 5491 - DNA, 451 bp, Glycine max
  Peptide Sequence Number=SeqID_122269
ggccccgacgggtgcagagaaacgcgaggagctggaaccagagaagcggcatgtaaaccgagacaggattttagcattcaaaaagttaaatttttctctccttgtggctgagtatgaagtcacctcaaagggaagagaattcagaagcttttccctcatctcccacgttgcttttctcttcttcttcctctccattgaagcctccattaaagctccaaactttgctcaccatttctactccaaattgcaaaaggaagccatttttggagtcgtgaagcgcacctctacgttgtgggacttcaaatttcaggtagaaaagtgtgagattttgagggttagagaagctaaatttggggttagtgtaaattggagtctaaagacttgtgggaaagcttgggctgagcaaatgagaaaaatgagtgacaaaggtgaaagcaagagccatttctaa

SEQ ID NO: 5492 - DNA, 633 bp, Glycine max
  Peptide Sequence Number=SeqID_122270
atgacatccaagaagaggaagagcactgcttctaggcccacagctcagtatgatactagatacactgacaacattctcagccgaaatattcttccggagagaaatgtgaagctttatcatactgagtttgacgagttcaaggtggagttggagaggcataatcataatcttcacaaacgcctcgctaacctccaggatggaagcacaaacgtggctctggttaaggaattctatgctaatttatacaccatagaggaccaagctccaaagcaagccagagagattgaagctaggctttgtattccctacaaggagtttgttttgaatgctgaaggccagccatggaaacttctcagaaaagatctgatgacactggcccaaacatggagtgtcttctcttactctaacctagctcccacatcccacacctcagatttgaatatggatagagctaggttggtctatggcttggtgactaacatggacatgaacatcagagcccttatctcagttaacttcaaaggagcaaggaaggcaagggttcgactacctgatgttccttcttcttctactccaccagctccttccacttttactactcctacaccagctcctccaggcccatccgcttag

SEQ ID NO: 5493 - DNA, 243 bp, Glycine max
  Peptide Sequence Number=SeqID_122271
atgcatgtatgtgtacattatggaaaaatactgccaacaccttatgttgggggaaatgtcttgaaaattatgaccaggccttgcttaaagggaatagaagagaagactaccaagttgaaaggaagtgagaaggctctagttgcacggcatgaagttagtcatgctgtagtaggtactgcagtagcaaaccttcttgctggacagccacatgttgaggctctggttatcagactcctggtttaa

SEQ ID NO: 5494 - DNA, 1125 bp, Glycine max
  Peptide Sequence Number=SeqID_122272
gtagtcctgatagtgacgcgcttcggatcgcagcagcgagacgtaaaagcgattcagctcgtcgtccaggtgcggcgccagtttggcgaagcgttcacaggatcgcgcttcgatgtaggcgccgcagatcagtttgtcgatcagcgtcgccggatcgtgggtgcggatctcgcggatcatacccttggcgtagcggctggcggtgatcttgcgatacgggatcccgcgcgcctgcatgatctccagcacctgcgagaagtgatgcaactcttccttgatcaacagcaccatgcgatccgccagatcctggccgtaggccgagccgtttttcggcaggatcttgcgggtgaactggccactggcggaacagcgtgtccggcgcgccctgcgcttcgtgcagaaacgcctcgtagggccgcagcagcgccaacagcgcgtcgccgctctctttgtccgccacgtagcggcggatcagccacatgccggtctgcgcggccttcagctcgcacaccaggtggtcagtcagcaacagctgcaggttttccggacggcgcgcggcgtcgatccaggcgtcaggagtttcacagtgcaggaagcttaaaatcggggctaacagggattgtgcagccaacaacgctgcagcttgaaagacgacggggatatcaggggccggcgagaaccggcccacaggtattgattggagagggattagtggcgtttgccgtcgtcgtcttcgtcgatgtagtcgccgtcttcgtcatcctcaccgtcttcaccgttcggatcttcgaagtaggtgccccagccatcgtagttgacgccgcagcgttccgccagcgccaccaactgctcgacctgagcgtcgatcagttcggcgttcaggccgacttcgctgatcacgtcgcagcacatcaccatcgaaccgtcttccacttccagctcttcggcgtcggtcacttcgtagcccagcttgaaggcttcaacggcggcctgctccagaacctcaaatttctcggcggacagatggtgctcgatggtgtagagcgcgtccggatcgctgccgtcttccagcagttcttcgatgatcaggcgggtctcttcacgttgttcttccagcaattcgcg

SEQ ID NO: 5495 - DNA, 645 bp, Glycine max
  Peptide Sequence Number=SeqID_122273
atggttacaccaccgagcttcccttctccagagtcaacaccttcaccatctatgatgaagaggactagaaaagccacacgactcagatcattgtcttccaaacccgtggggttggagagagcactggtggatgttacatatgttaactggaaacaggttcttgtagctcagaaggatttgatttgggatgacattcaagctgaatttgatatttcaaaagctttcaataaaaggatgaagaagaaaatcgtgaagtggaagatgactcgcacaaaaaaattgggtcagatgacatctgaggcggcatgccaaattcttaataggattgattccctggaagagcagtccgcacaagatagcattattgcccatggacgtcaggatgaggagctgacacaaaatatcagggacgagctagagcagtcgatcactgaaaaagtgacgagacaactaatgttgtccttcagccatatgcagtccctgggaatcatacctcctattgaacctgaggtagctctttttggtgcctatgtcagcacaaagggaagctgtgttgatccctcgggaatttatgaagggtcgacaactatgcaccatgtccctttgagcaatggtcttgtgaaggagggcattgaagaagtttga

SEQ ID NO: 5496 - DNA, 330 bp, Glycine max
  Peptide Sequence Number=SeqID_122274
atgatcttggagaagattgtgcagccgaacaaaaaggattggagcaccgggatggatgatgctctttgggcgcataggactacctacaaagcacccataggaatgtctccttattgggctggagaggaaaggaagttgaaactaactgagctagatgagatccgcttagaagcctacaaggagaagaccaagaagttccatgacagcttgatagctaagaaggacttcgtgttgagatcaaaagtgaatcctcacaaatccctccttagtggatgtagtggtggaggagacctccttacttcaccgtacttctcttccttcatgacttag

SEQ ID NO: 5497 - DNA, 417 bp, Glycine max
  Peptide Sequence Number=SeqID_122275
atgaacgcttggctgccacaagccagttatccctgtggtaacttttctgacacctctagcttcaaattccgaaggactaaaggatcgataggccacgctttcacggttcgtattcgtactggaaatcagaatcggacgagcttttacccttttgttccacacgagatttctgttctcgttgagctcatcttaggacacctgcgttatcttttaacagatgtgccgccccagccagactccccacctgacaatgtcttccgcccggatcgaccggccgaagccgaccttgggtccaaaaagaggggcagtgccccgcttccgattcacggaataagctcccacttatcctacacctctcaagtcatttcacaaagtcggactagagtcaagctcaacagggtcttctttccccgctga

SEQ ID NO: 5498 - DNA, 254 bp, Glycine max
  Peptide Sequence Number=SeqID_122276
gttgtgcacacaagtacctaggtggtggttgtcacgaggcgttgttgagtgtcgtggtgtcgagcatgactatagttgaggtcatggaggacgtgcgcgtgatggaggttgggggaaaggttatcgtgtgtgaatggcaactaggcggtagtggggagtgttgcaacatgacgatggtcaatggtggtggttgtgctatttggttgctagcttgggaggaaggaggcgatgactatggttttttggttcttgag

SEQ ID NO: 5499 - DNA, 4059 bp, Glycine max
  Peptide Sequence Number=SeqID_122277
atggcgacttcgactcctaaaaccaacgtcgttttcatagacaccaacctcgatacccacttggccctcgtcgtttccgacctcgacactgtctccaacctcaaaaagagtattctgtcggaacatcccttatgctttccgaaaattgggaaaattcagattcatgggataaaggttgagcgcaaggggtacttttaccaccttacagattccatgcctgtgagaagtgccttcagtggtgtcaaagagagctggtttctcactgttgatgtttctgtgttgagggagtgtgctcagaatgaccaattattttctcttggcattgcaaataatgctttgactgttggttctccatccaagagggggtgcacctttgacaatttcaagttgcctcagttggacaatagaccagttgaaaatgaagaaattcctgttgctagtccacatgttttgaaacatactggcaaaggagttaagtcatctggccaccacgacactggaaccccattacctggttctattcctgagacggaggaccattgctttgtaaatcgcaaactgccaagtttgaatactgagtgtgaagtagatggatctggtaaaggcattaaggatgatcgtaatgtatgtgaagaggctcctgtatcaagtgcaaagaaaatacgaaagagtaacaggaaaaaacaagacatggtgcaagatgataattcaaaagatgctgctgctgtagacaatgctcttagttttccatccaaaagggcatccagtgcaaataatgaacttccaggttcacgtattgaatgcgaggtagatggaaccaatgaaggcattaaggatgcttgtattgtacatgaggagggaaattgtaaatctgtatcaagtgtgaagaaaaaacagaaaggtaaaaggaaaaaagaagatgcggtgcagcatgacacttcaaaagtaaatgattcttctgttgttggatctggtgattatacaattcagcaggatattcaggtagtagcaaatccttcagaggatgcagataaagaagtaattaaggaaactgaaattttaaaggagcatcagcacgctgatggcagcaataataacactaagaatgacattgatgttgctgcatctgcaaataagaagcataagaaaaggaagaggtctttgactgttgattctaaagaaatgttcaaggtagagacagcaattcagaaggatgaaatgcataagtctgatgaagcacataaggaaaggaaagaatcaaaagagcagtttgaacttaaaaatgaaaaatctagggatgatgttgaatataagcaagatcaggtaactgaagacattttaaatactggacctcctgcaaagaaaaagaggaatggcaaagagaaaagtggagaagaaagtttgtccaaggcaaacttgattaatgatttcaatgtagacagtacttctcaccacattttggaggaccaacagaagattaaaaacagcaatgctgaccaatcagctgaacattttgatgacactaatccaccgcgaactagtgtgcggggtaggaggaagaaagggaagataaattcatcaaatccatatgaaacacctgtagttacttcttccaggaaagatgaagaagcagattgttccagtattcaaagaggtgttcagaaggaaatatccgaagatggcctatcctctaaagatcttggtatgagcaaagctactattaacaacatggagactggaacagatgcatgcaaagaaggctttcaatctacggaaagaacaacagcaaattataaaaaccattctgacattggaataaaagcacacactgctgatgtggatgagcctatggagctgactgagaataatgagaatgttgtccttgatcaatgtcataaaaatgaagctgatcagattgagggagctgaggaaggaagagaagtatcaccacataatgatcctaagttagtgcagttggaaaagtccacatcatccagccaggataaaacagatgcaaacatcggagaattaaatgtgacttcaaaaggtgtggatgtcaatggaatgactgaacctataaaatcagtgaaggaaaaaaggacgagaaaagctaagaattcaggtggagggtctgcacttagagaaggtattggccttgtggatgcttctgagcatgaaactgttattatgaaatctcttagtgcaaaaaattgtgatcctaagtcaggaaatacagagacagaggagaaccctttaaatcaaacagaaggggggaaaaatcagcaggagaaagtgcaagggacttctgataaggaagatgattctggtgttgataatgctgattccttggaacaaattaaaactaaatctaatgctgaacacatggacaagagacagagaaagaaatcaaacagcaaacagacttcaacctcaaagagcatatcaagtatgctaacaaaagatcaagttcttgatagcaagaagccatcaccatcttctggcagtggaacacatggcaaaccttcagttgcagtgacaaagaagagtaaatctacaagcacgaagtccactaacaaatcaagcaaaacaaatttggaactggtggaagactctgttagacttgaactttctgattctcggtttaattctgggggtaaagatgctgcccagcattcaacatgctctcctggagagaaagatgatgataacttggaagcaataaatggacatactcatgctgaggatttaagctcctcacagcaattatcatcaaaggaaaagcttgatgtaaggagtgaccttggtaagaaggttccaaatgtacacaggactggacaagattcaaaattgtctggtagatctgacagggctgtgtccttaattggagaaaacagaaaggctcatgtcaatgcttttgggaaaagtatggatttggagaaacaaagaaaacgtgctcctgtatcaaacttaaagctggaaggttccataaaaatggttcaaaataaagcaggaaaagcttctgggaacaacgttcgtggagttgcaagtaaaacacaacaagagaagagcttgttatcaggagcaattttcaaggatgacagtagcagcacctctgaagatgaagttgataattctgatgccagcactagaactccatcatataatccactgatgtctgatttttctgatggggatagcagttcaggtctgaattcacaagtagatggcacaaaagggatgtcaatcgatgatgttcttagaagctcaagcaggtttaagaaggccagaacagcctctcttttggaagagactcaaagccagcccgaatttgttccagacagcctggccgacaatagatacaagttacaagcaggaagtggtacaaggaaaaaagcattggaacgaatcgggtgcacaaaattccattcccttagccttagcatagcaaagtcactctactcggatctcattctgttaagctggttgagtgccggttgcaaaatgttgtacagaacccaaacaatcgctggtgtaaccacaaacagcagaagctgtcccctgttgtcactggcagcagcatcggcaatcatagcaatctcactagccgacgcttctgggccggacatcatgcccgatgcacagagccctagcccgagcccaacgatgacccccttgctgttacgcatgcggttcagttggttcagtgctggctgcagaatgttgaacagcacccacgctatggctggaatcaacggcaacaacaatgccagcccgcggttatcaccttcggctaattcagcaatttgcgatgcagctaaggctgcgtcgcagtttgcgagtgaggagaatattgcgcctgcgatggcagtgcctgctgtggaagttgagacgtgggagggtgggagcttggggttgtgcaacttgtgtgatgaccctgttgtgttgatgcactttgagttgatcatagccattgttgttgctatggttgctgccattatggaacttgaatgcagagtgtcgaggcaaagagaacacagaggaacttggcacgtctattaa

SEQ ID NO: 5500 - DNA, 1455 bp, Glycine max
  Peptide Sequence Number=SeqID_122278
atggcagctctgttaccttgcgcgccgaacatagtctatggtccgttgttggggaaccggagcacgagccacctcccgcaccgacctcactcccatgctttctccggttcgaccaccagacactttcttcgcggttcgcttaccgtcgcccggttcggattcaaacccgatttcttgcccgagccggatgaagctgaaggcgttctcagagaactgttcggccgagcggagggacttctttacacgattgccgatgccgccgtttcttcgtcttcttcttcttcttccgatacggttgcggcttcctatgccgccaaacagagcaacgattggctttccggaattgccaattacatggagacggttctcaagctgagaaatgcgaaatatcattatttccactttgattctagcgatttaatttcccgtactaggtctagttgccacagaaaggactttgaagttatgatgatgataacgagcatgtttggttttcagttcaaaattacgtttgaggcaaaagtaattctgccaaaggatcaggactcttgctcctgcgctcattttacttttattcgttggacttacattggaatgtgcaccgcaacattaccaactgcaaaccaaacatgcacaattttgcatagtaatgaagtactcaaggacgggctttctgctttgcatgtcccgtatgcttatggttttgcaattatactgctcacggttcttgtaaaagctgccacttttccattaaccaaaaaacaggtagaatcttccttagctatgcgaactttgcaaccacaagtaaaggccatccagcagcgttatgctggtgatcaggagagaattcaactcgaaactgctcggttgtataaactagccaacattaatcctctagcaggatgcctgcctacactcgcaacaataccagtgtggattgggctatatcgagccctttcaagtgtggcagatgaggggctccttactgaaggcttcttctggataccttcccttgctggtccaactacagttgcagctcgtcagaatggcagtggtatctcttggctttttcctttcgtgaaaagttctttgtctgtcgcaagttacccagatcatagggaagcctccacctttgggggtgcacaaatcacaatcttatatgtaccaaagttgaatgcattctggacttcagagggtgtgttaggatggtcaccctcccctcggatggtcagatacattggcttacctggtcttgcctgtgttgctggtcgtctctcagtacatctctgtccaaataatgcagtcatcacagctgagttatttgtcattttccatgtcaacttccagcctaatgatcccaacatgaaaagttctcaagccttgaccaatttccttccattaatgattggttactttgctctctcagttccttctggtcttagcctttactggtga

SEQ ID NO: 5501 - DNA, 798 bp, Glycine max
  Peptide Sequence Number=SeqID_122279
atgggttcgggttttgttttgtctgggagcagaatgggcgacgtgagcatgggtaacaagcctctggacaacggagggggaaacgacaaccgtcctatgaagatctcattccgagacaaggttatggacaatattgagaagcctcctgtgaaggaaaatttggctaagatcgtatatgaggatgacaatccaatgaagcctatggtcattattgaagattcagtctttgaaggactttgcgcaccgtggaaggatgccctaatgggcattattggtaaacagcttggtggtgttaagattcagttgcaagatgttggtatcactttaaaggacttgtggaatggtggtaattggaattgggacagggctgctatgatttggaatcttcttcagctggatgttcaagttcatgctttagatgataatagctcgacttggcttcaaaggatctgcttggcagaccatggagcaaggaacaaggaagtcttttcggatcttgtcattcgtgtcgtattagtgatgaaccagatccttagtttactcgaaatagttaccaagacctgcaacaacaacaaaggctcatccagtggcaaccaccttaacctagagagcacaaactcaacgttccatggcagctcttttggtaacccgggcaaggcggggtttggcagtcttattcaggacaatcatggtcattggatcatgtggaatttcatccaacacaaatgcaaaacatcaagttatataccatggcattggtgtggcttggctcgaaggatctcaccatctaacttgtga

SEQ ID NO: 5502 - DNA, 1533 bp, Glycine max
  Peptide Sequence Number=SeqID_122280
atggatgccacaaccagcggaaccccaactatccaataccataacatccctgaccagccaattactgccattattgccactccacttccaacatttcaaaggcagcaacgccattgctttggggactccactcctggagagtttcccttgtctgctaatccctccattgtccttcatgttctcactgcatgcaatttggaccctcaagaccttgctaaactagaggcaagtgcaacatgctccttcttcaggcagccggcaaactttgctccggattcggacttgtccttatctgagctcgccgcactggacatgtgccagaagagagccatattcaagccaatgacaactgaacaacgccaggatttgaagctaaggtgtggaggttcatggaaactggtgctgaggtatttgatggctggagaggcatgttgcaggagggagaaatctcaggctatagcaggtcctggtcacagcattgctgtgacatcaaaagggattgtttattcatttggttccaacagttctggacaacttggacatggcaccactgaggaggaatggcgacctcgaccgataaggttggaacatgtttatgcatttggggaagctgagtatggagttcaaggttctaaaactgttgcagctccacagatagtggagtctttgaaaaacatatttgttgtccaagctgcaattggtaactttttcacagctgtgttatcaagagaaggcagggtttatacattttcttggggcagtgatgaaaaacttggtcatcacactgatcaaagtgatgtggaacctcatcccttgttaggtgctcttgaaaacataccagtggtgcaaattgctgctggatattgctatctgctttgtctggcttgtcaacccagtggaatgtcagtgtattctgttgggtgtggcttggggggcaagcttggacatggctcaagaactgatgaagagtaccctcgtttgatcgaacagttcggactgctgaacctccaacccatggtcgttgcagctggtgcttggcatgctgctgtggtgggacgggatggccgtgtttgcacgtggggatgggggcgatatggttgcttggggcatgggaatgaagaatgtgaatcagtacctaaggtggtggaagcattgagcaatgtcaaagctgttcatgttgcaacaggagattacacgacctttgtagtgtctgatgatggtgatgtgtattcatttggctgtggacaatctgctagtcttgggcataatgctgctggaaatgatgagcagggcaacaggcatgcaaaagtgttagatccagagcttgtcacttcactgaaacagatcaatgaaagggtggtacagattagtctgaccaattgcaattactggaatgctcatacctttgccctcactgaatcagggaagctgtatgcatttggtgctggagacaaaggacagctaggaattgaacttgttgctaaccagactgaaaggggaaatccagaaagggttgaaattgatcttggttaa

SEQ ID NO: 5503 - DNA, 225 bp, Glycine max
  Peptide Sequence Number=SeqID_122281
atgctctcgggaaacggaagcttcgagcacacttccagagatctactcaaagatcccaacggtcagatagtggaaaagtgtcttgtgaagctgcagaccaaagttcgagaagatccaacggttaacaaaggctgggcagcgtttttaccgaggcagcttcatgtagctttctctagaagcttcattaagaggcttcctccagaagcttcctcgtggcttctttga

SEQ ID NO: 5504 - DNA, 1374 bp, Glycine max
  Peptide Sequence Number=SeqID_122282
atgaggggcagggatttcacacagaaccatgaaccagtaggtcccactcaaaagaaatatattatgaagaacagtagtctgaaaacggaagtacatggaagagttgaattgcaggaggaagtaaagtcacaagaggaaattggaacaggaataggtgtggacgtttataaaatactacatggatattggcatactattcctttatcctccttgcttattagtactactcctactcctcttaagttttttattctgagggcagatcaagctagcacgagcattaatgcctcaaggaggaacttagcatttctttcttgtggaacggggaaccccattgatgattgttggagatgtgaccccaattgggaaaagaaccggaagcgtctagcagattgttccattgggtttggtaagcatgccgttgggggaagggatggtaaaatatatgtggtgactgaccccggtgatcaccctgtgaaccccaagccaggaacactaagatatggtgtgatccaagaggagccattgtggatcatattcaagcgtgacatggtgatcaagctcaagcaagagcttatgatgaattctttcaagacaattgacggtagaggagcaagtgtgcacattgctggtggaccttgcatcactatacagtatgtgaccaacattatcattcatgggattaacatccatgactgcaagcaaggagggaatgcctatgtgagggattcccctacacattatgggtggaggacactctcggatggtgatggagtgtcaatctttggtgggagtcatgtttgggtggaccactgctctctctccaattgccgtgatgggttaattgatgccatccatggatccacaggcatcaccatatccaacaattacttgacccaccataacaaggtcatgcttttgggccacagtgacactttcactagggacaagaacatgcaagtcaccattgccttcaaccattttggagaagggctagtgcagagaatgccaagatgcaggcatggatacttccatgtggtgaacaatgactacacccattggagaatgtatgccataggggggagtgctgccccaactatcaatagccaagggaatagatttcttgctcccaatgacaataccttcaaagaggtgacaaagagggagaattcagcacagagcaagtggaagaattggaattggaggtcaagtggagatttgatgttaaacggtgcgttttttacggcatcaggagcaggtgcatcttcaagctatgcaagagcatctagtttggcagcaaaatcatcttcacttgtgagttctataacagcatcagctggatcacttagctgcagaaagggttcacgctgctga

SEQ ID NO: 5505 - DNA, 291 bp, Glycine max
  Peptide Sequence Number=SeqID_122283
atggggcagtggcgaccaatgaggtcctgccacacggttcgcgactgcaatcacaaaaggggaaaaaataatgagagatgcaacgacattgtatggaaggaagagaaaatcacaaagagtgaaaggggaaatgggaacaaacgaagtggtattaacccatgcagttcatgggaacgatgtcgccggatctacgaacctggaatcagagagcaaagagagaaagagggaggtggtaattgtgcgttgagagggagggagagagagtgttggatcaataaggtgcaaacctag

SEQ ID NO: 5506 - DNA, 183 bp, Glycine max
  Peptide Sequence Number=SeqID_122284
atggacctgaggggaggagggttaattgaattttatgttatgaggagggtcttcttggacttcaatctagttcttgtcgatggagatctgtttcacgtgttggaggagggaattgattgtcaagtgacggttattttgaggatcaagatctatggaggtgaatccggtacatggtcagaatga

SEQ ID NO: 5507 - DNA, 324 bp, Glycine max
  Peptide Sequence Number=SeqID_122285
atgaatgcagagataagagaaaatatgattggtgtgcttccaaagagaagaatattgatgcggcatggagagttacagggaaactgggacacgacggtatacaccaccatacccgaccacaacattcagtcaacggtgcaaggcatggcccagaccctctatgccgacgagcacctccaccgcgtgataggcagccacgactgctctcctgattggcgggtgcagttctacgtgtcctcctatgctcgcactcgatcgacacttcgcgagttcagatggtgtttcttgaataagaggatcatcagcgtgagggaagaatcatga

SEQ ID NO: 5508 - DNA, 358 bp, Glycine max
  Peptide Sequence Number=SeqID_122286
gtttggatatttccatgttgtgaacaatgattacacacattggcaacattatgcaataggtgggagttcatccccaactattttcagccaaggcaatagatttgttgctccaaatgatgatgaccacaaagaggtgaccaaacattttaaatcatcaaagagtgagtggaggaaatggaattggaggtctgaaggagatgtaatgttgaatggtgccttcttcacgccgtccggagcgggggcaactgctaggtatgataaagcgtcaagcatggcagcacgaccacctatgcttttgtcttacatgacagctggggctggagcgcttagatgcaacaagggcaatctatgccactag

SEQ ID NO: 5509 - DNA, 561 bp, Glycine max
  Peptide Sequence Number=SeqID_122287
atggatccaaccatcgatttggatgaagttttagatcgaatgatagatgaggaattggaagataataccgatgaagaaatcattaggttgatacttaagatccaacaacaactacatggcaacaccactgggtgtagccaaagaagaatagtggtacatcataatcatgaagaagtggaatgcttgaagcgatttatatcaagcatctacaccatatttgggaatgagtacttgaggagaccaaataatgaagacaatgaacgcctactacaaatgggagcgacacgtggatttccaggtatgttaggtttcattgattgtatgcactggaaatggaaaaattgtccagatgcttggaaaggtcaattttgtcgaggtgatcatcgcaatccaacaatcattcttgaagccgtgacatcacaagacttatggatttggcatggattttttggaaccgtcggttcaaataatgacattactgtgttaaatggatctaatgtgtttgatgaagttttgtcaggacgtgctcccacagtgcagttcacagtgaatagaacctaa

SEQ ID NO: 5510 - DNA, 2535 bp, Glycine max
  Peptide Sequence Number=SeqID_122288
atgaatcctctgtgctgcattgctccggtttccatcgatcgggaccgccccaaccacgtgctggcaaaatcgcccgctcagtgtcagttagggctcgatgcgtccatcaggacggtgaaccacgcctccaaatccagctcctccacgcaggattcctccgtcgccgtcgactctgtcaaggccacctccgccgtcgcggatctcccggaggaggaggagccacgcgattccaaggccttctccggcgggaacggcggcggagtggctgggagtgtcgccgggatcctgtacaagtgggtgaattacgggaaggggtggagatcgaggtggttcgtgttggaagatggagtgctttcgtattacaagattcacggaccggacaagatcttgatgagtccggcgaaggataggagcgtcagggtgatcggagaagagtcatcgaagtttgtgaagaaagcgaattggaatctgaatctgaatcgagcatcttctggtggaggagtaggaggaggtaatagcagtaacaacgggaagcaatgcaaaccgttcggtgagatacatttgaaggtttcttcagttcgttccagcaagtctgatgataagcggctttccatatttactgggacaaaaactcttcacttgaggtgcgtgtctagagaagacagagccatgtggattgaggccttgcagtctgcaaaagatctttttcctagagctctaacaagtagcgatcttgcaacttcagaagatatcgtagtttcaacagagaagctgcgatcacgattgtcacaggaaagcataagtgaaacaatcattaatgactgtgagtctattatgctttccgaagtctcttatcttcaaagcaagttgaagtttcttcagcagaaacatgttatgttgctggacaccttaaaacaactggagacagagaaaatagagttggaaactactgtagtggatgaaacaaaggaacgtgaatcatactgtggacaaggaaatagaaggtttagtgatttctattccgtcatgtcggagggcagtgctactgattcagtggcggataatgaaagtcaagatggagcagatgttgaaacagatgatgaggatagaacatattttgacacaaatgaatttttgtattctgatgccctaagaagtgcttcctatcgaagtagggaaggtatgggcaatgctagtatattcgatagagattatatttgttatgatggtgtgcatgggtttgacaaggagatcaaagatgtaagttatccatatgtcaaaagaagggataacctaccagagccaaaagaaaaagagaagcctgttggtttgtggtcaattattaaagacaatattgggaaggatctttctggagtttgtctccctgtttattttaacgaaccactgtcttcattgcaaaagtgttttgaagacctagagtattcatacctggttgatagagcattggagtggggaaagcaggggaatgacttgatgagaattctaaacattgcagcttttgctgtgtctagctatgcgtcaactgaaggtcgacaatgtaaaccttttaatcctttacttggggagacctacgaagctgactatccagataaaggacttaagtttttttctgaaaagggcagtgatttgtgtctattgtatgctgctaattttcatctaacaagaagcttgttccaggttagtcatcatccaatgattgttgcttgtcactgtgagggaaggggttggaagttttgggcagattctaatttgaaaggaaaattctgggggcgttctatccagttagatcctgtgggtgtcctcactctacagtttgaggatggtgaaacatttcagtggagcaaggtcaccacttccatatacaatatcatactaggtaaaatttattgtgaccactacggtaccatgcacatcaagggcagtggcaactattcttgcaaactgaaattcaaggagcaatccattattgacagaaatccacatcaggtccatgggtttgttcaagacaacagaactggagagaaggtagcgatgttaattgggaagtgggatgaagcaatgtactatgtacttggggatccaaccaccaagccaaaaggttatgatccgatgacagaagctgcattattgtgggaaagggacaaccatttaccgaagacaagatacaacctctctccttttgcaatttccttgaatgaaatattacctggtttatcagagaagttgcctccaactgactcaaggttgagaccagatcaaagacatttagaaaatggagaatatgagctggcaaatgcagaaaaactaagacttgaacagttgcagagacaggcaagaaagatgcaagaaagaggatggcaaccgagatggtttaagaaggaagaggatggttgttaccgatatattggtggctattgggaaacaagagaaaagaataattgggacggaatccctgatatatttggacagagttgtgatttaccttcatgctcggaagagactgcatcctactga

SEQ ID NO: 5511 - DNA, 390 bp, Glycine max
  Peptide Sequence Number=SeqID_122289
gacttccagctagtgccgactgtggaagagtttgaagaaatcctgggatgcccactgggaggaaggaagccatatcttttctttgggttctatccctccacgacaagagttgccaaggcaaatgggctttcttttattgacatcttggcgcttttgatctttggagttgtcctctttccgaatatggaagggttagtggacctagcagtgattgacgctttcctcgcctttcatcatggcaaggaaagcccggtcgtcgccattttggccatgtatgacacgttcgaccggggaggtgaaaagagtggcgcaagaattgtttgttgtgcactggctctctatgtgtggctggtttcacacctttttctccaagaaggaaggaagaattag

SEQ ID NO: 5512 - DNA, 996 bp, Glycine max
  Peptide Sequence Number=SeqID_122290
atggatcccgacggcgtggtcgcggcggaggcgcttatggcgtcgggtcggagttcggagaagctgagccttccatcactccaatccaaaatgaagtgcgatcccgaaggctacgaatcggagctactccttctctacaaccaattcaattcctcgctcgaactctttcagaaacaagccgccatgaacttcacctccatctccggcatcggcagcgaccccaccgtcgccaaggacctcggcgacagggccatgttcctcgcccacgtcactcctttctaccccaaacacctcgccgatttccccaaaaaactcgccgatttgctccgctgcgccgcccgcacgctgccttccggccttcgctgccacctcgcacacgcgctcattctcttatccaatcgaaagattgttgacattggagaaacgctgtcgttgttcatggagcttcaaaccctaggtgacagaacgctcaagaagttggcgtttgatcatgttgttcatagtataaggcgtatgaaccaaaagcataagaacgaagctaagaacagagcgcttcagaatgtcttgtttgacttgcttcagaaagaggctgaagagccagccaagagggcactcgtgactctatgtgagcttcacaggagaaaagtgtggtttgatgagagaacagcaaatgcaatctgcactgcttccttccatccaacatctaggattatgatagcaactttatcatttctgcttgattatgagaagattcaagatgatgatgatgacagtgataattcagacagtgatgatgaaaagacagaatcacctcaagttgtccttagcagggagacagtttataaggcaagccaccaaggtacagcagcaagcaaaaagaaaaagaaagcaaaactacaacgtgcaatacgcagcatgaaaaggcatcagcgtgtgtcatctgataggagcaaaaacagttattattcaccacttaaccatctgaaagatgctcag

SEQ ID NO: 5513 - DNA, 1299 bp, Glycine max
  Peptide Sequence Number=SeqID_122291
atgaggcttcgacttcccagtacttcagccgccatgattcattctaactctcttcacaaacagattgtttcaaaaccggaactgggaaatgaggagttcacgcaaaaggtactcaacaacagaagatggacattgccaagccccgaagcaaaaattcaccaactaatacatacacaaggtcctactttcctgttgaacacccatccatcttttggcgatgccaatcgcgtgaatgaacaaaggaagtacttttatgtggttcgggatgatttgttgcacccacttgttaatggcaacaaagcaagaaaactagatggactacttcctctgcttcaacattattctgtcactgatgtggttacatgtggaggctgtcagagtgctcacacagctgctattgctgttctgtgtgctgagagaggaattgtgtcacatctgcttctacgaggagagcagcctgaaatcttgacaggctataacttgatgtctacaatgtatggaaatgtcacgtatgttccaagaactgtttatgccaacagggaagagatgctaaagagctatgccgagtcagtggctggtaacgacggttctgtcctatggttcggtgatatcgttcaagcttcttcagcaaccgaattgtttactgatccaaactttatgcaaatggatgtaagtagaagtgaggaaaaccatctacgaaagattttagttgtcagtgaaggtgctggtgattctgttgctctactaggtgttattcgcttagtgcaatacttatcacagaatcatttacttggaaaacaaaggctcatgaaatttgttgtagatgctggtactggcacaacagctattggtttaggacttgcagcccgttgcttaggactcccatgggaggtatatgctgtcatgttggctgacaaaattgatgggtacagaaaacaggaggagcgtttgctttctgaattcaagaagcattttaacattgagtttattgaccacaatgtaaacagagaagatgcagggattgtgaattgggtggagcgtggccgtccaagaaaatttggtaatgtcttggaaggggaggtggaagcatgtcagcaaattgcccaacaaactgggattttggtggatcctgtgtatacattagctgcttgggaaacagcaatgcttctctccagcaacgaagctgaaggaggaccagaagtggtgttgcttcacactggaggcacgttgggtatgtttgggttggcccaaaggtacaaaaaatattttggcatgctcaaaaaaggacacagtcattaa

SEQ ID NO: 5514 - DNA, 207 bp, Glycine max
  Peptide Sequence Number=SeqID_122292
atggaagaaagctcatcaacaaccgtaggcgctgcagttgtaaagccaagaatggtttgggcacagcagaattggaatccgctggcaaagcaaagacagcttgatactttactttggaaaatcaaaaatcccgttaaagacaagttcccgcctgcgcgagggccttactcctcagatgtcctaaaaaggagggctcttgaaggctga

SEQ ID NO: 5515 - DNA, 541 bp, Glycine max
  Peptide Sequence Number=SeqID_122293
atgcaagcgaggagcattgaaattgagaggaggtactgtggttttggaatgatgatggaagaacttacgggtgtgaccaccgggtctactgaactcaataacaacctgtttgccgtcaatttccttgccgttcatgtgtttcaaggccttggcggcgtctcttatgtcgaagaactccacgaatctttgattctttttccatgggagacgacggagttggtcggaggagaggttggggtggaggttgaagatgacgagggtgccttggttgtgggagtcggggagggagttggagttagggaggacgtagtgggcagagaggaggccagggttggggtggaagtggagttgcatggagcggatggcggcgaaggcggattgtgcatggcggaggtcgaagaagtggacggtgagaatgccgtggcggagggcttcggtttggagggctctgatgtctccgaaggcctggagctcggctcggagggcggagtgggaggtgagagggaccggggtgaggaggagggagcgggtggaggaggtg

SEQ ID NO: 5516 - DNA, 714 bp, Glycine max
  Peptide Sequence Number=SeqID_122294
atgatgggcctgattctgtttggcttctcctgtggctccatgctgggcgtgctgcttgccggtaagctggtcgcgcactttggcaccagccgggtgatgcgcacgggttacctgatcctgctcggtggcctggtgctgatgaccgttgcgttaacgctcgccagtagcgggctggtgtttaccagtctggtgttgctgggcggcggaaccgcgctgatggatgtggtggttaatgtcgaaggagcagcgtttgagcggcgcatcggcaagtcaatcatgacaatcattcacggcttcttcagtttcggcacgctgatcggcgcactggcggggctggccatgaccgcagccgatatcagcacccactggcactttagcgtggtgctgctggttaacctgctgattgccgccctggcgctgcgccatctgcccaccaccagcgacagcgaacgcagcgaacagccgcatcacggcggctttctggcccaggttggacgtgaactgcgtgaccgccagctgctggtgctcggcgtggtgattctggcgatggcgctggcggaaggctcggctaacgactggctgccgttactgatgatcgacggccataacctcaatcatacccaaagcacgctggtctacgcgggcttcaccgctggcatgacgctggggcgctttctcggtgggctggtggttgatcgtctgggccgtgtctgg

SEQ ID NO: 5517 - DNA, 1107 bp, Glycine max
  Peptide Sequence Number=SeqID_122295
ggcctgaaatcgctcaccgattactacctgactcacaacctctccagtgacgaagataagcgcctgaccgagctggcctttgccaatattcagcgcgtgagggagcggctgccggcgtttctcactgcctcgcgcgcgcatcagaacgccatcagccttgatctgatcgaggggcagaacggcattggtgccgccattcgccagctggtcaccaattaccagcagcagctgatgctgaatatttctatcggcgatgagttacgcgccaccaacctcagcaccttccatgaagtgctgtggaccaccattaccggcgtgatagccacagtgattatttttggcctcgcgtcgcattcggtgagcagcgcatcagtggaaatcgccgccggtaatgaagatctctctgcgcgtaccgaacagcaggctgcttcgctggagcagaccgcggccagcatgactgaactgagtgaaaccgtacgtcagaccgccgataacacgcgtcaggccagccagctggcggctaacgccagttcgctgtcggaaaaaagtggtacctcgctcagcaccatgctctcgaccatggatgacattcgtggcagctcgcgcaaggtcacggacattgtttcaatgatcgaaggtatcgctttccagaccaatattctggcgctcaacgccgcagtcgaagccgcacgcgccggtgagcacggcaagggctttgcggtggtggccggcgaaccggggcccgcccaggccagcgacgtcagcagcaacatgcaggtgatgaatgacgctatccatcaggtcagcgaactgatgagcgaaatccccgcagccgcggttgagcagagtcagggcatcagccaggtgcagcaggcggtgaatcagatggatgatgtgacgcagcagaacgccgcgctggtggagcaggcctcagccgcgtcgcaatcgctgcaggaacaggcccagacgctcaaccagctggtgacccgcttcgtgctggcggaatccggcgcaacgccggtcatcaagccggcgccggcgagccacaaagcgccacagccgggacgcctggcactggccagcgatgccgactggcagagtttctaa

SEQ ID NO: 5518 - DNA, 192 bp, Glycine max
  Peptide Sequence Number=SeqID_122296
atggcttacacccacattccggtgaaagttgaaaatcctgacctcgcaccctacacttcagagccctacaatgctcaatggaacgccccggggcttctccgtgacaagcacacgttgcgttcgagtcgtattctcggagaaatggaggtggtcttcgtcattggaagtgcggtagacaggctttgtggttga

SEQ ID NO: 5519 - DNA, 1203 bp, Glycine max
  Peptide Sequence Number=SeqID_122297
atgccggaaaacatgagcatatcagtgaatggacaatctcaagtccctcctggcttcaggtttcatccaactgaagaggagcttcttcagtactacttgaggaagaaggtctcctatgagaagattgaccttgacgtgattcgtgacgttgatctcaacaagctcgagccatgggacatacaagagaaatgcaaaataggaaccactccgcagaatgattggtacttcttcagccacaaagacaagaagtaccccacaggaacgcgcaccaatcgcgccactgctgcagggttctggaaggccactggccgtgacaaagtcatatacagcaacggcaagaggattggaatgagaaagactctggttttctacaaaggaagagccccacatggccagaaatccgattggatcatgcatgaatacagactagacgacaacaacaccgctgacaccaatattgtgtccaatgtgatgggggatgctgctcaggaagaagggtgggtggtgtgtaggatattcaagaagaagaaccatctgaaaaccctagacagccccttggcttcaggggaagatagaaggagccacttgttcgactcgtgcgacgagggagctttggagcaaatacttgagcaaatgggaaggagttgcaaggaagagagcagctatgaaggcaactacagaaactatggaaggtttacaaggccttatgagacaacagggttgaacaatggcggcggatacaatgataggttcatgaagctcccgagcctcgagagcccgaaatccgcgagcatggagagccaccacaacaccaacaacaacaataacatgaatagtaataataataataatggtgataacaacgagaacaacaataataatgggtaccatcccatgattccagtagagatgggcacagacaacgaagggtcattcacaacgcaccaggtgagtggtggtgaccccaacaacaacaacaacaacatggttcatccattggaggtaggatcaggtggtggaggcctcaccaactgggctgcgctggaccgtctagttgcatctcaactcaatggccaaaccgatgcctctaggcaactcgcgtgtgcattcaacgaccccaccatgtattgcaccagtgaccatcatgatcttcatcaaatccccaccctccgatcctcatcaacgtccgcggcgcacacttga

SEQ ID NO: 5520 - DNA, 306 bp, Glycine max
  Peptide Sequence Number=SeqID_122298
atgaatttgtttgttttaaaggttgaagagacaccagacaccaataacttggttttactatgctccgagaagtgccacctaccaagaaagatggaggaagagagtttaaatgttgaggaaaaaaatgtgggtgggggccacgtgtatgcgggtatcactttggggccccacaaggttggacgttgtgggcaacttaagaagagtaagggcgcacgcccacatccacaactacgacctctgaccttaaaatctccatggaaaagcacctctgaaacaaccatggaccatggcaaaaaattcacctag

SEQ ID NO: 5521 - DNA, 225 bp, Glycine max
  Peptide Sequence Number=SeqID_122299
atggtggtgttcaagaggttaagaatattgtggcaaagaaatcccagctgggatatgggaagcaaaggtggatttttccgttatgcagatggttttgacaaattgctattactctttgggactttgggttgcattggaggtggcctacaaacccctatgacaatgcttgctcttagcagtttgataaatgattatgctggtggatctgtccaaaccatgttatag

SEQ ID NO: 5522 - DNA, 378 bp, Glycine max
  Peptide Sequence Number=SeqID_122300
atgtatggtaaaaaggatgtatcagaagatgaaataaggaaggcagcacgtctttcaaatgttcatgagtttataagttcgatgaaagatgtttatgacacttactgtggagaaagaggagtgcagctgtcaggagggcaaaagcaaaggatagcaattgctagagcagtgcttaaggacccttcaatccttctgttagatgaggcaacaagtgctcttgacagtgtgtcagagaatctggtacaagaggcactcgagaaaatgatggttggaagaatgtgtgtagttatagctcaccgtttgtcgacaatacaaagtgtagattccatagttgtgattaaaaatgggaaggtgatggaacaaggatcacactcctag

SEQ ID NO: 5523 - DNA, 1833 bp, Glycine max
  Peptide Sequence Number=SeqID_122301
gtactctgcagatgctctggtgaaggtgatatcaactcaaggatcataaatttgtttgatttgataggaaagtatagttgggatgcaaaagtagtattagtgcttgctgcttttgcagtaagatatggtgaattctggcaacttaagcagctatatcgtggtaatgctttggcagctttaatttcaaatattaagcagctgcccaacaacttaaagccactgaagctacaaatcaaggcattgagcttgttggttaagaccatgatggatgtggctatgtgtatcattaagtttgagtaccttccccttcaacatgtagagcctggaaatgatatattccttgtcagagacacaaagtctcgaatatacgaagctgcatactggatcaccagaagctgtttagcatgtttttctcaagtcatggatttcacagccaaaaaacatgaccaagtgcatgtttcttcccttgaggctcagataatgtattcagattcagcaataattgctgcttgggagctttcaagtttggcgtatagattaagtggcatatgctgtaatctcagaagacaggtggatctgtgtcacaaagagctagagagaaacttgtatgacaggctgttggatcttgctcgtgaggagaacattgataatcaaaagactctcactttattttttccttccaagaattacttgccattgaaggattgctcaacagaagtaaagcttcgtggttctgaactgaaaaataagacagttctgttgttgatctcaaaaccgcagctactcaacccgatagatatatacttactggtccagcaaacatgtgatcatcctctgaatgagaggttgagggagagttataagattgtgtggattccccttccatcttctgatacatggactgaagctgaagaaagtagttttaattttatgtccgattccttgccttggaatgctgttcggaaaccaaggttacttagctcagcagtggtgaagtacataagggaacaatggaactacaaggatgagccaatcatggtagctctagattcaaaagggaaggtcacaaattacaatgctcttgatatgatcaacatttggggtgcacaagcataccccttttcggcttcaaaagaggaagaactatggcaagaccagaatttgacaatgcaacttttgctggatggcatcaatcctctccttgcttactgggttgaacaaggcaaaaatatttgcctttatgggagtgaaaacttggtttggatccaacaattcaatgataagataactgagatcaaacgagcaggtctgcagctggatacaatatatgttggtaatagtcaatcaggtgaaaatgttaagcaaataatggcaagaggtggtgaaaaaagtctcagtgatccactttccttcacaaatgtgcaacacttttgggttcgattggagaccatgagaaggtctaaactcagactaggaaagacaccaagttctgatcatgtactagctgagttgtcaactttgcttgacatggatgatagagaagaaggttgggctgtgattggatgtgggggttcaagctcaactgatattcttaggcttcaagggatgcaggtgatggaattcttaaggaaatgttcagagtggagagaaaatataaccaatttgggattgcatggtgctctaagaaacttcctagacccccattttgttgaagggagttgcaatcactcatactttgtttcctctagagaaaatgaaagaccaagtcaaggaactgtaatgtgtcaagtgtgcaagcgtcccatgaagaattttgtggtgtaccagccatga

SEQ ID NO: 5524 - DNA, 539 bp, Glycine max
  Peptide Sequence Number=SeqID_122302
aggaaatggagcaagtgttgcaaggattattccttacgcagctattcattatatgtcctatgaggaataccgcagatggattatacaaacttttcctcatgtttggaaaggccctacccttgaccttgtggcaggctcactctctggaggcacagctgtacttttcacttatccacttgacttgactcgaaccaagttagcttatcaggaactggaaggaaaggttttaccttgcgcattcatttataccaattatttgcatttgaaactacagattgttagtccaaaaaagttgaatgcttcggggatggttaataatgaacaagtttacagagggatccttgattgtcttgcaaagacttataaagagggtggcatcaggggtctctatcgtggagtggctccaactcttgttggaatattcccatatgcgggtttgaaattctacttctatgaggaaatgaagcgccatgtccctgaggagtacaataaaagcatcatggccaaactcacgtgcggatctgtggcagggttattgg

SEQ ID NO: 5525 - DNA, 537 bp, Glycine max
  Peptide Sequence Number=SeqID_122303
atgaaaggttatattagaggatttcttgtgtacgtcctcgatcaggaggtggtgaaaggcctcggagacaatggtgtaatggtgattttggacaaccacgtgtcgaagccgcggtggtgctgcagtgacgacgacggcaatggcttcttcggggactcgtatttcgatcctgaccaatatggacacccttttcaacagaaaactaggccagggttatcggaagttgaagcacacaaagtgatttttcaccccattgacagggcccagaaagtgctatcagtaaagggtagaaatagcacctgtttacaagcagagggagaaaggaaggaaacaaaactaggaaatgaatgctcagtatgggaaataatctctgattcgatgttgcacctctcaagtaaaatcaacaacaacgcttccgatgtggatgccaacaacaacattgtcacgaatgcatgcaaatgcctgagtggtgttaagatgtgtgaccctgcaagccaatggttcaaacttgttgacaacacaagaaattcaacctga

SEQ ID NO: 5526 - DNA, 618 bp, Glycine max
  Peptide Sequence Number=SeqID_122304
cgatcgatgcttttctcgcctatcataaccacaaggaaagcccggttgtcgctatgctagccgatctatacgacaccttcgaccgaagatgtgagaagagcagtacgaggattgtttgctgtactccagctctttatgtatggttggtttcacacctttttcgccaagaggtgaggcatgcttgcccgctagaagaaggaagaaccggagttcttatttcatgcggaggatttctgaatgttcccatgatggggacgaggggtttcaataagaccaacgtggagatgcttcagaaggtccgcaaggcatggggggtggtacaaaagaaggacaaagagctcagagacaatgggcccattggtggctatcatgagtggttgaaagcccacgtgcaagatgaggcaccagaggaagacgaaggggtgcaggcccttaggacggaactcaagcaagctcaaacagtcaaagaaaggttcaatttagcaactcttaaaatccgaaaggagaatgccaaactgagagatataaatatagctaccaccaaggctttggaacaagagaccaagagggctcgtagggaagagcacggccgaaacaagttccgaggggctctgtggg

SEQ ID NO: 5527 - DNA, 741 bp, Glycine max
  Peptide Sequence Number=SeqID_122305
atggttgttgttgcatactgtgcaaaccccgctaatgtgccctttgcaagtgcctatgtcattgttcttgttacatctcaggtcccacatgctatggatattttactagctgagcttcacagggcttgcatatatactgtcccaaagcacctggtttacaagaagtctgcctatcaatcaaaagaggcatacttcagaagtattggctatcgagaagatgatgaaaagatggagagtacggaagattatttaaagcggttagaatcatacatgaagatgtatggtgcactggttcagactgaaattacaaactgtcaaaattttcacggcttgaaagaaggttgggcatggcttgcaaggttcttgaatacacacccagcaaatcaatacacagctgtttcgcttaatgcattcttgcaaatggctggatttgctctctataacagatataaatctcaattcttaaagatgctgaacgtcgtctctgagaactttttagttgatctgaaatcacagaatataccagaattggcgaggacagttacggagatacagacttacatagacgataagaagttccttcaagagccagaaggaagaagcctgcagtctgatttgttatcaaccaagatacttcaagaggcagacagatggataccgaagcctaaaaaaagttcagggagatcggcgattgttttcattttaaggtctttcacaagcctcacagtttacacaaactag

SEQ ID NO: 5528 - DNA, 996 bp, Glycine max
  Peptide Sequence Number=SeqID_122306
atggcgttgccgctgaacccgaacctgattggaccttcgacgatcttgtttcggaactcaacgctttggagactaagctcgccactaatgcttcttcttccacccaacgttcttcacctctcgataaatcaatatcgaagtggcgtgttcagtgggaaagaaatccagagaggtagggctttcgtgttgcgtgccgacgagtttgacatggaggactcagagagcgacgatgatgatcatgttgacagggctttggtagtaactgacagtggcaaacggttcacctgtgatgaactttatctgagtgtcagtgatgatgattctgacattgcctctggttttgaagtgagaccctacttgatggatgaattgggagaggtcgaaggtgccttgttggagttgacacatgaacatcagcttagggttaaggatgaaataaggaacaagatctcggcattggagacagctctggtgaatgaaactcagaattctacttcttcctttcttcgggttgagaaatataaagaaacaaggctggacttggataaaaagtttgacactcaatatcagcgtcggattgcagaagcacttgataatcacttgacagctgttcaacgggaccgtgaacttagatcacaaatagaagaaaggaaaataagaagtgatgcagcttatgaagaggccaagagaaaggttgcttttgaaaagcagcagcaagaaaaggctaaagctgaagcagaggccaaacttagagctgaggaagcaaaacgagaagctgagagcaaagcagcaatggaggccaagaaacaggcagcaattgaagctgaaaaaagcgcagcagtagaagctgaaagaagagcagaaaaggaagctactgaaacttccaaaagagttacttctggagggacccaacaagctactgcccatccaacaggtactgcatcaagcctatccaatgctgaaaccaaggaatctggtattgcttttctttattga

SEQ ID NO: 5529 - DNA, 1611 bp, Glycine max
  Peptide Sequence Number=SeqID_122307
atgcatctagagctagagacttggacaattttggttgctattgtgtgcatcttggtatttcttctgaaggagtttgttatgggagggaagagctcaaaagggagtggtaggaggtatgattttggtgcttcttcatcttcaagggataatagctatggtggataccctccgcaatcaccatacacttcttatcaaacacctcagcacccttgtgcatcagcatcagcatcagctccattttatgactatgcacagccaaaaaggaagttggataagaagtattccagaatagctgataattaccgttctttggatgaggttactgctgcacttgcgaatgctgggctggaatcttctaatctcattgttggaattgatttcaccaagagcaatgagtggacagggaagaggtcattcaatcgaaaaagtttacatgacattagaagtggtcaaaacccttatgaacaagcaatttctattatcggaaagactttatctgctttcgatgaagataacttgattccctgttttggattcggagatgcgtctacacatgatcaagatgtattcagtttcttttcagaagagaggttctgcaatgggtttgaggaagttctgacacgatacagacaaattattccttccctcaaactcgcaggacccacttcatttgcccctattattgaaatggctatgactattgttgagcaaagtggtggccaatatcatgtcttgctaataattgcagatggacagaagaaaactacatctgcacaattctatcaatacctggataaattacatcaggcttcaaaaactgatactcagcttgttgcacaggtgactagaagcgttgacacacagcatggcaacttaagtccgcaagagcttaatacaataaatgcaatagtaaaagccagtgagtatccactgtcaatagttttggtgggagttggagatggaccatgggaaatgatgagggaatttgatgataacatcccttctcgtgtatttgacaattttcagtttgtgaattttactgaaataatgaggaggaatgtagatccagccagaaaagagacagatttttcactttcagctttgatggagataccttctcaatacaaggcaaccctagagcttggcatattgggttcacggaggggacattcaccagatagggttgctctacccccacctctttatagtagaacctcttccagcatcagcacaaaatctacaaggtcaaacagttttcagcagaggacacctacacatactagctatgatagcggtgttcacacagagacatcatcaagttctttatacgataataaggtttgccccatttgtcttaccaatgcaaaggatatggcctttggttgtgggcatcaggcaggggctgcaaaaggatgtgcagatttggtcaggctcttttcaagatggtttcttgtccacaaaaactgcactcgcaatttcgaggcaaaacttgtattcccagttacagttaggaagaagtgttcacagaaagaattggccttccctgttgtatatatatgcagttcatgtgtcttggaaggcatcatgtttttaaataaactgcttgtataa

SEQ ID NO: 5530 - DNA, 1914 bp, Glycine max
  Peptide Sequence Number=SeqID_122308
atgttaggggaagcgggtaagaaggacaaagccccccccggtggtgttgcatggaaaacttattctcgttctgtttcatggactgataggtctcccaatagccgcaagccaccgacaaacagcaaaacaagaccacttttgccaccccttcagcctctctcaatcaacaaacgcaacgtggaggaatggcctagtgctggatctgatgatcttggagtttggccacttcctcagactccaagaggctcctcaacctcctcaagtcaacaacaacccaccaaggattttctcttcaagagggacaaattggccttctttgacaaagagtgttccagaattgccgagcacatatacttggggagtgacacggtagccaagaaccacgaactcctcaggcagaatggaatcactcacgttctcaactgtgttggctttgtttgtcctgagtatttcaaaggtgattttgtgtacaagacactttggttgcaggacagccccactgaggacatcacaagtattctctatgatgtgtttgattactttgaggatgttagagagcaaggtgggcgtgtccttgtccattgttgtcaaggggtttctcgatcaacggctttggtgattgcttacctcatgtggagggaagggcagagctttgaagatgcttttcagtttgtgaagactgcaagggctgtcacaaacccgaacatgggttttgcttgtcaacttttgcagtgtcagaaaagggttcatgctatgcctgcaagtccaaattctgttctcaagatgtatcgtatggctcctcactccccctatgaccctcttcatcttgtccccaagatggttaaccagccaggttcacaagctcttgattctcgtggggcattcattgtccatgagtgcagcctttcggtgatccgttatgagggggcaaaaggtcctattttgacaatccacgaaggtgaagaaccacccgggttttggattgctctttctattgagcaacgaatatcaggtgattctgaaaaagaagtggtgatcatggaggagccctctgaaggcatggagagtgctgttgaaccggttgattctgggatgactactggtccaagaaaaattgatgcatatgatttggattttgagattttccacaaggcacttgctggtggggttgttccacctttttccttgtctgatccaggatcagaaacttgtcttcctgctagagaacaaggttgggcaagactgaggaggaagtttgctagtggattgctcacatcccccaaattcatctgtgatgctgattcaaccccatgcaatgatcatcaacctagtgtatctgaggaagctgcatatgagcctttgtcaccatcatcaattcctccgtgtggttcaccggattcctttgaatgctatccaaatagggaaaaaggtagtcctgaagccatggacttctctgttcatggtgttgcttcatcattgccactgtctcctaccggcacatcaaatccttttccttgcttcataagctgcattccaaaattcaattccaagtcaccaacactctcaccttcaagttctgattacgccagttcatttactttttcgccttcctctaccaactggtccgacttgtccttggtgtcttctcggcagccatcaccatctggccttgaatcggctgaacccttttatgttaaagacgcgtctttctcagaaaattccactttacttcacaaagatgtctcttcacccttggaagaattttcagctaatcacacatttggaggggcgaactccaatttgcagttgaaaggttctttcctctccatcgccgagcgcagagggaatcatccaccgcctctgatgttgctaccctcagccagtgaatcctctcatgtccccaagaccaacgtg

SEQ ID NO: 5531 - DNA, 417 bp, Glycine max
  Peptide Sequence Number=SeqID_122309
atgtcgccacacgggggcgacatggatgggggtgaaaaaaggaaagagagggatggggtttctcttgcttttggcatagcgggccccggcgggaggcccgcacgacgggctattagctcagtggtagagcgcgcccctgataattgcgtcgttgtgcctggactgaggatagatggggcgattcaggtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctggggtga

SEQ ID NO: 5532 - DNA, 150 bp, Glycine max
  Peptide Sequence Number=SeqID_122310
atggatcctggagaaggagctgctgatgtggatgttggagtaggagctgcagatgaggaaggaagctcagctggcctagccctcgccctcctagcccctcagatagaaactatcagatcatcaggattccaacagttcttcctgatgtag

SEQ ID NO: 5533 - DNA, 1059 bp, Glycine max
  Peptide Sequence Number=SeqID_122311
atgttgaatctcccatctggcctgcttccctccattgatctttcttacatcgaagacagatatacaggtcgccaggcttggtcttttatgaataatggtaacaaaagaagttcatcgcaggttcaattatcaaatgatacatcaaagatttgggttccatcaaatccaagaggtgcagaaagattacctcccggcattgttgaagctgagtcggactattatttgcgtagactgtggggtaagcccagtgaggatctaacgtccaggccaaattaccttgtaaccttcactgttggctatgatcagaaaaataatattgatgcagctgtgaaaaagttttcagggaacttcactattctgctatttcattatgatggccgaactactgaatgggatgagtttgaatggtcaaagcaggctattcattttttccctcttaggtggtatgccaagcggtttctgcatcctgacattgtggcaccatatgactatatattcatatgggatgaagacctgggtgttgagcattttaatgcagaagagtacataaaacttgtgaggaagcatggcttggagatttcacagcctggcttggagcctaatagagggttgacatggcaaatgacaaaaagaagaggtgatcaggaagttcacaaagtgacagaggagaaaccaggatggtgttctgaccctcatttgcctccttgtgcagcgtttgttgagattatggctccagtgttctcgcgagatgcatggcgctgtgtgtggcatatgattcagaatgacttggtccatgggtggggtcttgattttgctcttagaaaatgtgttgagcctgcacatgagaagattggagttgttgattctcagtggattgttcaccaaggtattccctcactagggaatcagggtgaatctcaaacagggaaagcgccatggcagggggtgagggagcggtgtagaaaggagtggaccatgttccagagtcggttggcaaatgctgaatacgcgtatcacaactccattggaattgatacatctaattccactgctcattag

SEQ ID NO: 5534 - DNA, 2058 bp, Glycine max
  Peptide Sequence Number=SeqID_122312
atggcggagacggtgagacttcgcgtggtgttcgaggatcgtggcatgttgagcaagtcaaagaagaagcaagggctcaagcgttgctggtttctgcttaaaccccaacacaccgccatttccgatgttgcctctcatctactcaacactttccgcctccaccgcacctgtccccatggcatcgtcctatcgatggatggttttgttttgccatcttttgaatccacttgcattttgaaggataaggacattgtttgtgtgaagagaaaaggaagcgtatcaactgatgataataaacctgcaatgctgccacctgcggcttgtgagaatcagtctattgagcttccgaaacttctcacaattgagggccttcaagaggagtctgggggagaagaaaccatgtcccacaaggatggcgatgaccaacttgaagatgcagtttatgtggaatctgaatcggacaggaatgttgtctccaagaaaagaaaagcttcaaagaagctcaagagccctagtcagaagaagattaagttgtctactgccgaaaacttgtcagtcattcctcaggtccacgaggaggaaaacggaagctctgaaggccatattcatcaccaattgagtgttgtcaagaaggacaagaagaagcattccaatttatctagtcagtcaaataagtcaagcaaccttaataaacagaagaatgacaaaagtgatcctacaagtgatgaaacaaggtttgtccagcctcaagatgaaagcgaaactaaaaagttgcctagcagaagtgctcggcggaagaaagctaaaagaagatggctgagggaactaaaattagagaatgagatgaaggagaagaagtggttctacggtgccattgtgttgtggaattcgttggttcgcaatcatgactttgtttgctattgcggcatctcaatagatggatgtgggactgcatgtgacctttttcccaatcaatcccagtgtcccactccccccatgcatccccatcagactccagtgcttgaaaaagatggacaagaattacctatcaaagataataattgtgttgtttctgatgtacatcaaaaacctgatgaagaaagtggagaagaagatgacattgttcctgtggaaattaggccagggcacattcggtttgagccccttaagaaagatcaggatcaggcagtgacacaggatcagtttccagtggaaatatttcagtggaatggaattaccaacaagaagaagggccagaaatggggtaaagagagaatgtcattccgtaaacaggatggctacgaacattccagtcaagattgtcctacagttcggaatgctgaaaaggaacagccatccaatgcaatagattttgataagcttaaaccttattatacaagcttgcctaaggaaggtgatgtaattgcttatcgattgattgagttaacagcatcttggactccggaactttcctcctttagggttgggaaaatatctcggtatgatgctaaatcaaacaggatttggctggaaccagttttagaatatccatttgattttaagaaaaaaatagatgaggatgcatcttctgtacagtataatccatccccttatcaagagaatggttctttagagatagagtatacatcgcttgctgatgttcgaatggttaagcatggcaatcctgatttgaaaactgtagttgtttctagtgatgcttgggttaagacaacaaaagcaactaatgatattaccaaagaaaaacttgcggcaaaagcaactaatggtagcactgatgaaaaactcgcagctgatcaaactaccatgggaagttgccagccagaaagaggtcatatcactgctaaagaaaatggggaagtaaacgtgtgggacgaaattaacgaggcattaaaagcaaagaaggccaagctgtcgaaggaggatggttggagtagaggaggagagagctctagcacgaggtcatggtcccatagagccatgagatgcagtgcgctgggtcccacaatggcattgttaaggtccaacaatggactttaa

SEQ ID NO: 5535 - DNA, 492 bp, Glycine max
  Peptide Sequence Number=SeqID_122313
atggcctttgatgcaatcctctctaggaagggaccagttaccagagccatgagcaaaaggctccaagaggattgggctagagctaccaaagaaggccctagggttctcatgaaccttagtgatgcaatcctccctaggaagggactagtcactagagccatgagcaagaggctccaagaggattgggctattgctgctgaagaaggccctagggttctcatgagcctcaggggactattgtttgctggcatgcaaccttcgcttgaccgcctcgaggtacttaacacccatcgttgggtaatccgtaaagttccacaacattccggaaggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacagggaaggtattag

SEQ ID NO: 5536 - DNA, 474 bp, Glycine max
  Peptide Sequence Number=SeqID_122314
atggaggtcaatgcggctatagttgttgccgcaagtaccgccacaaaagtggaccccgctcacccatctggcctcaatcaagtaaatcctccagtctcggatatagtaggacagggaggcgaagcgttaggaagtacgggtgacccttattttgtaatgtcaacaactttgcacccatacccattgagagccaacaaccccaatctgatcatgcacatgtctctcaacccatggggggagacacatgaagcaccccgagaccacaatctagctggcttcgaacctcacctcgaatatgccactgaggggcaagcagtttggggtgtacccttgccagacacgttggagggccctcaatttcacccacaaccacaacccttgcattttgcggtgggaagagtccctcctgctatggtggaaaggggaaaatttgatcatatagaggaaaggctgagggacattgaaggaggctga

SEQ ID NO: 5537 - DNA, 1084 bp, Glycine max
  Peptide Sequence Number=SeqID_122315
atggtagtggatatgcaaaatggcgtgctggcaacgccgcgttacgaccgcgccggacgctgcgcgcgcattaatcagctgatggccgccgccgatcaggtcatttttattcagcatagcgggccggatttagccgctgactccgcagactggcaaatagtcgccgaactggaacaacccgccggcgcgctttacatcaccaaaaccgcctgcgacagcttctggcaaaccgggctcgcggcgcagcttgaacagcatcagattgaaagctttgtcatttgcggctgcgccaccgattattgcgtcgataccaccatcaaagtcggggccagccttggctatcacgtcaccgtggcggccgatgcccacaccaccgccgatcgcacacatgtgtcggcgcagcagcttattaatcagcacaacgaagtgtgggcggatttgatcatgccgggcaatccgcatgacacttgtctgtatggagtttctcacatgcgagcttatattcctcagcctggagccaatgacaacacgctgtggcgggttgcaggcctgcctccacgtggtattgagttaacgcgtatgctggaagccggtttgccggtggccgtcattgatgatatccgtcactggtcggccatgacgcgcgccgaaatcatgaaggtcacagggattaatgaacgcaacattgcccgtcgtaaaagcacgggtaaaagtctgtcacccgacgagagtgaacgtgtcgcccgcttcgtccgcgtgatggatgccgccgttcagctttttgctggtaataaagaagaggccacccagtggctgagccggccggtgaaagggttaggcaatgttgcgcccatcaccttactgacgacggagagcggtgcgctggatgtgctcgatctgatcggccgtctggagcacggctatcccaccgtttatgttgccacgtcggtgtcactcgcagcactggaagtgctggtccatatcggaagagagtcggtgctggatgagtacaccttactcagtatcgacatcccggatgcagaagttgcctatcttgctgaagcatttttgccgccggactggc

SEQ ID NO: 5538 - DNA, 404 bp, Glycine max
  Peptide Sequence Number=SeqID_122316
ttgccgctattagcgctgtttctgggaacaagcaggttttcccgccatatggtttgcctccaaactatactccacccaatgagaatgtcaataacttcacttctatacccattgagagccaacaacctcaatctgatcatgcacatgtctctcaacccatgggtgagacacatgaaatgcgccaccataatctagccgacttccagccttgcctcggatatgccactgaagggcaagcagatcatcaagaggaaaggctcagggccattgaaggaggcgaagattatgcctttgcgaacctagaagagttgttcctagtacccaatatcatcacccctcctaagttcaaggtgccagactttgtcaagtacaagggggctacttgccccaagaacctccaatga

SEQ ID NO: 5539 - DNA, 423 bp, Glycine max
  Peptide Sequence Number=SeqID_122317
gggtactgaaaggggtgtccatgagaaagttgaacatgacaaggaggaggaaagggaaataggccttgaggatgttgggaaaggtgttttcaggatggaagggtctttgttggaattgggagagccactaaaatttggaagggttgaggatttagggcctattcttgtcacaagaggggtagatagactgcgaaaggggaatgcccaaacaaaaagtcgagggaggagggagaaacaacaaaaagaactggagactaacttcaacatgatggaccaggacaataagaatataaagcaaccccaagagggggttgtgggggttagagaaggagcaatgctttttggtgaagctgatttgctggaatttcctctaaatgggagaaaagttacttggtataaggatgatgggtcttccatgactag

SEQ ID NO: 5540 - DNA, 597 bp, Glycine max
  Peptide Sequence Number=SeqID_122318
atgccgccagttgcatcagcggttcaggtggtgccgtcactagttgtggcgagaatggggctgacgtggctgggtgccgccagcaccaactgcggcatgcaagaagagagaggagtcgtactacacaagtttcacacttcctctcatgtttttactgcatttggaactcttcactcttctcgacatcttcatctctgtcaagtttccatagcacagagagaaaactgggtgggtcctccactttcgactttgaattacattattgttattcgtcttgggacgtcggagaaaactttgcaaatggtatttgatacgggcagtcatctcacatggacccaatgttatcaatgcaagtcatgctatgaacaagccaatgcaagatttaatccattaaattcttcaacatatgaggcttcagattacttagatgatacatgcaaagacctcataagcagtggacaaggtccgttgcaaatgtcccgccactggcattggcgggttgtccagtgtctcgctggtgctagtggcggcacaagttgtaccgcaattggtgctagcggcacccagccacgtcagccccattctcaccacaactag

SEQ ID NO: 5541 - DNA, 253 bp, Glycine max
  Peptide Sequence Number=SeqID_122319
gttcttccggaaacttccggatgaaacttcttccggaaacctccggatgacgatcttccggaaacctccggatgacgatcttccggacgaagtttgtggggcaattttgccacttcactgtttgctgggtgccccagcaataatgctgggtgcacgtagcaactccccagaaagccccgtgctatcagaatggcccaacagcacacaccgtaaggtccaaaacgcttttcttttctcctaccctaaagcttag

SEQ ID NO: 5542 - DNA, 207 bp, Glycine max
  Peptide Sequence Number=SeqID_122320
atgtggagggtttttcaacaatgggaagaggtggaggatgtgttcattcctttagagcgagagactggggagaaaattcagatttgtgaggatgaaaacgggagaggatgtggaggatatcatcgtagggagaaaaagattacaaaggagagggtgaaggagggaaagaagtatgggatcattagggaggccaaaagggatggatga

SEQ ID NO: 5543 - DNA, 174 bp, Glycine max
  Peptide Sequence Number=SeqID_122321
atggcgaggaggaggatgctacatcagtggttagagtggatgataggatgcaactgcaaggttaatggaggccaagaaagaagacatggcaatgggacgggtatcgtctccccaattcttgatcccgacttcccaaaatgtctccgtacccgtatttcatacccgacggattaa

SEQ ID NO: 5544 - DNA, 2127 bp, Glycine max
  Peptide Sequence Number=SeqID_122322
atgactgccgtattctccaggaacctcgactcacctctcacttattcctccccaggaactgccactgaatgcagagaactgatccaacaagcaaaacaagaacagctagctcaaaatgcctattctgttcataatatgcttgaacttaactctgaactgaagcaattagtgaaacagggacaactttgtaaatctaggtatatgtttgataaaatgactcacagagatgagatttcatggactacattaatagctggttatgtcaatgcctcagactcgtatgaagcattgatcttgttttcaaatatgtgggtccagccaggacttcaaagggaccaattcatgattagtgttgcactcaaggcttgtggacttggtgtcaacatatgttttggagaattattacatggattttcagtgaaatctggtttgataaactcagtgtttgtcagcagtgccctaatagacatgtacatgaaagtaggcaaaatagaacaaggttgcagagtctttaaaaaaatgacaaaaagaaatgtagtatcatggactgccattattgcggggcttgtacatgctggctacaatatggaggcattgttgtacttttctgaaatgtggatatcaaaagtgggctatgattcacatacatttgccattgctttaaaagcatctgctgattcaagtttgttacatcatgggaaagctatacacacacaaacaataaaacaaggatttgatgagagctcatttgtgattaatactctggctaccatgtataataaatgtgggaaagcagactatgtcatgcgattatttgaaaaaatgaagatgccagatgtagtttcatggacaacccttattacgacttatgtacagaaaggtgaagaagaacatgcagtagaagcttttaaaagaatgagaaaatcaaatgtcagtcctaataaatacacttttgcagccgtaatttctgcctgtgcaaatcttgctattgctaaatggggggaacagattcatggccatgtattgcgtttaggtttggtagatgctttgtctgtggcaaattccattgttactctttattcaaaatctgggctgctaaagtcagcttctctagtgtttcatggtataactagaaaagatattatctcttggagcactataattgctgtttattctcaaggaggttatgcaaaagaagcttttgactatctatcatggatgagaagggaaggaccaaaaccaaatgaattcgctctttctagtgtgctgagtgtttgtggaagcatggcacttcttgaacaaggaaaacaggtgcatgctcatgtactgtgcattggcatagatcatgaagcaatggttcacagtgctcttattagtatgtattcaaaatgtggcagtgtagaagaagcttcaaaaatctttaatgggatgaaaatcaataacataatatcgtggacagccatgattaatgggtatgctgaacatggttatagccaagaggccattaatttgtttgagaagatttccagtgttggtttaaagccagactatgtgacgttcattggggtcctgacagcatgtagccatgctggaatggttgatcttggtttctactattttatgttaatgactaatgagtaccagatcagtccttcaaaagaacactatggttgcatcattgatcttctatgcagagcagggcgattgagcgaagctgagcacatgatacgaagtatgccatgttatactgatgatgttgtgtggtctaccttactcagatcatgtagagtgcatggggatgttgaccgaggaagatggacagcagaacagttacttcggttggatccaaattctgctggaactcatattgctctggctaacatatatgctgccaaggggagatggaaggaagctgcacatataagaaagttaatgaagtcaaagggagtaataaaggagcgaggatggtcttgggttaatgtcaatgataaattaaatgcatttgttgctggggatcaggctcatccacaaagtgaacatatcacaactgttttggaattattgagtgcaaatataggagatgcaaggcaggaaataagatctctaaatgatgacgtcgaagattag

SEQ ID NO: 5545 - DNA, 465 bp, Glycine max
  Peptide Sequence Number=SeqID_122323
atgccacccaccaggcaccctttggacccggataagtctaacagggccctggggtttccggcgttgatcacgagcctctaccactcattcggggttcccgtcaccccaagaaaggtgatccgaccgccgatcactcgggccttcatcgagaagtactgcatgcctaggcaggtgcagggtgatgccaccacctcatcaggccacagacgctctgccaccacctcatcaggccgatcccgctggatcactaggcatggagcattatctacagcacttggttcgccagcaggcggccaaccaccgggggcagagcaatttggggctgaggtcgcatggcccggagactggctcgaggcccaagcaagggaggagcccgcaggatcccctggtgaggcagaggaggcccacatggatgaagaaatgaatgacttgctcgatttcttgggaggaagcggagccacgtga

SEQ ID NO: 5546 - DNA, 168 bp, Glycine max
  Peptide Sequence Number=SeqID_122324
atgtggggtgcaagggttttggtgtccatagagatttgggtgagtgagaaaaacgtggtggtggtggttttgaagaagaggtgggttgggaagtgggaggagcaggaagcaatccacgagattcttcacaatcaagagcaattcggatggaatcattacaaaatttga

SEQ ID NO: 5547 - DNA, 438 bp, Glycine max
  Peptide Sequence Number=SeqID_122325
atgaagaattggttagggaggggcgaggggcgaggggcgagggggctaaagtccctgctagtccccattagatccgtcgctgttcaagaagaagagaaactgttttgtctctcaagtgaatgttacctcctacaatactgcggggatgaagaaaaacatgcttatcttagtgattctaggactactccaattttagaaaagagaaaaaaagtgatgcaatcctatcgtccaagggtattggatagaagactccaagaggcttgggctagagctactaaagaaggccctggggttctcatgaaccttaggcttctcaatgaagttttctcaaagaagcttctcaaggaagttttctcaaagaagcttctcaaggaagttttctcaaagaagcttctcaaggaagttttcttaagaaaacttcccaaggaagctacctag

SEQ ID NO: 5548 - DNA, 615 bp, Glycine max
  Peptide Sequence Number=SeqID_122326
atggaggtgacccaatatacgttcctggtggtcctagtgtggagttcattatgtacaaatgcacagtggaataacccaataaactactctcccttcgacgagataaacaaaggtgaaaactcgaagctacgcgcgtgttgttgttcttcttccggacgccgtaacactacaaagctcgtggcagcagccacagaaacgattgaaaagtgccctgtttttgaatactcgacggcgaaggagcttaaagtggggaatgggacagaggagtgcgcggtgtgtttggtcgagttcgaagactctgacaccattaagatgctcccaaaatgccaacacgttttccaccagcattgcatcgatacatggttaccctctcgcatgacctgtcccatttgtcgccagaaactcacgtctgaggataataccgtaatcgacgttgttgatgtcgtcgtcccaacggaacaacaagaacatgatgatacagagtctacagagtcggaggtggcagtaacagcagcagaagaacaacctcaacctgatgaaactgcagaacatgaaaccgacactgatcacagtactgttgtggaacaggtggttgaatttgaggttgttgcctga

SEQ ID NO: 5549 - DNA, 765 bp, Glycine max
  Peptide Sequence Number=SeqID_122327
agacatagaaatagctttatcaccatagaggatttcaaatttctatataaacatggaataaatactgtgaggataccagttgggtggtgggttgcttatgatcctgatcctccgagtccatttattggaggaagtcttgaagctctagataatgcattttcatgggcacaggaatatgatattaaatgcataattgaccttcatgctgctcctgcttcccaaaatgggatggagcatagtgcaagcagagatggatttacgggctggccaacttctcctgattatatttccgactcattacatgctattgattttttagtttctagatatgcaaaaaatcctgctttgctgggaattgagctattgaatgaaccatctgctgccacagtttcattagatgttttaatttcatattacaagcagggctaccaaattgttcgaaaatattcatcatcagcttatgtgataatctgccagagaattggtgttgcagatcctatggaactttatcaagccaacataggatctcacaacttagttttggatttgcatttctacaatctctttgacacatttttcgataatatgagtgctatggataatattcaatacatatacaaaagtcgggtaggtcaactgcaagccttaaacaattcaaatggcccacttgttttagttggtaactcacccagcaaatggagcttgaacattctaggatggttaggattgacatgcacctggttttgtctactttcgttattgtga

SEQ ID NO: 5550 - DNA, 935 bp, Glycine max
  Peptide Sequence Number=SeqID_122328
atgacgaaactgaaagagctgataggaataatgaaggacaaagcatcgcagggcaaagccgcgatcctctccaaacgcgccactctctctctcctccgagccaccagccacgactccttcgcccctcccacgcgggatcacctctccacgctcctctcctccggtgatggctcacgcgccaccgcctccgacgccgtagacctcctcaccggccgcctccagaccacccagagctccgccgtggcgctgaaatgcctgatcgtggtgcaccacgtgatcaggcgtggcagcttcatcatgagggaccagcttccatacagcggcggcaggaaccaccttaacctctccaaattcagagacaaaagcagccccgtgtgttgggaactctctttgtgggtacgatggtacgctaaacacgtggaacagcttctctgggcttccagaattgtcggattcttaccaaccgaaaaagagaaagcttcgggtcttaccaacgaggagttgttgagagagacggaggctttgttaacggttctagaagggattggaaacatacccaacgctgcatccatggaagggaatagattagtttctgaagtagcgactttggtggaagaagatggggttgcggtgttgagtgagatttttcttagagttaacgagtttagagagagattggtgtgtctcggttttggagaagtagtggaattggtttacgtcttgaatagattgggcaagtgtaaagagatattggtgatcacagagaaacagaagttatgggatttagtgagagaattgaaggtgaagatagagaagatggaagtgtatagggaagaagggaaaagaacggtgacaacacagagagcaacaaagtcagataggtttgctctcacgcttgtgaattccgttgatttgggacggtttccctctgcaag

SEQ ID NO: 5551 - DNA, 959 bp, Glycine max
  Peptide Sequence Number=SeqID_122329
atggggatggggaggagaacaaattatagttcaataccttcgcctcttcactcaccaatcccactttcatcaattccgtgggttccttccctcattcatggagatcacatgcatctaaaccttgcacctatcgttataattgtcttagctggcacaacttgcataattatgtttctcatcaccttgttcaaaatcctaaggtactattatccaaatagatacaacgttagcagaagcaacccaccaatattatttgacattcgtggagattttcccttttctgatgatgaggaacgtgaacaagccattaggcatcccatatggttcatcctcacagagggtctccaacagtcaatcatagactccatcacagtatgcaaatacagaaaagaggaagggttaactaaagaatctgagtgtcttgtttgccttggtgagtttcaacaagaagagagtctaagagttttgccaaagtgtaaccatgcttttcacgtcccttgtgttgatacttggttgagatctcataaaacctgtccactgtgtcgtgcccctattgttcttgatgttgccagtgttggtggtggcacggagtctgattcaagtgtttctgatatgaatgaatgcatagaagaaagtaattatagtggtggagaagaagaagattctagtgaagaggggagggatgatggaattcaagttttgaatgaatctggcaaggtgagtggccattcttcaattctaattggttctgcttctgatgatgttactgcacaagaatttgatgatgaaattgaactcaaaatgaagaggtctgtctcggtggattcatcttttccttcaatggtacttagggatgtgttggatttaaatttggatacagaaagcttggtgattgaaaaggtttcaatttcaagtaacaaagatgttattgcactgcaagagaggaatttctcattgag

SEQ ID NO: 5552 - DNA, 2433 bp, Glycine max
  Peptide Sequence Number=SeqID_122330
atggggacaaacgataccctattcagcataaacaaaacaatttacaataaagttgtgtttgacgactacaattcagacccagacggaagattccttttctataatattaccattgacatgccatccaagatagtatccgatggcatatggggtaacagagattatggtgctttaatttcaagagccacaatgccactgttggagacccaaattctctgcattttcgtcatcacgcaatgctttcatttggtgcttaggcgcctaggcttcccttatttcgtttcacaaatgatggctgggtttgttctaggcccttctctgaagatagaggcattgagaaaattcaaaatgatgttgttcccctacgggagtgaagacgtgttgaacctagtatcagggtttgggtacgcattattcctcttcctgaacggggtgaagatggatttcagcatgataaccagaacagggaagaaagcttggacaatagctctttcgtcccttatgattcccactttcattggtctctttgtatgctacagtttcatggggcaggcgcaaaaagcccttggagagttcgatggaggaaagctacccgtgatagtaatagggcacagtggttgttccttccctgtggtagcttctctactctctgatcttgagatattgaactctgaacttggtcgcttagcactatcagcagcacttgtgatggatgtgataagccaagttgtgagaggactaggcactgctgttgtgagcagccttagactcgattctcatgaccatgccccaggcaagggacctaaacttgcaacctacacagccataaaattcttcatttttatagcattaacaattgtgatcgcacgccccgcaatgaggtggattgtgaggaacacaccagaaggaagacctgtgaagaaagcatacatgtacattgtgttcctcatgaccctttgcgcagggttgcttggagtgtgggctaaccagactgtgttaggtgggatgttactctttggtcttcttgtgccagaaggtcctccattgggctcccaattggtcaagcagtttgagatgatcaactcatggttccttttgccaatctttgtcacatgttgtgccatgaaggtcgatatttccacgcttaagagtggcacgttggttctcgttgtggtctcaataattgtttgtgtgcatttggttaagatgcttctaactgttggaatttgccggtattgcaacatgcccaaaacggatggtttgtgcctcgctctcatgttgagttgcaaaggtgtcgtcgactacgtcaccagcatctttctatttgattcaatgttaatgagcaatgaaacagtctccatgacggctatatcagtgcttgtgttgggaagcattgcacgcattggggtgaaatctctatacaacccagcaaggaagtacgcagggtatcagaaaaggaacatactgagcttgaaacccaattcagagcttcgggtggttgcatgcatccagaaaccaagccacataaattccgtaaaaaacgctcttgaaatttggtgccccacaataacaaaccccttggtggttcacgtcttgcatttgatggagttagttggcagatcctctcccatcttcatctcacaccgtctccaagaaagggttagccacccaagccacattaactactccgaagatgtcattgtggcattcgacctctttgaacatgacaatgctggcactacatcagtcagcacctacacggccatatctccaccacgtttcatgcatgatgatatttgttaccttgcattggacaaactcgcttccatcatcttacttccatttcacataagatggggcgaggatggtggtattgaatcaactgatgtaaacatgagagctctcaactctaaggtacttgagagagcaccatgctccgtggggattctcgtgaatagagggtcttcttcttcttcaatgaagcaaatagcagtgatctttctagggggttcagatgatagagaggcactatgcttggctaagagggccatcaaagattgcgattgtaacttggttgtgtaccacttggtttctagccaaaatgaggtggcaaactgggacctcatgctggatgatgaggtgcttaaaagtgttagggggtattatggtaccatcgagaatgtgtcatacgaaaaggttgctattgaggaaccttctcagaccagtgcttttgtgtctgatattgcaaatcagcatgattttttcatagttgggagacgtaatgggatcaaatcgcctcagacagcagcacttgagagttggacagagttttctgagttgggtgtgattggagatttgcttgcttcctctgataccaatactaatgcttcaattctagttgtgcaacaacaacaaatgcccaagtcgttgtga

SEQ ID NO: 5553 - DNA, 5032 bp, Glycine max
  Peptide Sequence Number=SeqID_122331
ggtggagctccgcctcggccgctgccccctccaccgcgacgacgtcgaggccctgatcgacgaatgccgctccagccacgacagcttcactttctacccaaccgacgacgtcgccgccgttctcaactaccggagctgggagcaggcgcgcgatgccgtcgtctggttctgggaggcgcggctcgcggagaagcacgatttcacgccggcgttggattccaacgttgtcgtcgtcaaggacgatgtggattgtcgccttcgaccggttttcgcgaggcacgtgaaagggttgatgatgatggaagaaggtaaggaggtgaagtttgggatggatgagtgtgaacggttggcgaaagaaatttctcggctttcgagttcgctgagtaagcccttgcgaattggcacgcaaaacgagcttatgaagaagaagaaagggctcgttgatgagaagaatctggttgaaaggaggttgaaggagtttgagtctgcgatgcagtgtttgttgaagtatttggaggatggcggtgatgacgtggagggtgttaaggtgtttaggtttgatggaggttttgattggaagcggattcactgtcttatcaaaagggagtgtcggaggcttgaggatgggttgcctatttatgcttaccggagggatattcttcaggaaatacattatcagcagtggcaattactgggggtgtgggaaattgtgggcaaatgccaccgcaattgcggtcacaaagactccaaattccttgacattgcatgggaaattgggtcaaatgtgactgcaattgcagtcgctgaaaaccttgacgttgtggctgaaattgcgacgcaaactggagggatcttttgtgtgtttcctggtctggcaggcatttctggagggaagagtacgcagctggtacagtttcttgctgattcaggcgttggttctgacaaatccattgtatgcacccaacctcgcaagattgctgccaaagcagtggctcaaagggtccagcaagaaagcagtggatgttatgaaggccaatcaatcaaatattgttctacatttttatcctcgcgtgagtttgattccaggataacattcatgactgatcattctttattgcagcactacatgagtgataataatttgtctggggtctcgtgcatcataattgatgaggctcacgagaggagcttaaatacagattttctgttgactttgttgaagagtttactttgtaggagggttgaaatgcggcttatcattatgtctgctacagctgatgcaaagcagctatctgattacttttttggttgtggaatttttcatgtgcttgggagaagctttccggtggatatcaaatatgttccttctgactgtggtggagattctggttctgctgttgttgcgtcatatgtttctgatgttgtcagaatggcaactgagattcacaaaactgagaaagagggaactattcttgcctttttgacctctcagatagaagtagaatgggcctgtgaaaagtttcaagctgcctctgcagtagctttgcccttgcatggaaaactttcatctgacgagcagttccgtgtttttcagaactaccctggaaagagaaaagtgatattttcaacaaatcttgcagagacatcacttacaattcctggtgttaggtatgtgatagattctggggtggttaaagacagcagatttgatcctagcagtgggatgagtgtacttaaggtttgctggatcagccagagctctgctgatcaacgggctggtcgtgctgggaggaccgagcctggtgtgtgctatagaatgtacttggaagccgattatcagtctatggacctaaatacagagccggagattcggaaagttcatcttggtgtagcagttctgagaatccttgctttaggagtgaaggacatgcaagattttgattttgtggatgctccaagtcctagctcaatagatatggcaatccggaatctaattcaattaggagccattgaactgaacaataatgctcatgatttaacttctgaaggttggtgcttggtgagaatgggaattgaacctaggcttgggaaacttattcttggttgtttcaaacatggtttgggtagggagggtatcatccttgctgctgtgatggccaatgctagtagcatcttttgcagagttggcagtgaatttgataagcaaagatctgattgtcttaaagtgcaattttgccattgtgatggtgacctctttactcttctctctgtgtacaaggaatgggaagctttgcctcgagaaaggaagaacaaatggtgttgggaaaacagcatcaatgccaaatccatcaggaggtgtcaagacacaattttggagttagaaacttgccttgagcgtgaacatgacattgttactccaagttactggctttgggacccttgtatgccctctaatcatgataagaatttgaaaagggtaatactgtcctcacttgttgagaatgtagccatgtactctggctgcaatcaacttggttatgaagtggcgcaaactgggcaacatgttcaactacatccatcttgttcattgcttgtatttgctgagaaaccaagttgggtagtttttggtgagcttctttccatttctaatcaatatttggtctgtgtgtgtgcatttgactttcaatctttattcaacctttgccctgctcccttgtttgatgtatccaaaatggaagagcggaagttgctaatgaagacactgtctggtctcggctgtattcttctcaagagattttgtggaaaagccaactgcgatttgcttgctcttgtttcacgtataaggaaagcttgtatggatgaacgcatcttcattgaagtgaatgttgacaagaatgaaatccacttatatgccacttcaaatgagatggatatagcccttgggttggttaatggtgttctagaatatgagaggaagttgttacgcacggaatgtatggataagtttttgtatcatgggtctggtttctctccacctgtagctttgtttgggtctggtgctgagataaaacatttggaacttgagaaacgttccttgagtgttgatgtgtgtcatccaaacataaatgaaattgatgacagggagctcttgatgttttttgagaagaatacctctggttgcatctgtgctgtgcacaaattcacaggcaatatgagggatggagatagggataagtggggcaggataatatttatgtcccctgatgttgtcagaagagctgctgagctagatggacaagagttttgtggctcatccttgaaaattgttccttcacagttgggatgggataaaacattttcgttccctgctgttaaagcaagaatttcttggcctcgtaggcttagcaggggatttgccatagttaaatgtgatataaaggatgtcaattatatcttgagagatttctataaccttgcagtaggaggaaggtatgttcgatgtgaaattggcaaaaagagtattgacagcgttgttataaatgggcttgacaaagagctttcggaagctgaaatagtggatgtgctaagaactgctacaagtagaaggattttggattttttcttggtgagaggggatgctgctggaaatccaccatgcagtgctttggaagaggcactcctaaaagaaatttacccctttttgccgaaaaggaaccctcacattattccttgccgagttcaggtgtttgcacctgagcctaaggattctttcatgagagctttgatcacttttgatggaagattacatttagaggcagcgaaagcattggagcaaattgagggaaaggtgttacctggatgtctttcatggcaaaagataaagtgccagcagttgtttcatagctccattatatttcccactccagtgtatcatgtgattaaggaacaactggatgaagtacttgcaagcttcaggaatttgaaaggtcttgaatgcaacctgggcaggacagttaatggttctcaccgagtgaagataacggcaaatgccacaaggacagtggcggaagttagaagacctctggaagaactattgagagggaaaaccattgagcatgacagcctcacccctgtagttttccaactcatgttgtccagggatggctttagtcttaaaaactcattgcagcaagagacgggaacttatattctttttgacagacacaacttaaatttacgggtgtttggttccccaaacaaggttgctttggctcaggagaaggtgatacagtccctcctttctctccatgaagaaaagcagttagaaattcatctgagagggatggatctacctcctgatttaatgaagcaaatgattaagaattttgggccagatctccgtggactgaaagagagggtacctggggtagatcttacactcaacacacgtcgccatatagtcattcttcatggtagcaaggagttgaaaccgagagtagaggaaataatttttgagattgctcgttcaagccatcatttggttgagagatttgaaaatggacccagttgcccaatttgcttgtgcgaggttgaggatggataccggcttgaaggctgtggtcatttgttctgccggttgtgtctggttgagcaatttgaatctgctattaataaccaaggcactttcccagtatgttgtactcacagggactgtggagatcccatcctgcttacagatttgagatctcttttatttggtgataagttggaggatcttttcagggcttctttgggagcttttgtggcaacgagtgggggagcttacaggttttgcccttctcctgactgcccctcaatttatcgagttgcagatcccgagtctgctgaattcaaggaagatccggactcatctctgaaagagtggtgcagagggaaagaacaaatgggtgcaaccacgttgagtgcaagttgtgacttttctgctatgcaagctctacattatgtgttcaaaagcagttcaatacggttgtga

SEQ ID NO: 5554 - DNA, 2439 bp, Glycine max
  Peptide Sequence Number=SeqID_122332
atggggacaaacgagaccctattgagcataaacagaacaattttcattaatgctacgttcgacaactataattcagacccagacagaaaatttatttactataatgtttccattgatatgccatccaagatagtatccgatggcatatggggtaacaaaaattatggcgctttactctcaagatccacaatgccagtgttagagcttcaaattctcaccatttttgtcatcacgcaatgctttcattttgtgcttaggcgccttggcttcccttatttcgtttcacaaatgatggcagggtttgttctaggcccttctctgaagatagaagcattggccaaattcaaagtgatgctgttcccttacgggagtgaagacgtattgaacctagtaacagggattggatacttattcttcctgttcctaaatggggtgactatggatttcagcatgataacaaaaactgggaagaaagcttggacaatagctctttcgtcccttatgattcccactttcattggtctctttgtatgctacagtttcatggggtacttacaacaatccctaggagagttcgatggaggaaaacttccggtgatagtagtgggccacagtggtgtttccttccccgtggtagcttctctactctctgatcttgagatattgaactctgaacttggacgcttagcactctcatcagcattttccatggatgtgataagcgaagttatgaggggatttggcactgctgttgtgagtagccttaaactcgattctcacgataaaggtgaaggaaagggacctaaacttgcactcatcacttccataaactatgttgctttcatgacacttacgattgtgattgcacgcccggcaatgaggtgggttgtgaggaataccccagaaggaagatctgtgaagaaaacacacacatcaatggtgattctcatggccatattggtagggttgtttggagttgtggctaaccagacagtgttaggtggggttttactcgttggtcttcttgtgccagaaggtcctccattgggctctgaattggtgaagcagcttgagatgttcaacacatggttccttgttccaatctttgtcacgtgttgtgccatgaaggtcgatgtttccacgcctattagttccgagttggttctagttgtggttaccattgttgttgttgtgcatttggttaagatgcttataactgttgggatttgccgctattgcaacatgcccaaaacggatggtttctgcctcgctctcttgttgagctgcaaaggtgtcgtcgactttgtcaacgacgtctttctctttgattcatttttaatgagcaatgaaactatctccatgatggctatatcagtgcttgtgttgggaagcattgcacgcattggggtgaaatccttatacgaccctgcaaggaaatacgcagggtatcagaaaaggaacatactgaacttgaaacccaattcagagcttcgggttgttgcatgcatccacaaaccaagccacataaattccgtaaaaaatgttcttgacatttgttgccccacaacagccaaccccttagtggttcacgtcttgcatctgattgagttagttggtagatcctctcccatcttcatctcacaccgtctccaagaaaggcttagctcaggccacaactactctgaagatatcattgtaacattcgacctctttgaacatgacaatgctggcactgcatcagttagcacctacacagccgtttctccactacgtttcatgcatgatgatatttgttaccttgcattggacaaactcgcttccatcatcttacttccatttcacataagatggggtgaggatggtggtgttgaatcaactgatgaaaacatgagaactctcaactctaaggtccttgaaagagcaccatgctccgtggggattctcgtgaaccgaagctcttcttcttctactcatcaaagccctttaatgaagcaaatagcaatgatctttttggggggtgcagatgatagagaggcactgtgcttggctaggaggaccatcaaagattatgattgtaacttggttgtgtaccacttggtttctagccaaagtgaggcaaattggaacctcatgctcgatgatgaggtgctgaagagtgttaagggctattatggtaccattgagaatgtgtcatacgaaaaggtttctattgagcaaccttctgagaccactgcttttgtgtcggatattgcaaatcggcatgattttttcatagttgggagacgtaatgggatcaaatcgccacagacagcagcacttgaaagttggacagagttttctgagttgggtgtgattggagatttgcttgcttcctctgataccaatactaatgcttcaattctagttgtgcagcaacaacaaatgcccaagtcgtcatga

SEQ ID NO: 5555 - DNA, 1077 bp, Glycine max
  Peptide Sequence Number=SeqID_122333
atgggtgaagagggagaagaagtggtgagaaagcaaggacaaaggggtgttgatggagataaatggcttacttcttcttcttcttcttcttcttcttcttctaacaacaataagatcccatctttcccactcatgaagagacttaacagctcagattcttccactgccctcatgacaatttttccatcatcatcaacagaggaacatagtccgaggaacagccaccacatgtatggcagggagttccgatcgatgttggacggactcgacgaggaagggtgtgttgaagaaccggggcatcaatctgagaagaagcgtcgactaagtgtggaacaagtgaaggctttggagaagaactttgaggttgaaaacaagcttgaacctgagaggaaggtcaagcttgcccaagaacttgggttgcaacctagacaagtagccgtttggttccaaaaccgccgagccagatggaaaaccaaacaattggagagagattatggtgtcctcaaagccaattatgatgctcttaagcttaactttggcaccctcaatcaggacaacgaagccttacgaaagcagataaaggaattgaaatcgaggctgctgcaagaagagaacacagcaggaagcggtgtttcggtgaaggaagaagagataacaacgatgcctgcagactcagaagagaaaacgatggaacaaagtaagagtgacccaccttctgaaacctcgaacattaatcctagttcggagtcgtcggaggaggaccacttgaattacgaatgtttcaacaacaacagcgacgactgtgtcgtcggaggatccgccgcagcatcgctcttgcaagtggacttcatgaaagacggttcttccgacagcgacggatcaagcgcgatcttgaacgaagacaccatgtacttgccgtcttcgatgaactgttttcagttccagaaaccgtatcatcacgcgcagtacgtgaagacggaggagcacaatttcttgagcgccgatgaggcctgcaatttcttctccgatgaacaagcaccgaccctgcaatggtactgtccagaacagtggagctga

SEQ ID NO: 5556 - DNA, 658 bp, Glycine max
  Peptide Sequence Number=SeqID_122334
gaggactacacgtcctcaccttcagagtgttgcacgccctcaccctctgaggccgcacgtcctcaccttcagagggctgcacgccttcaccttcagagggctgcacgtccacaccttcagaggtctacacgccctcaccttcagagggctacaagctcttagcttaagaggactacaagtcctcgcctttagagggttacacacccttaccttcagaggactgcagaggactgcgtgtcctcgccttcagagggttgcacgccctccccttcataggactgcacttcctcaccttcaaagggctacacgatctcacctgcagaggaatacacgtcctcaccttcagatagctacacgctctttccttcagaggactacatgtcctcgccttcagagggttgcacaccctcaccttatgaggactgcacgtgctcaccttcaagggctatgcgccctcaccttcagaggactacaagacctcaccttgagagggctacacactcttaccttcagaggactacacgtcctcgcctttagagggttgcacgccctcaccttcagaggactgcacgtcctcaccttcagagggctacacaccctaaccttcagaggactacacatcctcaccttcagagtgttgcacgccctcacactctga

SEQ ID NO: 5557 - DNA, 438 bp, Glycine max
  Peptide Sequence Number=SeqID_122335
atgccttatgcatgcgataccagactagatgtgcccaatcaatttgtcagccggtatgaaaggcccacattactattagatcttcttcagaaacatgtgcaaggtttgaagatctggggagtaagatacagacaattagataatggaggatgcagctttcaggaaccaatgaaccggcaaacagccttccgatcatatccgcttggttggtgcaaaccaaccgacgggcatcatgcacagaaaatcaaacttccaatcatcatccagtgcaccttcaaatggtacaccgtcactagacaattagaaaagaaatccatatctatgaacttagggtcaatgatagaacgagaggagaagaggttagtgtatcgtgtatgttgttcttccgatgagaacaatgaggaggaggaaatggaggaaggaattggagtatcctga

SEQ ID NO: 5558 - DNA, 246 bp, Glycine max
  Peptide Sequence Number=SeqID_122336
atgtttggtttgcatgtttggtttagggttggtggtacttctgctgttctgttctgtgttatggcacgttctccagacaagataaagagcatcgatggctcgaaagaaactcttaaactcagtgtgaggatcagtgatctatggtttattggcacgcctaacaaatctgagcaagctgaaatggtgtttgtggactctgatggtgatgagatccacgctgcttgtgaacaagaccaattgaagtaa

SEQ ID NO: 5559 - DNA, 384 bp, Glycine max
  Peptide Sequence Number=SeqID_122337
atgcagaaccccaagaccacgacggtactatgtgatactgaacctgaacctgtgtcaattttaacattccctgcatttttcctaattctcatggcaccaactcactctacatcaattgatattaatggtgaggatgctccacaattccttactggatttgctgaaaatattggccttgaaaatgttcgtactgcaacaattgtgtctgcagctattgctgctcatactcgttcctgtcttctacaggcttgggctctggaaatgcaaggcaaacaggttgatgctatggtggaactgtcaaaaatatgccttcttctacgaatatttcctcctgaggagtctttgttcaaaatcgtcatagaaggtcctataagaccgacttag

SEQ ID NO: 5560 - DNA, 390 bp, Glycine max
  Peptide Sequence Number=SeqID_122338
atgcagaatctagagattccaaccatttctattctaggtgcacttgctaagtcaggtatcagggttctggtatacagtggagatcaagattcagtcatcccattaactgggacaagatccctggtaaatggattagccaaggactttggactcaacacaacagtgtcctatagagcatggtttgagggaagacaggttaaaactgaagacttggaatgcattaagatcctgaaaaaggtggccggttggacacaagtatatggagacatcttatcatttgccaccataagaggagctgctcatgaagctccattttcccaaccagagaggtcactggtgctgctaaaagcatttttggaaggaaagccacttccagaaccattcctttaa

SEQ ID NO: 5561 - DNA, 237 bp, Glycine max
  Peptide Sequence Number=SeqID_122339
gtgcagatccatgagtgtctctaccagctcagcctcagtcagcagagccagggtttcgctccttttgcgtgccctactctagatcagtttagggctgagctcgcatggcccggagattggcctgaggaccagacagaggaggcacctgcaggagctcccgacggtgcagaggacacccgcatggatgaggagatgacagatttactcggcttcatgagaggaagcggagccacgtga

SEQ ID NO: 5562 - DNA, 164 bp, Glycine max
  Peptide Sequence Number=SeqID_122340
ggcgtgaagccacgtggaaacgcttggaggagcttgctgcaaagaaagctgcaagtggtgaagcagtgcttattggtaaggcaccaactcgcaactctgcagcttatacttttgtacccaagaagcacatttgggcacttccccttttaatgaatttccaatga

SEQ ID NO: 5563 - DNA, 1683 bp, Glycine max
  Peptide Sequence Number=SeqID_122341
atgtctcaggttatgtggtctttacatcatgcaacagtgatcatgaacttagtgactacatgttgtttagcaaggcatgctctaagcttgcttcgtgaaaggaaggatggatatgatatagtgatcagcgatgtaaacatgcccgacatggatggttttaaacttcttgagcatgttgggcttgagatggatcttcctgtcattatgatgtctgtggatggggaaacaagcagggtgatgaaaggtgttcaacatggagcctgtgattatctccttaagcctataaggatgaaagaactgagaaacatatggcagcatgtcttaagaaaaaggatacatgaggccaaagaatttgaaagttttgagagttttgagagcattcacttgatgagaaatggatcagagctatcagatgatgggaacctgtttgcggtagaagatgttacctcaacaaagaaaagaaaagatgcagataacaaacacgatgacaaagaatgtttggatccatcatccaccaagaaagctagagtagtctggtctgtggatcttcatcagaagtttgttaaagcggtgaatcagattggatttgataaagtggggccgaagaaaatactagatctgatgaatgtcccatggctgactagagagaacgttgctagccacttgcagaaatacaggctttatttgagtaggattcagaaagaaaacgatcagagatcttcctcaagtggattgaagcattcagattttcctttaaaagatatgagaagttttggttttcagaactcagtaaacaaccagcaacaaaacgatgttgccattgacagctacaatcattcggatggatcattacaacttcagaatgtggaaactaaaagtcacgaagcggatcccaagggaattgtttcacagtccaccatagcgaaaaaaggaaggattttgactggtaacattgctgacacaaatatgagagagagtttaagggttggccttaatcaaacttttgcccctctggagtcagaagaaaaccatgcagtatttgattgttccatgccaacaccatacacttggactgaagttccacacatgcaactcaaagaagaacacaagtcaattgttcatttagaagatagcttcaatcagttgccattacatggtaagcagcagcaacacatccaagtggatcaatcacaatcagttgcttcaattagttccgctcccttgataacggaggaagaggttgctgcttgtaaagagccaaaacctttgtttgcagattacaagaatgattatgccaattctgtgagttcaatagggaatgcagttggcacctttcctattcaaccaggaagtcttattatgaatggtcaatcttcagaacccatttccaccacaaattctggattgaaaacacagggatataataatctcagtagcatttctgatctggaaatttaccaaagcaaccttcttttgggaggtgaggtagcttctgcaccatcattggatgaggacttgcatttctattggctacaaggtgaatgctataataatatgaacttcagtctgcagaatataggaatgtctgaatattatgatccaggacttatttcagaagctccaacacacttatatgattcagctgattactcagttatagatcaaggtctattcatagcatga

SEQ ID NO: 5564 - DNA, 1806 bp, Glycine max
  Peptide Sequence Number=SeqID_122342
ggtaaccccattcttgcgcttggagaatctatctcgtttgggaggtttatgacagagagcctggattgggagaaatggtcaacattttcacacaatcgctacgtagaagaagccgagaaatattccaagccgggttctgttgccgctaagaaagcctactttgaggctcattacaaaagaaaggctgcagagcgagcagctgctgtgatccaagaagcaaacgctcaggctaatggaacttttgaggcacaagttcatgaaggaaactgtgccgattcatcctctgagacaagttcaaatgtggaaaacactgtggccgccaatgaacagccggataatgaaactgttaattaccaagttgttgaatgtgctgatagagaccaacataaatgtgatgcccgacaaagtgatttggacatttctaatgtggaaggagcagaggatgtgccgcgtcatcacactgctacggatcttaatgtggaaagttgcagatttgttgataattctaattctaaccagctttatcttgttgaggacaatacagatattgctgtccctgcagaagagatgacactagatcatgttcctgttgatcaggaagttttggctttgcctgtcaagggaagagaagtaaactcttctccaaaattatcaaccaaaactggggttgccaatcattctcgttcttttgatgaaaggaaggctgctgtgccacccagaagtggaataaacagtggtccgatgggtaagaagtctgttggaggcttagttgagaagaagagactaactgcacagtcagtccacatgtcaatcaatcttccatctggtaccggtgaaacacgcaaaagaactgctgcagcttcacagtccagaaatggcttaaacaatttttcaacaagtaagaagtctgttggagggttggttgagaagaaaagaataactgcaccatcactttacatgtcaatcaatctcccatctggtgccggtatcacaagcaaaacagctactgtagttactaaacccagaaatggaataaactttgctgcaaaaagtttgaagtctgttggagactcagtggagaagggaccaactaaaaggtcactccacatgtcaatcaatctgccttctggtgcaggtgaaacaagtaaaacagcttcagtgttggaacagaacagaattaaaaaaaatcattccaacattccaaaaaataatccaggggcgttgcggacatcgacaaaggtatctcatggtttgctaaatcaagcttcagctaatcccccttctcgggatagaagctgcctgaaatcttcaagccccaccaaaagcaacccccaatcagctaccatatctgcaccttttagattcagaagtgaggaaagagcattcttgcagaggatggatgaaactaaatccaaggaagaagagaaagttaagttgcaaaggactctcaaggtgaataattttataataacggttctgctgggtaaaacagagcatgatcacaagaagctgcagcagagcagtggctctatatccaaacttaatgaagacaagcctggtgaatcacaatctccaagcaatcagactagaaagatctcgcttacgctgccccggtcaccaaaacttgggaggaaagcaagttctagttctagcacagtccaggacaaaagcttaggaaattcatggaagcctcctatcagcacctccaagcgtactacagaaaaaaataaccgaacaacacggcaatcagtaactttattatcaaataatacaagagaaaatgcttcaccaaatattcagcaatga

SEQ ID NO: 5565 - DNA, 1023 bp, Glycine max
  Peptide Sequence Number=SeqID_122343
atgccgataacgctatcagtgtatttatcagtgagcccggaaatgatcagcctgcaaaccaatctgtctgccctcaacgccagcaagcaatctgccagaagtggcgcggcgctgggcgatgcgatccgccatttatcgtcgggtatgcgcatcaccagcgcgcgtgacgatgcggcaggtcaggcgattggtaaccgttttagcagccagcagaacggcctggcggtggcgcagcgtaataccggtgacggcctgtcactggtcgaaaccgcggaaagcgcgctggatgagatcaataaccgcctgcagcggattcgccagctggcggttcagggattaaacagcaccaattcgcagagcgactcagacgccattcaggcggagattaacctcaatctgaaagagattgaccggctcaacaccagcagcagctttaccggcatcaggctgctggatggcagcgccggtaagctgggattccaggttggcgctaatgacaacgagaaaatcagtctcgacctgtcggcacccggcttcagcgtggaggcgctgggacttaaggatttggtgatcagcggcatcagcggcaaagtgaccaatgtcaccaccctcaccggcatcgccaccaatatggcgttcagcaacccggcaattaccgtgaactatctgcccgccagcggctcaccgcagctggtgcgcagcagtggtgataaccgccagtacgtgcagagcagcgacgccgacggcaagccggtctattatctggccgccgtcagtgcgcgctgggacaccgccacggctgccggtaacgtctcgattagccgcagcaatccggcgccgctgtacagcaacgtcagcagcattgcgtcgcgcaccatcccggcggttaattatcaggacagcagtggcagcgcgctgagcaccacgcccgcagccacgttaacgcaggataatggccagtattatattgagcagaacaacagctggtatcgggccacgctcagcttcggcaacagcggtgcg

SEQ ID NO: 5566 - DNA, 774 bp, Glycine max
  Peptide Sequence Number=SeqID_122344
cggtccggcggtgcaccagctgcggaaactgcggcgatagagcgtgatgtattcatcaatgaaggcgcggctcaggctgtcgctgtgcagccctttgtggatgtagttcatgacaaacagcaggtcttcgaaattggcgatctcttcgttgaaccgcagccggtgctgacgaatgacatcgccgcgaaacaccttgtcgcagataccgtggcgcgggtggtaatagagcagatcgttaatcgccgcagacaccgacagcgcgtgcgcctgttcacggttggcgggaaaatccagcggtgcgccgtccgggttgaacagccggccgcgcgaggcgcgaatgccccggttgcgtgccgccgagacgcccgcgttggcctggctgataaggtggaactgcggataaccggcgtagcgctgcaggatcgccagcgagtcatcgctggagccgtcattaataaaaatggcctcaaagcgaacctcatcctgctgcagcaggctgtcgatgcatctttccagataagctgcggcgttatacaccggcacaatgacgctaatcagcacgtcgttaacgggagtttatctggcgatttaaagggtaaaaaccgcaggctaccgcccctggcttacagcgaccagcgtgctggagttctctttggtgcattttcaggcgtaaagaaggggcgctgcactccgcagagttcagttatttatcagccagttagccccaacatctcctgcacagcaacgagaacgggaactgccgaccgcggttga

SEQ ID NO: 5567 - DNA, 204 bp, Glycine max
  Peptide Sequence Number=SeqID_122345
atggataatggttgtttctcttccccaagacgtgattttcctgctggtctgagagttctagttgtggatgatgatccaacgtggctcaagatccttgagaagatgctcaaaaagtgcaattatgaaggttgtggtcatatttgtcatgggtcagtttctaaggaatgtgcttctttttttagggaaaacaaatccttctattag

SEQ ID NO: 5568 - DNA, 351 bp, Glycine max
  Peptide Sequence Number=SeqID_122346
atgaaggagtgttcatggttggatatgttgggacgtttagtcataccattcatcaagggttggcttctaacccttgtccttctatgttgtattccacctcttgtaatctctggttccatgatgagctttacttttgcaaagttgccatcccatggacaagcagcttattctgaagcagcaactgtagtagagcgcacaattgattcaattcaacaagttgcatcatttacaggcgagagtcaagctatagctcaatacaatcaatccttaaccaaagcttacaggactgcagtgcaagatggagtggttgctggtttaggcctggggtcaatccttaaccaaagcttatag

SEQ ID NO: 5569 - DNA, 155 bp, Glycine max
  Peptide Sequence Number=SeqID_122347
tcaggaaattctcaagtacggttctaaggaaaggaattgactcacctattccgaccgaggagaacaggccattcgacagggagactcggaagttgcggagtcttggtttaatcaagccgctgaatattgtaaacaagcttctcgctaaccccctg

SEQ ID NO: 5570 - DNA, 2028 bp, Glycine max
  Peptide Sequence Number=SeqID_122348
atggtgagactgtggaacaagcttaagagactgcagcaggatatgagaaggtttagcaaacccctgagtaatctaaagcagaatctgatcaaagccaaagaagatcttcaatttgctcaggaaaaccttagaaacaataacatgaatggagatagtattgatagagtgaggcagctgacagaagaggttattaatcttaatgatttggaggaaaagatgcttatgcagagagcaaaagtggattggataaggaaaggtgatgggaataactcctttttccatgctattataaaaagcagaaataatagaagaaatatatacatgctgcagaaaactgatggaaccttgcttgaaaaccagtctgagatagaggatgagatcatggatttctacaagaaacttatggggactgaggatagccagctgcaccatattgacatagatgctatgagaaatggcaaacaagttaatatggagcaaagaagatatcttgtgagcaatatcactgagcaggatattgagagagcccttaaagggataggtgatgataaaagcccagggattgatggttttggggctaagttttttaaggccagctggtgcatagtaaaagaggatgttatagcagctattctggaatttttcaacacaggaagattgtatagaggctttaataatacagtggtaactttaatccctaaaggtgataatgctaggtatgtgaaagattatcgtcccatagctggctgcacaactgtgtataaaatcattgccaaaatcataactgagagattagggaaaattctgcctagcatcattagtcatagccaggctgcttttgtgcctgggcagaatattcacaaccatatccttttagcttatgagctcctcaatgggtatggcaggaaaggtggaacccctcgtgtgatgatgcagttagatttacataaggcatatgacatggttaattggagggccatggaatgtattcttaaggaaataggtttacctatgcagtttgtgagttggatcatgactggtgtctccacagtctcctataggtttaatgttaatggaacctattatgacattatgcaagccaagagagggattagacaaggggaccccatgtcccctatgctttttgtgataatcatggaatatttgcatagaactttggtgaagatgcagcaaaatcctgacttcaatcatcactcgaaatggttaaaggtgaatccagcaaagtgtcagatgttctttggaggaatggatggttgtagcaaagaaaatctgagaaggataactgattttgcagaaggaaaactccctgtgagataccttggcgtgcccttatcttgcaaaaggctcactattcagcagtacatgccactgatagacaaaatagtggacagagtgaagcattggactagcaaattgctaagctatgctgggagaatccagttggtgaagagcatcactagtgccattgcaataaattctgagaatctttgggtgttgtgggttcatacatattatctgaagggcaatgatgctattactgcttttgtcaggcctaatagttcttggatccttaagaacattatgaagcaaagacataaactgggtcagatacaacaacattgggaccaagctctcagtagacagaagtttcctatgagtgctatgtatcatgggctgacagaggaacaccaaagagtgtcgtggagtggcactagagaaatttgggggaacatattggattggctgggtagaagacatgatccgagggagtgggatatggagcttgcttggattattgagaacaccaaaggtaaaggttggaaaagtgctctgctgaaaatggcaacagcggagacagtttataatgtgtggcactatagaaatagcatgtgctttggcacagctgtggataaacaggttatagaaagaaatatcattgacaacatagtgtatagaagttggcaatatccaactcttagaagtcatgttgcaaagctaatgatgtag

SEQ ID NO: 5571 - DNA, 495 bp, Glycine max
  Peptide Sequence Number=SeqID_122349
atggatgttgaaaaagtggtgcatactggaggctgccactgtaagagtgtaaggtggaaagtggttgctccttcgagtgttgtggcatgggattgcaactgctcaacctgctacatgagagccaatactcatttcattgtaccagctaacaattttgagcttttgggagattctgagaagtttcttacaacttacactttcggcactcacactgcaaagcacacattctgtaaaatctgtggcataacctcattctattgtccacgctcaaacccagatggggttgcagttacattcaggtattttgatgggaagaattgggacagtgcatatactcagacagctttgtctggcaaactaacatcacaagaaatggcagaacttgagtcctttgctttggcatatgctatcaggggtgttagatacatggaaggaatgttactctactattttcttcttggaaagctgcataatgaagtgcatcgctcatactag

SEQ ID NO: 5572 - DNA, 373 bp, Glycine max
  Peptide Sequence Number=SeqID_122350
cgtcggccaactgattgcagcgaccgtggccaccaccattctggtcaccggcgcgaccagtgacggcaagctggcgctgctggttccggcggagctgttcaaagacgcctatcgtcgcatggggctggataacaagaacctgtcgcgcactatcgaggatgccggcaccgttattgaaccgctgctgccgtggacttcggccggggtatatatggcgacaacgctcggcgtcagcactctcgacctgctgccgtgggccgttcagtgctacgcggctattttcttcgcattattttatggttttaccgggatcggtattgcgcgcactgcggctcctacagagcaggcgcagaagcgcgccgtagcggaataa

SEQ ID NO: 5573 - DNA, 582 bp, Glycine max
  Peptide Sequence Number=SeqID_122351
gtgaggaagtgttgtcctctgaaggtgagggcgcgtaacgctctgaaggtgagggcgcgcagtcctctgaaggtgatggcgtgcaaccctctgaaggcgatgacgtgcaatcctctgaaggtaagagcgtgtagcactctgaacgtgaggacgtgttgtcctcttaaggtaaggtcgtgtagccctctgaaggtgaggctgcgtagccctctgaaggttaggacgtgcggtcctcagagggtgagggcgtgcaacactctaaaggtgaggatgtgcaatcctatgaaggtgagggcgtgcaaccctctaaaggcgaggacgtgtagttctctgaaggtgtgggcgtccaaccctctgaaggcgaggacgtgtagtcctctaaaggaaagagcgtgtagccaactcaaggtgaggacgtgtcgtcctctaaaggtgagtgcgcgtagccccctgaagatgaggacgtgcaatccttttaaggggaggggttgcaaccctctgaaggcgaggacatgtagtcctctgaaggtgagggtgcgtagccctctaaaggtgaggacctgcagtcctctgaaggtgagg

SEQ ID NO: 5574 - DNA, 1054 bp, Glycine max
  Peptide Sequence Number=SeqID_122352
atgtggtttatcccgatatctatgcttattgctctttctggaaaatgtcaatcatcaatcatatgcagactaggcatttatgagcccgttgaacataataaccctgcactctctcccaacttcgaatctcctgtctacgaggctgaagaggaggaggatgatgaaatcccggaggaacttgctcggttattggaatatgaaaagaaaaccattcggcctcatgaggaggtagtagaggtgattaacttgggaaccgaggaagataagaaggaagtcaagattggggcatcgcttgaggcaactgtcaaacgaagggtgattgaattactcaaagaatacgtcgatgtgttcgcatggtcgtaccaagatatgcccggcttggatccccgtattgtggagcaccgtttgcctttgaagcccgaatgcccaccagtcaaacagaaactgagaagaactcgccctgacatggctctcaagatcaaagaggaagtacagaagcaaatcgatgcaggttttcttgtcacatcagagtatccccaatggttagccaacatagtgcctgttccaaagagggacggcaaggtcaggatgtgcgttgactaccgggatttgaacaaggctagtccgaaagatgactttcctctacctcacatcgatgtattggttgacagcgctgcaaagtccaaggtcttctccttcatggacggtttctctgggtacaatcagatcaagatggcagttgaagatagagaaaagacatctttcatcacgccttggggcaccttttgttacagagtaatgccctttgggttgataaatgcaggtgccacttaccaaagaggcatgaccactctctttcatgacatgatgcacaaagagatagaagtgtacgtggatgatatgattgtcaagtcaggcactgaagaagaacatgtcgagtacttgctgaagatgtttcaacggctgagaaagtaccaacttcgactgaatcccaacaaatgtacctttggtgttagatctggaaaactcttgggcttcattgtcagtcagaaag

SEQ ID NO: 5575 - DNA, 252 bp, Glycine max
  Peptide Sequence Number=SeqID_122353
atggaagtgcactcagtacttgaagccagttaccttgtttatgaaggtctgaaccactcaaatcaagtgaacccctggccatgtacagcaatccgacatgatgaaagcctgtttgaagggtctgctagtccatgcttgaagctgaggagtgcattcctttccttctcactgcaagtcatattgagccttgctgccttgcttgcactgaagtggagagttgttgcagtggacaatatcaagagaagaacatga

SEQ ID NO: 5576 - DNA, 832 bp, Glycine max
  Peptide Sequence Number=SeqID_122354
tacctcggctccgagggctacacgtctcaccatcagagggctgcacgccctcaccttcagaggactacacgtcctcaccttaagaggactacacgtcctcaccttcagaggactacacgtcctcgccttcagaggactacacgtccttgccttcagaggactacacatcctcgccttcagaggactacacgtcctcaccgtcggagggctacacactctcacttttagtgggcacacccttgccttcagaggactacacgtcctcgccatcagaggactagacgtcctcgccttcagaggacttcacgtcctcaccttcagagggctgcacgccctcaccttcagagggctacacgccattgccattgtagggctacacgccctcaccttcagagaattacacgtcctcaccgtcggagggctacatgccctcacctttagtgggctacacgccctcgccattagaggactacacgtcctcgccatcagaggactacacatcctcgccttcagaggacttcacgtcctcaccttcagagggctacacactttcgccttcgtaggactacatgtcctcacctttagagggctacacgccctcacctttagaggaatacacgtcttcaccttcaaagggctacacaccctcatcttcaaaggactatacgtcctccccttgagaggactacacgtcctcgccttcggagggctacacgccctcaccttcaaaggactacatgtcccccttttcagagggctacacgccctcgcctttggagggcgacacgtcctcgctttcggagggctgcacactgtggcgtccctaaattaa

SEQ ID NO: 5577 - DNA, 318 bp, Glycine max
  Peptide Sequence Number=SeqID_122355
atgcctgaaatatcctttctgatggtcgtggtcctggaagcagggaaaattttttctaagaatactctcttgaggtcatcccagcttgtgatggaccttggagcaaggatgttcaaaatcaccaaccacagaatgcacagactcaccaataacagaatgctcaggatgctcaaaagatcagcaaaagtggtcgctaaatccgtcgcaaagcactattcacagcaaaacacaaaaactgaaacagggaaagtgctaaacaaaaaaactaaagcaaaacaccacactaaacaaaataacaagacactaaacaacacttaa

SEQ ID NO: 5578 - DNA, 489 bp, Glycine max
  Peptide Sequence Number=SeqID_122356
cgagaattcgctaagtgcaaccttcaatggctaagcgcgaggaagaatctagaagaagatgagctgtcaagttcgctaagcgcaccgctccaggtcatcaagcgcaccgcttcataccatccgctaagcgaaacaagcgtgctaagccaaaatccacttatgcgcgctaagctatccagatctgtgctaagcgcacgagcacgaaccaaggccacctatttaagcctaaaatcagatttacaaagggagtatggaacttttcttgagaagctctggatgcacgaagtgagcttcaaaacaaggaaagggaaacaaggctcaaaagggctatcaaaggaattaattcaaggtaagtccatttggctagaagcttataagaacaaaattgcctcaatcatttccaaatatgcatgtgaattaggacgcatcaacaagaatcaagccaaggctattgtgcaagcaatcaatggggcaaaacacaccaaatga

SEQ ID NO: 5579 - DNA, 336 bp, Glycine max
  Peptide Sequence Number=SeqID_122357
atgggcccaaaatttaccgattgcatcatttatggtgacaatgatggtcatcagaaagatgatcttgctgctaagtatggtattgatgcagcaacatgggaagaatttgcaaaaagccgccaaacccctaattggcaggacatattgaacacgactattggcaggcttgagcatccaggtcgcgtacgtgtggcgggcacaggtgtcacaattagccagtattatggacaagcatctcatggctcaaatagttcttccatatcaatcagtcaacaacagttggctcaaatagttcttccatatcaatcagtcaacaacaattggctcaaatcatag

SEQ ID NO: 5580 - DNA, 671 bp, Glycine max
  Peptide Sequence Number=SeqID_122358
attgggaccaacacttggctgggataggaggtagaacaatcaactggtttcctcgatggaaggaaggaaaggagggagttctcttctcatgtggggactacccaaacatcccgttgataggaacgaggggttgcattaacaacaatcccgcacttgctataagacagttagggtaccccatgaggggagcaccgatagaagaaagcctctctcctttccttgtgagagattttggtacacaaagtttcaaaattatacaaagagtccataaggcgtgggaaagcccgttaaggaaagataaagaacttaggggcattcataatggcatcatcggtggttatcatgaatggctgaaagttcatacacgagggttagattggctctccaagttgaaaattatcaatgaggagaacttcgaagctctggaagaggatgaagaagtccgagctctaaaaaccgaactaggaaaagcaatacttgccaaagaaaaattcaagttggtcgctacagacgtccggaaagagtgtgccgagttacgagaagaaaatgcagctaccgcaagagcccttgaacaagaaaccaagagggctcgccgagacaaattccgtggagctttgtggggcagcaatagtgagctcaagcttcgaagggaagagagagaccaatcatga

SEQ ID NO: 5581 - DNA, 1314 bp, Glycine max
  Peptide Sequence Number=SeqID_122359
cgatcaacagctgcgccagttctcgctgtggatgatgggcagcctcagccagtcgcagtggccgaccctggcggtttccgcctcgctgatcctgcctgcggcgctgctgacgctgctgcaggcgcgccgactgaacctgttgcagttgggggacgaagaggcccactacctcggggtgaacgtccagcgcgccaagctgcagctgctgttgttgagcgccttgctgatcggcgcggcggtagcgatgagcggcgtgatcggctttgtcggcctggtggtgccgcatctggtgcgcatgcgcctcggcggcgatcaccgctggctgctgccctgctccgcgctgggcggcgcctgcctgctgctggtcagcgatacgctggcgcgcacgctggtggcgccggccgaaatgccggtggggctgatgaccagcctgatcggcggtccctatttcttgtggctggtgatgcgccagcgggagcgagccgcctcggtacgcgccggttgatcaacgacgtttcgctcagccttgccggcggtgaaatggtggcgattatcggccctaacggcgccggcaagtcgacgctgctgcgcttgctgaccggctatttgacgccgaactgcggcgaatgtcggctgcttgaccgcccactggaacactgggcgccgcaacagttggccaaagtccgggccgtgatgcgccagtacagcgatttggcgtttccgttcagcgtggaagaagtggtcagcatggggcgttcgccgcacggcaaacgcgacgagcatcaggcgatccaacaggtgatggcgcaaaccgactgcctggcgctggcgcagcgcgactaccgccagctgtccggcgctgtggcaaccgcagccgtcccccgcctggctgttcctcgacgaaccgacctcggcgctggatctgtatcaccagcagcacaccctgcgcctgctgcgctcgctgacgcgccaacagccgctgggcgggcggttggtggcgagcggcacgccgcaggaagtgttgcaaacggagatcctcacccgctggtatcaggccgatctcggcgtggtgcatcatcccgaagtgtcgctgccgcaggtgcttgccccagtccggcggcagcgcggcgagatcgtcatactccggcacatcgtcgaacggccgcagcagagcctgatgcaatcgctgcaaacggcccacgtcgtctttctccgcgtcctcaatcgcctgctgcgccagatagttgcgcaggatcagccgcggattcaccgccttcatcgcccgttgccgctccgcatcgctcacctgctcct

SEQ ID NO: 5582 - DNA, 1036 bp, Glycine max
  Peptide Sequence Number=SeqID_122360
agggctacacgccctcgcctttaaaggactacacgtcctcgccattagaggactacacatcctcgcattccgaggactacaagtcctcgccttcagagggctacacgcactcgccttcagggggctgcacgcccacaccttcatagggctacacgcactcaacttcaaaggactacacgtcctcgccttgaggactacatgtcctcaccttcagacgcctgcatgtcctcacactcagagggctacacgccctcgccttcagaggactacacgcactcgccttgaggactacacgtcctcacctttagagggctgcacgccctcgccttcagaggactacaagtcctcgccttcagaggactgcacatcctccccttcagaggactacacgtcctcgccatcagaggactacacggctgcacggcctcaccttcagagggcttcacgccctcgccatcagaagactacacgtcctcgcctttataggactacacgtcctcgccttcataagactacacgtcttccccttcagagcgatacacgcccccgccttcacaggacacacgtcctcacctttagagggctgcacgccctcgcattgagagggctgcaagtcctcgcctttagaggactacatgtcctcgccatcagagggctgcacgcacaaaccttcataggactacacgtcctcgccttgaggaatacacgtcctcaccttcagagggctacacgccctcaccatcagaggactaaacgtcctcgccttcagagggctacacaccctcgccttcagaggactacacggctacacgccctcaccttcagaggactacacgtcctcatccttaaagggttgcacgcccttaccttcagaggacaaaacgtcctcaccttcagagggctacatgccctcaccatcagaggactacacgtccttgcctttacattactacgcgtcctctccattagagggctacacgccctcgccttcagaggactagacatcctcgcctttagaggactagacgtcctcgcc

SEQ ID NO: 5583 - DNA, 285 bp, Glycine max
  Peptide Sequence Number=SeqID_122361
atgggactcagtcggacacccaacgtctcaatatattacgggactcaatcggacatccaaggcttaatcgggcatccgagtaaaaagttatattcttttgaatttgctcgctgtcgcaacgtgcccttttgcgggcgagcaaaggcgaggctcacgggtgcgctttccaaaggaggaaagatgcgcggagtcgccaccaatgtttatttgtggaaaacgtcggaaaaaccgaagaaaaccggtcaaaatgaaaattctaagttcgggagttgtatttacgcttga

SEQ ID NO: 5584 - DNA, 1487 bp, Glycine max
  Peptide Sequence Number=SeqID_122362
acgcctccgatgccgccaagcgcggcaagaagcgcggcagttacaactgcggccgctgcggcctcccgaagaagggccacaactgcaccgtaaaaactcccgcctccaccgccgcggcaactcccgattcgtccctctccattgtctccttaccttcctcgtccgctgtgccaagtctccgacagtctccgtcgaatctcggtcgcgcgttgtcgttcgatgatttcgatgaacctgctcttgttgtcgatcggtacgaaccagatgaaaaagtggattccgatgtgttcgatgagaccaatccggatctggatctggacgccgatgcggggggactgccggcgagtctcatgtgggaagtgatgaggaggctgccaccgccggggctgttgtccgccgcaaaggtttgcaagggatggagggatacgacgaagaggctgtggagagcggtggaggaattgaaaattagggttccagctaacgttcctgtcagatttgttgcctcgatgttgcaaaagtgccctgggattgtgagactctcgcttagaatggagagtgattttgattcaactatgttggcttgcattgccttctcgtgccctaatcttgagtgtatgaagatcttgacgtttgatgctgcaatcattcggatcaatgggagttgcccgagattgcaaaacatacatatagcttcgatacggctttcacactccgctgtgcttgctcttacagctgctcagttgagggggctgcgaatgctttctcttgttcttggatctgaaatcactgatgcatctgttgctgccattgcctcaagctatccaaatcttgaattgcttgatctcagtggatctggtgttagtgacagtggcattagtatgatttgcaatgtgttccctgataccttgacaagactcctgcttgctctttgccctaatgtgacttcaagtggtattcaatttgctacatttcagttgccacaccttgaaattatggactgtggcatgaccatatgtgatcctaatacggaaaatccaactgctgacgaaaacaactgcaatttgcagaagacatctggcgttaatgtacacctaataaaccaaaagctaatcatcaaacatagccgtttaaagaaactcagtttgtggggttgcactggcttagatgccctatacttaaactgcccacgactcattgatctgaatctgaattcttgttcaaatttgcatccagggagactgttgctccagtgccccaatttggaaaatgtgcatgcatctggttgtcaggatatgttaataggggccatccaaagtcaggtccacgatgcttctgctgagatggaaaaccattcacaatctaaacgtctacctgatggctccaaaaggattcgggttccacatttacttagtgaggaagagttccctgaacctgaaaaaaaacggagaaagatcgagagacagctttgtaatgtgcttctggactga

SEQ ID NO: 5585 - DNA, 450 bp, Glycine max
  Peptide Sequence Number=SeqID_122363
atgctacaatctggcttgatttatcaggtcttagcccaaaccattcaggcgcataagtatctcacctcttgtcatctttctatctttgctgatggcacaaaggatgagactactatttggaagcttcctcctaatggaccacctgattcgtacacgggagcctatggtgggatcattcatgatttgaaaggaaagattctgagctatttttccaaacggctaggctattgtagtgttatcttagcaaaactttggagcttgaagtatggtatccaatctgccttatccaaaatggatgtgcttgaggttgtgcaaatggttgaagggatcaagaatgctcctcaatctttgagacctttaatcttggatattaggaggatgcttctggcacatgggaggctttattctcttgtgcacattaagagggaagccaattttgctgctgactag

SEQ ID NO: 5586 - DNA, 309 bp, Glycine max
  Peptide Sequence Number=SeqID_122364
atggtggcccaagcccgggctgttgatatgctcgtggagacgtcatcatcgcgattgtggatggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaaccccatacctgtcgggacccgaaagatggtgaactatgcctgagcggggcgaagccagaggaaactctggtggaggcccgcagcgatactgacgtgcaaatcgttcgtctgacttgg

SEQ ID NO: 5587 - DNA, 111 bp, Glycine max
  Peptide Sequence Number=SeqID_122365
atggggggtggaaatgagtcgagcagcttatcgagggtctttggctcggtctatgtaaggctcggctcgacttggtttgtttaccataaaggtcaaactcaagctttttaa

SEQ ID NO: 5588 - DNA, 393 bp, Glycine max
  Peptide Sequence Number=SeqID_122366
atgaaactaccagaaaatgcacaacaactgccacttgcagacatggacaaatcaagtgaacaagcagcagcgactgagcctcagagtagaagaagaagaagcaactcagcgtgggaagaagaagaagaagaagcaaccagcagcttcgtaaaccctaatttttttggggaagaagaagcaaccttgcgtcaaaataggggaggagcttgccacccagctcgcccaggcgagcaaggttgcttcctccagaagcaactgccttctggaggaagaaactggaaagcccaactttcgaagaagttacggaaactcacggattgcgcaaaaacacctccttttgatttccgtcacattacggaatttcacggatcgcgtaagcctgcttctttttga

SEQ ID NO: 5589 - DNA, 756 bp, Glycine max
  Peptide Sequence Number=SeqID_122367
atgaaaagacttttcagactattaattattttgcttgtcattttgctgctggcggcggtgctgtggtggttcttcgggcgtggtaatccgaatgcgctgtggcaaatcgtcagccaacagtgcgtgcccaatcagcagcagaacaacgatccggcgccctgcttaaaggttgatttaacacagggttatgtgctgtttaaggacagcaaaggcccctatcacgatctggtgatgccaaccgaaaaggtcagcggcatcgagagcccggcattgcagacggagcacgcgccgccttatttcgcccaggcctggaataaccgcgaacatatatccggcgagttgggtaagccgttaaaagatgcgtggctttcgctggcggtcaattcgaaatatggccgttctcaggatcagctgcatattcacgttgcctgcctgcgtcaggatatctataacgcgctggggcaacaggcggagcaattagatcagcagtggcgcccgctggcggtgaaattggtcggccaccaatatctggccagaaaattggcgggcaccgatttaacccaggaagatcctttccgtttgctgcacaactatgtggtcgagcagggcgacagcatcggcaattatggcctggcgctggcggtcagcccgcagggtgagatgctgctgttggccaaccgtttgaagttgaccgatctgaacctgggctcggccggcgaaattcaggactaccactgcgcggtggcggggaactga

SEQ ID NO: 5590 - DNA, 615 bp, Glycine max
  Peptide Sequence Number=SeqID_122368
atgggcaaatccctgcattatctcgacgtgggctcaggctttccgttgctgctgggccacagctatctgttcgatctgaacatgtgggcaccgcagttcgaagcgctggcgaaacgctaccgcctgatcgtgccggatctctggggccacggcgactcaccggcgctgccggccgggcgaaacagcctgtcggatatcgccgccgatcatttggcgctgatgaatcgcttggatattgaagagttcggcatcgtcggcctgtccgtcggcggcatgtggggcgccgaactggcagcactggcgcctgagcgggtcaaggtgctggcgctgatggacagctatctgggcgacgaaacgccggaggcgcggcagcgttatatgggcatgctggcggccgttgaacaggccggcgccatcacctcgccgttgctggagtatatcgccgcgcagttttattccgacgaagtacccgatgcgttgtcgcaaccattgttggcccatctgcagagcctgcccgccgctcgcctgcgcgagagcatcgtcccgctgggccggatgatcttcggtcgccccgacaagctggcgctgctggaaaacatcaccgccgccagcatc

SEQ ID NO: 5591 - DNA, 297 bp, Glycine max
  Peptide Sequence Number=SeqID_122369
atgaggtcagacaccaatattggtgttcaaggaagggcctcatttctgttgatagcttgcgaaaagagtggtgagtataggcctaagaagaatgatttggtaagaacatgcactggcagtagaaaatgtggatgcccgtttaagttgcgtgcgaatacctacaaaacaaataggtacaaactgtcattgcttgatattgttggtgttacaccaacaggaatgacattctccgttgcttttgcttacttggaaggagaatatcttaataatgttgtttgggctctacagcagttttag

SEQ ID NO: 5592 - DNA, 339 bp, Glycine max
  Peptide Sequence Number=SeqID_122370
atggcacgcaaaccgaggcaggattttagcgtttcaaaggtcagattttttctcacttttgtgactgagtatgggtcacagtcaaaaagagaaaccccacaaaatttcagaacagctctctctctccctctccctcacgttgcctttcttctcctccattctccattgaaaccccaacaaagctccaacctttggtgctcatttctgctccaaatcgcgaaagaagggcattttcggggtcgtgaagtgcgtggctacgagtgggacttcgaaaatccaggtttgggtggacttctttctctcttaaatttcgtgggtatggggttttgggagatatga

SEQ ID NO: 5593 - DNA, 409 bp, Glycine max
  Peptide Sequence Number=SeqID_122371
atgagtcatcattcatctagtgttaatggcgagggtactagtcataaggaccctctatctagaatcttagatgagttgagttccctcaagttatgcaaagaaaaaatagaaagaaaaggaaaaggaaaaggaaaagagaggacctcacttccagaggagaaaaaaaaggaaagaaagcctcaagaggctaacattaacctctcatacttccatgggaaggacaatgtagaggcttacttagattgggaaataagggtagagcaacaacttaaaaggaagtttacttcaaaatcttatggctctcactcttatccaaagaaagaccaaggccaaggcatcttaggggcgacaccttctaagcccaaagatgataagggaaagacaatagaaaagcaaccccccaaggcta

SEQ ID NO: 5594 - DNA, 1143 bp, Glycine max
  Peptide Sequence Number=SeqID_122372
atggaggcttccctgtctaaagtctatcgtgctttcccagactgctctgctgtgggtgctaagcttcatacaatgctgcgtcaggctgaagagcaagtccgttctcagagacatcaagcaacatatcttgttcatcttgctgcaaggactgccccaaaaggcctacactgtctttctatgcggttgactgcagaatactttgccttgaggcctgaggagagaaagcttccaaatgaaaataaaatttatcatcctgacctttatcattatgctgtcttctctgacaatgttctggcatgtgcagcggttgttaattctactatctctactgccaaggaacaggagaaacttgttttccatgtattgaccaaatcactcaacttaccagcaatctcaatgtggttcttaataaatcctcctgccaaagctacagtccacatactgagcatagacaactttgaatggtcgtccaagtacaatacctaccaggaaaataattccagctatccaagattcacttctgaactgaactacctgcatttctaccttccagacatttttcctgctttaaataagattgtacttttggatcatgatgtggtggtgcaacaagatctcagtgaactatggaatatcaatatgaagggaaacgtaattggagcagttggaacttgtcaggaaggaaaaatcccattttataggattgatatgttcataaacttgtcagatccattaattggaaagcggtttgatgccaatgcttgcacatgggcctttgggatgaacttgtttgatttgcaacagtggaggagacataatttaactgctgtctatcagaattatgtgcaaatgggtttgtggaacattggaagtctacctttaggctggctgactttctataataagacagagttgttggatagacagtggcatgttcttggccttggttatagttcggatgttgatcgaaatgagattgagcaggcttccgttatacactatgatgggcttaggaagccgtggctggatattgcaatgggaagatataaaatgcaatctccaggcatagttcaaaattcaaagttccctctacctgacatgacggggattctgttgtcgacaagcttgatggcacattcatga

SEQ ID NO: 5595 - DNA, 555 bp, Glycine max
  Peptide Sequence Number=SeqID_122373
atgtcgttcattaacccttcaccctcttccacctcacgtgcaatcgctccctccggcttcgccacgcgccggccatgggaggagttcttcgcgctccactcgttcacgcgcccctacaccctcggcgaggcctcgctccgcgtgaagcgcaacctcggccacttccgcgtgaactacgccatggccgtgctcctcgtcgtgttcctcagcctcctctggcaccctatctccctcatcgtgttcctcgccgtcttcaccgcgtggttcttcctctacttcttccgcgacggccccgtcgtcgtgctccgccacgagctcgacgaccgcctcgtcctcgcggcgctcaccgccgtcaccgttgcggccctcgtcctcaccggcgtctggctcaacgtggtggtggcgctgctcgtcgcagcggcggcggtggctgtgcatgcggcgcttcggagcaccgacgatttgtacgtggaggaattggaagtttccgatggaggtttggtttcggttgttggtggtagccctacgaaacgaacagggtccactagaatatag

SEQ ID NO: 5596 - DNA, 1098 bp, Glycine max
  Peptide Sequence Number=SeqID_122374
atgacaggaagaagaacaaaacctgcaagaaaggctagtggcctgcagggatctagtttctccattgagaagctcattaaaaaagaagaggaattactggaagatcaccaagataattcatgctcgcctgacacttcaaacaagtctgctaagaatggtgggcagaatggtgctgaaccacacgaagcaaaatgggatctttggaaaactttgaattatttagcagaggctgcaagtaggagtaagccttttaagtctaatgtgcaagcatctgatgctaaactagaatccatgaaagtgactgacagtgatgctaaagtgctgaaagccaaaattaaggaaaagaagcgcaaggcaaaagtcgaagatgaaaagattatcactgatcatgtctcttctgatacagcaaaacccaacaaattgcgaagagttcgcccaagaaaggaacctgtttttggagaatctagaatatcacctcaggctgttctggatgctactgacagaaatctcttatggaatgattcaatttggttctccttagcagcttctgaaaaccaggaaggagatgcacctttaccgcaaattccttcaaattatgtaagaataaaggctaccaccaacaaccgaaaccaaacctccatcggaaacttccaattcctccacgtacaaatcgtcggtgctccgaagcgccgcatgcacagccaccgccgccgctgcgacgagcagcgccaccaccacgttgagccagacgccggtgaggacgagggccgcaacggtgacggcggtgagcgccgcgaggacgaggcggtcgtcgagctcgtggcggagcacgacgacggggccgtcgcggaagaagtagaggaagaaccacgcggtgaagacggcgaggaacacgatgagggagatagggtgccagaggaggctgaggaacacgacgaggagcacggccatggcgtagttcacgcggaagtggccgaggttgcgcttcacgcggagcgaggcctcgccgagggtgtaggggcgcgtgaacgagtggagcgcgaagaactcctcccatggccggcgcgtggcgaagccggagggagcgattgcacgtga

SEQ ID NO: 5597 - DNA, 1685 bp, Glycine max
  Peptide Sequence Number=SeqID_122375
aagtcaatagcacgcttagtagagaagtggaatggagcaaccctaggttgcttcaggattcaaatgtcggagtgattttcaatagctgtcattgcagccaaagtagctgcgattctgggctaggtgcacctacagggtttggtggttctgtacaacactcttcatcaaacaggagggattatgatgatggtgggtcaccaaagaggaacctcagtttggatggtttacctcattttgagaaaaacttctacgttgagtcaccagctgtaagggcaatgacagatgctgaagttaatgagtaccggcagcagagggaaataactgttgaaggtcgagatatcccgaaacctgtcaagtcctttcatgatgctggttttccagaatatgtaatggaagaaattacaaaagctggctttactgaacctacgcccattcaatctcaaggttggcccatggctttgaaggggcgtgatctgataggaattgcagaaacaggatcagggaagacacttgcttacttgttgccatccattgtgcatgttaatgctcagcctattctaaatcctggagatggaccaattgtgttagttttggctccaactcgtgaacttgctgtccaaatacaacaagaggctactaaatttggtgcatcatctaggattaagagtacatgcatctatggtggggttccaaagggacctcaggtgcgtgatctccagaaaggtgtcgaaattgtaattgccactccaggaaggttaattgatatgcttgagtcaaatcataccaacttgcagagggtcacataccttgtattggatgaagctgataggatgttggatatggggtttgatcctcagctacggaagattgtctcccagattcgtccagatcgtcaaactttgtattggagtgctacctggccaaaggaggtcgaacaattggcaaggaagttcctttataacccatacaaagacatcatggatggcagccgaatactgatatttatggataccaaaaaaggatgtgatcaaatcactaggcaactccgcatggatggatggcctgcactctcaattcatggagataaaagtcaagcagaaagagattgggtgctctcagaatttaaatcaggcaaaagtcctattatgacggcaacagatgttgcagcccgtggtctagatgtgaaggatgtgaaatatgtaataaattatgacttcccggggtcacttgaggattatgttcatcgcattgggcggacagggagagctggtgcaaaaggaactgcatacacatacttcacagctgctaatgccagatttgcaaaggaacttatagccatactcgaggaagctggacagaaagtgagtcctgaattagcagcaatggggcgtggtgcacctcctccaccttcaggtagtgagagacaagaaaagaaaagaatgagtgaagaaggtcctccaaagctatataccgacaagccccgaaaagtttgtggctttggtaacagcgcgattgaagcagtttcgggggcaacagaaatcaaacgcgttctcctcgccggcggcgatggggacacacgccgctactccgccgccacctccgccaccgccaaaggaaccctttattcggcgctacaaattcgtttggcctatgcttttggctgtgaatcttggtgtcgcaggtga

SEQ ID NO: 5598 - DNA, 1272 bp, Glycine max
  Peptide Sequence Number=SeqID_122376
atggacaatatttggattgtgtttgtgacagtgtttctcttatgcactgtgatcctctacaggaacaggcttagccttatgcttaaatcaaaacgtaagaataagcttccattaggcactcttggatggccttttatcggtgaaaccgttgagtttgtctcttgtgcttactctgatcgccctgagagcttcatggacaagcgacgccgcatgtatggcaaggtgtttaagtcacacatatttggaagccccacaattgtttccactgatgctgatgtgaataagtttatcctgcaaagtgatgcaaaggtttttgttccctcttatcccaagtctcttactgagttgatgggagagtcttctattttgctcatcaatggaagccttcagaggagaatacatggactcattggagctttcttcaagtctcaacagctaaaggctcagatcaccagagatatgcaaaagtatgcccaagaatccatggcaagttggagagaggactgccccatatacatacaagatgaaacaaaaaaggcaaaaaagacaatggtgaaattagtgaagagaattatcctagctaaaagaaatagtggcatctgcaaagttccagaagatgtggtggatgtccttcttagtgatgttagtgaaaaattaacggatgatttaatagcagataatattattgatatgatgattccaggggaagactcggtgccacttcttatgactctagctacaaaatatctatcggaatgtcctgctgctttgcaacaattgacggaggaaaatatgaagcttaagaaacttcaagatcaggatggggaatccttgagttggaccgattacttatcactgccatttactcaaacagtcatcagtgaaactttaaggatgggaaatattataattggagttatgagaaaggccttaaaagatgttgaaataaaagggcacttaataccaaaagggtggtgtgtgtttgcaaattttagatcagttcatctagatgacaaaaactatgaatgtccatatcaattcaatccttggaggtggcaagacaaagatatgagcagttgcaatttcactccttttggagggggacaaaggctgtgccctggccttgacttggccaggctggaagcttccatcttcctacaccactttgtcactcaattcagatggcatgctgaagaagatacaatagtgaactttcctacagtaagaatgaaaaagaggatgcctgtgatggtaaggagagtggaatcttaa

SEQ ID NO: 5599 - DNA, 252 bp, Glycine max
  Peptide Sequence Number=SeqID_122377
atggctttattactagatatgtcaacattgaaggctgcaaatgcagatgctgtctttgaagatttgatttggtggcatttgactggtgattgggaagaggataatgaccttgagggaagtttatatttgcatggagaaaccaaatcattggcaataatcttccttgtagaagcaagcttcatgatgatgaatcaagttgattcaagtagttttgatgatgacaaagatgatgacaaaaagcccaaagaatga

SEQ ID NO: 5600 - DNA, 1281 bp, Glycine max
  Peptide Sequence Number=SeqID_122378
atgaagtttgggagtgcattcatgagtatttttacaaacaaactatcaccacagcaaggcaacttcgcactgaattttgagcaacgactcttgcggatttgcgcaatcgcagattctcttgcctctgttggaagtccaattatgcttcaggagcatatcgattccattcttgaaggtccctcactgaattatcatccgccattattgaaagcaagttttaaccaccgcggacatacaccaccataccaaaaatcactccgtcataccgaaaattgcctcactgcaacaaaaatagcacctttgccgattacagtaacagagaaagagttctttaaagggggtggggaccattgcagtcccatgcccctatttatacaaacccataaggcacttgggttcgcgaaacgagttagggcaatgattgcaactcagaccctagaacacacatgtgacctctcaccggattatcaacctatcaatcaagttgaggtgccgttattagctcatgaatctcgcttgaacaagttcaagaaatctctttctgattctccctcaattaacctaactcaggtgccaaacaagcaggatcctgaaaatttctccaatttcaaggtgggtctggctgtggaggaggttacaatggtggttttaactgcaacaacgattgtcatggtggcatcagtgttggtgctggcagtagtggcgatggcggccgaggacaagtgctatgttgaccaatgttacttctcagccaacaataattggattccagattcagacgctttgtttcatgtaattggagagtctcaaaatattcaatttgagccctttgaaggacctggccaaatcttcattggcaataatcaaggtttgcctatttccacctctggttcttcatccttcatctctccttataacactaaagtctctttgtcccttcagcatttattgcatgttcctaatatcactaaaaatcttattagtgtcagccagtttgccaaagataaggtcttacttcaaggcaatgttggtcctgatggtccatacagcttctccaacatcaagtttcaacatccttggtctgcatcttcagctcttgcttgtatctcaactgctgaaaagtcctctttgacttcatgtaataagtctgaaaaatccattgtaaattcatgtactagaactagttctctatggcatgatcgtctaggtcatcctaattctcatgtactgcaattagtcttgcaacaccgtaaaatacctacatctaataaaaattcttag

SEQ ID NO: 5601 - DNA, 225 bp, Glycine max
  Peptide Sequence Number=SeqID_122379
atggaagcgtgtgaagaccaaaacgcgattctcccagaagtctccaacaatttttccaatgatgagtctccaagtgactctagtgatcttccaaaagagactaaggatcatcttcctccgctaccaaacattgacaaagtagaagcgattcttaaatatgagtttaagaataagtgcttattggaagaggtcttcacttacacttcctaccctaatgataagtga

SEQ ID NO: 5602 - DNA, 725 bp, Glycine max
  Peptide Sequence Number=SeqID_122380
ggctacacgccctcgccgtcagaggactacacgtcctcaccttcagaggactacacgtccttgccttcaaagggctacacgtcctcaccttcaggggactacacgtcctcacctttagagggctacacgccctcgccttcggaggattacacgtcctcacctttagggggctacacgccctcaccttcagaggactacgcatcctcaccttcagagggctacacgccctcggcttcagaggagtacacgtcctcaccttcagaggactacacgtcctcgccttcagaggactacacttcctccactttagaggactacacgtcctcaccttcagagggctacactctctcgccttcagtgagctccacatccgcaccttaagagaatttaaggggccagtactttccttttatcagttcctgggccaccctctgatccccccagcaaggtcacgccatcatgacattgagatcgcacccgcaagacacccagtggacccggagaaattcaacagggtcttggggtttccagctctgattacgggcctttgtcagttctacagagtgcccgtcgcccccaacaaggtcatcaggcccctattaaccggactttcatcgagaagtactgcgcccctaagcaggcgcagggcgaggcatcacagtagttggcaacaggagcaccaccgccacctccagagcccctcagctcatccacaaaaaggttag

SEQ ID NO: 5603 - DNA, 768 bp, Glycine max
  Peptide Sequence Number=SeqID_122381
atggcttcaaactctgcggcggaaggagtatcaatgggcgacgattacgaagccttgattgcaaccaccgacgcggagcttctgaagcgagcatggcgcaacgagaaggcagcccccgagattctccgctacgaatctgatttggtttcccgcgtcaagaaagtcattcaattcctggaagaaactgtggaggagaaatccagtggcggtactaatcctctttcagtgtctctgtatcagatggacttggatagaactctctttctgttaagatcttatctcaggatccgcatccagaagtttaaaacccttgaaaacgaccggcgtggccgcggagagccgaaattccttgatgttgcgacagaaattgtagctgccaaccgatttttaaaaccttgggaaggaatcaggggtaaaagaattgaactaattgaaaagttcgtgttccacatccaaaaaactgaagaactttggaacaggctatctaaagacgagaaagattttgccaaagcgtgtgaaaatgacctaaagcaacatctggatgagagcgttctgttgaagttgcctaaagattataagtctgttctgaggcaatcttcaatgagtgaagaggatgacatggtcccagaaccacaactagacacatttgttttgtgtagaagtaaagagtatctcacgggcattcagctcgaagatggacctgttgatgacaggcaaattctcttgtacttggatgaattaattctgctctgccttgaaaaaggttaa

SEQ ID NO: 5604 - DNA, 528 bp, Glycine max
  Peptide Sequence Number=SeqID_122382
catgacaacaacctatggcacgatcccaacctcgccgcctccgaacctggagtacatctcacgcgcgaagcagcggatcaaggccgggctggggacgcggcggccgtggaaggcgatgttcaactacagatcgctgaaggtccctggcggcggcgtgccggaggcactatcgcggattcggatcaacgtgtcgtatttccgcatgaactacgcaatggtgacgctgctgattctgtttctgagcctcttgtggcacccgatctccctgatcgtgttcctcgtcctcatggcggcgtggctgttcctctacttcctccgcgacgagccgcttgtggtgctgggccacctcgtggacgaccgcctcgtgctgctcgtcatggcgctgctcacggtggcgctgctgcttctcaccgacgccaccgtgaacattctcgtggcggtggcggtcggggtggtggcggtggtggcgcacgcagcgttcaggaggacggaggatttgttcttgggagaagaggaagaagttgctag

SEQ ID NO: 5605 - DNA, 219 bp, Glycine max
  Peptide Sequence Number=SeqID_122383
atgagtgaaggattcaaaaagaaaaagaacttcaacattgtatgttcgaacaagataagagagggttggaactacttgcagttgacaaggttggataaggggggtgaggtgtggggttggattgggtgtggtatgagttggggtgatatggttcgggctaggtgcaaccaacctagggttttaagagtggttcagtgtgagggtcgaatgtggggataa

SEQ ID NO: 5606 - DNA, 402 bp, Glycine max
  Peptide Sequence Number=SeqID_122384
atgttgggggtttccactagcttgcttatccatcatcgcgaagcaacttggagttgttggagctacctgaagggcaaggatcagctctcagctctattccccaaccctgataaccatcacccttgggtagtgagagaattttcctctagaattcatctgtgtggtcaaataattaacattattcttgccatcgtattccataaagtctcatatgtagttactaagattctagccaacaatcttagacatgaaccctatagggacattgtgcacctgaacacaataagggatcataaagagaggaatcaatgtaggatcttcctttcctttatagcacctagtataaggatgagtttgtcaaaactccatgggcccccatccagaactcagttgtggtcatga

SEQ ID NO: 5607 - DNA, 219 bp, Glycine max
  Peptide Sequence Number=SeqID_122385
atgtcaaagggattgagtatcaggcaagtagttcagaatctgcaaccatgcgagagcgggagctcagagaaaatgagtatgtatggtagaaatgatctattggataacaaaacgatggagaaggagcaaagccaaaacatgcaacaattggacaaggttgtgttgccatgtcccttggacgagactcaacaaagttggctactaggatccgacgaatag

SEQ ID NO: 5608 - DNA, 180 bp, Glycine max
  Peptide Sequence Number=SeqID_122386
atgttgtcatctggttttgacgatactccacaaagtaaatccaaggctactgctacgtggattgttgttaaatgtaatagacaaaaaggaagtgctgcgtgcgggtattacgtcatgcatcggatgtcaactataatcttaggaagtttcaagaataattggaaaacgataattgcttaa

SEQ ID NO: 5609 - DNA, 375 bp, Glycine max
  Peptide Sequence Number=SeqID_122387
atgtgtctactcaatgaggctattagtggattaccatatctactggactcatcagtgagtaatgaaggtgaaaattggagcatgggacaatgccaattattttgccttggaaggtttcttctaaaaaggaatagaattttagttgtagattccattgattctgcaacagatgccattttacaaagggtcctcaggcatgaattctctgaatgcacagttataaatgtggctcacagagttccaactgtaatagacagtgacatggtaaactgttggagtatgatgaaccatcaaaacttatggaggccaaatcttcttcattgtccaacctttgtagctgaatactgttccagctgcagcaggaactccttatga

SEQ ID NO: 5610 - DNA, 366 bp, Glycine max
  Peptide Sequence Number=SeqID_122388
atgactaagacggatagagattgttgttggctgtattcgaatttcacagatcctgaaatacttcgactgctggttctatctatgctgtctttgaatgattatccagtttcatatcatattaaaattagtttaagaatatttttatatgatagtgatgacaacggtgatgataatgatgtcagcagtggcactaacaatagagatattagtgatgatgacaataacaatagtgatgatgacaatgttggtggaggtgacattaatggtgatagtgatattgatagtgatgataatgacgacgtggtggtggtagtgaatattggtggtgacagaccgtggtgttggtggaggtggcattggtggtga

SEQ ID NO: 5611 - DNA, 621 bp, Glycine max
  Peptide Sequence Number=SeqID_122389
atgaagcatgctacaaaaattgaagtgacacaatttgaagtaacggccatcgcagctgcaatagccgacaaaatcacagctggcacggttattactaaagtggctcacataaatcccattttaaccgagaagcggcctaaagcagcatcgcctaggaatgttttagaggatcgatttgggattctgacacctttgaatcagaaccgaaccctaatttcccattcactcatccttccctgcaaaattttcttgccagctgtgacaaacagcaaccatcctccaaccttcgataacattttcaaggttggtcgctccatgccactgtttgggattgacaactatgacacagaaattaaagctaaagaacaggctcttaaacagaatattgagctccatgtgcaaaaagctagcaatctatcagataaccatcatgcttctgctgtcaccaaggggcagaaacaagtcccccagtcaaggctaaggggaaagagtggcctaggccatagaacttggcattcacgcaattctagacttatgcaccatcttgcagtacatgatttctattcctcaagcaaatcttatacttcatcatctatctctcctgttcatttgtcagcatga

SEQ ID NO: 5612 - DNA, 288 bp, Glycine max
  Peptide Sequence Number=SeqID_122390
atggtggtggtccaccctctgacatgtcaggtggcggtgtctatcaccttgtggatatgcatgcatgcttttggtggtgcttgcaaccatgatatgtcagagtggtgtgccctttgctgttgcctcacatctgagtccacgtctctaacatgtcagaaggtggtgcgtctcttgtggtggccatgcattcgggtaatgttcgatccatttgatcaacagttgcatagaaggcaaccatgtggacgagggcttgtgacactagtcggtcagcacaggccgaacgagtga

SEQ ID NO: 5613 - DNA, 845 bp, Glycine max
  Peptide Sequence Number=SeqID_122391
caccgccgcacatcagcgctcgcaagtctagcggtcaggctgcgcgtatcccaccacatcccgccgcgcttaatgcgccgctacagggcgcgtcccattcgccattcaggctgcgcaactgttgggaagggcgatcgggttttcccagtcacgacgttgtaaaacgacggccagtgaattgtaatacgactcactatagggcgaattggagctccaccgcggtggcggccgctctagaactagtggatcccccgggctgcaggaattcgatctttgatcctggaccacgtggaaagagtctctccactgggaccccagatgaacaaagagctcttaatcagttactgagaatgagtgatgttcttcttctaacttctgacgaggctgaggaattaactggcatagaagatccaatattagcagggcaggagtttctcaaaagagggatccgcacaaaatgggtgaatgttattgactctgtcggatgtggagacagttttgtagctgctattgtctatggttttatacataatatgccactggttaatacattggcaattgcaaatgcagtgggtgctgcaacagccatgggctgtggtgctggtaggaatgtagcaacactggagaatgtagtaaatatattaagatcatcaaacctcaacgaagatgatgaattttggattgaaatatttgaaaagaatgtggttgctcaggaaataacatatctgtcaaatgttatgaatggaaacaaaaatcgtctcaaccttgtctcatttgacaaggttgcctctgagctcttgcccaagcttgaacttccacaaacagtggggaatgtgccaacttga

SEQ ID NO: 5614 - DNA, 1074 bp, Glycine max
  Peptide Sequence Number=SeqID_122392
atggcagccaagtttccagagcctccctcgccgatcaattttgtagaggatgtcctggacgttggagtaggcatggtgggacccatcgggcatgagggaggggtcgtggtgtgcgccgtcttcgctgtaagagacgcccatgctaaggtagaggaggcctttgtcggcgatagaggttcatgcagtgctcggtgttctcccggccttgatgaggatgatgacggatctggtgtgttggagggagaaaacgaagaagagaagaaagtagaagaaagggctgctgagatgtctggggaagtttttgatggacaagatgcaggctatgtgcctgagaaccctgagtttccgcaaaaccattctgacgaatacgatggaggaaatgtgattgatgactcagggtttccgcaactgcagcctgatgaacacgataatggagggtttccgcagctgcagcctgatgaatatgatgccggagggtttccgcagctgcagcctgatgaacacgatgctggagggtttctgcagctgcagcctgatgaacacaatgccggcaatttagctgaggatggcaatattcctgaacataattttgacgggaatgatgttgaagggttgcctggaaaccctgatttgccttctcaagagcatgctgaggaacaaaatattggaggagatgtgactgagaattttggctctgaggaaaagcggggacctgaggaggatttgaaaggaggtgaagtaaagaagtggccagggtggcctggagagaatgtttttaggatgttggttcctgtgcaaaaggttggcagtattattggccggaaaggtgagtttattaggaaaattaccgaagacactaaggctcgtataaaaattctcgatggtcctcctggaacttcagaaagagctgttggaggtgagcttcgcaacaaaatgaatgggcttggctggaaaagtggtgattgggcaaaatggggtgaatttggctgtcatatgcaatttggctgctatttgtgcaatgcaaaaagctgtactatgagtttcttgtggcaaccagcagctgtgatgctctga

SEQ ID NO: 5615 - DNA, 225 bp, Glycine max
  Peptide Sequence Number=SeqID_122393
atgtttgcttgttgggaaatctgcaaaaaagcaggtttaggtgttggtggcgtaataggtggtgccagtggcatgtccatgccaacttttcagctgccaaagaagcatgtaactgatctggaatctgattctctggaacctctgcccgtgattaatcaatcatggcatgaaccgacattggagtctgctttgggaattgggatggccctacgaactcttttttaa

SEQ ID NO: 5616 - DNA, 417 bp, Glycine max
  Peptide Sequence Number=SeqID_122394
atgtgtcatgtctggtctacgattgacacatgtaaatccaaatgcactagagctgctctcaaaaatctcaatttggtagaagatagatctattccaagggtacaagctcatttctttcctaagaatataaacacagatgttagctatagtaatatgaggaaggctgcttcttgggaagatttgactgacaactatttattctgttctaaagctgtagatcctcagtacaaggatttaaggcattttcagtggcattgggaaaagggggagcctgtcattgtcagcaatgtgcttgaatgtacatctggtttaagctgggaaccgcttgtcatgtggcgtgcattacgtcatgtaactaataccaagcatggccaacatttggcggagaaaacaattgattgcttagattggactgag

SEQ ID NO: 5617 - DNA, 906 bp, Glycine max
  Peptide Sequence Number=SeqID_122395
atgaaagcacaacgttttgccctgagcgcactggcactcagcttcggcctgctcgccacgcacgcctttgccgccaacccggaaaccgtcaccatcggttatcagaaagccaacatttttgcactgctgaaatatcgcggcacgctggatgagaccttaaaaaaagagggtatcgcggtgcgctgggtggaattccccgccggcccgcaaatgctggaggggctcaacgtgggcagtatcgatctggccgccaccggcgatgcgccacccgccttcgcgcaggcggcaaaagccgatctgatttatctcggacattcacccgccaaccctaaaaccgaagccattgtggtgccgaaagactcacccatcaaaagcgtggccgatctcaaaggcaaacgcgttggcctgaacaagggttcagacgttaattatctgctggtgaaagcactggaagatgccgggctgaactataaagatgtcacgccggtttacctgccgccggccgatgcgcgcgccgccttccagaagggcgcaatcgatgcctgggtgatctgggatccttacctggctgaggtcgaagccaacgcaggcgcgcgtgaagtgcgcaacgccgaaggtctggtgccgcactacaccttctatcttgccagccgcccgtttgccgaaaaccacccacaaacggctaagcaggtggttgacgagttgagcaagctgagcgactgggccaatcagcatcaggatgaagccgccgcgattctggcgaaatccaccggtctggataaatccatctggcagaccacgctgcaacgcctgccttatggcgcgtcacgcatgtcaccgcaggtgtttgcggaacagcaggcgctggcggacaccttcacccgcgtcggcctgctaccggtgaag

SEQ ID NO: 5618 - DNA, 1653 bp, Glycine max
  Peptide Sequence Number=SeqID_122396
atgaagtggttttcccgaagcgccgtactgttctctgccaaaacctgtctggccgcctttctggctttttatcttgcgctggaactcaacctggacaaacccgcctggtcactgaccaccgtgtatgttgcctcgcagctttattctgcttcgacggtgtccaaatcggtgtttcgtttttttggcaccgtgctgggcgggctgtttactctgttgatctatccggctacggtccagtcgccgatgctgtttagcctgtgtatttcactctgggttgccgtctgtctgtatctctcgctgcacgatcgcacgccaaaaagttacgtcttcatgctggccggctacagcgccgccattatgggctttcccgatgtgacctcgcccggcgccattacctatacggtgatttcccgcattgaggaaatcaccgtggcgattgtctgcagcagcctggtgcatcggctgatcttcccggtttcgatgcgtcatctgctcgaacagagcgtcgggctgtggtatcagaacgcgcgtaaattgtgtagcgagctgatgacggcgatgcccgcggcaaaatcgctggagcgcgaggatattctggtgcagatggccaactatccgctcaacgtcgaaacgttgatcacccactgcgtctatgaaggggatgccgcgcggcggctggtgcggctggtcagcgtgcagtatcagcatctgtcgtacctgatcccgacgctcaccgccattgaatcgcggctgaatctgctggcacagcagcagatccgctttcccgattatgtcgcgacggcctttcagcaatttttacaatggctgaacggtgatgcgcaacagccggtgcgcgatcgcctcaccggcgctcaggagcagctgcagcaggcctggcgcgcagggcagcttaacagtgaagagagcattttgctcatcggcctgctggaacggttactcaattttgtccgtattgccgatgcttaccacagcgtcagcgagcgcgtcagtgactggacgccagcggtgaaaccgggcaaggcgtcacgcgcgcataagcatgtcgataaagggctgttgctgctgtcgtgctttactgccttcatcgctacctttgccagctgcctgttctggatcggcagcggctggcgtgatggttcaaccgcgccgatgatggcggcggtgctatgttcgttcttcgccgggctggatagccccatcgcaccgatgaagctgtttctgaagggcgtactgatctccatggcgatcagcctgatttacgtcacgctgctgatcccgcaggcggtgacgtttgaagcgctggtgatttgcctcgcgccgggattgtttgctttagggctggtgattgccaatccgtccaccaacctgatcggtctcatcgtcgccacgcagatccccgcttatagtgaatgccatgatctccacgctggtgggcattgctgttgcgctggtgctgacgctgctgattcgcaacaaacgcccggcgtggacggccacgcgtgcgcttcgcaaaggcattcgcgatctgctgcagtttattaccgcgctgcgcatgaacaccgccacgctgacggcgcggcagcaatttgtcgcacgcacgctggacagggtaaacgtgattctgccgcgtaa

SEQ ID NO: 5619 - DNA, 396 bp, Glycine max
  Peptide Sequence Number=SeqID_122397
gcgatctatccggagattttgcagctggtgcagccctggttgcgtccgggtgccctgattgtggccgatgatgccgatttcagcccggaatatctggaaatggtccacggcagccgcctctatacctcgctgccttttgctgatggcgtcgaagttgctgcgatgaaggttaccgttccactgttagtgattgcttttgcttcggcgaaagcgggggcatttcaggcgaaaatcgatccgttaaagctggcgctgaaaccggctaacgcacttgccagcaccgatcaggcgcagccgctggcgattgccgaagcgcatgcgcgcctggcggcggcggtgagcggctgtcagtgtccgttctgcacccagatgcggctggtgaatagcgggttatga

SEQ ID NO: 5620 - DNA, 1350 bp, Glycine max
  Peptide Sequence Number=SeqID_122398
atgagttatcaatggctaaccctgtggcgttacgccgacacctttctggaggccgcgtggctcacgctgcaggttaccctgctggcgttcgcgctggcggtggcgctcggtctgctggccgcgctggcgaaatcttcaccgctggcgccgctgcgctggatcagccactgttatgttgagttcatccgcaatacaccggtgctgctgcaaatttttatcatcttttttggcttgccgtcgctcggtatcaccatgagcgcctttaccgccggggtgctggcactgggaattaacgttggtgcctatttgtcggaaaccttccgcgccggtattcagtccgtggcgaagggccatctggaagcggcgtatatcctcggcattccgcgccaccagattttcctcagcgtggtgctgccgcaggctgctcgcgccgtctggccggcgatcatcaataacctgattcagctgctgctcggtacgtcgctgctctcggcgatcgccctgccggagctgaccggtaccgccacggtaattaacgcgcgcaccctgctttatattcagactttcagcgtcgttgccctggtgtatctggtgctgagtaacctgttttcatggcttggcaccatggccggacgccggctgttccacccgccgctggtaacgccggtaaaaaagtccggctggcgtgaaacgggagaatgcgttatgagcgaacttatcatcagctcgctgccaatcctgctgaaagggctggtcatcaccttactgctgtccatcgccgctatcgccggcagcaccctgctcggtttactggccgcggtgcttcgtaccagccgtctgccgatcgccagagagattgccgtgctgtataccgagctgtttcgcggcacgccggtgctgatcacactgatgttcatttacttcggcgtggcctattttggttatgaaatcaacttgttcgccgccggcattctgggcctgagcatttatcagggcgcttacattgctgaagtgttccgggccggcattgaagccgtgccgaaagggcagtgggaagtgtcgtggatcctcggattatcaaaacgccagacgtttctcagcgtagtgttgccacaaacgcgcggcatcgtgctgccgccgctggtgggtcagtatctttcactgatcaaagatacgtcaattgtcagcatgatcggcatgtcggagctgatgcaccaggggcaggcgattgttgatcgcattggccagccggtggtggtttacggcctggtcgccctgctctacttcgctgtctgctttccgctttcccgttgggttcaacatcatcaaaccaggagccagttatcatga

SEQ ID NO: 5621 - DNA, 2229 bp, Glycine max
  Peptide Sequence Number=SeqID_122399
atggggattctggtctcaaccgcagcctgcgcgactgactatccgctcaccgtcaccgacatggatggtcacacgcaaacaatcagcaaagaaccgcagcacatcattctgcaggatgggcgcgatgtgttgacgctggcgctgctcgatcgcgacaatccgtttaaacgatacgcaacctgggatatgctgaagcgccgctggcctgaagcgacaaaaattgttgatatgggcttcagcgatcagggccaggttaatctggaaagcgtgctggcgcagaaaccggatctgatgattgcacagctgcgcgctaagccggcgctggaacaatccggcgtgctgagcacgctgaacaacctgcacatcccggtgctgttcgtcgattatgaactgcatccggcacaaaacaccgccccgagcgtcacgctgctgggcaaagtgctgaaccgcgaaagcgaagccaaagcctacaccgatttttaccagcagcgcttcgaccgcatcacgcaagccgttgcgaaggtcaaaaacaaacccacggtatttatcgaacccattgccggtaacagcgataactgctgctttacccacagccataatggctggggtggcctggtagaagcggtcggcggcaaaaatattggttcggcactgctgccaggcaatgccggctttgtcgcgctggaaaaaatcatcgccatgaaaccggatgtttacatcatgaccggttcaaagcggccaaacagcaatgtgctgccgtttggttacggcgtgcaaccgcaggaagtgcgtgccacgttccagacgttattgcagcgtaccggtctggcgcaaatcgcgccggtgaagcaggggcgcgtgtatggggtgtatcatcacttctacaatcacccgtacaatattatcggcatggaaatcctcgcgaaggatctctatccgcagcagtttgacgatctcaagccggtggcggatttccataccctcgtgaaaaccttcactcaactgccggacgatgccatcgaactgagctatccggacaaccagcggctgccggtcaccgtactctctggctttctcggcgccggaaaaaccactttgcttaaccatattctcaacaaccgcgaaggccgccgcgtggcggtgatcgtcaacgatatgtcggaagtgaatattgatgccgcgctggtgcgcgagggcggcgcggcgttgtcacgtaccgacgagaagctggtggaaatgagcaacggctgcatctgctgcacgctgcgcgaagatttactgctggaggtcaaccggctggcgaaagaggggcgttttgatcatctggtgattgaatcgaccggcatctctgagccgctgccggtggcggaaacctttacgtttgccgatgaagaggggcaaagcctgtccgccgtagcggcgctggatactatggtgaccgtggtggatggctacaatttcctgcgtgactatgattccagcgaaagcgtccgctcgcgcggcgaatcgctcggcgaggaagatgagcgcacggtagtcgatttgctgatcgatcagattgaattctgcgatgtgctgattctcaacaaaaccgacctgattgatgcggcggagcaggcacggttgaccgcgattctgcactcgctcaatccccgtgcgcggattattcgcgcgcagtttggtcaggtggcgcttgatcaggtgctgaataccggcctgtttgacttcgatgctgcggcacaggctcctggctggctgaaagagttgcgcggcgagcacacgcctgaaactgaagagtatggcatccgcagctttgttttccgcgcgcgtcgtcccttccatccgcagcgtttttatcaggtgattacgcagcacatgcagggcgtggtgcggtcgaaagggtatttctggctggcaacccgcccgcgtcacgccggatcctggtcgcaggccggcggcgtcacgcggcaggggctggccgggatgtggtgggcctgcgtgcctgaagatcgctggccgcaggacgcagacacgctgcactacatccgcgaaaactggcatgaaggcacgggggatgcgcggcaggagatggtgatcatcggtatcgatatggatgaaaccgtgctgcgtcagcagctgcaccatgcgttactgaccgatgaggagatggcgctggggccagacggctgggcacagttgccggatccgttccagccatggtttgactga

SEQ ID NO: 5622 - DNA, 393 bp, Glycine max
  Peptide Sequence Number=SeqID_122400
atgacgatcaaacgttatggcattgagggcggtaccggtaccggcgggcaaaaattgccgttcgcccgcgccgttgaggccgatggctggctgtatatctcaggccagacgccgatgcgcgacggcgaagtggtagagggtggcatcatcgaacagacacagttagcgttcgacaactgcctcaccatcatgcgcgaagcgggttatcgcgtggaggatgtggtccatgtgacagcggtgttgaccgacgcgcgttatttcagttctttcaacaaagtattcagtgagatattcagtggtcatccaccggcgcgtatttgtagcgtgcaggatttagtggtcgactgcaaagtcgaagtggacatgaaatgtttccgcgccgaccgtaaataa

SEQ ID NO: 5623 - DNA, 753 bp, Glycine max
  Peptide Sequence Number=SeqID_122401
atgccggatgaaaaaacgtcccgggcacgcggtgttgaccgggttattgatatttttcgtcagctgcatatcgcgcgtcagcctatggcgatgcgggatttaatcgaagcgaccggtgcaccgcgctccagtatttatgagctggtcagtttgctgagtgaagcgggcctggttgagcttgatgcggaaggtgccgtgtttttcggtcgtgaaatgcactattacggtgcggattacatggcccacaacgatctgatccgtcgtgcacatcagcttatggttgagatcgtggcgcgtcatggcgaaaccgtgcagctgtgtatgctggaaggtaacaaatacaccgtggtgctgtcggagagcaacgcccatccgtttaaaatcacctctgatatcggtgtgcgcgtgccgatcacctggacggcgaccggtcgtttgctgctgagtaactggtcggacagcgccatcctcgacctgattccggaggaggattatcggctggccagcggtcagattctcgacaagcagaccttcctcgaagagattcaccgtgccggccagctgggctactgcatgaccgaaggtctgtccgaaagctttacctgctgtatggctgcaccgattcgctcgcgcagcggccaggcggtcgcggcgatctgctttatggtcagccgtgataccccggcggaacgccgacagatgctgttgcaggaactgatcgcgtccgggcagaaattgtctgatttcacctga

SEQ ID NO: 5624 - DNA, 867 bp, Glycine max
  Peptide Sequence Number=SeqID_122402
atgcagcgcggactggcattcagtgcgctgctgtttgtgaacgcctttttctggccatggctggcgtatcagcgtgcgcttcgtgccgaagactcaaccggtaccgaacgccagaatctgacgctggatgccgcctttggcggaatctgggtggcgctgatggcgttaagcccgatgccctcttttgtcatcatggcggtgctggcatcggatcgctatgccgctggcggcggcgcgcagctgattgccgccatacaggcatttttgtgcgggtttattatggtgtggctgctggatggcaccagtgtaaatctggcgttcagcacgcaaaccgtctggctgacactgccgctggctacctgttacatgctggtactcagcgtggcttcgtacaatctcacctggcatttacgcacccgcaaccgtgaactggagcgcatcgcgctgatggatcccggcctgaaaatccctaaccgccgtctgtttgagcggcggctggagagtgagtttcacagcacgcggcgcggcgatagcagcggctatctgctgttgctggatgtcgatcacttcaaagtggtcaatgatagctggggtcatgaggcgggcgattttctgctggccgagatctcgacgctgctgcgcaactatgtcgggcagcaggacattccggcgcgctttggcggcgatgagctgggcgtcatcgtgcatcaggccagcgatgaatcggtgtatcggtattgcgctgcggttagcgccgaatcgttaagcgactggctgcgccatgcggatgaagcgctgtatgaagtgaagcgcgccgggcgcaacggcgtgcgactgtggcaaacgccgctggcccgcgcatcataa

SEQ ID NO: 5625 - DNA, 2181 bp, Glycine max
  Peptide Sequence Number=SeqID_122403
atggcagtaaaaatgattgcggtggatatggatgggacatttctcgatgacaataagcagtacaacgcgcagcgttttgcgcgccagtacgcgctgctgaaggagaaaggcatccgtttcgtggtcgccagcggcaatcagtattatcagttgcagcactattttcccgctatcaaagatgagatcgccttcgtggctgaaaacggtgcctgggtgtccgacagcaacgaagaaattttctgcggcgagctggcgccggaacgtgttcatcaggtgctggatattctcgccaaagaaccggaaatcagcaccgtggtgtgcggtcgcaacggcgcctatgtgcacaagtcaatgccggatgaggtggtcgccatgctggccaatcactatcgccggctggagaagcgcgacagcctgtacgatatcgacgataccattttcaagttttcgctgaatctggcacacgaaggtgtcgaggcgctgctggcgcgtctgcatagcgaactgaacgcgattgaaaacatcatgcatccggtctccagcggatttggatttgtcgatttaatcattcccggctgtcataaggcgcacggcatcgcgctgctgcaggagaagtggggcattgatgattgtgaagtgctggcgattggcgacagcgccaacgacatcgaaatgctacgtcaggcctgttacagctttgccatggccaacgccgctgcaccagtggcagccgtggcgcgttatcggacggaaagtaataacgacgagggcgctctcaacgtcatcgcccgcctgctggcacgcgaaacgccgtttgggcgggctttttccgccggcgtgccgcctgccgcgcgaagattagcttccatctcatccagtgccgcctggttttctaatcccactgatacatctgctcaatcggccgggcgaaggtcatgcccagcgcggtcagccggctacgctgcagttcaccggtacgggcgcgctgtcccggccagtgatacaacgcgtgcagcaccattgtgctccacttcaccgaaaacagatccatcagacggcgcggtggcgaatccgcatagaaaaccatctgccgccttcattcagcccacatcagaatttgaggaaggcatcatgaaaattaacgcactggtggcacaggatgcagcgcaaccgctggctgccggccagattaccttgcgtccgctgcagcagcaggacgtaaagattgaaattctttactgcggcgtatgccattctgatttgcacatggcgcgcaatgagtgggcggtcagtcgttatccgctggtgccgggccacgagatcgttggacgcgtgctggagaccggaactcaggttacgcgtttcaaagccggtgatgtggttggtgtgggcgtaatggtggattcctgccgtgcctgccacttctgccagcagcaggaagagcagtactgcgaagcgggcttcaccgccacttacaacggcatcgataaatacaccaacgacagcacctggggcggctatgcgcaaaatgtggtggtcgatcagcattttgtcgtgtcgatcccgcaaaatctggcgctggcgggcgtggcaccgctgctgtgtgcgggcgtgacggtgtggtcaccgctgcgccattttggcgtcaaagccggcgataacgtcggggtagtggggctgggtggtttgggccacatggcggtaaaactggccagcgcgctgggcgctgaggttactctgtttactacctcgccggaaaaaggcgctgacgcacgtcgtcttggtgcgacgcgcgtggtggtatcgcgtgatgccgcgcaaatggcggcatgccagacctcgcttgatttcatcattgactgcgtggcggcaccgcacgatctcgatccttacctcgcgacgctgaagaccaatggccgtctggtgctggtcggcattcctgatcaaccgcatcagccgccgaacgtcacgccgctggtgtttcgccgtctgagcatcagcggttcatcgatcggtagcatcaaagagacccaggagatgctggatttctgcggcgagcataacatcacggcagatattgagctgatcgccggtgaagagatcgaaacggccttcgcgcgtatgctgaagggcgaggtgaagtaccgtttcgtcattgatatgctggcgactcgctggtaa

SEQ ID NO: 5626 - DNA, 834 bp, Glycine max
  Peptide Sequence Number=SeqID_122404
atggctgaggttatgcagcggcgcccagccggtcaccaccgtgccggttttgcgccggcgcatcagcatcccttccgtcgtgagcgccgccagcgctttgcgcaccgtaccgaccgagacaccgaacttcgccgccagactgttttcactgggcaaaatggtgcccgccggcagttcgccctgcaggatggattcactgatatagcgcttcactacttcgtacagcggagcgccttcgccttcgttcaggcgactgaattgaggaacgtcgaaaattcatcactacagcgcgctctgacccatatcgccgacgatcaggcgcagattcttgacgatctgcaacgcatgctggcggtggatacctgcttcccgcccggactgggttacgccgaattcgccgacctgctgagcacgatgctgcagccgatgcagttttccctgcagcgcgtttcggtgcccgacgcactgtggcagacgccggacggcagcgcgcggggcgagcgggtgaatctgctggccgcgctggatgccggcgcgtctgaaaactgcaatctctactttcacaccgatacggttccggccggtgatggctggcgctttccgccgctggcgctcagcgtggcggaaaacaagctgttcggacgcggcgccgcggacatgaaaggcaccatcgtggccgcgctggctgcggtgcgggccgcgcagcgctatcagctcagcctgcgctataacccggtgtttttactctgtaccgatgaagagggcggcctttatcccggtattcgttatctggcggagcagcagttattccatggtcacctgctcagctcaacg

SEQ ID NO: 5627 - DNA, 306 bp, Glycine max
  Peptide Sequence Number=SeqID_122405
atgccatttcagatcctgtcaaacaccgctgccagcatcaccgatttaaagcgtgatcccatgggaacagtgcgttcagcggaaggggaaaccattgctatcttaaaccgcaacgagcccgctttttactgcgttccaccggctttcgttccttccgctgaaaaggagtggaagaaactgggtcatccggtgcgtgagcagtttaagaaaaagctggatgaaaccatcactgtcatggtattaggtgtgggtaaacgcgaaggcagtcaggtctatgcggatacggaatacagattgcctgagtaa

SEQ ID NO: 5628 - DNA, 1221 bp, Glycine max
  Peptide Sequence Number=SeqID_122406
atgaacacgctattgactcagctgccagcggagcagcagggtggatttaacgcgctatggcaggataccgaacgttttaaagatttgagcctgcaggcggcagcgatttacggccagttgcgtgtcgcggaaaacaccgtcaaagtggcgggcgataacagcagcgcggcgatcaaacagatcatcgccctggttaaggcgcgtaacgatgaactggctaatgggtcagcggcgctctcgctgctgatgggcagcctggcgatagcgctgggtgtgctggtggcctggactatcatccggcagattacgcgcccggtgtttcacaacctcgcgctggccgaacgcattgccagcggcgacctcagctcgcagtttgtcactaatcgccaggacgagctcggccagctcacctctgccatgggacgcatgaatgcgcggctgcgcggcatgattggcgaggtgctgcacagcgtcagcaatgtgtcgcaggctgccagcaccatacaccagggtaacctggagttgtcgtcgcgcaccgcccagcaatcggctgcggtggtggaaaccgccgccagcatggagcagctcaccgccacggtaaaaaataatgccagcaatgcgcgtctcgccagccagatcgcggcggaagcgacgcataacgccagtcagggcggtatcgcggtgcacaatgtcgtcagcaccatgggcgagatctctgatagttctaagaaaattgccgagattactgcggtgatcaacagcatcgccttccaaaccaatatcctggcgctcaacgcggcggttgaagccgcccgcgccggcgagcaggggcgcggctttgccgtggtcgccagcgaagtgcgtaatctggcccagcgcagtgccggagcggcgaaagatattgaacgactgattggcgaatcggtagggcgtatcagcaacggccatcagcaggtggcgcgcgcgggtgaaacgatggagcagattgtcagtagcatcgcacgcgtgaatgaaatcatggcggagatctcggctgcttctgatgagcagagccgcggcattgagcaaatcgcgcgcgcggtaggtgagctggacggtactacccagcaaaatgcgtcgctggtcagcgcgtcatcccattccgcacaggcgctggaagagcaggcattcatgctgcagcggctggtcagccagtttcgtttgcagggagctgcaagctaa

SEQ ID NO: 5629 - DNA, 681 bp, Glycine max
  Peptide Sequence Number=SeqID_122407
atgaattactcgcatttcactattcgcgttcaggagcagacgatggccgcacaacgtaacgctaagatttctgaaagaaaaaagccgcagcaggcgcgatccagtgagctggtggcagccattttgcaggcggcgactcaggttctggagcaggaaggtgccacgcgctttaccactgcccgcgtggccgaacgggcgggcgtcagtattggatcgctgtaccagtattttcccaacaaggccgctatccttttccgcctgcagagcgaagagtggcagcgaaccggcgatctgctgggttcgattctgcgcgacagtgcatccacgccgcgtcagcgcttgcatcagctgacctgggcgttcctgcactcagagtgtgaggaggcggcgatgcgcaccgcactgaatgatgccgcgccactttaccgggatgcgccggaagtgcaggctgcgcgcgccaatggcgagaatgtgatgtgcgaatttctgcaacagctgctgccgcagcgggacgcggctgaggtggcgcgggcggcggatttaatcaacagtacgctgggtgacgtcggcaagcatttttccgaatcgccgcgcagcgcagcagaaattcaggcttacgcacgcgatatggcagacatgttctgtgcctggatcagagaaaaaggggccgaattgcagtaa

SEQ ID NO: 5630 - DNA, 804 bp, Glycine max
  Peptide Sequence Number=SeqID_122408
atgaacagctggggtcaatcggtaatcggaaacatgcaaaaaaactatgacgcgcacgacgttcctcaattcagtcgcctgaacgaaggcgaaggcgctccgctgtacgaagtagtgaagcgctatatcagtgaatccatcctgcagggcgaactgccggcgggcaccattttgcccagtgaaaacagtctggcggcgaagttcggtgtctcggtcggtacggtgcgcaaagcgctggcggcgctcacgacggaagggatgctgatgcgccggcgcaaaaccggcacggtggtgaccggctgggcgccgctgcataacctcagccatttctttcactattttcgtctgcatgacaaatcgggcggtttgctgcagtcggaaacgcgactgctggagtatcagcacagccgcgccagcgccgacgaggccgataagctgcagatcgcaccaggtgacgcagtgattcgcctgaaacgcctgcgccgggtgaagggcattgcggccatgcatgaaacgctggtgttgcccgccgcgcgtctgcccgactttccgccggcggaacagctaccgcagttgctgtatcgctacctgtttgagcagtacgatgtgcgtgttgcggcggtgcgcgagcagatcagcgccacgctcgctacagaagaagatgccagcctgctggaacttgttctgccgcacgcggtgatggtgatcgatgaggtctcatttgatcaaagcgccacgccggtgattcttgcgcatcaccgtttcagcactgaacactttatgtatgtcaatgagatacgctga

SEQ ID NO: 5631 - DNA, 183 bp, Glycine max
  Peptide Sequence Number=SeqID_122409
atgaccataaattgtctccgcatgtcatcgggctcgccgcctatggatgaccaaaaggtgcgtaatgaccataatttgtctccgcatgtcatcgggctcaccgcctctggattacaaaaggagcagaatgaccataatttgtctctgcgtgccaccgtacatgatcgttgtggatggcaaaag

SEQ ID NO: 5632 - DNA, 1113 bp, Glycine max
  Peptide Sequence Number=SeqID_122410
atgtgcgccatgaaagggttaaaccgcagacagtttatcgccagttcaaccgccctgaccggagcggcgctgctgccctggtcattcagtgcctcggctgccgccgttgccagcgcgaccccgggcggcacgccgcgtaaaggtggcttattgcgcatcagcgttgaccaggcggtcagcgtgctcaatccccatcaggtgcgggttaatccggaatatctggtggcagagctgctgtacagcggcttaacccgcctgacgcaggcgatgaaagcggaaggcgatctggcgcagtcctggcagccgaacgacgacttaacccagtggaccttcacgctgcggcccgatctgcgcttcagcgacggttcgccactcaccgcagcggacgtggtcgccagcctgcaggcactgctggacccgaaaaacgcctcaccggcgctgcacaacatcggcccgattaaaacggtaagcgccaaagacaacaacaccatcctgattgagaccgaggcgccttatgccgatctgccggtgatgctggcctatccggatgccaaaattatcccggcgcatatcgcgcaggggcagtacgacaagctgagtagcgcctcgctcggggccgggccgttccagctggtgtcttacgatccggaacgcaaaatcgtggtgaaacgcaacccgcactattacgacgccacgcggccgtatctggatggcgtggaagtggtggtgtatcccgacgctatcgctgaaagctccgcgctgatcgccggcgataccgatctgatgctgagtgcgcagtcgagcgagtttgcccgcttagccaaatcggcgggcgtgctgccgctgcgcgtggcatccggtcagtttcttaacgtcaacatgggctgcgatcaaaagccgtttaatgatgtgcgcgtccgccaggcgctggcgctgtgcgtggaccgccaggcatcggtagattttgtcgcagacggtctgggatcgccgggtaacgacacgccaatcaacgccgcttatccgtattacgcgcagctgacgcaaaaagcgctggactacagcaaagccaaagcgctgctggcggaggccggttatccgaatgggctggattaa

SEQ ID NO: 5633 - DNA, 688 bp, Glycine max
  Peptide Sequence Number=SeqID_122411
atggagatcgcttccggatcaaacggtgccacgtgcgcgccgcccgccaccatcagcagcgccagcagcagaatcagcacacccgccgcaccctgcggcgagcgcagtaatcgtttcagtatttcaggcataggaaatccgcttatcgagcatgacgtaggccaaatccgcgaggaaattcaccacggcataggttgccgcgaggatcatcacgccggcctgaatagtgggcagatcgcgcgcctgtaccgcgacaatcagctcccggccaataccgggaatggcaaaaatctcctccaccaccacaatcccgcccagcaaatagccgacgtcgagcgccacaatggtgatggtgggcagcaggccattgcgcatcgcatggcgccacaggatgcgtcggcgcgacaggcctttcagccacgcggcgcgaacgtagtcggtgtgcagcacgtcaaccatttccgagcgcaccatgcgcgaaacgtgtgccaccagaatcagcgcaacggtgatcgacggcagaatcaggtgctgaataccgctgataaaattttcgctgagcggcacgtagccggtggcgggcagaatctgccagacatcggcaaacagcagcagcaccagcgtggcggtgacgaattccggaaacgagatgcccatgtacgagatcacgctgaccagcacatcggcg

SEQ ID NO: 5634 - DNA, 678 bp, Glycine max
  Peptide Sequence Number=SeqID_122412
atgccgggcgaagtgctggggctggtgggggaatccggctccggcaagaccacccttggctgggcgatcatgcgctggctggccagtaacgcacgcgagcaggcgggtgatatccggctgaacggcgaaagcctgctgcagctgccagcgcaccaactgatggcgctgcgcggtaaaaagcttggcatgatttttcaggatcccagcgcgtcgctaaacccgacactgacgctgggtgaacaggtcaccgaagtgctgcgccgtcatcgtgggctgtcagcgcgcgaagcgcagcagctgggggaatcgctgctgcgcgatgtcgagctgaagcacccggcacgcatgatgcagcgctatccgcatcaggtttccggcggtgagaagcagcgcatcctgatcgctaccgccttcgcctgccagccggactgcctgatttttgatgagccgaccacggcgctggacgtcatcagctcggcgcaaatcctcgatctatacgagcgactgcgcgccgagaccggcgttgcgtcgctgtatatctcacacgatctggcgctggtggcgaaagtggccgaccgggtgtgcgtgctggagcagggccgcatcgtcgagcaggccgcgacgcgcacgctgttcagcgcacccgcgcatgcgtatacgcgcaaactgattgccgcg

SEQ ID NO: 5635 - DNA, 129 bp, Glycine max
  misc_feature (71)..(71): n is a, c, g, or t
  Peptide Sequence Number=SeqID_122413
cctggggatggccagcagcgggcaacagacgcaccgctatcacctctagagttcacctcagctcatccacnaaaagccatcaagcgtccagctcaagacgttaaagaagcgctactaggaggcaaccta

SEQ ID NO: 5636 - DNA, 387 bp, Glycine max
  Peptide Sequence Number=SeqID_122414
atggagttcgcatatcgtgatggccaaaaccaaaggacaccattgccaactttgtgccctatttccacacccgcttatgtctctgaacacccgttacaagggtttgattttatgccaagtggtttttccaacaatgtcctggtgcccagagtttttccaacactgatgtcagtcaatgcagacgaaacattccaacgagatctagagacaaagcatatacaacaagagccagataaggaggaaatcataagagaaatacttgtcaacaagatgacattgacacaacgacaagagttagatgaggaagcaaatggcgacgaagagagcattgggacctcgatgcaaaattggaggggatatcatttcggtgagtttcaatgcctttga

SEQ ID NO: 5637 - DNA, 411 bp, Glycine max
  Peptide Sequence Number=SeqID_122415
atgggatttgcaggagccctaaggaacattgttcgccctctctcagttgcatcatcaagagctttaatgcctcgaatctccatcaatgcttcgatggcaccattttgtcctgcttttccatctccctgcaaacctcctcaatggcttcatcccctttggaatcaattccacagcttgacagacactcgcttccccaagagacgaccctctgaaaaacctcgtcgaaagagagccagcttgagaccctctgggccttatgcttgggttcaatatacaccgtgccaacccatacttccaaataagcctaatgaagggagtgtcaaaaggagaaatgagaagaaacgcatgaggcaacgccgtgcctttatattggtgcgctccccctttaccctgcacacattgaatttttag

SEQ ID NO: 5638 - DNA, 141 bp, Glycine max
  Peptide Sequence Number=SeqID_122416
atgtgggaacaactcagactcattagtcctgaattattgatgcatgcatccttgctcttgcttgtagccacaaagatgtttgcagccaagggacctgagcaacaattcacgattatgacaaagataagatctgcaaattaa

SEQ ID NO: 5639 - DNA, 258 bp, Glycine max
  Peptide Sequence Number=SeqID_122417
atggccaagttagaacctccagaaggatgcagcttccttgatggtcttgaggttgatgcagctcttgatttgagccacacacaaaacatagggagaatgacaaaggctcacttcccacactcagagtttattgtggtttccttgaaggaaggcatgttcaataacaccaatgttcttttccggacaaaatttgtggatgtgtttgcttcatcgatctgttacaagtcttacacttatgttcatcttcagggcaagtag

SEQ ID NO: 5640 - DNA, 741 bp, Glycine max
  Peptide Sequence Number=SeqID_122418
atgtcaaggaagacaatctcactctatgacatcactgcgaatgacaacccaggaagtctcttaatgcaagttcaattgaaaggaaagaacttcgatgagtgggcttgttctcttagatctgctttgaagaacttgtgggaggaattggggaaccatgtgcagattcctgcattcacgtgtggagggtgcacctgcaacttagcatccaagctagaaaagaaacttgaagaagagaaaattcatcaatttctcatggggcttgataagactgtttatgggactgtcagatcaaatatgcttgctcaggatcctttgcctaagcgacctcatggtcgcggcaaggctgaaaaaggaaggacatatggtgccagaggatgtggtgctgtaagtaaagcaaatgcagcccaagcctctacatcagaaccaaaaccaaacattgtgataacagatgctgataaatctgctgtaagtggactcgatgcggagcagtggcaaacattggtgaatctcttaaacgatgtcaaaataggacttgtagaaaagttgactggtaagcgtaatttggaacagtggatcatagaaacaggtgcttctcgacatataataggaaagatagaatgcttgactgatgtgacaactatcctggattatccagtaggacttctggatgaaaagcaaatgtctgctactagggaaggaacaatgatgctgagtgatacattgaaactaagcaattgttaa

SEQ ID NO: 5641 - DNA, 249 bp, Glycine max
  Peptide Sequence Number=SeqID_122419
atggtttctgttatttgggagactgataggaatattatcacggggtccaagcccaaatcgaaatggaatgagccctcacttgtgtattctcgtaagtccaaagggaatagaggcacctctgataccagaacgcatcagagaccatgtgccaatattaagcatttttttcttctgagacatggaagtttgaaactcccccttaccttctcaattccctcctcaatcccctggcctgcctggagagagtag

SEQ ID NO: 5642 - DNA, 270 bp, Glycine max
  Peptide Sequence Number=SeqID_122420
atgcccccctcgtactccctcttgggtaagcttccatcacgaataaacaatgcgagcaaattgtcgtcgcacaaaccaccatcatctcctctaacagtcagcgccactgtgtcatccatgctgagcaaaacctccacattcaatgttatagaactcactattcaacagaacaatgatgaaagatgtcactactcaatggagatggtggtgaaagaagctgctgctgagtggcaacaacagtgtttgatccgtcaacttattcattgttga

SEQ ID NO: 5643 - DNA, 234 bp, Glycine max
  Peptide Sequence Number=SeqID_122421
atggtgaataaggtgaagacaacaccgagactcaaagtggcgcttggggtggaggaatgggaagagtggatggtgctgttcctcactaacccatctcattcccaacataacacaatcacatccaacatggtagccattatgaagagatggagagaagaatccgcaaaaagccttatgttaatctctgtgtccaacaaagcaaacctcttaaaagttttgctccaatggagttag

SEQ ID NO: 5644 - DNA, 1836 bp, Glycine max
  Peptide Sequence Number=SeqID_122422
atggcttatgcgtttaccttttggacttgctatgttttgctaaaggagtatgggaaggttgcaacaatgagacttggctttcttgcagcagaaaagcgtcgtcctgatcaatttacggtgcttgttagaaatattccaccagaccctgatgaatctgtgagtgaacttgttgagcacttctttctagtcaatcatccagatcactatctgactcaccaggttgtttatgatgccaacaaacttgctaagttggttgaaaagaagaagaagtttaaaaattggcttgtctactatcaaaataagcttgaaagaacttcaaaaagacctgaaataaagactggtttccttggtctttggggaaagaaagtggatgctattgatcatcacatcactgaaattgacaagttgtcaaaagaaattgttgaggagagggaaaatgtcacaaatgatcccaaggccatcatgcccgctgcatttgtttcatttaaaacaagatgggctgctgctgtttgtgcacaaactcagcaaaccagaaatccaacactttggttgaccgaatgggctccagagccacgagatgtatattggcgaaacttgccaattccatatgtttccctcactgtcaggaggttaatcatagcagtgacattcttttttctcactttcttttttatgatccccattgcatttgttcaaactctggcaagtcttgatggaatccagaaagcagcaccatggctgaagccacttgttgacatccctttcattaagtccttcattcaaggttttctgcccggtattgtgttgaagctattcctcatcttcttgccaacaatattgatgatcatgtctaaatttgaaggctttggatctatatcttctctggagagaagatcagcttctagatattatcttttcaattttgtgaatatattccttgggaacatacttactggaacagcatttcaacagctgagctctttcattcaccaaccagccgaccaatatcctgtaacaattggcactgctattcctttaaaagcaagttttttcattacttatataatggttgatggatgggccagtatagctgcagaggttttgatgttgaaaccgctaattgtttatcacttgaagaatttcttcttggtgaaaactgaaaaggacagggaagaggccatggatcctgggagtattggtttcaacactggagaacctcgtatacaattgtactttttgttgggtctagtatatgctgcagtgacacctgctgttcttcctttcataacagttttctttggcctggcctatcttgtgttccgtcatcagatcattaacgtatataatcaggagtatgagagtggtgcagcattctggcctgatgtccatttccgtatcgtgatggcactgattgtctcacagatagttttgatgggactcctcaccaccaagaaagctgcttcatcaactccttttctcattgtgctcccaatactaaccatatggttccataggtactgcaaaggccgttttgaatctgcatttgttaaatttcccttacaggaagcaatgatgaaagatacattagaacgggcaacagaacctaacctgaacttgaaaggttatcttcagaatgcctatgttcacccagtttttaaggacagcatggatgacgatgatgacgaggaagatagactcagtatagacttggaaactgaaagtgtgactgtgcgcacaaaacgccaatcacgaaggaatacaccattgccaagcaaaaataatgatgcatcatctccttctctgtctgatggtattggaaatcatccagagccttaa

SEQ ID NO: 5645 - DNA, 393 bp, Glycine max
  Peptide Sequence Number=SeqID_122423
atggagggcattacagacaagctagtactaaatcctaagacactatgtcaaagcttgaccaggcagactcttcaagcacgaagtagttgcactgcatcaaaagagggagctttcaagcaaggattggcaagctctataaagcttccaaactccatgttcactttcattcatcaagtccaacccattatagaaaaagtgaattctgatgatgaggaacctgttgttgctgctaaagatttggccatggaattctatgatggccctcctccatccttggaatataagttttctaaaacaccaatggacagttcctctgatgatgaatctagagatgatttctttcacaagattgaaaacgaagaagaagctgccaaacaaaagagggagaagtaa

SEQ ID NO: 5646 - DNA, 538 bp, Glycine max
  Peptide Sequence Number=SeqID_122424
gaatctgatggatccatagatgatgaagtgacctttatgtctagaaagttcaaaaagatgatggagaagaaaggaaagttccaacactccttcagacgcaaggattcaagattcgaaaagaagaacaaggagaaaagcaatgagatcatctactttgagtgtggaaagcttggacacatgaagaaactaaggaaagaagtagaatgccatactaaagaatttgggaagttcttggaaagttcaaagactctcaccactcttttgaaattccatcaacatccccttgacaagtctagcctgggctttgaaaagggaacaacattctctaagtcacagcctattttgcacaaatttgacttctatggtaagtctggacactccaagttcaaatgcatctataagaagaaacaaatgtgtaagggatggggtttcagctggtaccgagatagtggatggtcacaatacatgatgggggaaaggtctatgttcctagacctaaagccacatgaaggaggaccagttgcctttggaggcatag

SEQ ID NO: 5647 - DNA, 2637 bp, Glycine max
  Peptide Sequence Number=SeqID_122425
atgaaggggttcgtttctcttcttacatctgcagcttgtgagtggcttttgatatttctgctgctactcgatgccttgctatcatatatgctcaccaagtttgcgagctattgccaactgcaaatgccttgcttgttgtgttctaggcttgatcatatcttacgccgtgaaaggccagagttctatgagaacctattttgcagcaatcacaaatcagaaatatcatctctgattttgtgtcatattcatggtaagctagcagatgggcataggatgtgtgatgattgtcttttgtcagtcactgcaaagaccaagtgcaatgcaaaaactcaaagattgttggtggggaaatttgggctggttcttggtggttctggtttcaaaagtccatcactaagcaaagatttgttttttggctctaagggtgcaagactatgtacaagacaatgtacttgttgtggtaagctttggaagtcagatcagaactccccaagatctatccatctaaaatcacatgggagagctgttcttaagccatatattcctttgccatgtgcaccaacgcaacgccgtttaaatcaccaggataacttgaagaaaatgagggataaatttcctggatcagagggaaaaagcagtttccggccactatctcatgttgggtacactgagctgagacttaattccaattctgagtccgaatttccattttctgatgatgatgatgatgttagtagcgtgtatcatgagaacattgaagccagcaatgaccctattgctgttacatctgcaccttcctcaaaatgtattccatgtgatttgaatccgaaagagccgattgatagttctgccaaatccatgcctttgccttcagatcaatgtggggagcctaatgtcagcaaacaacaagatgtgaatgccaattgtgcagtagaaaataatttgcaacaagcaaatcaagagtcattcagttctgatccagctgagctcatttcaatagaggaggtttcaccacctcctattgttaagaatgttcctcatagagaatcagaatttgaagacagtaagattacttctcattctaaggattctcttcctggtcccctatctgagtttatgactttgaatggcacatatgtacatgctggagcatcatcggaaaaatctgcagatgttgcacaagcaagagatactggaatggtatctgagaagaatgaagaagttttacagaagattggtacagaggaaacagcatcaacagacactcatccggtggtatgtgactctgctcctataaatcctaaagaagagaattcaagtaacatgaataagtcctctgtaaccactaaggaaagagaacaaactggttttatcaaagagaagccaactactgaggaagttaataatgtcaaggaagaacaggagcaatcaccatcagacaaatcttctcctaatgggtctaatacatcatcaaatgttcctgtaaatcatgttcactcacctaaggcagatgtcgaggcttctagtttaaacaaagttcaggtatttcgaaagtcatcctcagtggaatctggtcttgattctctggatgaaagcaatatttctgaaattgaaggagagtctaatgatgatagactgaggaggcaaattgagtattacaagaaatgcatgcattctttacagaaggaactggaggaagaaagaaacgcttatgctgttgctacaaatgaagcaatgtctatgatcacaaggttacaggaggagaaggcagcactgcagatggaggctcttcaatatttaagaatgatggaggagcaagcagaatatgataatgatgaattggagaaagtgaatggtctactcacagaaaaggaaaaagagatacaagatttggaagctgagctggaattttatagatcaaacatggcagatgaggagcctatgatccataatatgcataaggaaagttgggatttgaaaggagaaaacgtcactacacaaaacactgttgtgcataacatcataaataccgtaagtagttcaaagaatgctgaggtttccaaagttggtgatggagatgtgactggtgaaaccgcatttttggaatttgaagaggaaaaggaatacatttctcaatgtttgaaaaacttggaagagaatgttcatcaaatttctttgcatgcgcctaatgatagatccgagaaacttgaagtcagtaaatcgaatcaacaaggagcttcaaatggtgaagggcctcaattagatgatggatcagctgaagatgatgatgcttgttctcttagtgccgaaaacaatcattccaaatctcctgaaccacaaatctccacgccgagaagagaagttgagttggttattctagaaaatcaaatatcagaccttaatgaccggttggaagcacttgaatttgatcatgatcttctggagcacctaacaaattctcttcaaaatggcaatgatggaaatcaatttattcaagacatagctcaccgattgcatgagtggtgcaggggtggttttgcggtggtcactaggctagagttaagatttggatttagatctagtcagggtagggtgtgcgcgatgagtaggaatggcaagggcacaagtaatgcctaa

SEQ ID NO: 5648 - DNA, 1291 bp, Glycine max
  Peptide Sequence Number=SeqID_122426
atggattcccttccaacactaacaataaaagtggaaaatctatcactaatcgtggtggaaaagtttgaacacgttgtgataggattggccatgctgttgaaagtcacggagaatggtcaacaacaggcacctgagaatcaagatcttcgtttctctcctcaacagtttcaagccttgctggctttaatacaacaaccaaacaatggcacttcagcatcttccaagtcttgtgtcaatcaaattggttcaatgtcctcttctattattgcaagtatatatgttgtcaaacttccaaatggtcaacaagttgcagccactcattctggtgtaggctcgaaaaccaggaggaagattggtacaattgatgttcatgatggtctttacactcttgttcttcaaccaggttatactcaactggagggtgtcgattttcttgatacattctctccagttgccaagttaactattgttcagctgcttcttgctcttgctgccattcataaatggcaccttaagcaacttgatgtcaacaatgccttcttgcatggtgagcttcttgaagaagtttatatgcagccacctcttggtctacatgtttccaaacctggccagttttgtcgtttacagcgttctctttatggccttaagcaagctagccgtcaatggtatgctaagctttcttctttccttacatctcatgggtataagcaatcagcttttaatcactctcttttcctcaagttttctacgaataatatcactgctcttctggtgtacgctgatgacattgttcttactggtaatgatcttcatgagatttctcgtattacagctcttatggataatacttttaagataaagaatttgggtgatctgaaattttttcttggtcttgaggcattcacttgtgtcaataaatatgttcttgatcttctttctaacaatggcatgcttgcatcacgtcccgtttctactccaatggattatcatactcgtcttcattcatcctctggcactcttctcactgatcccttgatttatcaaagactacttggtcggctcatatatctgactaccacacgtcctgatattgcctttgtagttcaacacttaagtcaatttgtttcaagtcctactatagctcatcatcaagctgcttttcgcgttcttcgatatttgaagggcactcccggtttaggtgttttcttgtcagctgatagctctttacagctcaaagcttttagtgattcagattgggctggctgcgttgattcttgccgatccatcattg

SEQ ID NO: 5649 - DNA, 2151 bp, Glycine max
  Peptide Sequence Number=SeqID_122427
atgaatcccgataagttcacccacaagacaaacgaagctctggtgagtgctcacgaaatagcaacaagcaacggtcacgcgcagttcacccctcttcacctggcgtcctctctgatttccgacaaggatggcattttctctcaagcgctttcaaacgccgccggcgaagaatccgcgcgcgcggcggagcgagtcatcaacaatgcactgaagaagctgccgtctcagtctcctcttccggacgaggttcccgcgagcaatgccctcgtcaaagccatccgcagagcgcagactctgcagaagaaacgcggcgacacgcacttggccgtcgaccaactcatcctcggccttcttgaagattctcagatagcggagttgctcaacgaagctggcgtggcggcttcgaaggtcaaatctgaagtggagaggcttcgtggcaaggaagggaagaaagtggaaagtgccactggtgattcaacctttcaggctctgaagacctatggaagagaccttgtggaacaagcaggcaagcttgaccctgttattggaagggatgaggaaattcgaagggttgtgaggattttatctagaaggacaaagaataacccggttttgattggagaaccgggagtgggaaagaccgcagtggttgaagggttggcacagagaattgttaaaggtgatgtacctagcaatctttctgatgttaaactcattgcattggacatgggtgcattggttgcgggcgcaaaatacagaggggagtttgaggagcggttgaaagcggtcttgaaggaggtggaggatgctgaggggaagcctatgcttgcgaggggtcagttgaggtgtattggtgccaccacgcttgaggagtataggaagtatgtggagaaggatgctgcgtttgagagaagatttcagcaggtgtacgtggcagaaccgagtgttgttgacactattagtatacttcgtgggttgaaagagagatatgaaggtcaccatggtgttcggattctggaccgtgctttggttgtagcggctcagttgtctagtcgctacatcactggtcgacatcttccggacaaagcaattgatttagttgatgaggcttgtgccaatgtgagagttcaactagatagtcatccagaggaaattgataaccttgaaaggaagagaatgcagctagaagtggaacttcatgcactagagaaagagaaggacaaagctagtaaagctcgtttagtggaagtgcggaaagagcttgatgacttgagagacaagttgcaacctttgatgatgaagtacaaaaaggagaaggaaaggattgataatatacgacgactaaagcagaaaagggaagagctgaacttcgctctacaagaggctgagaggcgatatgatcttgctagagctgcagacttgcggtatggggcgattcaggaggtggaatctgcaatacaagagcttgaagggaacaatgaggggaatgtaatgttgacagaaactgttggacctgaacacatagccgaggttgttagccgttggactggtatacctgtgacaaggcttggccaaaacgataaagaaaggttgattggtcttgctgacagattgcaccagagagttgtggggcaagaccaagcagttaatgctgttgctgaagctgtgctgagatcaagagctgggcttggaagacctcagcaaccaactggttccttcttgttcttgggtccaactggtgttggcaagactgagctttcaaaggcacttgctgagcaactcttcgatgacgaaaatcaattggtgagaattgacatgtctgaatacatggaacaacactctgtttcgcggttgattggtgcaccaccagggtatgttggacatgaagaaggaggtcaactaactgaagctataaggcggaggccttatagtgtggtactctttgatgaagtggaaaaggcacacacatctgtgtttaacactctccttcaagtcttggatgatgggaggttaactgatggccaaggccgtactgtggacttccgaaacactgtcattatcatgacctccaaccttggtgcagagcatctcctcactggactttcaggaaaatcttcaatgcaagtagcccgtgatagagtgatgcaagag

SEQ ID NO: 5650 - DNA, 1512 bp, Glycine max
  Peptide Sequence Number=SeqID_122428
atggttgggtcacccagggatgaaaaagatgagactcgggacttgcattcagccccagaaattcgtgatgtgtttggtgattttgatgatgatgaagaggaggaaatggggtatgcaatccagcaggacattgaacaagattcgaatagataccctatggaggaggaagggagttacggaaagaatctgagacctgaagatatacttgctgatgaagatcatcagtatgaatcggaggaggaaaacattgagataaaaactaaggagaagccacttggcccccctttagagttagaggttccgttacgaccacctccagctcttccagaaaagatgaacatgattaaagtttccaatattatgggtgttgatccaaaaccatttgatcctaaaacatatgtggaagaggatacttttgtaaccgatgaatctggaaccagaaaacgcatacgtttggagaacaatattgtacgctggaggactactaaaaatcctgatggcacaacatcatgtgaaagcaatgctcgctttgtgagatggtccgatggcagcctgcagttgttaattgggaatgaagttcttgacatatcagtgcaagatgcacagcatgatcaagcacatcttttccttagacatggaaagggtatcctccaatcacaaggaaggttgttaaggaaaatgaggtttatgccatcttccttgtcatcaaattctcatcggctgttgactgcccttgttgactcaaggcataagaaggtttttaaggtgaaaaactgcataactgacattgatcctgagagggaaaaagaggaaaaagagaaggctgaaagccaaaatatccgcgcaaatgtgcttcttaaccgaaagcgtgagaaggtgaatcggaagtatactccagctgtggagaggaggcgtcaactttctcctgggtttttagaggatgctttggatgaggaggatgaagcggattattatgataatcgtcgttctcagcatcgctttgaggatgatttggaagcggaagcccgagcagagaaacgaattatgaatgctaaaaagtcgcagggacctaaagatatccctcgtaagtcttccttcccacctgctaaatcctctcggaacccaatgggttacccagatgatgagagagaggagtctgagtatgaaactgaggaggaagatgagaggcctccttcacgtaagagggatgaggatactgagccagagtatgaggatgaggaagaagaggaagaacactatgaagaagctgaacaagttaatgatgcatcagatgaggaggaagaggaggactactgtacatgtgtcctctgtgtgcttgtacatcttgttgggggatgttcttatgatgaatgtatggaaccaaagcagaagaacaaggagtttagaggcagtgccaaaaggaagggatttgaatctgatgaggactctcctccaaggaaaacaaccacccatcggcggatggcggttgtgtacgatagtgatgaggactaa

SEQ ID NO: 5651 - DNA, 300 bp, Glycine max
  Peptide Sequence Number=SeqID_122429
atggctacaactccctgctctcctcctcctactggtgcagcatcgcattcatcgtctcccttgaagcagacaagcaaggccacatgcctaagatcattggaaactagaccagttggggcagagagacccctggtccatgttgatcctgctatcgggaatgctgacggtccccacaaaaagaagttaagaacatatttggagatcatctctcgtgataaggtggatgtgacatacgagaattggaagcaagtccttgctgctcaaaaggatttgatatgggaggatattcaggttaattag

SEQ ID NO: 5652 - DNA, 201 bp, Glycine max
  Peptide Sequence Number=SeqID_122430
atggctaatttctctaggaggatcctcttcatggttttagtgatcatcttcatcattatggttgctttgtctcaacgtggagaaggttgcaggcctttgcatgacgatgaacaaggttctggggaatttgatgggcttttgttgcaattccttccacgtggtcctttgaagccttcagcacccgatccaattcacccctaa

SEQ ID NO: 5653 - DNA, 207 bp, Glycine max
  Peptide Sequence Number=SeqID_122431
atggagaacggaggatgcagagtggttgaggtggccaaagactgtcccagctggccagaaaatgctggtgatgttgccagagaagggtgtgttcattggaaaggagaacagtcggtgctacttcataaaagtgtgcaccatgctccagccactcctccgatagcaccactatttaatgctattgacaactatgacatgcatatatag

SEQ ID NO: 5654 - DNA, 4956 bp, Glycine max
  Peptide Sequence Number=SeqID_122432
atgcctggaaacgaagtaggagacagggtccataatttttttggtcaagagaacttgtcccagggacaatatcattctcaggcggttgatgggaactggccaggactaagcaacaatctgtgggctggtagccagcgatcgactggtgtgccttttatttccaatttgaagaattttaatcaacaacaatcagatcctgagcagggacatgcaagctctccacgtctgcgacatggtttgaacctatctcagcctagttttaggcctgagtctggcagaaatctgctgccaaaccagcaatcagctgtgaatggctatatacagggacaacaggtttttcagaccaggcagaatgaagctaacattttgggagtggacacagagtctgattggaatagtctgtcaagaggaataccagtgctggagtcacaagggagtggtcttgaactctacaagaaaaacttggctaggaatgatgctgctgaatctccagtcaattttgatttttttggtggtcaacagcaaataggtggacggcatggtggaatgcttcaacctttacctagacagcagtcaggcataaatgaaatgcatctattaaagcagcaagcagtacttaaccagatgcaagaacttcagaggcagcaacaatttcatcacttagaagcgaagcaacagaattctattgctccgacttcctccatttcaaaacaggcagttgcaagccattctgcatctctcatcagtggcattcccattaatgaggtatctaacattatatggcagcctgaagttatgccaactaatgctaattggcttcagcatggtgcctctccagttctgcatgggtcctctaatggacttgtgttatcccctgaacaaggacaggcattgcgtcttatgggtttggttcctaatcagggtgatcagtctctttatggggttccaatttctggttcaagaggcacacctaatctgtataatgttcaagcagataagcctgcagtgcctcaggtttctatcccacaccagtattctcatgttcatgggaacaaacctgcactgcagcacatatcagctggtgataattcattttctcctcatcaatatactgcatttccagaccaacttaacacaaatgatgggacttcagtttcaaggcagaatgttcaagggaaaaatatgtttggttctactgctcacagtataaataatggactgaatatggagaacttgcagcaaatgaattctgagcaaagaattgcaccaatgcaagattttcacgggaggcaagaactagctggatctttagagatgtcgcaggacaagatgcttgtgcaggctcctccttcacagaacatggctaccttagatcctactgaagagaagattttgtttggttcagatgacagcttgtgggatgggtttggcagtaatatgggtggtttcagtatgctggatggtacagatagttttagtgggattccatctattcaaagtgggagttggagtgcacttatgcagtctgctgtagcagaaacttctagtagtgacataggcaaacaagaggagttgagtggtctaagtttccggaatttgggacagtcgtctggaaatgaacagccttcaactattgatagcagcaaacaacaatctatttggactgacagtaacttgcaatcagcatccaatataaattcaagactttttctttggcctgatggtgttagtaggccaaatgcctctgaaaattattctggtgtttctgggtttcatcagtcaggtcctgatactttgcatgaacagcataacaggttacagaacaattctcagagatcaattccacagtttttagaaagaggcaaatggttagattgcagtcctcagcaaaaacaacttgccgaagggggtcacatatttggaaatgctgctaactcttcaggtatagaaaaaaaccagcagaccatattgtcatgtaatagtagtggtgatcctttcaataaatctaatggatgggatattatgaaattgccatttgatagaagttcaaatttcaaaacccatgaaagtgaaaacttatcgcagccccatcacgagaaagctatgtgtgaggagatgggccagattcctgctatgtgggaacctgattctgatactaattcatctgttggaatggaacatgtgaagtctgcaggtaatatgcaggtttgtggggaagattctggtacaaatggtattgctacattgccaaattcaggcactgcatggttcagccagcaaagcagcaagcagctccctaattttgatgtatggagggatgcagagtcagcaggaagctatagaagaaatgaagttccaggaaagtataagcatcatatggagaagaatcccttagttttggaatcatcaaaggatggaaatgtagaaggtgcggcacatgatttggagaattctaacaaaaaggaaaaatctgcagatagtcttggctctaatccttccaatcctagagctggtggtatgagagaaaatagtagttttgatggcaatgatttgcatagtccaaagttatctggtcagggaaatcgaagacctcctgtttctcgtaaatttcagtatcacccaatgggggatctgggtgttgaagtggaaccttatggaattggaaacaaacatgtcaaaaattcacagcctatgccccatcaacccttgggaggacagtcaaagtatggtcattctgacaggaaatataatgaaatgaataagggtgactcaaaaagcttagaaaacaatgctttgaaaagcatacaccctggtcaaatgtcaaaaaaattaacctcatttgacagaagtgttgggaattatgcctcacagaagactgcatcatccagggtgcctgaaactgactcttctgatggatctggtgcacatcctccggaaaatcaaagttttttctctcagggcattggtttacaattggctccccctactcaaaggcttcctgtggtatcttcttatggctcatcagagacagatcatactacaccgcatgtgtctgagacaagggataaggaccatacatggttgggtactaatcagacgtttccatctctagatccatcccatggggagcttaggagtaatatttctagcacagcaggacaaatttttgataaggcatcacaatacggtatgctgggaaacattccacaggcttttacatctggttttcctttctccaggatccatactcagaatcagaatttggcaagtcttggtggacaagtagcaaatactcaatctgctaatgtaactttcactgcttccatgaatcagactgatgaatactgtgaaaaagctcaaactagtcaatctgaattggcttctgctcaggacatgtcccagctgagtgctatagacgaagatcgtctgagagatccggccatccaaattttgacagcagagactggcactcagccttctgttacttttagtgcatctctacatggcaccccttcaaaagttacgcacaatgtatggaccagtttttctagcaagcaacatcctaatgcttcaaggtttctatcccagccccaacaaattaatgattgtgaaatgatctccagctcacagaagccaggtgatgagggtttggagaaagatggcaatgaccattctggtactggcccttgttctgcttactccaataattctgtgggaaactcgcttaaagaaatctctgtgctgcagacattgcctgagagtgttgttgcttctgaacaggctgcatgttcatcacatttgaaagaaactgttggaaaacctactcttgatgcatctcaacccagcccaactgctactcccagagatattgaggcttttggccgatctctaagaccaaacattgttttgaatcataatttctccttgttggatcaagttcaatctgcaagaaacatggagactgatcctagtaatcgggatgtcaagagattgaaagtttctgataatatagtggtggaaaaacagctggtagattccaaccatgggcaacagttgtcatatgggtatgataatgtgatcaaagatgggtggtcaggtaataattccatgccatcatcagatcctaatatgctaagcttttcaacaaagccacttgatggacagtacacaaatgcatcttctcaagaggaggttggttatggtcaaaaaattgctcttaatgttgctgacagtaacaaagcagcctctgttaaaagtgattattctctggtaaatcctcaaatggcaccatcatggtttgagcgatatggaacttttaaaaatggtaagatgttgccaatgtacaatgcacagaagatgactgctgctaagataatggaccagcctttcattgtagcaaaccaatcagatagtttgcgctttcataattcagtagagcaaattcagagtgtcagtgatgcccagctaagtaatgctagtgaaagtccaatgcctgctttagctgcaagtaagcatgcagactctcagttatcgacacctgctgttgaacccgacttacttattatgagaccgaagaagcgaaaaagtgccacatctgaactcataccatggcataaagaactgttagagggttctgaaaggcttcgagatatcagtgcggcagaattagactgggctcaaagtgcaagcagattgattgaaaaggttgaagacagtgtggaggtagttgaagatttgccagcagtggtgaagtcaaaaagaagacttgtcttgactacacagcttatgcagcaactacttagccctcctccagctgcagttcttgtagcagatgtgcagttgcatcatgagagtgtggtctactcagttgccagattagcattaggagaagcatgcagttcaatctcatggtccagatgtgatacacttttgcctcctggcaacaagaacctgtaa

SEQ ID NO: 5655 - DNA, 477 bp, Glycine max
  Peptide Sequence Number=SeqID_122433
atggatatggaagcgcctactgatggggttgatgacatgaccaagcttgcttatttgcatgagccaggagtgctgcataatttggaaaccagatacatgatgaatgaaatatatacttataccgggaatattctcattgcaatcaatcccttccaaaatctttcacacctgtatgatactaatgtgatgcaaagatacaagggagcaacgattggaggcttgggcccacatgtttttgctattgctgaagcagcatatagggcaatgattaatgaggaaaaaagcaactcaattctggttagtggtgagagtggtgctggtaagacagaaaccaccaaaatgcttatgcagtacctggcatatttgggtggtaacacttcatctgaaggacgaactgttgaaaaacaagtactagaagctcttgctcttggccaaagtaagaacaacttagagatgcctggaaacatagtgtcatag

SEQ ID NO: 5656 - DNA, 1614 bp, Glycine max
  Peptide Sequence Number=SeqID_122434
atgtctaaattaccatctgcaaaggttgtttacatgaataatgattttggcgtaatcaatcttaaaatcatttacgtaaaacttcaggtcaacgagaataaagtaggtgtagcggagatgaggatgttgcggtggatgtgtggtaagactcggcaggataaaattagaaacggagctattagagagagggttggagtaacgcctattgtagagaagatggtggaaaatagacttaggtggtttgggcatgtagagagaaaaccggtagactctgtagtgaggagagtagaccagatggagagaaggcaaacaattcgaggcagaggaagacccaaaaagactataagagagattatcaagaaggatctcgaacttaatgatttggatagaagtatgaaaccaggtggaatcattgctctgctcgatgaagcttgtatgtttccgaagtcaactcatgaaacattttcacagaagctttatcagacattcaaagatcacaaacgcttcatcaagccaaaattggcacgctcagatttctctgttgttcattatgcaggggaggttcagtatcaatctgagcaatttttagacaagaacaaagactatgttgttcctgaacatcaagacatgctaagtgcttcaaaatgttcatttgtatcaggcctttttgctccactttctgaggaaacagccaaatctgctaaattttcttctattggttctcgtttcaagctacaattacaacagttgatggatgcactcaatctgacagagccacactatattagatgtataaagccaaatagtctattaaaacctttcatatttgaaaatatgaatgttatccaacaattacgatctggtggtgttcttgaagcagtaagaattaaatgtgctggattccccactcactggacctttcatgatttcttaactcgattaggcattcttgctccggaggttcttcaagggaacttcgaagaaaaggattcatgtaaaaagattttggagaagattgggctgacaggttatcagataggtgaaacacaaatattcctaagagctggtcagatggctgaattggatgctcggagagcattcctgctcagtaattctgcaatagttatccaaaagcatactaaaactcattttagtcagaaaagatatattgcattgcaaaagtcctctgtttttctgcaatccatttgcagaggagaactggctcgaagatcgtattatcacatgaagagggaagcaggtgcagtcagaattcaaaagtatatgcgtggaacactagccaggaaatggtacaccgaaataaagatctctgccattgtcttgcagacaggttttcgagcagtggctgcttgtaataaatttagatatagaaagcaaattagtgcatcgactactattcaggtttttgagacacctgcgcaaaatgaaagtccttctatggaagaatgttcaaatcctgtccaagaagaatcctcaagtcctttccaagatgatgaaagcattgaagctatcagggattcctctattcctctcaaagacactgaaaagattgaggttcttactatagaaataaaaaacttgaagattatctcttaa

SEQ ID NO: 5657 - DNA, 906 bp, Glycine max
  Peptide Sequence Number=SeqID_122435
atgcagtcaaatccagttcttgaagcatttggtaatgcaaaaactgttagaaatgacaattccagccgttttggaaaatttgttgagattcaatttaataagtatggacgaatatctggtgcagccattagaacttatcttcttgagaaatctcgtgtttgccaaatctcagatcctgagcgtaactatcattgtttctaccttctctgtgcttctcctcctgaggaaaaggagaaatataagttgggagatcctagatcatttcactaccttaatcaatccaattgctatgaattagttggtgtaaatgctgctcaagagtatctgagcaccaagagagccatggatatagtgggaatcagtcaggaggagcaggatgctattttcagagttgtagctgctattcttcatcttggaaacattaagtttgcaaaatcagaagaaactgattcatcagttctagaagatgaagcatccaggtgtgatcctaattgtttggaaggtgcactacgtgagcgtgtgatgattactccagaagaaatcatcaaaagaagtcttgatcctcttggtgctacagttagcagggatggtttagccaaaacactatattctcgattatttgactggttagtccaaaaaattaatatctccattgggcaggatcctagctcaaaatgtctcattggtgttcttgacatatatggctttgaaagctttcaaacgaatagttttgagcagttttgtataaatttcacaaatgaaaagctgcaacaacacttcaaccagcatgtgtttaagatggagcaagaggaatacacaaaagaagggattgactggagctacttagaatttgtagataatcaagatgtactggatctcattgaaaaggtttcttcaaacttttag

SEQ ID NO: 5658 - DNA, 507 bp, Glycine max
  Peptide Sequence Number=SeqID_122436
atgttgcaggaagaaaaacaaagaggtgatgaatatgaaaggaaatatgtagaagctcaaggatctagtgaagagttacgcaaaaagttagcagaaactgaaaaaagagtacatcagcttcaggactcgttgaacaggaaaatggataggataaaggaaggagcaagacagatccagaataactgtgtatgggctgctgctggagttctccatcagtatggcatattcttgatgaatatttcaaaagcttcatttatgatgatatcttccatgtcaagtcaagttgccgagctgaaggcgatcttgagtacttcatcaagattgagttcaacttttcgacctattgctagggttgacattgcttccagtaactctgatacttcatctacagactctgatttcacatttccggctcctgtttcaaatactgaacttttatcttccccagagtcaaattctttccaactagtagttcaggatgtcactgcaggggatggatcgggttag

SEQ ID NO: 5659 - DNA, 684 bp, Glycine max
  Peptide Sequence Number=SeqID_122437
atggaattcagctaccaagaagattcctccaaaagctcgagcaacgaaatcgatcgatcgtccgaacagaatgatgagacgggcaccggaagatccttcgagtgtgtgttttgcaagagaggcttcaacactgcacaggctttggggggacacatgaacatacacagaaaagctagagccaataacagcaaggccaagcccaattttcctccctcgagttcaagcaaggttgatcatcatgagagtaataactatgcaaatccaagctatcttacaagagggaatcactattcttctactcttcctgatcatagagaggtagatgatgttaattacaattactaccatcaattatattttccctcacccgcatgtggtgccaaatcaccttcacatgtacaatatagtagtgaggttttgtgtgtagagaaccaaagggatcctcatcttctgtttggacaagattggaggcaaaggggtttgagtttgtacactaatccactatgtgtacatgaaaataaagacaagatagaaaacaacagtgaagaggatgatcttgatttggagcttagacttgagagatgggttgcaggttggaagcagaaagaagcaagatttctagcatggaggcttcttcaaggaaggttgcaagttcgggtttctgatgagggaaggtacttctag

SEQ ID NO: 5660 - DNA, 102 bp, Glycine max
  Peptide Sequence Number=SeqID_122438
atggaggaactgtgtgaaagtggtatttcccttttgcctgatcctggaaagctctggcatatggcagaaatattgagtattttgacttcaaaagatcaataa

SEQ ID NO: 5661 - DNA, 111 bp, Glycine max
  Peptide Sequence Number=SeqID_122439
atggcggagattggacctgtaaattataatgccaaacttcaatttttccagctttctgaggggcctttgcacgtaatcctttcgttacatgttggggctgttagtctttga

SEQ ID NO: 5662 - DNA, 120 bp, Glycine max
  Peptide Sequence Number=SeqID_122440
atggccgaagaatttgtgaagggctctgttcatcaaaacggtgtcgctgtcataaccctcgatcgccccaaagcatttctcagagtcatagatgatgggaggaagagcattaacatgcag

SEQ ID NO: 5663 - DNA, 297 bp, Glycine max
  Peptide Sequence Number=SeqID_122441
atgggctcatacttagcccatgggcccaaaatctaccttaaggctcatgagaaccctagggccttctcttgcatctctggcccaatctttttggagtcttctatccaatgcccttgggggcaaccaactgcaccatcatattcgttgcatatctttaatatttattttgttcttgaaatattttcagagatggaatctacacttgtggaaatgcttgttgattggtattgccaacatgatctatggaccatgaattcaacactgagggcatttggcaacattagagaagtgttatga

SEQ ID NO: 5664 - DNA, 282 bp, Glycine max
  Peptide Sequence Number=SeqID_122442
atggaaagtgtcttttctctctttgtagccgctagaactgattttatccaatttctggtgcagtctgttggctacaattacatatgtctatgggcatatgattccatttcaccaaagatagttttggacgattgcatgacaggggggaaggaagcccgaaaacaaaatagaactttgactaagtttttcccaaataaaattacaattcacatgccacaggatgaggctctactagaatcctggaagcagcaactggatcgagaagttgagactcaaaattaa

SEQ ID NO: 5665 - DNA, 165 bp, Glycine max
  Peptide Sequence Number=SeqID_122443
atgaagcttaatgaggagaggcgcaggaacactcaagaaaaagatttactactgcggcaggaggaactggacaatttgttgttcagaatttctcaaatttctccattgggtgttcattcatggcttttggaagatgcaataagcaataaatatttacttacctga

SEQ ID NO: 5666 - DNA, 732 bp, Glycine max
  Peptide Sequence Number=SeqID_122444
atggctccttctttagttcgattatatgaacaaatgcccgaacctaaatatgttattgctatgggagcatgtacaattacaggggggatgtttagtaccgattcttatagtactgttcggggcgtggataaactaatcccagtggatgtctatttgccgggctgtccacctaaaccggaggctattatagatgctataacaaaacttcgaaagactaataccaaattcattaaaaaattcaggagaagcaaaaaaatgcaaggtcgtttgtcttcttggctagtcaaacatggactaattcatagatcattgggtttcgattaccaaggaatcgagactttacaaataaagcccgaggattggcattccattgctgtcattttatatgtatatggttacaattatctacgttcccaatgtgcctatgatgtagcaccaggaggactattagctagtgtatatcaccttacgagactagagtatggtatagatcaacccgaagaggtctgcataaaaatatttgtcgcaagaaaaaatcccagaattccttccattttctgggtttggaaaagtgcggattttcaagaaaaggaatcttatgatatgttgggaatctcttatgataatcatccgcgtctgagacgtattttaatgcccgaaagttggataggatggcctttgcgtaaagattatatcgccccaaatttttatgaaatacaagatgctcactaa

SEQ ID NO: 5667 - DNA, 435 bp, Glycine max
  Peptide Sequence Number=SeqID_122445
atggatatgaatttggggtacttcatctcccaccagatctctctgattgcacaacatgatacatccagacttggattccctaccttgatcacagctctatgtaaggccaaaggagtccaatcagattctagatccctggagaacttgagccctgccattaacttggcatacatcaagaagaaatgttggaatcttgattatccaacagtgacatttagagagccaaggaaggccaggggtgtacacatggctcaggaggaggagacttccacagaccaaatcctagagccatccccaacacccataactaatgatgccataccatctgcaccagcatctgagttagagcagcctatctctcaggattcaccagttgctcaagtgttggatcttaatgagcatgcacaggagcaaccacaggagcaggacatttaa

SEQ ID NO: 5668 - DNA, 273 bp, Glycine max
  Peptide Sequence Number=SeqID_122446
atgggtatgaatatgaagatgtcatacagagtcatgctagttttgttttcacttttcatgttcgtcataccttcaatgcttagtaatgactcttgcggcagtggattcgttcctctgacccctattcggtgtccagggcgatctcatgcttggctacctcatcctaggctacctcatcctaggtttccacctgaaatatcagcttctagttttgaggtagcccgaccggtgccaccatcattcaacaggcctcgaaacattcactatccctag

SEQ ID NO: 5669 - DNA, 219 bp, Glycine max
  Peptide Sequence Number=SeqID_122447
atgcctaaatcatctcccaacatgcatgtgaaccaagaagtatcaacaagagtcaagccaaggctattgtgcaagcaaccaatggggcaaaacacaccgaataaaatagatgacgatggctcaaaatctcaccgaggagaaaaacaaggatttcaattcacaaaatgccaagaaactcctatttcaaaaacaattacccattacctgtacataacctag

SEQ ID NO: 5670 - DNA, 409 bp, Glycine max
  Peptide Sequence Number=SeqID_122448
cgtgaggcgcgcgtgtgatcagatccgaactcactcatctccggcagcgcgtgatgacagagcagcctctggagtaagggtgaacggggcctcgggccctgtagcagttgtgggtgtagtaagatctaccagaacgaggtgggcacgggattcggttcgcggaaagagcgccgtaggagatagcgacattgcggttggccactccaacgcctccgacatgaggttcaagcctgtctcctccatctgcgcctgcacgccaacctcggaagttaaggcaatgcagaagagtagtgacagagcgagggggacaggggacagggggtcacatgcgccaaagctgtgcgttggatggcatccagcggtggaaaagggagtgtggcgtattgatgaggttttaatgaaaagcatg

SEQ ID NO: 5671 - DNA, 360 bp, Glycine max
  Peptide Sequence Number=SeqID_122449
atggcttcttctcttcctcttctcaaccttcttaccctcgctctgtcactactcttctgcattgccttaacttccgaggttggcgtgcaggcgcagatggaggagacaggcttgaacctcatgtcggaggcgttggagtggccaaccgcaatgtcgctctacgacgaagacagcgaagaagaggatgtccagaacggttacagtcggagatcgttgttctggcggaggatgaagtactacatctcctacggcgctctttccgcgaaccgaatcccgtgcccacctcgttctgggcccgaggccccgttcacccttactccagaggctgctctgtcatcacgcgctgccggagatgagtga

SEQ ID NO: 5672 - DNA, 231 bp, Glycine max
  Peptide Sequence Number=SeqID_122450
atgtccatggcaacagatgcgttaagctatgatgtaaaggaatctacatgccagattggcagtgataataactcagtcatcactgatccgagaatcaaagctattgttattcattccaattggaatcattcaacagtggaatttgaaatcaataatagcaccgaaactaaactcatccacaattcaccagtccaccaacctcctcccacacaaaaaacaattctaacttga

SEQ ID NO: 5673 - DNA, 405 bp, Glycine max
  Peptide Sequence Number=SeqID_122451
atgtggttgatgttcacagagaaacaagttttatgcatagatggtcgcaacaacagagttgctctttttgatggtattgaggagggtggcatcagagcatcgtctctttattcctcaagttcttcccatgaaattgatgaacatgataatgaacaagcattggatggattgcaagatagagtcaatctgcttaaaagattgtcaggtgatataaatgaggaagtggatagtcataaccggatgctggatcgtatgggaaatgatatggattcttcgagaggagtcctctcaggcactatggataaattcaaaatggtatttgagacaaaatccagccgaagaatgttttcacttgtagcatcctttgttgtgctttttcttataatatactatctgactaggtaa

SEQ ID NO: 5674 - DNA, 642 bp, Glycine max
  Peptide Sequence Number=SeqID_122452
atggcttctgcaactggctctggttcttcttctggcttcggatctccctgtggggcatgcaagtttctgcgaagaaagtgtgtcactgattgcatctttgcaccttacttttgctcagaacaaggagctgctaaattcgctgccattcataaggtgttcggtgctagcaacgtttccaagctgctcttgcgtataccagctcacggtcgttttgaggcaatactcacaattgcttatgaagctcaagctcgccttagagaccctgtttatggttgtgtctcccatattttcgccttgcaacaacaggtagcatgcttgcaggcacaagtaatgcaaatgaaggcacagctagaccagaaccacatggagcccaggaactttgagaatcattggtcagagaatgttgcacaatcattcaatccattttgtcccacttccatgaataacctcatatctcctcagagctcactcgattcattgggttatagcagcatcaatgatggaatgagcatgctagatgtacaaagcagcagagaggaatatttcgcactgcaagcctgtaattctaagaaaagatcatataacaatgacttgggtgagctgcaagaattggcacttaggatgataaggaactgtgactag

SEQ ID NO: 5675 - DNA, 942 bp, Glycine max
  Peptide Sequence Number=SeqID_122453
atggcagcaaagctagacgttggagttgatttcactcgaaagctatgtagttcttgcatgctctcccctcgcaggctatctagcattctggtttctatggctactggcagccttcgcttgaagcaccctggcctattttatttcagagatttgcttgatatgtcgtggcacaaggggctgcatgattcagacctattgctcacgtataggtaccatagacctctacatattggtcccccgtctttaacaattaagcattcagtttcacctgaggttggaatccatggaattcccatgaacaagttttcacattccctaagtcgaggtgtaaggttgtccaagttgtcgattgggtttgattatattgcgccttcagaatctgattcgagcaaagccaaagcaaccggtgtatactttaagcgttttcactttacgcacgatggaggccgctctataagcacagatcaagatggttttcaactgactcgcagtggaggtccatctgacaacataatagtgattagtcaagaatctcgttatgaagatgaaagtgatcacggctttactaactttagtgtccagatggaactagggactccaattccaccaatcttgctatcctactaccggtttgaagtttctgctgcaagaggaattaaacttggaccaacaattttcttctcacggatgagtggtggaacagttatgggatcctttgctccatatcaagcatttgcaatcggtggtcccagtagtgtgcgaggctatggggagggtgcagttggtgttggacagtcgtgtctggtatctacaagtgaattgtcaatcccattgttattatacttggagaaatcttgcccgccagtttggagtccttatattgattgtcttggaaccttaaaaatcaacatggggcaaggattaccaaattgtgttaggtga

SEQ ID NO: 5676 - DNA, 648 bp, Glycine max
  Peptide Sequence Number=SeqID_122454
atggtgataaatgatcatgatcatcagcacaaagctgaagagatattaatagagccagaaacaattaattccaaattagaatcctcaaattccaaaattgaaaaggtcaagatgactggtacaggatctccttgtggagcctgcaagttcttgagaagaaaatgtgtgagaggctgtgtttttgcaccttacttttgccaagagcaaggtgctacccattttgcagccattcataaggtctttggtgcaagcaatgtctcaaagctcctcgctcaccttcctgtgagtgatcgttgtgaagctgctgtcacaatctcctatgaagctcaagccagacttcaggatccaatttatggatgtgtctcccatatttttgcactccaacaacaggtggtcaatttacaagcacagctagcttaccttaaggaacaagcagctcagagttgtctcaatggcactatcaatgaaaaccctaatgaaaaattattggaaaaatcttctgctgctttaccccaagaccttcaaagttggtttcagttggaaaattccaacctggggccagaatttcttcctaacatgtgtactaatttatcaacacaacattatgggaacaatgctctcatgatggaagatctaaaccctattggg

SEQ ID NO: 5677 - DNA, 462 bp, Glycine max
  Peptide Sequence Number=SeqID_122455
atgtttgactttgtgagcaggtctggtgatattttcgttcactggatccggcacagaaggttaaccttctgtagcaatagggtcaattgcacagtgggaaccaactacaagacagccagaattagtaattactactatcctattccttacaaagcgcaatcaaggagtgaaggggttgccagcagccccaaaattcgtgatttgcatagttacatgctctatttgaagtgtttgcggatcactgtctttgctctggataacaagttaacaaccaaaggctataatctcgcacaatctaggaatgtttacggaaaccacatgacaaatgcaaggaagtgttttatgcaacactgcacaatgtctcacagctcatgtcctcgtcctatcctccttcgcaaggccacacccatctcactcactattccaccgcaattcacaccgcttcttatctcaagtgaatga

SEQ ID NO: 5678 - DNA, 660 bp, Glycine max
  Peptide Sequence Number=SeqID_122456
atgaagaagagttctggttcctcccagaaacttggttcatttctaagtccaggggcaccaaactacagtgagaaaagcattgggagccaaaaggggtggagctcagagagggtgttgttgcagccttcaagcagcaacataaggaatgctagtgtagctaacttgacaccctttaacagtggaagaacaataccttcaaaatgggatgatgctgagagatggatttgtagccccgtttcaggctattctaacaacaaaaccaattcctatgcacaacttcagcagcggcgaccgaaatcaaaaagtggtccaattatgcctccaggaacaggctactactccaattactcacccacaattccactgcgccaaggtttggtagtgaagaacttcatgatgggtggttctcctttttcaacgggagtgttggcaccggatgctatttctcttcaccattattattcacatgaggctgttttcggtcaccgttatgactttgacaatagtatgcaatgctctagtccattgctcaatgaaaatagtgtagccctcccatcagtgtctagtgcacccatgtggtcagaactgctatgcgacccttcttcgcctaattctcaaggtatggataatgatgttcttcttcggatgcaaactttctaa

SEQ ID NO: 5679 - DNA, 1279 bp, Glycine max
  Peptide Sequence Number=SeqID_122457
ttatcactactcttctatcaataaaaccgcaatggtggacgtggaccggaggatgaccggtctaaacccggcccatatagccggtttacgccgtttatcggcccgagcatcagcagccccgtccgtcccggtccgtaacggcgtcgtttcattcgcttccttagcagacaaggtaataaaccaccttcgcgactcaggcatacacgtgcagcatggtctctcggacacggagttcgcacgtgccgaggccgagtttgggttcgtgttcccgccggacctccgcgccgtcctcgctgctggacttcccgttggtccgggattcccggactggcggtctggcggcgcgcggctgcacctgcgcgcgtcgctggaccttccgatcgcggcgatttcgtttcagatcgcacggaacgcggtgtggtcgaagtcgtggggtccgcggccgtgcgagccggagaaggcgttgcgagtggcgaggaacgcgctgaagcgagcgccgctgctgattccaatcttcaaccattgctacattccttccaatccctccctcgccggaaaccctatcttcttcgtcgatgagaacagaatcttctgctgcggcttagatctctccgatttcttcgaccgcgagtcgctcttccggagctcagaagccgatcctatactcctcaagaagcagcgatccgtcagcgagaaatccaccggcgtttccgtttccgcggcgttctcgcgccggagcctcgactccggcacgaggacgccgcggtgggtggagttctggtccgacgccgccacggataagcggaggaggaactcatcctcgtcgtcgttatcggcgtcgtcttcgccggagaggtttttcgagatgccgcggagtaaagttcctggttgggtggaagaatacatagggcaaatcgggtcagttttgaaagcgggtgggtggagcgaatcggatataaatgaaatggttgaggtttcagcttctggattcttcgagggagagatggtggtgttggataatcaagcgctgttggatgctctgcttttgaaggcagataagttttcggattctctccgaaaagctgggtggagctccgaagaggtatccgaagcattggggttcgattttcgacccgagaaggaacggaaaccggccaagaagctgtcacctcaactcgccgagagaatcgagaaattggctcagtcggtttcccggtcttgcttttccctcttttgggttgaaaacgatgaggaattggggaaacgcgttgtactatga

SEQ ID NO: 5680 - DNA, 552 bp, Glycine max
  Peptide Sequence Number=SeqID_122458
atgattagaggcattgagttggagggagcttgggtggaggagcttagtgttgtcaaagaggaagctagtaaattcttcaagaaaagatttagagaatataattgggagatgccacaattagatggggtggtattcaagaaaatctcaagggaggacaactatatgttggttggtggtattctaaagaatgatgtgtttaatttccttcaagactttcattcttcgggatctttctctaaaggagctaatgcatcatttatagctctcatcgcaaggttgataagccacaagaaaggggattacagaccaatttctttggttggttgcatgtataaagtggtgacaaagattttggcaaagagattgcaaaagtttttacatgtgggaagaaatggagtggaagtcattttgttacaatacacagataacacaatttttgtgggagagttgaacttggagaatgtggttgtggttaagagtatcttgaggaggtttttgtgggagtgtgaggatgggagggagaaaatatcatgggttagttgggaaaaatga

SEQ ID NO: 5681 - DNA, 889 bp, Glycine max
  Peptide Sequence Number=SeqID_122459
atgggtttaccttggtatcgtgttcatactgttgtattaaatgatccaggccgtttgctttctgttcatataatgcacacagctctggttgctggttgggccggttcgatggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggtgtggccggagcacatattgtgttttcgggcttgtgctttttagcggctatttggcattgggtttattgggatctagaaatcttttgtgatgaacgtactggaaaaccttctttggatttgcccaaaatttttggaattcatttatttcttgcaggggtggcttgttttggttttggcgcatttcatgtaacaggattgtatggtcctggaatatgggtgtccgatccttatggactaactggaaggatacaatccgtaaatcccgcgtggggcgtggaaggttttgatccttttgttccggggggggtagcttctcatcatattgcagcaggaacgttgggcatattagcaggtcttttccatcttagtgtgcgtccaccccaacgtctatataaaggattacggatgggaaatattgaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaa

SEQ ID NO: 5682 - DNA, 282 bp, Glycine max
  Peptide Sequence Number=SeqID_122460
atgaaaaacaatgcgactaccggggaaggggagtatgctgatgaaataaccacaaatgagattttggatgtttgcatttcatttctaaatgaccatttagaggaaacattgggttcaacaaaaatagaagaaaatcactcaaagtttattaatctcacacagggcaaggtttttggtaagttgggattttggctaaaggcttgtagcatggctggacatgatatatgtcagggtttggtttggttcagggataaaagggaatgtcccacattatttccatga

SEQ ID NO: 5683 - DNA, 912 bp, Glycine max
  Peptide Sequence Number=SeqID_122461
atgaccatgctcgctcaaacatggagcgttctttctttttctaacctcattcctacctcccacacatctgatgtgactttggacagagccaaattgatttatgggattattatgaagatggacatgaacctggggtacctcatctcccaccaaatctctctaattgcacagcatgacacatccaaacttggattccctgccttgatcacagctctatgcaaggccagaggagttcagtcagactctagatccctggagagcttgagccctgccattaacttggcatatattaagaagaactattggaatcttgatgatccaaaagtgacatttagagggccaaggaaggccaggggtaagagatcagaggcccccactacttcagcaccaccagagacaccaactccttcttcttccacatcttcattacctcctattctgactccaattattcttccctcgtccactcagagaccacttccagctcctatatctgcaggaccatcagattctatttttacacctcagatgctttattccatgctccagagcatccacaaggggcagtccatcatcatgcagagccttcagggcttgggcttgccatccattatgagcatggatgagtttgatgcacaggtggcttggccaggagcccagccttctccttctggaaggggtggggcctccgcaacccaggagcctattcctgagcatacagcagcagcaacagtagtagagggggaggatgagctcacccctcctaagcctttttattttgatgcaggtgtatacatggctcaggaggaggagacttctacagaccacattcatgagccatcttctacacctgtacctgatgatgccataccatctgcaccagcatctgagctagagcagcctatcccttag

SEQ ID NO: 5684 - DNA, 435 bp, Glycine max
  Peptide Sequence Number=SeqID_122462
atggcggaaccatcaaagaagcgaaatggcacttcaagtcggagtcaacggcattccgggtcacaggaaacaccaattccttcatccattccttctggatcattgttttcatctgaggaacagcggatacggtacacaaacctcttttcctctcgttccattatagacccaaaattcatagatatggatttattttcaaatgagagttttgaatgctttcaagcatttgaaaactccaatcttattccattcacgtctctaaaattgcctgtttattctgatcttgtcaaagccttctattcaaacttagaaatccaagaaggcaccctaatgtctgaggtttatgggattaagatggtcattgaccagtccctattctatgatttaaccaaattgccaagtgaaggtgtaccatttgaaggttgcactgattga

SEQ ID NO: 5685 - DNA, 234 bp, Glycine max
  Peptide Sequence Number=SeqID_122463
atgaacgtgctaagcgtgcttgttgcgcttagcctgttcatcgcagctgttaaatttttggatttccagatgatcacgctaagcggaccatgtcgcgctaagcgtgctaagcgcgccctgtgtgctaagcctaagggtcattctggtgaggctgagctaagcccaacatgctacgctaagcccataccctcttctgttttgaaaatggtagatttaggcctaagcccagcatga

SEQ ID NO: 5686 - DNA, 417 bp, Glycine max
  Peptide Sequence Number=SeqID_122464
atgttcggcatcttgtaccatatttggtataattatgaatggccaccaagtatcaaatttgaagcaataaataccttcagagtaaagagcatagctagcaatagcatgaaagtggtgggttttgacaaagaggcttcccagactcctcatctattcatcaccaacatcttccaacaacacaaggttcctgtgatagatttcacaggatatgatgatgatgaaaattgttgtcacgggttatatatttttaatcgtcaaacagatgttaagggtcataagaaagagtggtattctcgtgaccctaaggtgagagtgaggtatttctgcaatggagatcttcttgtggccaaagtagcaaactggagggacactataatgtttgatttccaagatggtcctctaactcccgactgctaa

SEQ ID NO: 5687 - DNA, 2169 bp, Glycine max
  Peptide Sequence Number=SeqID_122465
atgggtagcaacctgcaccgactgctcagaagcttctgtttgggcactgattggaagtatgccatcttttggaagctcaaacaacgggctcggatgatcttgacatgggaggatgcttactatgacaatccaagtatttgtgagtcttccgaaaacaagagctgccataattcattggagcagattggcagtgcggatttttcgcatgatcctctagggttagctgtggcaaagatgtcatatcatgtagctgttactggaaagcatcggtggatctgtgtagataatcatgttacaagttctggcccatcttttgagtttgctgatgggtggcaatctcagttttctgctggaattagaaccattgttgttgtagcagtagttgcccttggagttgttcagcttggctctttaaataaagttactgaagatatgggggtcgtgtcctgtatccgaagtctctttttgtctactcaagattacacaataagccatgttcataatcaagtacaaaatagtgtgaagaattcctcatctgtgctggataccaaaacttcaaaaagcatgcctgccttacatgatacagagaaaaccatgaagcatgaagcactggatattttaatgccctttcaatgtcctaggaagaattattcacctcacgctgttcatcagaagatggttgttgatgtggccaagcatgattttcctgaattaaacagtgatagaagttccattttgcttcagtcaatgtcaaatatgatgaacgtggagcaacagaaattagtagggatgagacctgtaaatgagagtaagtttgaagggaacagtggctgtgaagataaaagtttggaatcaggaaaaaatgtttcatcatttttacacaatttagtaatggataataatggtgtcaatgatttagcatgcccgtcagaaaatgttggagtagatccagtatccttctcttcaggctttcttgatgcagctgtttgtgtgagcgataagtttcagtatgtagacataaacgaaaaaggagtgttgaatgtgcccagaccttcagatgcaaacttccaaataaaaagtgagaagtcaaagtttcagactgaaccttgttacaaggatacctcatacacaatgaagtttcctgctggctatgagctacatgaagcacttggaccaagttttctgaaagggagtaagtgttttaattgggcagcggaagcaaatcaagatgttaaaaatgctgagatgtcagatgagattagctgtagccaattgacttctgaatttcgcccagagcatctcttggaagctatggtggctaacattagccatagtaataataatgttaatagtgagttatcattttcgacatcaatgcaggctgcaattgcctcaggaagaaatcctgaaggttctgttcacactattaattctgaaggctgttcaatagatcagcttccttttgttaaagaggacaaacattatagtttgagttcatctgggatatgcggtgtaatgtccccaaagggattttcttctacatgtcctagttcatgtagtgaacagtttgagaggtcttctgaaccaactaagaacagcaagaagagggctaggcctggggaaagttgtaggcctagaccaagggacagacaactgatacaagatcgtattaaggagttgagggaactggtgccaaatggtgcaaagtgcagtattgattcattgctggagtgcaccattaaacacatgctctttcttcagaacataactaagcatgctgacaagctaaataaatttgcggatacaaagacaaagttacatcacatggaaaaagacattcctggtcaacaaggttcaagttgggcaatggaagtaggaggccatctgaaagttagttcaatactagtggagaatcttaaccagaatggccagatgtttgttgagatggtgtgtgaagagtgcagccattttcttgaaatagcagacgccatcagaagcttaggtatgacaattttgaatggtgcaacagaagctcacggtgagaagacatttgtatgttttgtggtcgaggcaggatcagagggccaaaacaacagaaatttacacagattggatatcttgtggtcacttgttcaattacttcaatccaagagcacaatgtattcataa

SEQ ID NO: 5688 - DNA, 192 bp, Glycine max
  Peptide Sequence Number=SeqID_122466
atggaaaagaagccacaaagttcaaggctttacgggaactcaaaccataaatttctcgcctttgagcttcattcgttggagaaaaagaaaaagctaactgttttactttatttttcttcctttttccacttttcaatggaggaatgtaagcacgcggtgcaatttagcaaagggcacaggcataatgggtaa

SEQ ID NO: 5689 - DNA, 1095 bp, Glycine max
  Peptide Sequence Number=SeqID_122467
atggtgtggttttgtatctctactctatctataaaagtcctttggaatggtgaggttttggatgattcctttaggccgactagagggatttgtcaagcatccatcgaccaagttgagatcattaaaccttgtcttgatattttttgtgagagctctggtgccaaggatggattgttcgtgagaagattagtgatgcttttccaacatacgaataagcttggcaaatatttgggagtgcaattacatcatgagagagtgtccagatctaccacaaggagtgtcattgagaaaatgaaaagaaggcttaggtcatggaaggtttgtaagaactttttgtggggtgatattgatcatagtaggagtatgcatttggtgtcgtggaaccaggatctttgtactaaaaactctcatttatgggtgaagaacaatattagatggagggtaggggatggtcatgatgtgcttttttggattgatagttgggttcttggtgtcgggtccttgctgggtaagcaaataagcaccttgggtaatcaagatttgactatgaacgtaagtgattttgtgggggaagatggtagatgggatattaatctcaggctccaattccttcccagttctatgtgtgcgagtattcacaatggagccactgaagattcccctgttcaattcaatacggcgttggaaaggtattggaaagcttcagtggggttgaaggatgattttagcattggccctgactctataaaccattcgtctatccattcttggggttcaccaagcttaggtagaatcaaggtcaatatcgatggtgcaattcagattagagatcatcctgcgacatgtggtggagttgctaggaatcatcactatgggcattgtatgtataggtttatgattcatcttgggaatgttcatgtgatctttgaggaactctgggttatttttcatggtctcaaactagctttggatagaggacaggataacaacttagtggttaaggaagccttctcttccaatgatccttcttgtgtacacactagttccccattgaagcgtggcgcgagacttcttatggaaacaacactagtttaa

SEQ ID NO: 5690 - DNA, 405 bp, Glycine max
  Peptide Sequence Number=SeqID_122468
atgagcgtcaccgcattcctggatgcaagttcatcagaactagtatgttctcaaagcttcaacctcaacaccatcctttcccacaccattctcttcaactctttgcgaaggatgacaatcgtgcactatcaccatgccaaacttcgtcttctctttcactctagcttgtcggtgagcgcaagttcaagaatgagccaacaccatcgtgtcaaggctaatgtcgttgacatcaatgttgatgacatggatcgagacacagtaacctatgaagcacggacacgccaccgaagtgccgcgtcccgcgtcgaagacgcaccagacacacaaacgggtgcgactccggtgcaacgcggtgtccgttgccgccgccgtcgccggacacgattggatgcaagaaacacgtga

SEQ ID NO: 5691 - DNA, 213 bp, Glycine max
  Peptide Sequence Number=SeqID_122469
atggagaaagatagttggggaggaggcaaggatgaacacaacgacaacgaggatagcgccaccttgacctcttcgatgaaagtacaaaatattttcgtcaacccaggaaggcaagccaccatcctctacctcgctagtctagccacgatgaggcgcgcgactaaggaggatgcaaatggagtctgtggcagctatcgcggaggctcacgatga

SEQ ID NO: 5692 - DNA, 399 bp, Glycine max
  Peptide Sequence Number=SeqID_122470
atgtttattgggggtcttgtgccttttagtgcaatagtcctgcaactacaccaggcatatgctagtatgtggggctacaaaatatacactcttcctagcattttatttgccacattcattcctgtcattttgatcattgcacttgtcagtattggcttgacatacattcaactatctgcggaagaccatgaatggtggtggagcttgtacataggagatgagaggattagaggaaatggtcatattagacagccattactactgtggaaaacaccatcagaaaatatcagtgctgtgtggtggctcaacagccattttcatgtttgggtattgcgtctacttctatgtgagatcaaatatgagtggattcttgcagctatccttctttattggctataa

SEQ ID NO: 5693 - DNA, 1791 bp, Glycine max
  Peptide Sequence Number=SeqID_122471
atgaacaaatcctcagatgcaactgcgtctcctacgtgcagaggcagatacaaaaaacccaatttccgaagctccaagtcccaacccccaagccccgtccagttcagctccaagacgccggagaagccgccgcagcgaatccgcaaccgtggcgtcgcgctctccgtcgctgacatcagaaaggccgcctgcaagcgcttgcaggatcagaagcaatgcactgaaatgacgtcggcgccatcgtcatcgtcgctgaacaagagtgtcaggaggcaaatctcactgtggccttcttctcccagcaaaccaaagactactgatgatgaatccaacaagcttcccgagaaatatgaaattttggatgagttcttcgatcgcttggatactttggtttcattgcaccgtctgaaacggtggactccaacctttacttcaatcagttcaaggattgaatctttaactgacaggaggtttactcacagtcatctagcccagttgaaatttatcttgcctaatgctattgttcttaagaagcatcttgtgcttgatgaacggacgagttgtatgaagccggatattcacatttctttagaccctgatgcggtagaggccgatgatgccaagttgcccccacaacgtgggagagtgtcgctgaagaaggtgtttcgggcacggctaagagatttttgtgaatctcatcctgagggtgatgaaattccagaagggacattgcctgagccattcaatcgcccaaagaaagacagtgttttggacatgttggaaactcgcctcccaacaaaattgccaccctgcatgcgttatagtgacattgtcaataatgcagagtctgctaacttggatgagaaattgtctgtacttgtcaatacatcagttgaattgcctaatgagcatctggcagcaccttctcacatgtctccatcctttagagcagatgatgtacagaaaaatcctctgttagatttattacagcccctggcttttccagtttcagagtcaagccggaatgaaaatacaccctttgtggatactgaatctcatctgaaaacgtccccagctaagttggcttcagaagcatctagtagtgaaagttgtctaacaatttgtgctcctctggaatcatcatgtgctcaccctgctactccaagcaaaaccactgagtacaccgaaaacaaagatgggtctctcaagagcattgatgccatgtcaactccagctaaacttgtttctactccaattaggttgatgagtgccacacctgccttgcggtcacccaaaaggcattatatgagcccagatgaccactctatcagttctttgaacaagttagctcggcgtccacctcgctcaaggtcattgaaatttgacactccagtgaagaacaaggatgatatttttgacaccctccaagaaagtactatccaatcgattagagaaaaggaaaggctggccatggagaaaagagacccagctatcacagaagcaaagaaacgaaagaaaaatatagctagcctccctaagctctttgacatgatacgtgggttacttagacagcggaattgtatcactaaagcagagcttgtaagcaagataatctcaagccgatgtgatattgctgacagaagtgaagttgaagagcagctaaatttgttgcaagaactagcaccagaatggatttctgagaagcaggtctctagtggggatttgctattattcataaataaaatgttgagccctgaaaccgttcgagcatcccttgaagaagcaacatag

SEQ ID NO: 5694 - DNA, 450 bp, Glycine max
  Peptide Sequence Number=SeqID_122472
atggccattgagggctttacaatgagaaggggtgaaagaaagggagtaaatgaaatccctaggagagggggttctgtcgtggtgtcctctgtcccttggactggctctctatttataactgttgaagtgggctttgggccttcttatcagggggatttaagcaaagcaaaccgcagttcctattggcggtttcgggaactcaccaagtcgccggtcctgttggcgactccctgcacctgtagcttcgttcagagcctcggaaatggcttctgtggcttctgtgcctctgcaccctacgttcgtagccttggaaatcgccagtcaaagctgcgatttcagcacaggctcgaaatcgctagcttcaccggcgggacgctcctcaacctgaaatcgccagcagcagcagcgggttgccatccacgtgtccgttgcccacgatgtcgccaatga

SEQ ID NO: 5695 - DNA, 1920 bp, Glycine max
  Peptide Sequence Number=SeqID_122473
atgtttaacaagccaagaggtgctagtgcttttaatgtattgaattggaaacgtcaaggtgaatcatctgtgacaacaggtttacttcaggatgttccaccagagattgaattgtcggattatagaaggatcccaagtccaggtagtgagagcccttcagacctacttaatggtgagagcctaaatgtagaacccattgctgatttggatttcttcttcgaaaggctttacagctactactgtgagaaagggctctggtgcatcatcataaagtggatagttgaacttctgagtcttggtttcaccatatgtttttcgggttttttcttactatatgttgactggaatgggctccgaaatgcaaagtgtgggatgaatgcagttgaatctggaaggaagccttgtgatcttgctaaagaagctcttcatgagcaccctttaaccccatttacacttagcaaagctattattgttggatacttgggaatattttctatctattggatattttgcttcttgagattctttgttcaactaaaggatactttggatatccgacagttttactacaataatctccgtgttactgataatgatattcaaaccatgccctgggctacaattcttgaaaaggttgttcttgtgcaaagctcacgacaactctgtgtggtaaaggatctttctgctcatgacatggtaatgaggttgatgcggaaggagaactacttgattggaatgctcaacaagggtgtgctttctttccccatttctcagtgggtcccaggtgctggacctacagtgaaatctggtactaatggcacacaatatcgtctaatgcttcccaagacccttgagtggactttgaactggtgcatcctgcaaagcatgtttgatcgaaacttctgtgtcagaagagattttgtgtcaaatccaaagacattaaagaaaaggcttatgatagttgggattgtaatgcttttactttctccatttcttgtcatattcatgctggtatatctctttctgaggcacgctgaacaattttataatcacccaagcacagcatcatctcgaagatggtcaaatttgtcacgatgggtctttagggaattcaatgagggtattaaagtaattttagacattgtattaaagaaaacaaaaaatctgatttctctctcctccataactcttgtatcccacttctttctcctccatatctcacgtccccgtgcccccatatctcccatctcaccatcatggacatgctgcaaggttgcaaagaatgatggtgatgcacgcaagtttgttgatgagatgcggtggtggcataatggggagttgcagagacagagcggaaacggatctcttgtggatcatctcttcaggcaccggattaatagcagtgtattacatgcttctaactatatcaagcaatttccttcacctatcatatctatcatttcaaaattcatatcatttgtatcgggtggctttgctgcaattctgatcatcattgcttttatagaggagtctctgctggagggtcatatatttggtcggaacttgttctggtatgctgctgtttttggaactataactgctattagacgggctgcaattgcagatgagcttctagtcatagaccccgaaggagcaatgtcaatggtagttgagcatacgcattatatgcccaagagatggcggggcaaagaaagtactgaaatggtccggattgagtttgaaaccttattccagtatagtgggatgatgttacttgaggagatggcctcgattttccttactccatacttacttctgttggttgtcccaaagcgggttgatgatatcttgcagtttattgcagattttactgtagatgttgaaggtgttggtcatgtttgcaggttggcatggaattga

SEQ ID NO: 5696 - DNA, 1068 bp, Glycine max
  Peptide Sequence Number=SeqID_122474
atggctaaaccccaccatctctttctccttcttcttcttctctgcgccactcttgagttttcttcatcttcaccctccgatcacctctacaatgttggagaacttgtcccattgtttgtcaacaaagtgggacccttcaacaaccccagtgagacatatgagtactatgatttgcctttctgcaccccagacccaattgtcagaaagaaagagtcccttggggaagttctcaatggtgaccgtttgagcaatgctttgtatgagtttaagttccgggtggacaagattgatgagaccttgtgccaaaagaatcttacaattgatcaaattgcaacctttaaacgagctataaaccgcgacttttacttccagttttatctggacgatcttccactatgggggttcattggtaaacttgaagaggatgggtggacacctggtggaggaggacctaactattacctttttacacatgttcaatttgatgttctttacaatgggaaccggatcatacaagtcaatgcatttggtgatccaaatcgcgctgcagatattactaaagatgttggtgttgatgttaagttcacttattctgttatctggaatgccactaaagtacgttttgagaacaggatggacagatacttgagagcttcgttgatgcctgtccaccagcaagttcattggttctcgtttgttaactcaattgtcatcattttgcttttgattggtttgcttgccctgctttatatgcggcatctgaggagtgatttgaaaaagtattctaatgcaaatgaagaagataatgaggttggttggaagtccctccaacatggcgatgtattcagacctcctccaaactcatccttactttttgctgttgtgggaactggtacccaattgctaatcttgctttgtgtcttgctgtttctagcacttattggcaccctctatccctacaatcgtggaggactgttaaattggcttgtcttgctgtatgctctttcatctgtttttgctgggtacactgcagcatccttccatggcctgtttgctgagaatggatgg

SEQ ID NO: 5697 - DNA, 1017 bp, Glycine max
  Peptide Sequence Number=SeqID_122475
atggcactgagaaagaaccactcctacaacaacaagcttggttatgaagctttcccacccatcaaaacccaggctggaacactccaacacccaccacaacctgcttcctcagactatgcttttcccatattagtcattgttgttctcagcatcttggccactgtcttgttactcctcagctacttcacttttctaaccaaatactgctcaaactggcgtcaagttaacccaatgagatggatttccatccttcgagctcggcacgacgaggaccccttcatagcattctctcctaccatgtggaaccgagggcttgatgactctatcatcagagaaatcccaacttttaagttcataaaagaagaaggtgaggatcaaagtgtgtattatggttgtgtggtttgtttgactgagttcaaggaacatgatgtgctgaaagttcttcccaattgcaaccatgctttccatttggactgcattgacatttggcttcagaccaattccaattgtccactttgcagatcaggcatttcaggaaccacccactgtccattggaccacatcatagcaccaagttcttctcctcaggattctcagttactctccaacatgggaagtgatgaagattttgtggttattgaacttggaggagaacatggagcagcacttccacaggtgcaacaacaagagaggaatgactcaaggggaagcttggcacatagaaaccactctacaaggaagtgccaccatgtttccatcatgggagatgagtgcattgatatcagaaagaaagatgatcagttccatattcagcctattagaagatctttctcaatggactcagcacatgatagacaaacttacttggatgctcaagtcattatacaacaaagtaggcttcagaatgaggctagtgctagtgaggattgtaatagcagatgtcgaagaccattcttcccgttttgctatggaaagggatccaaaaatgcagttcttcctttggagaatgatgtttaa

SEQ ID NO: 5698 - DNA, 479 bp, Glycine max
  Peptide Sequence Number=SeqID_122476
atggataaagttctttcaaatgggttcagtgacagatctgtccctgaagactatattttcccactggaattaagaccaggaaacctcaaaatccccttcaacagcaacatcccagtgattgatctcaatgaagcacaaaatggtgatagaactaacacaattcaaaaaattatcaaggctgctgaggagggtttggtctcatgtgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 5699 - DNA, 792 bp, Glycine max
  Peptide Sequence Number=SeqID_122477
atggacgaagcagggggtgttttcaaggagttatttgagatgccggctgaggagaaacaaaaaatgtgttcaaatgacccttcaaagacatgcaagatgttcactagcaatgtcaattatgcaactgaaaaggttcacctgtggcgagacaattttaggcacccatgccatcctttggagcagtggcaacatctctggcctgaaaatccaactaactacagagagtgtgttggggagttttcagttgaagttaaaaaattggcttcaaggatcttgagtttgattagtgaagggcttggtctgaagagtggatattttgagaatgatcttactggatcaatggttctttcaattaatcattatccaccatgccctgaaccaagtttggcacttggaataactaagcactcagatccaaatctcataaccattttaatgcaagatcatgtatctggccttcaagtattcaaggatggaaattggattgcggttgagcctattcctaatgcatttgtggtaaacataggccaccagttgcggataatcagtaatggtaagctactaagtgctgagcacagagcagtgacaaattcaagtgatactcgcacctctgctgctttcttcgtagctccttcagaggaatgtatcatagagccagcgcaagctcttactgctgaacatcaccctccaatttttaagtccttcaaatacaaagacttcatctcttactactttgccaaaactggtgatacagaagtagtgctgaaatcatttaaagcacacaagaattaa

SEQ ID NO: 5700 - DNA, 984 bp, Glycine max
  Peptide Sequence Number=SeqID_122478
atggcagataaagatgctttttgctacccttatcatgttgatgattgcacatcaccacaagagaatttgcctaataaagggccttctcattcagaaatgcttcccaaaaattctaggaaaggagctggttccacatcagagaagccacttgatgcaaagacactgagacgtttagctcaaaacagagaagctgcaaggaaaagccgtctcaggaaaaaggcttatgtgcagcaactagagtcaagtagattaaagctcacccaccttgaacaagaccttcaaagagctcgctctcagggtgtgtttatgggatgtggtggtgctggtggcagtttaagttctggagctgcaatgtttgacatggagtatgcaagatggttggaggatgatcagcggcacatgatggagctccgttcggggctgcaggtgccgctgccggacggcgaactaagagtgattgtggatggatatctgtctcattatgatgaggttttcaggctgaaaggggtggctgttaaaacagatgtgtttcatcttattaatggcatgtggacttcaccagctgagagatgcttcctctggataggtggttttaaaccatcagagctcatcacaatgttgataccacagttggagcccctagtggagcagcaaattatgggcatacatggactccggcattcgttagtacaagcagaagaagctctcactcaaggtcttgaacagcttcagcagtctcttgttgacaccatcgccggcagtcccgtcgccgacggtgttcaacagatggtggcagccatgggtaagcttggcaaccttgaaggatttgttagtcaggctgataatttgaggcaaataacccttcaccaattatgtcgattgctgacagtccgtcaagcagcacggtgttttcttgtgattggagagtattatggccgtcttagagcccttagttctctttgggcatcaagaccacgagagtaa

SEQ ID NO: 5701 - DNA, 2943 bp, Glycine max
  Peptide Sequence Number=SeqID_122479
atgatgaatgcatcaagattgaagtctggacctggtggaatgaagtctgagggctcttcagagcttactaatacaagtgttcgcgtgatgcttacaagtgagcaaggcatttctcttcacagggaacacatagctgagcagagagttcttgcaaaaggaagcaataggggaaacactcaggaggacccagcaagcagccctaacacgctaataaaaaacaaggtatctcgggcaccaagaacaggttcagttagtgcactagaatcatctaacattcaaccttcatctacaacatttccaggttcttctattcatccaatgacccagtgggttggtcagaggccacctaaaaattcacgctcacgaagagtgaaagtagtttctcctgcctcacgcaatcttgaagttcaggtctcatccgaaggctgtctaacttctgacttcaatgtaaaagcttcttctgatggcaacaatggatttcaacttgctagcagtgtagacaacagtactccaaaatataaaagaccgcctgatgatatttcatctccctttggattatctgaaagtgaagaatctggagcgggggaaaacaaaataaaagagaaagctgtgaatggaagtgactttgctatggccgcagataaggctggggcttctgtgtttcaaatgaagaagaataagatatcaacagatgaatctggagatagtgtgcagagacaaggaagaagtggaaggaatttatcattagtaaggcctggcctcccttgtgggagggagaagtcagagaatgtaccaacaatgaagccagtacaggacatgaagcctaatgataagagtagaaccaaatatgggcgccctccttcaaaaaagcagaaagagcgcaaaattttgactcgtgtagggaagcaactgaacattagttctcctgattttggaggtgaacctgatgatgatcacgaagaattatataaagctgcaaatgctgctcataatgctagcaaccttgcttgttcgggtccattttggaagaaaatggagtctatttttgcttctatcagcttggatgatgcatcttacttgaagcaacagctcaatatttctgaggaatttgataaaagtttatctaatatgtttggcattgatcatgatttgttgagtgttgttataaataacaagcccactcaaggttcagaggaaagaaagagaagtcactgtgatgaagaatcaactaagtttgatgctttaggtgtaaagaaggacatggaaagactggacaaggttaccccagtattccaaagacttctttgtgctctaatcgaagaagatgaaagtgaagaatcatatcaccaaagtgatgcaaagaatatatctcgacaatgtgctagtgatgattctcactgtggttcttgtaatcaaattgattttgaacccaaagatcgggatagaatggattctgaagttgaatcagaggtggatcttcaagttcagaagaactgcatgttggatagactatcttgtgataagagcaccacgtccaacacatttagatacccaaacacatccagttctttacaaagcactggagtttggcagggagatgaagaattttctctttcagatatcacactcaccagtgaaatatgttcaaatgatcttgatcaactgcagcctgctgaattaactgttcctagctttccttcttctgatggccagtatcagctgatgccactggatgacagactgctgcttgagttgcagagcattggcttatatcctgaaatattgcctgatttagccgaggaagatgaagctataaatcaagatattgtgaaacttgagaaagcactgtacgaacagaatgggagtaagaagaataacttggacaagattgatagagctgttcaagaagggagggatgtggaaaggcagaagattgagcaagctgcatttgaccatcttattgaaatggcttacagaaagagattgtcatacatgcaagtggtccacaagtttgcatgccgtggaagcaaaaattcaaaaggtgcagttcacaaggtgtctaaacaagttgcttcggcttttctcaaacgtactcttggaagatgtaaaagatatgaagaagctggcgttaactgcttcagtgaacctaccctacaaaatatcatgtttaccccaccttcatgtgagaaggatgcacaacctgcagattgcatggtctctgggacagccagcaatacatgtaacaaagcttcagttcaaattgaagccagaaaatcaggtgcagtttctagtgcttctgagaaatatgattgccatagagactatgcagacaggggaatggttgattcttttcaaggttcaattcagtcatcagagcaagcatcatccaagaatgggtccatgtttatcaaggaaaagaagagggaaatgttggtcaatggtggtgtcagtggttcttcctcaagagcatcaaatcttgatggtgctgttcatggtggagtgaagggaaagagaagcgagagggagaggaatcaaagccgggatcagagcagacaaaattctattggcagagctggacgcatgtcactggacagtagccaaaatgagaacaaaccaaaagctaagaagcaaaagagtactgctagtggacatgataggtttatggaagcaaaggaatctgctcgtttaccaattcatgatacaatcaataatgatagcaaagatggggctacgttatctggtaaccaggacacttctcaaataaaggaatccaatgactttgggaatttgccgctacctgacttaagttcaatagaagaatttggtggtgcgcaagatcttagttcatggttgaactttgaagaagatggtttgccagaccatgattctattggccttgatattccaatggatgacctatcggatttaaatatgcttatgtga

SEQ ID NO: 5702 - DNA, 360 bp, Glycine max
  Peptide Sequence Number=SeqID_122480
atgaacattgtggataagcagagaattttccacctttatgttgagtatctagtggtagaggctgaaattatccattgtgttccaagctattttcgtgatgatatgttcatgatccagttggtgatcacattgcaagtgaccacaatgaaggaagaaaccaatgatacagaggaatttgatggggaatttgtaaatcttgaagaaataaatataagaagtcgtgtaagaaagaaaagagggagacaatttgatggtggtgcaactagcagtgttgaaaacaatgatgacaatgatgttgattatcaatctggaaaattggatagtgggcaaagtcagatggggaagataatgcaattttga

SEQ ID NO: 5703 - DNA, 486 bp, Glycine max
  Peptide Sequence Number=SeqID_122481
atggcatcaagaaagagagcgagaattgaggacatcccttcatcatccaacctatctccttcgacagcagccatggaaccagatgcccaacaagcacattctttaattcctatgttgcaaagcttattcaggggacagttgatgatcgtatacaaccagcaggagttggttcacaacagaccaatcatatctatggagcagtttctggaaaaagtggcatggcctgaagctcagctccctctagaaagagcccataaggttgttccacccggacctgtactagctaggactgagccgacatcaattgaaccacagcctcctgtagtagatccacctacttctccggagcttgagacattgtctcctccagcaccacctttgataatcatccccgatgactcagctgatgaagctgctgcttctcctgattcaccatcttgcaacatagacgatggttctgccttttctgattggatggactgctga

SEQ ID NO: 5704 - DNA, 522 bp, Glycine max
  Peptide Sequence Number=SeqID_122482
atggttgagtctgccatgtcaaagacaatgatggaggaagtagtaatggcaagttcttggtcagaggggtcagaggatgatgaccttgtgagagagcttttagatgatgggtctccccttcttattgaaccccccaacacaacaacaaaattagcctcttcaagtgatgaccaagaccaagcctttaataggttcatctccaacatttactcaggacctaccatctcagatattgaaaatgctttgtcagtgaccaaccaaagagatcaccacttcccacaactctcatcagccagagtttccatattggaaaggggtttgagtaagattgagaataagtataccctgaaaatcaaatgctttggcaatgggatgggtgatgatggatataagtggagaaagtatggacagaaatccattaagaatagcccaaatcctagtactttggcattacttcaaaaatcttttaccgcaagacaaaaaggacatgcagagagggtcttaaacttggaacttatttaa

SEQ ID NO: 5705 - DNA, 528 bp, Glycine max
  Peptide Sequence Number=SeqID_122483
atgatgaactacaggagttactataggtgcaccaacccaaggtgcagtgccaagaagcaagttgagagatccaatgaggacccagacactcttatcataacctatgaagggctccacttgcactttgcttacccatatttcctcatgggccaacaacagcaatctcattcctacccaccaatcaagaagtccaagcccacctctccacaggcccaggaccaaacccatagagcagactatgttcatgaagcccatcagacagaagaagcccaatcaaatgctactatgggtgtgatgccatcatccacttcattggactctacactagacatggcccaagaaagtttgggctcacaagggttgcttgaagatatggtgccattcatggttcggaacccctcaaacaatgtcaatagtgctcatacaaaattctcttgttcttcataccgttctcctccaacatcacctctttgggcttcaacttactccaccacttgctataccgttggcttaaattctagcacttag

SEQ ID NO: 5706 - DNA, 840 bp, Glycine max
  Peptide Sequence Number=SeqID_122484
atggcggacgtgtactccgcccccgaggaaatccacgggctcctcagctattgtcagcatatgatagacttgatggaacatatgaaagtcgacatgtcggctttcaaagaacaaatgacttctatgatggaggccatgctagggatgaaacaactaatggagagtaacgcggccaccgccactgctactagcacggctgccgaggcagacccggctctcccgactgctgcgcaccatcccgttccaaacatggtgggacgagagagaagcacatcaggacatatcagcaacccccatccgggatacaaccgaggggagcctcctcggcatcctgacatggtccacgagaatcctcgagagcacgctcagagagacgtcgactcctactccccgtttcccgctgaggggccggtgcccaacgcactacctcaacccaacatcacgagagagcctcgaaaccacccaatgcaaccaatgtttctgtccgtgggagggccgcccctggcagcggaaggaaaggggaaactcaatctcatcgaagagagattgagggctgttgaaggattcggcgattatctgttcatagacatgaccgacctgtgcctggtgctggatgttgtcatccttctgaagtttaaggctggggcaacaatcatatggtacactaacctagaagcttcccgcatccgcacctggaaggatctgattacggccttccttaggcaatatcagtacaactctgacatggctcccgaccgaactcaactgcaaaacatgatcaaacgagaacatgagtcttttaaagaatacactcagcgttggagggacctagcaacgcaa

SEQ ID NO: 5707 - DNA, 405 bp, Glycine max
  Peptide Sequence Number=SeqID_122485
atggcttctgagtccggcaggctggcgacggtcgtcagcgcgtcgcggccgatgccgagcatgctgagcgccttcacgctgctggaatgcgggttggccgccagcacctggacggggccgagcgccgccaggccctgttgggcgatatccacgccgtgctgttgccccagccactgccggccaatggccagcccggcgaaattggccatggtggcgccgctgaccaggctgccgctgaacgcttccggcaggcccagcagggatttcaactgcgtcaccgcggccagctcgatcgccgcggcgatcgtatcatggctgagttggctattttggtctgtcacgctaaccagccagtctgccgcgaccgccgccggcgtgcccccgccggtgacgaagccaaaataa

SEQ ID NO: 5708 - DNA, 636 bp, Glycine max
  Peptide Sequence Number=SeqID_122486
atggatcttgtaggaccgccaaaggagtgtataggagaaaatcagctacccttgagtggagtgatacctggtaaaaaagtccaaaccggtgatgctcagaaagaaaatcctacaaaagggccttttgaagctttatcagcaggaaaatcttcccatattgttggttcaggaccgccaaaggagtgtataggagaaaatcagctacccttgagtggagtgatacctggtaaaaaagtccaaaccggtgatgctcagaaagaaaatcctacaaaagggccttttgaagctttatcagcaggaaaatcttcccatattgttggttcaggaccgccaaaggagtgtataggagaaaatcagctacccttggatggagtgatacctggtaaaaaagttcaaacccatgatgctcagaaagaaaatcctacaaaaggggcaccatttgaagctttatcagcaggaaaatcttcccctattgtcgattcaggtgatatccgccgtgctgatgctgaatgtaacaaatctaatattgaaaaaagtgatcttcggagtgttcaggaaaacttaaaccttcattgtaaatttttaccctcttcatttcctgcttggaggtatgtacccctcttcccttgtcactga

SEQ ID NO: 5709 - DNA, 249 bp, Glycine max
  Peptide Sequence Number=SeqID_122487
atgggaggaaaatgcgcggagtcgccaccaacgtttattcgaggaaaacgtcggaaaaaccggaaaagacgtggtctacgaactttaagtgtgaaaggttcgggagttgtatttacacacggggaaggaacttaccaattgaagatcgaagaacgaacgaagaacgatgaagaacggtggaaaatcttcgcgaaatcgcccacgaaaacgtctcggaagcattacggaagtgcctcggcttattcatga

SEQ ID NO: 5710 - DNA, 975 bp, Glycine max
  Peptide Sequence Number=SeqID_122488
atggatgctgctaatttgttcaagcccatgcttgcgaggggtcaattgaggtgtatcggcgccaccacacttgaggagtataggcagtatgaggagaaggatgctgcattcgagagaaggtttcagcaggtgtttgtggcagaactgagtgttgttgacactattagtatacttcgtgggttgaaagagagatgtgaaggtcaccatggtgtttggattctgggtcgtgctttggtcgacatcttccggacaaagcaaattgatttagttgatgaggcttgtgccaatgtgagagttcaacttgatagtcggccagaggaaattgataaccttgaaaggaagagaatgcagctagaagtggaacttcatgcactggagaaagagaaggacaaagctagtaaagctcgtttggttgaacaaccaactggctccttcttgttcttgggtccaactggtgttggcaagactgagcttgcaaaggcacttgtggagcaactcttcgatgaaaaaaatcaattggtgagagttgacatgtctgaatacatggagcagcactctgtttctcgattgatctgtgcaccaccagggtatgttggacatgaagaaggaggtcagctaacagaagctgtaaggcggaggccttacagtgtgttactctttaatgaagtggaaaaggcacacacatctgtgtttaacacactccttcaagtcttggatgatgggaggttaactgatggccaaggccgtgcggtggacttcagaaacactgtcattatcatgacctctaaccttggtgcagagcatctcctcactggactttttggaaaatcttcaatgcaagtagctcgtgatagagtaatgcaagtgaggtctttgtgctttttgtttaatatgtatgacagagtatctctggccgtaaagaagatgaagattgagcaaattgatgacgatgaagatggtgaaatggaagaatga

SEQ ID NO: 5711 - DNA, 174 bp, Glycine max
  Peptide Sequence Number=SeqID_122489
atgccagtttctccttcacgggatcaattggtcaggtttggccatgcccttttcgagtatggcctcaccgcttctatttacgatgtcatggttattccttccctgcaaagaatgggaattggtcaaatgatagttaaaaaaattgttaggtatgcagttgtggatgagacttaa

SEQ ID NO: 5712 - DNA, 342 bp, Glycine max
  Peptide Sequence Number=SeqID_122490
atgcgtggggtagaaggtgtcacagtttggcctggggatccacctagacattcacctctcatgcatgatgacacatttgttgaactagatattcctcaacacccggtggcggcagtagctatagacgaagcacttgcaattgcacctactcatgaggcttgccaagcaataactggaagattgaaactgctactcaacctaaggatagtgacaaaaggtacaaaaacattcagtgtcatggaagactgcctaaggattgccaaaggtgtgattgcaaaacgcaatgtatatgtgcaattgcgacgaaggtggcgtatggaagatgcagatgaagacctttag

SEQ ID NO: 5713 - DNA, 249 bp, Glycine max
  Peptide Sequence Number=SeqID_122491
atggaaaacggcgtttacatgttgggggttgcagaagacggagacaagaacggaactgtgagacagtgcaatgcggagcttgtggatatccacgggttcgggtcaggtagggaatcggtgggtagagtggttgcaatcaacgaagaggtcttggagacggtgcgggtccacatggcgtgggtcggtagaaatcatgtcaccatttttgttttgtgtgtttgggcaacgcaagaagtttggagtggataa

SEQ ID NO: 5714 - DNA, 294 bp, Glycine max
  Peptide Sequence Number=SeqID_122492
atggattgtgaagatggtgctaataaagaggttcaagaactggttgttggtgtaagaagaccaaagggtttttttcctcttggtgggagtgggactagtctagcttctatggagtccttgtcaatgcctcaggttcaggaggttgttctgtctgcagacatgcaatgtgagaggtaccagaagagggttactgacattattgcaaaaatgaatggagcatttgattcccaagaggaagagagaggaaatgcatacatcattcataagaggtggtccttgttggtttccacctag

SEQ ID NO: 5715 - DNA, 524 bp, Glycine max
  Peptide Sequence Number=SeqID_122493
gggaaaaagtggtgtcagtatttggtcctggtaacttgagagtgtctcaagattgggtagggaatgagtggatatatgtgagggaaaggcctgatcttgtggcttctgttttatctagcttgaaaacaaagcaaaattccaataacagccaatcaactggagcaaccaccagagatgtaatacaatccgggcaatcagatacttgcttggattctgataaggatagaccaagaaagcctgaagtggttccagaccttttgaagaatgatttgttatcccagttaaggtggaagaccaccagaaagaggagacgctggagcagcgccacctcatatcagaagccacagtgcactgacacccatcagaagaggtcgccgaatgttgtcacatcaaatgctcctgacagttttgtgatcccagcatcattaaaagttgatcatgatgactgcaagtatgttggggatccttccatcttcagttcttcagttgtgccttctctaactaacatggttatgtgtaggtga

SEQ ID NO: 5716 - DNA, 354 bp, Glycine max
  Peptide Sequence Number=SeqID_122494
atggatccgacggtggagattggctttgacgcaggaaaggaaaggaagttaagcggggaggcgaagttacgaaagtgccccggggatttggtagagttacgggtttgccaattttttggacagaaaaaaaaaaacgcagatggaaatcgatggtgtcgcccgaaattgccggtggagaaaagaaagaatggaaagactcgatctctctcgatgccaggtggacgcattgccaaagtaaaaagagtgttacttggtgcacatagcatttttgctgcacatagcatttttgctggaccacccagcacgcaggatgaaagggcaatgtccttcaccctttgctataaaatcaaatag

SEQ ID NO: 5717 - DNA, 1278 bp, Glycine max
  Peptide Sequence Number=SeqID_122495
atgggaacgacgtcgtgtgagaagaagagcgtcgtgtacgtgagctgggacgaggtgttcgtgtcgaacgacaaggggaggagggaggttcattacttgcttaaacgaagaggcggtggctcggatctggccgttttgggaaaagagaagagcctcctcagacacatgtcgtatcgctacgccattcgaaacgccgcgttgtttaagccttacttgaagctcaggtcgcgcagagaggttgttgattggctggattcaattgtttcagattcgtcttcaggggatgcggttatggtgggaaaacatggttatgaacctgaaattggagccttgaaggacaatcaattgcagaagatgcacagttgtacaaaagagttctcatggatagggttgccatggacgtgtaagaaaagaagaaagcactatcaggcatataaaagaaatggttttcagatatccgtgcatgattttgtatttgttctggcagaagaggacaagcgtttagttgcctacttggaagacctttatgaggattccagaggcaacaggatggttgtggtgcgctggtttcacaaaattgatgaggttggtattgctttgccgcacagttttagtgacagagaggttttcttttctctttatcttcaagatctgagtattgaatgcatagatggattggctttcgtgctcagtcctgggcattacaaaaagtttcagaatgaggcctgtcgtactcacttggaaccattcatgtgcaaccaccagttcgataatgatgatgtgaaaccctttgatataacacggattaagggttattggaaacaggaaattctcaggtacatgtatgcccaattggacttgaagtctagtgggagttccgggcaatctgatgttagcctggaacttgatgaaaatcatacatctactgcttttgtcagacctaagaagaggctgtgccttactgaagcagctgatgccaaagaagcagctgatctggttggccttagtacagaaaatctgaataacagcaatactggaaacaattctgggaaactggttgggcacacaaacaagacagcaaccattaaagggaaaaatgaacatgcttcacaccatttaattgtaggttcccaagtcgaggtcctctctcaagacagtgggatgagaggatgctggtttagagcttctgtcattaagaagcacaaagataaagtcaaggtgcaatatcaagacattctggatgcggtcgatgaaaccaagaagcttgaggtgtgttga

SEQ ID NO: 5718 - DNA, 303 bp, Glycine max
  Peptide Sequence Number=SeqID_122496
atgatttatgttaaccctgacccgggaagtcaggcagcaggcgggggtaccagacggcgagtcaggtgccaggcggatataccttatggtcatccgcacctttcgtcaaccaaggcgaatgagttcgacggtttttactctcgtcttccggagacattcaagcccgatgacacacgagattcttctctgctaggtggggacgatcaagccatagcgtgtggaaacgtcatgggggtgcaaatagcaaccaagtccacttgggccttcatgagggttccaacaaaaggcggtgccttctggtag

SEQ ID NO: 5719 - DNA, 1992 bp, Glycine max
  Peptide Sequence Number=SeqID_122497
atgggaggcgaggagaagcggcaccagatgatgcagaacctcttcggagaccaatccgaggaggaggaagagctcgacgttgattctgagcacgaatcaaacccgcaactcaattacccctccgtacaccccaattccacgaaccctaaccttttccttacgccacgtttggatcccgaaccatttcctaacagttttcgtggggagggggtgggggagcaggagggcgaggtggagggccagggcgaggtggagatcgagagcgacggagacggtgagcccgaccgtgagagcgagggcgagagggagcagagctcgcaggaggtggaggttgtggagagggaagaggagagcgagggaagagactcggatagtgatgccaaggacggcgggtatagccagcatggcgtcacgagcaagcggagggacgacgtcgtggagagcggatcggagaggtccgaggaaaatcagtacgctcaccatgatgacggggaagaagtggatgaagccagaagccccagtgggtcacccagggatgaaaaagatgagactcgtgacttgcatgcggcccctgaaattcgtgatgtatttggtgattttgatgatgatgaagaggaggacatcgggtatgcagttcagcaggacatcagacaagattcgaatagatatgctgtggaggaggaaggaagttacggaaagaacctgagacctgaagatatactcgctgatgaagataatcagtatgaatcagaggatgaaaatatcgagataaaaactaaggagaagccacttggcccccccttagagttagaggttccattacgaccacctccagctcttccagaaaagatgaacatgattaaagtttccaatattatgggtgttgatccaaaaccctttgatcctaaaacatatgtggaagaggatacttttgtaactgatgaatctggaaccagaaaacgcatacgtttggagaacaatattgtacgctggaggactactagaaatcctgatggcacaacatcttgtgaaagcaacgctcgctttgtgagatggtctgatggcagcctgcagctattaattgggaatgaagttcttgacatatcagtacaagatgcacagcatgatcaagcacatcttttccttagacatggaaagggaatcctccaatcacaaggaaggttattaaggaaaatgaggtttatgccatcttccttgtcatcaaattctcatcggctgctgactgcccttgttgactcaaggcataagaaggcttttaaggttaaaaactgcattactgacattgatcctgagcgggaaaaagaagaaaaagagaaggctgaaagtcaaaatatccgtgctaatgtgcttcttaaccgaaagcgtgagaaggtgaatcggaagtatactccagctgtggagaggaggcgtcaactttctcctgggtttttagaggatgctttggatgaggaggatgaagcagactattatgataatcatcgttctcagcgccgctttgaggatgatttggaagtggaagcccgagcagagaaacgaattatgaatgctaaaaagtcacggggacctaaagatatccctcgtaagtcttccttcccacctgctaaatcctctcggaacccaatgggttacccagatgatgagagagaggagtctgagtatgaaactgaggaggaggaagatgagaggcctccttcacgtaagagggatgaggatactgagccagagtatgaggatgaggaagaagaggaagaacactatgaagaagccgaacaagttaatgatgcatcagatgatggggaagaggaggactactgtacatgtgtcctctttgtgcttgaaccaaagcagaagagcaaggagtttagaggcagtgccaaaaggaagggatttgaatctgatgatgactcttctccaaggaaaataaccacccatcggcggatggcggttgtgtatgatagtgatgaggactga

SEQ ID NO: 5720 - DNA, 258 bp, Glycine max
  Peptide Sequence Number=SeqID_122498
atgtcgtacgaaaacgagggagaagataactcgaagttgcgagtgaagataaatgagtatgtcaatcttcacgatcctctcatagtgtgtggcctaaacgcgctacatggacttggccttgctggagaagtcaaggtagtcgtaccccacgacgacacaggcggccatgacaagctcgccatggaggcgaaaggagccaacatagtcgaggagaaagaaagggagaaaccaatggaagggaaggaggctggagggtag

SEQ ID NO: 5721 - DNA, 525 bp, Glycine max
  Peptide Sequence Number=SeqID_122499
atggaacaaagcacttgtagcaacataaggcaggttgtatgcattactcctaagacatgtggacttcaagcagccaaaagaggtggtatatggttgccactggacattatattgatggctcttagaacttgcaaagtcaaattttgggggttcatttatgttctcgctcctcactcaagtgatagattgtgtaatgcattagttgattgtttaatggactggaacattgacacaaagttgtccaccatcaccctagataattgtagcacaaatgacataatgattaacaaaattaaggatgaattgcaactaggcaatttattaaggtgtaggaaaaggggaaccaatcgaattgcggcgtttggcaccggttacagcgcaaggccaaagagtcacttaggttttgatggttgtttgttagatccagaaacaaagccacaagaaagggcaaaatggtctttcatgaagatttctgaccctaaattcgctcaggctagcatccaactcgcctgggctaagatgtga

SEQ ID NO: 5722 - DNA, 207 bp, Glycine max
  Peptide Sequence Number=SeqID_122500
atggcaaaaagctatgtggaatctaaagtagtcactgaatttgaatttgctagtttgatgaatgaaattggttcaaatgatgaaggtgaaatgggtcggggcggggaaactcgacacccaaccgagggtggggctaggtctgaatttttaacccccaaccaggatcagggggcgaggatggtttgggatgtcgggggtagggagtag

SEQ ID NO: 5723 - DNA, 279 bp, Glycine max
  Peptide Sequence Number=SeqID_122501
atgatgagcgggggccacgttcaccattacagcgtgcaacgaggacacccagtggaggttatagatgatcgaggtagcattgattgtatgcattgggaatggaaaaattatctagtagcacaaaaaggtcaattttatcgtggtgatgccccacaccataagacttatggatttgatatgcatattttgggattttgggttcaaacaatgacatcaaaatgctctaaggaatctcctgtgttcaatgaaattatgaagggagaagcctatacagtataa

SEQ ID NO: 5724 - DNA, 252 bp, Glycine max
  Peptide Sequence Number=SeqID_122502
atggcgatttgcagagccattgggaaccgccagtcaaactggcgagttccaacagctgagggtgcctgccatggcagtgaagggcagagcgcgtcgcgtcagtcaaggccaaatcgccaatggcaatggcgatttgccttgggcatggatcgccagccatgctggcgggttgctcctaaatatgcttcttccattataaaagctcagtccgagagtgcaccagctacgcttccttcgtggctcagtccgaga

SEQ ID NO: 5725 - DNA, 153 bp, Glycine max
  Peptide Sequence Number=SeqID_122503
atggtggggtacgagcacaattggacttttcagggtggtggcatgagtacaagaatgatggcgcatgtggagtttgagtctagttatggtgacaagaatgaggggttaggaaaggtcggctcaaggataagactactaatgctcaaactttag

SEQ ID NO: 5726 - DNA, 315 bp, Glycine max
  Peptide Sequence Number=SeqID_122504
atgaaggatgcaaaagttgtgatgactagaagcaagaaagttcaaaatgactttgagaagaaagaagactcttctccaaaagttacaaatgacatccttactataaaggacgaaacacctaaaaaggttaagaaattgggcataacaaacttagaacctactaacatcactctttaccttgctaatcattcagttgtctatcctagaaaggcgattgaggatgtgctagttaaggtggacaagttcatctttcgagttgattttgtaattgtagacataaaggcggatgaggatgctcatgtcatattgggatga

SEQ ID NO: 5727 - DNA, 210 bp, Glycine max
  Peptide Sequence Number=SeqID_122505
atggggatgtctcctccacctctaggacctctcaatcactcacaaaatcagctcacgctctcaggatggcttccttttccaactctgattcttcctcgcgctcagccgaggagggttgcactcagcggatggctcgctaagccagatgattggcttagcgagatggtgaaaatcagcatttcacaaacttgcctaattgtcatgccctaa

SEQ ID NO: 5728 - DNA, 504 bp, Glycine max
  Peptide Sequence Number=SeqID_122506
atgattgagacaagtatgcgagcaggaaatgccgaagtgtatggattcctcgagcgacagtccattcagagatctaggcaatcgccagacaaccacctgaaaggaataattaacagtgctttgaaaggacttgacgatactccacaacctaaatccaaggctggtgctaggtggattgttgttaaatgtaatagacaaaaaggaagcactgagtgtggatattgcgtgatgcactggatgtcaattataatcttaggaagtttcaagaataattgggaaacacaaaagaggcagaagaaactggccaaggctattgctaataaagacaaggctttggaaacttttggccttgctataaaggttaaaaggatccttagggagcagaagggaaaggtccaaaccaaaaagcctgcccatcaaaaaaaggaggaggaaaaaattgttatagaggagcaatggatgaagaagaaacatgaagtgcccagaccctctcttccagtgtag

SEQ ID NO: 5729 - DNA, 5364 bp, Glycine max
  Peptide Sequence Number=SeqID_122507
atgcctggaaacgaagtaggagacagggtccataatttttttggtcaagagaacttgtcccagggacaatatcattctcaggcagttgatgggaactggccaggactaagcaacaatttgtgggctggtagccagagatcgactggtgtgccttttatttccaatttgaagaattttaatcaacaacaatcagatcctgagcagggacatgcaagctctccacatttgcgacatggattgaacctatctcagtctagttttaggcctgagtctggcagaaatctgctgccaaaccagcaatcagctgtgaatggctatatacagggacaacaggtttttcagaccaggcagcatgacattttgggagtggacacagagtctgattgggatagtctgtcaagaggaataccagtgctggagtcacaagggagtggtcttgaactctacaagaaaaacttggctaggaatgacgctgctgaatctccagtcaattttgatttttttgggggtcagcagcaaataggtggacagcatggtggaatgcttcaacctttacctagacagcagtcaggcgtaaatgaaatgcatgtattaaagcagcaagcagtacataaccagatgcaagaacttcagaggcagcaacaatttcatcaattagaagcgaagcaacatgattctatggctcctacttcctccatttcaaaacaggtagttgcaagccattctgcatctctcatcagtggcattcccattaacgaggcatctaaccttatatggcagcctgaagttatgccaactaatgctaattggctccagcatggtggctccccagttctgcatgggtcctctaatggacttatgttttcccctgaacaaggacagacattgcacctgatgggtttggttcctaatcagggtgatcagtctctttatggggttcctatttctagttcaagaggcacacctaacctgtataatgttcaagcagataagcctgcagtgcctcaggtttctatcccacaccagtattctcttgttcttgggaacaaacctgctctgcagcacatatcagctggtgataattcattttctcctcatcaatatgctgcatgtccagaccaagttaacacaaatgatgggacttcagtttcaaggcaggatgttcaagggaaaaatatgtttggttctactgctcacagtataaataatggaccgaatatggagaacttgcagcaaatgaatcctgagcaaagaattctaccaatgcaagattttcacgggaggcaagaactagctggatctttagagatgttgcaggacaagatgctagtgcaggctcctccttcacagaacgttgctaccttagatccgactgaagagaaaattttgtttggttcagatgacagcctgtgggatggatttggcagtaatatgggtggtttcaatatgttggatggtacagatagttttagtgggattccatctattcagagtgggagttggagtgcacttatgcagtctgctgtagcagaaacttctagtagtgacataggcaaacaagaggagttgagtggtctaagtttccggaatatgggacagtcatctggaaatgagccgccttcaactattgatagcagcaaacagcaatctatttggactgacagtaacttacaatcagcatccaatataaattcaagactttttcttcggcccgatgatggtagtaggccaaatgcctctgaaaattattccggtgtttctgggtttcatcagtcaggtcctgatacttcgcgtgaacagcataaaaggttacagaacaattctcagagatcaattccacagtttttagaaagtggcaaatggttagattgcagtcctcagcaaaaacaacttgcagaagggggtcaaatatatggaaatgctgctaactcctcaggtatagaaaaaaaccagcagagcatgttgtcaggtaatagtagtggtgatcctttcaataaatctaatggatgggatattatgaaatcgccatttgataggagttcaaatttgaaaacccatgaaagtgaaaactcattgcagccccatcacgagaaagctatgtgtgaggagatgggccaggttcctgctatgtgggaacctgattcagatactaattcatctgttggaatggaacatgtgaagtctgcaggtaatatgcaggtttgtggggaagattctggtacgaatggtattgctgcattgccaaattcaggcactgcatggttcagccagcaaagcagcaagcagctccctaatgttgatgtatttagggatgcagagtcagcaggaagctatagaagaaatgaagttccaggaaagtataagcatcatatggagaagaaccccttagttttggaatcatcaaagaacggaaatgtagaaggtgagatgcatgatttggagaactctaacaaaaaggagaaatctgcggatagtcttggctgtaatccttcccatcctagagctggtggtatgagagaaaatagtagttttgatggcaatgattttcataatccaaagttatctggtcagggaaatcgaagacctcctgtatctcgtaaatttcagtatcacccgatgggggatctgggtgttgaagtggaaccttatggaattggaaacaaacatgtcataaattcacagcctatgccccatcaacccttgggagtatttaaaggtcaggaccaaagctatcttggacagtcaaagtatggtcattctgacaggaattataatgaaatgaataagcttggaccagtcaagtggggttatggcattgcaacaaacacaagcctttctaactgccatttatcttccagggtgcctgaaactgagtcttctgatggatctgttgcacatcctccacagaatcaaagttttttgtctcagggcattggtttacaattggctcctcctactcaaaggtttcctgtggtatgttctcatgggtcatcagagacagatcatactacaccacatgtgtctgagacaagggataaggaccatacatggttgggtactaatcagacttttccatctcgagatccatctcatggggagcttaggagtaatatttctagcacagcaggacaaatttttgataaggtgtcacaatacggtgtgctgggaaacattccacagtcttttacatctggttttcctttctccaggatccattctcagaatcagaatttggcaaatcttggtggacaagtagcaaatactcaacctgctaatgtagctttcactgcttccatgaatcagactgatgaatactgtgaaaaagctcaaactagtcaatctgaattggcttctgctcaggacatgtcccagctgagtgatatagatgaagatcgtctgagagatcctgccatccaaattttgacagcagaggctggcactcagccttctgttacttttagtgcatctccacatggcaccccttcaaaagttgctcacaatgtatggaccagtttttctagcaagcaacatcctaatgcttcaaggtttctatcccagccccaacaaattaatgattgtgaaatgatcaccagctcacagaagccaggtgatgagggtttggagaaagatggcaatgaccattctggtactgacccttgtattgcttactccaatagttctgtgggaaactcgcttaaagaaatttctgcgcagaagacattgcctgagagtgttgttgctgctgaacaggcttcatgttcatcatacctgaaagaaactgttggacaacatatgtttgatgcatctcaacctagcccaactgctactccaagagatattgaggcttttggccgatctttaagaccaaacattgttttgaatcataatttccccttgttggatcaagttcaattcacaagaaacacggagactgatcctagtaatcgggatgtcaagagattgaaagtttctgataatatggtggtggacaaacagctggtagattccaaccatgggcagcagttgtcatatggatatgataatgtggtcaaagatgggtcaggtaataattccatgccatcatcagatcctaatatgctaagcttttcaacaaagccacttgatagacaggacacaaatgcatcttctcaagagaaggttggttatggtgaaaaaattgctcttaatgttgatgatagtaacaaagcaacttctgttaaaagtaattattctctagtaaatcctcagatggcaccatcatggtttgagcggtatggaacttttaaaaatggtaagatgttgccaatgtataatgtacagaagatgactgctgctaagattatggaccagccattcattttaccaaaccaatcagatagtttgtgctttcataattcagtagagcaaattcagagtgtcagtgatgctcagctaagtaacgctagcgaaagtccaatgtctgcctctgctgcaagtaagcatgtagaccctcagttattgacacctgctgttgaacctggcttacttgttacgagaccgaagaagcgaaaaagtgccacatctgaactcataccatggcataaagaactgttacagggttctgaaaggcttcgagatatcagtgtggcagaattagactgggctcgaagtgcaaacagactgatcgagaaggttgaagacagtgtggaggtagttgaagatttgtcagcagtggtgaagtcgaaaagaagacttgtcttgactacacagcttatgcagcaactacttagccctcctccagctgcagttcttgtagcagatgtgaagttgcatcatgagagtgtggtctactcagttgcaagattagcattaggagaagcatgcagttcaatctcatggtccagatgtgatacactttttcctcctggcaacaagaacctgctgtctgagaagtgtaaatcatccgacaaaattgatcattacattttgaaagttacggacttcgttggtagagcaaggaaattggaagatgatatattgagcggttttggggttggcctctatgtgccgttatccgggattgactacttaggtgatagtgccctttccaatgtacctcagaattcggatcattgcatctccatggtcattatgaggagattgcatgaaatgactcacccaactacaggaggaaatatcttgtcttgtaatagtgaggatttggaaagatattctgtcatcaaccgatttgccaagttccatggaaggggacaaaatgatggggcagaggcctcatcatcttctggtgcaaatactaatgctcaaaaatcgttccccctaaaatatgttactgcagttccattgcctaggaatctccctgacagg

SEQ ID NO: 5730 - DNA, 198 bp, Glycine max
  Peptide Sequence Number=SeqID_122508
atgggctgttcccaaaacggaacgacgcaaaacacacacacacacactcaatcacaattccctccacgagctccagcaccagctgagctcaaaccaaacacgcattcacgcgataacacgcaagatcggaagcatgcgcgcaattccgtttcgcaagcagcattcgtatcgatttcgccgcgcaaaacagctgaatga

SEQ ID NO: 5731 - DNA, 103 bp, Glycine max
  Peptide Sequence Number=SeqID_122509
atggtgtcagccatcaagaatttggaggtacaggtgggccaactagctgaaagatccacatggagttttgtagccaacactgaggagaattccaaggaagaat

SEQ ID NO: 5732 - DNA, 1201 bp, Glycine max
  Peptide Sequence Number=SeqID_122510
atgatcctgttctcccaaatcgccttccgccgcagcctgagcaaagaacaggtgaagcagctggcgtcccgctgcgtggcggggtgtcacctcggtggtggcgatcgtgttcctggtgttcatcatcggcctgatcggctacttcccgaccacgcgcgtctcgctgtacgccggcctggtctgggtggtattgctgctggcggggtactggttcaaggtcaaccatcagaaaaaacgcgcaccgttggcgacgcagcaagactaaatggaaaaacaccggctaaggccggtgtttttttagcgtttgtcttccacttcatcctccccggcggcgcgcgcttcgatatgcatgtcgccgccgttaaggcgttcctcctcttcctcgccggcgcagcgcgccagcacctcgcgaatgttgcggggcatgcggctttcgtccagcgaagcgctgtgcaggcagccgataaacagcagggtggccatcagggtaaacagccgcatgccgcgcaggtcattgccggttggcgtctgatgcacgcgcaggccgaactcgtcgatcaccgccagaatatgatcgaaaatatccgcctgaatgctttcatactccgcccagaccgtggtgttggtgaaggcgtagatttccagcggcaggccttccggcgtcggcgccagctggcgcaccatcagcgtcatgttctggtgaatgcgcgggtgagcgcgcaggtaggcttccagataggcgcgcagcgtgccgaggttggtcaggcggcggccgttgagcggcgaggccagatcgatggcaatctcctgattgtgccggctcagctcctgggttttatcattcaggtagctgtgcagcagcgggttgcgctgcaggcggcgctgttcctcttccgacaggaagtgcacgctgccggtgtcgatattcaggctgcgcttgatgcggcgcccgccggattccgacatcgaccgccagtttttgaacgagtcggagatcagcgcgtaggtgggaatggtggtgacggtgttgtcccagttacgcactttgaccgtggtcaggccgatgtcggtgaccgcgccgtcggcgccgtatttcggcatttccagccagtcgccgatcttcagcatatcgttggcggagagctggatgccggccaccaggccgaggatcggatccttgaacaccaacatcaggaccgcg

SEQ ID NO: 5733 - DNA, 240 bp, Glycine max
  Peptide Sequence Number=SeqID_122511
atgtcagtggttaaagctcttattgatcttggggcaaacatcagtcaaatggctctatctatgacccagttagccacaggaggggattgctcccaattttcttccgagacagcctgggtttgctaccgtggtggagctcgcactaggcatggggagcagttgaccacctactcccagtacctccacacctacccagaccatgacaccatcgcaaccaagctgagcaccccaggagggtga

SEQ ID NO: 5734 - DNA, 600 bp, Glycine max
  Peptide Sequence Number=SeqID_122512
ctgaagataaaggcgtatcatgataagaagctccaaagacagaacttccagccaggccaacaagtcttgctcttcaattctagactcaggctatttccaggaaagctgaagtcaaaatggtcaaggccgttcgtgatcaaagaagtaagactccatggagctgtggaattggtagaccttacaacagacacaccagagaaaagatggatcatcaacggaggtacaagaagcggaaaggttattgggctggaaagcattgcgctcagcacgcatttgcacgctcagcgccaagctgacagcacacacactaagcgaggcatccttgctaagcgcacaagtagtgatcagagcttggaagctgagtctggatgtattggactgggcaatctaggtgtgggaggtaagagcgaggttaaagtaggaaagcatgctctaggtctgagccaaggtggtcaggtccttccgcagaatcttccacgaagccccgttgacattcagcatgaatcaccctcctggggtgctcagcttggttgcgatggtgtcatggtctgggtaggtgtggaggtactgggagtaggtggtcaactgctccccctttga

SEQ ID NO: 5735 - DNA, 242 bp, Glycine max
  Peptide Sequence Number=SeqID_122513
gagtacgtgagctcagttgaaggtgggcaactggggatggtgggttcatgtgtgatttgtggatgtggagagtcgatttgcaccatcgcccgaacgccacctagtaccacatatgacggagtggtacttggagatatgtcgtgggggtcaggagaccttggggacgtcaggcgagctcctggcagtcaaccgataaaagaacaaagaccacaaagcaaggaggcttgtgtggtggctggcca

SEQ ID NO: 5736 - DNA, 270 bp, Glycine max
  Peptide Sequence Number=SeqID_122514
atgaacaaaggaacgaagatattgctccagaatgcgaatgaggacttctgtttagacatcagattgtgggtggtaggaagtgctcatgcggagcttggtgccactcaattgaaaaaagttcttgctagaaagtgcttattaaccgggggtccctgttggatacaaggcttcacggaaatccatggagtttgcaaacaatgtccaagaaaagcacaacgaccttgtaggcggtgtaatgaggttggagagcaccgagacgggttcccttag

SEQ ID NO: 5737 - DNA, 693 bp, Glycine max
  Peptide Sequence Number=SeqID_122515
acgtcctcaccttcagaggactacacgtcctcaccttcagaaggctacacgctttcaccttcagaggagtacacgtcctcgccttcaaagggttgcacaccctcaccttcagaggactacacgtcctctccttcagcgggctacacaccctcaccttcagaggactacacgtcctcgccttcacagggctacacgccctcgccttcagaggactacacgtcctccccttcagaggactacacgtcctcgccttcagagggttgcacgccttcacacgtccttgcctttagagggttgcacatcctcgctttcagagggctccacatctgtgcctttagaggacttaaggtaagtatgcacgtggctcaactgatttctgatgccattcattattgtagggatcacgcccataagacaccaaatggacctggaggagcccaacagggccctggggtttccagctctggttacgggcctctatcagtcctacagggtgcccgtcccccccagcaagggatcgtgcccgcaagacacctagtggacccgaagaagtccaacagggtcttggggtttccagccctgattacgggcctctatcagttctacggagtgcctgttgcccccaccaaggtcatcaggccccctaataaccgagctttcatcaagaagtactatgcccctaggcaagcgtag

SEQ ID NO: 5738 - DNA, 654 bp, Glycine max
  Peptide Sequence Number=SeqID_122516
atggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggtccgaaccgactgatgttgaagaatcagcggatgagttgtggttaggggtgaaatgccactcgaacccagagctagctggttctccccgaaatgcgttgaggcgcagcagttga

SEQ ID NO: 5739 - DNA, 360 bp, Glycine max
  Peptide Sequence Number=SeqID_122517
atgattgaatccagcaaattcttctatcacatttctagggccaaggcgggttcgggtcagagccactcaggatgcaccaccaccaccaccagtcatccctcctctagcctcctcctcttctgccgacccatcttcctcctcttctcagcaggagcagctcttgcagatgatgcagagcctccaccacaaccagcacctcatcatccagaacctgcaccaggttgtttggctaggagtccagccctcttctatagggggggtgacacctttggcgcgggtaatgatgatgttgcaaagactagagctgacgatgattacgtcgcagacatcactgctccacaaggatcttgggcaccatag

SEQ ID NO: 5740 - DNA, 318 bp, Glycine max
  Peptide Sequence Number=SeqID_122518
atgaaaactgtgagtaacgtaaagcccaaaagagtaaattggaaatctaaagaggcgtgcttagtgcgtcctaggcttagcgagaacaacacgcttagcgccaacatgataattcaagaaagcatggctaattcaagaaagagtcacacgctaagtgtgagaattactgtcatactcgctaagcgtgacaagtgcgctcaacacgaaggttgcatgaaaactaagctgatccacacctataaaagaaggagagagaataagggagaaacacacagaaacttcaagagaatacaattctttatagaaggcaaagactag

SEQ ID NO: 5741 - DNA, 273 bp, Glycine max
  Peptide Sequence Number=SeqID_122519
atgacaaaaatattatcttatgtaggtgttcattcagttatttctttgattcttgctttcattttgaaccgtgctgctcatcatcacagacaaaaaggaatcactaaatgtggctactacgtgatgcactggatgtccacgataatcttaggatctttcaggaataattgggagacgtattttaatgaagttagaccattggaagcagagagattcaaggcgcttcgcatacaatgggcacagtattatctaaaagttagaaatcaaacatag

SEQ ID NO: 5742 - DNA, 396 bp, Glycine max
  Peptide Sequence Number=SeqID_122520
atggtcaaaaatcaatcaaatcagatttcccttccgactccccagcgtgacacgtgtcccactctgcctagaaaggtggaattaatgatgggtagtgggagatcgaggcgacggttaccagtaaacgtgctatcatgtcgccgtttcaggaaaactggttcaaggaagtatttacgaagtataaggctaagacaagaaagagggcttcgaaccattgggcgaatcgagctggcgtatggtcgaatcgaagtcagggcaacaagatttctggacttagcgcaatttctgacaaaacttcacaaaattagttcgacttcgagcaacatggataaccgttctaaggagcagttatgtgcatgcaaggtgtacgtagcaggacacttggcattaggatag

SEQ ID NO: 5743 - DNA, 534 bp, Glycine max
  Peptide Sequence Number=SeqID_122521
atgtcgcaaggacaagcagttccgtttgctgggaagtggcaacgctttacagtcaggaatgatggagaaaaggtggttccagaaccatatggtgacacagaacagacagaaacctgggaatcagaggtgatgatcccttttgcagtggaaagaacagtttacgcttttggtggccccttaccagacaaagcatctctttcgagtaaaatgaataaggtatttccctgctaccaaacttgtgaacctaggatttttgatagtgagccttacaactttaattgtttaagcaaaccccacaaactctttcgatccgccccgtcaatagcccatagggattacctaccttggcttgatcgagtcgaacaagcgtatgaggatttctggaagacatatggcatctttgatttgatacaattctctcgatctggtcccgaatatcgaccagaaatgctgatagcagccatgcacttcttcgaatcttctaccaacacctttcagtttaagtgtgggatgatgacccccactctcttagat

SEQ ID NO: 5744 - DNA, 1299 bp, Glycine max
  Peptide Sequence Number=SeqID_122522
atgactaggcaagtctgggcaatcatggttaagcaagctctatgggttacctttgggtactacttatggattttaaatttcttccacttgagaggaaaattaccatgtgaaagaaactcacacttgacgagaagattcttaaagtacaagtgtgaggtatcaatggaaggaaaagaaactgagggaatgttgaagatgacgacagataagagacaacagaagcgaagcagaagtgacagagaagaggaaagggacaggctgagtgagttgcctgactgtgttgtgctccacataatggaatttatggacacaaaatatgctgtacaaacttgtgtcttgtctaaaagatggaaggacctttggaagcgtctaacttatcgtggattcaatacaaccctctttaacaatgttgtcaaattcaacaaatttgtgtctggcgttctgtctggccgagatggttcagtttccctgctcaatcttgaattcacgcgtcgcggtatggcagagcccaagctcttcaataggctgatgaaatatgctgtgctgcacaatgttcagcagtttacagtatctctaaatttaagcttcagacagagtttcgagtttcgcccctacatcttttcctgtgagtccttgacatttctgaagctttcatttaattcttttgacacctcgattgtagcacttccaggatctctgaacatgccagcattaaaaagcttgcaagttgaggctgtctcttttactgcaagggacaatgactatgctgagccgttttctacctgtaatgtgctgaatactttgatacttgatggttgttcgttgcataaagatgcaaaattcctctctatatcaaattctagcctctctagtttgaccataagtggtagctttgaaggaggagcttccaaaattgcgctttctactccaaaccttagttctctcacagtcacgggtcataataatcacacaatctcctccgcatgcaatctttctttccttgaagaagtaaccattgacacccttggttatacactttttccgaatacagacttactcatcataagctggctgcaagttctcaccaatgtaaagatactgaggctctattcgggtacccttctgacaatactacgggatatatcaaatcctgtttcggtgagtactcagcctccctgctttgttcaattgaagtcattgattttggagaaccaaccatctgcagatatatcttttgagcaactaaagagagcagtggagtacctacttcaaaactctccacaacgtagaattgattaa

SEQ ID NO: 5745 - DNA, 99 bp, Glycine max
  Peptide Sequence Number=SeqID_122523
atggtatcaaagcagattgatcctgggacctgtcatcttagtaatgtagaagtcaagcagcatggtccaatggcggttgttaacggcggtgcaagttga

SEQ ID NO: 5746 - DNA, 753 bp, Glycine max
  Peptide Sequence Number=SeqID_122524
atggcggttcagagctccacttccagcgaatcgcaagcttcggagaacgttatgcatcgccatttctttttatggagagagtttctgtggggagctgttgcgggtgcatttggggaaggaatgatgcatccagtggatactgttaaaactcgattacaaagtcaagctattctaaatggaattcaggttgatggattaaaaggcttttacaggggtgtaacacctggtattattggatctcttgctactggcgcaacatattttggtgtcatagagtccacaaaaaagtggattgaggattcacatcctagccttaggggccactgggcacatttcattgctggagctgttggtgatactctaggttcttttgtgtatgttccatgtgaagtgatgaagcaacgcatgcagattcaaggcacaattgcatcttggagttccgttgtagtgaatgatggcatcgcaatcaagcctggcacacaaatatatggttattatacagggatgttacatgcaggctgttcaatatggaaagcacagggcttaaagggtttatatgcaggatatttgtctacattggcaagggatgttccatttgctggcctaatggttgtgttctatgaagctttgaaagatgctaaagattatgtagagcaaagatggatatctagcccaaattggcatgttaataattcagttgagggcctggttttaggaggattagctggtggtatgtccagtgctctgccttaa

SEQ ID NO: 5747 - DNA, 231 bp, Glycine max
  Peptide Sequence Number=SeqID_122525
atggggaataaactcaacataccatatttgtttgccagattaattcttggtgaagatcatatgtaccagcgtcctgtgtacataagaacaaaggagtgtagtgtcaattctcctgactatggacccttgcctccagattcacctggatggtgccttgcaccatttgacccagagggtattttgaggtcgaaaagcattccctgctccctccttttatcctttcttttataa

SEQ ID NO: 5748 - DNA, 504 bp, Glycine max
  Peptide Sequence Number=SeqID_122526
atgccatcagtccttcaactggagtcacttcctgtgttgaatgccttgactgacatattccaggataattctcctaggcttcaggatattgcattgtatttctttccatcagaacttactgagaggtccagaaagaacctggatagcatattgaagtttttgaatgctgagaaatcaatgctgagaagttatattaatggagtagagttgctggtatttacctcaaatcaacttgacatggactcaaagggtgctatagctgcagtaaatgctggacatttcctgtggggaatgtttcgccaaaagaaaattgataaagctattgaaagagtgcctgacatggagccagttgatatggacatcgatatgattggaggaaaggatgtggtggagagagctgatgtcgttcgaaattgtaaacctaagagtgcctctttgatggaggattataacaaactggacgttcctccaggctttgaagaatttaccaaaatgtctaaatga

SEQ ID NO: 5749 - DNA, 877 bp, Glycine max
  Peptide Sequence Number=SeqID_122527
atgttatttccaccccatttcagttactgcatgcgatttaataccttaatagttcctatagactggatttgtgagccttgcaaatccaaggatgtttcgacttcaccacatgaagtgaatcagggtattggcttgagggcttctaaaatgcgacagcctgtcaaaacagggaaagtgaagttccttcccgaggatgaagtccttagactttattctggcaattttcccttggcaacaacccggaaaacttctgttgggtccaaaaatgttgtttcaaagattccctcacagactccaaaaccatatccttgcatatcacctcctaaagtacttgggaagctttcaagaaatgatgaagtacacaagaagtcaatgactaatcaacatgcttcttgctcattatcaaaaggaccgccaaaggagtgtataggagaaaatcagctacccttgggtggagtgatacctggtaaaaaagtccaaaccggtgatgctcagaaagaaaatcctactaaagggccttttgaagctttatcagcaggaaaatcctcccatattgtcggttcaggaccgccaaaggagtgtataggagaaaatcagctacccttgagtggagtgatacctggtaaaaaagtccaaaccggtgatgctcagaaagaaaatcctacaaaagggccttttgaagctttatcagcaggaaaatcttcccatattgttggttcaggaccgccaaaggagtgtataggagaaaatcagctacccttgagtggagtgatacctggtaaaaaagtccaaaccggtgatgctcagaaagaaaatcctacaaaagggccttttgaagctttatcagcaggaaaatcttcccatattgttggttcag

SEQ ID NO: 5750 - DNA, 773 bp, Glycine max
  Peptide Sequence Number=SeqID_122528
ggcgcctgggaaagatatgagcagaacgttcactccctgaacatccttccaaagaggaatgttaatttatacattacggagtacgacgagttccgccgagagctcgagaggaggtgctggcataaagccttgactaggcagcttgatgatcgcattgatgtggccttggtcaaggaattttatgccaacctttatgacccaaaagataagtccccgaggcaagtcagagtctggggcaaattgattaagtttgatggggattcgctcaacacattcctagagaccctagtgggagcatcgtggaagctactctggaaggacctcaccacacttgcacagacatggagtgtcctttcctactccaacctcaccctcacctctcacatgtccgatctgaatatggacagggcgaggttagtttatggacttgtgatgaagatggacatggatgtgggctcgttcatctctggacagatctcacagatggcccagtccaactcctctcggctaggattccctgcacttattacaacactatgcatcgccagaggagtggtccttgactcacttacttttgagtccttgagccctgccattaatttggcatacatcaggaagaattgttggaactcggatgatcccatgatcacatttatggggactcgcaaggctcgggctcgagtacctactgacgcttctactccccctgctctaactccagtaccagcaccctccagcccctccactcagagcacagacattcttgtgtcgat

SEQ ID NO: 5751 - DNA, 136 bp, Glycine max
  Peptide Sequence Number=SeqID_122529
gacgaagccaaactctgttcatttacgttactgcttcatgtttcagtgcacgcttcgtgttcgattaattgcctctgagcctaaattgcgttcatgcttaatggacgaagggctaactggtgtatgtggtgcctaa

SEQ ID NO: 5752 - DNA, 534 bp, Glycine max
  Peptide Sequence Number=SeqID_122530
atggaacgaattgcctccctcgcccagtattatgatcagccgttgaggtgcttcatctttggggacttccagctatcaccaatggtggaagaatttgaagagatcctaggatgtcctctagggggaaggaaaccatacctcttctcagggttctacccctcattggccagaatttctaaaaaagtccaaatctcggcgcaggaattagaccgccaaaggcaagtcgaaaatgggggtggtcggaataccgagaaaatatttggagcgatcgacgtttttctcgcctatcataaccacaaggaaagtccggttgtcgctatgctagccgacctatatgacaccttcgaccgaagatgtgaagaaagcaatgcaaggattgtttgctgtactccagctctctatgtggggctggtttcacacctttttctccaagaaggtaggcccgtctatccgctacaaggttaccgctcgtgcgtcgaaaaaggaaaggcgaattgggaccaactcttggctagcatggggggcgtctgttaa

SEQ ID NO: 5753 - DNA, 186 bp, Glycine max
  Peptide Sequence Number=SeqID_122531
acatccagcaagggcatcagaccccctactaatagagctttcatcaagaagtactgcgtctccagacaggcgcagggcgaaacaccacagcagcttggtgatggacagcaacgggcaacagacgcaccgccatcacctctagagttcacctcagctcatccacacaaaggtagaaagataccttga

SEQ ID NO: 5754 - DNA, 315 bp, Glycine max
  Peptide Sequence Number=SeqID_122532
atgcggttatccgcaagctcgatgagtgataaacgcttagagacaaattctgcgcccttagtcattcaggagcagcgagtcgagtgtaagtcgagaggtgggcggagacaaattatggtcattccgtacacctgttcgccatccagaggcgaacgtgttcggtggcacgcagagacaatttatggtcattctgcgtcttgccgcccaggctcgatcgtgtccaacaacacaaagagacaaattatagtcattatgcgtcttgtatcaaccaagaggaacaaattcgacagtatcaggatgatgtgtcggtactaa

SEQ ID NO: 5755 - DNA, 252 bp, Glycine max
  Peptide Sequence Number=SeqID_122533
atggatatcaagtctaacttcttaagctctaagattaccttcaaaaatgaaaagaatattctgcaaagagagctgagagcagcaccgataattatatttaaactcatgtcatctcgttgccttgaagaatgcaccccagatatgcacttggaacaaatagttgccaaagtgctgaggattgtgatatgctggaacaaaaagaaactcaccttgagggaaagaaagcaagtgacttgccacaaaaacctttaa

SEQ ID NO: 5756 - DNA, 141 bp, Glycine max
  Peptide Sequence Number=SeqID_122534
atggagatttttgagttagggattgcaaagagtaacagtaaggttcaaaggaaaggcatattgggttggaagacactcagaagcaagatcgtttcaaaatttgaaatatcagttgaagcagctatggaaaaagttgtatga

SEQ ID NO: 5757 - DNA, 231 bp, Glycine max
  Peptide Sequence Number=SeqID_122535
atgtatattaaaaaggctccaggacaaggattgctatatgaggataaaggaattatccaaatctctaggtattgtgatgctaattgggatggatgccccatagatagtgatgcaatcctccctgggaagggactagtcaccagagccatgagcaagaggctccaagaggattgggctagagctgctgaagaaggccttagggttctcatgaacctcaaggtagatttttga

SEQ ID NO: 5758 - DNA, 547 bp, Glycine max
  Peptide Sequence Number=SeqID_122536
ttctcagtctctcacactcactcacctcacggtgctacaactcccactctttttctcggcctctcactctcactctccttgccgagccattagtggcggagaaggaagggatctggatggtgctcacggaaactttggaggacggtctttgttcttttcatttgtgacaagttttttgttgttgttttgcggaatcctttctcctcgggggcgacaacatgaaaagcattgtggcgcagctaaggcacgacatctggcagcagttcttgtctgggtcattatgaaggaacctctcacagaagttcacatgccaggcctcgctggatccgcggtggaacaaccagcgcttcaacatcggcaactcctcttcatggcctgccacgatgacgccaagggagtcagggatttgctcaatgaaggcttgcggcgagatctacatccttggaagagggttttcggtgaatctacgattcttagaatcagtttggctatggcagtggaagataagtggtgcatggtgatcgaaggtcgtggtttcgctgcttga

SEQ ID NO: 5759 - DNA, 1206 bp, Glycine max
  Peptide Sequence Number=SeqID_122537
atggggcaacagcctaaagtggattctcataccagtttggtctatctgattaaggtagaactattcactgctaaggatctcgttggtgctaagttaattggcaaaccagatccttatgctgtcattacatgtggcaatgaaaagcgattcagttccatggtccctggttcaagaaatccaatgtggggtgggggcaagggtgaggtgttcaatttttccgttgatgaacttcctgtccagagagaatgttggggtagcacctattctggaaatgatggtgcaatctcatctcagatggtttgggcatgtggagaagggatcgggattctctgcagtcggaaactacctgcattcatgcggtcaactaatggtgatcatttgatgaagatcagacggatgatcaatgtcacaatttatgattggtataaatgtcgggataatgctattcttggttcagtgactgttccacttaaaagcaatggtcaaactggtccagtgtggcatactttagatagcccatcagggaagtcattgattgactggactgataggatacattgttatggagaagccactgtagtccatcaaaagccagggcctcttcaaactatatttgatcttcattctgacgaggttattgatcatagatatatttgtgcacttgagacgtcattcttgtaccaaggtgatatgtatgtctcagcatggaacatttgtttctattccaatatgttctcaaaggaaatgaagattcaaaggagtgaacttgcattgattaatcctgctataacaattattcttcgcaagggtgctggtggacatggtgtccctcctttcagtcctttgggaagtcctgatggtagggtcggatgtatgtttgcatcatttgtggacaggaataaagcattagaaaatctacagcgtgcatcaaagaatttccatgaaattttagaagctgggaaggaaaatgcagagccagagctacgtgcacttagcgattctgccagaggaagtaaggcactggataaggctcttgaagaaagcatgccaaaaactggaaaacttcaaccttttatcaaagaagaggctttagttggtatgaacgatgaagttcttccctgcatagatgagcagttttctaacttattattgaatgatgatggttcaaatttttctagcaaatcgttccatatggaaggatgctaa

SEQ ID NO: 5760 - DNA, 480 bp, Glycine max
  Peptide Sequence Number=SeqID_122538
gaaagaatgcactttacggcgcccttaccaaatgcttgccagagctagagtaatgagtgaaatagaggaggtgcaagagcagatgaaggtcgacatgaaggccatgaaagagaaaatgactacaatgatggaagccatgataagtatgagaaaaatgatggaggtcaacacaactacagttgttgccacaagtaccgccacagaagtggacctgactcacccacctggcttcaatcaagttcagaataagcattccttcccaccatatggcttgcctcccaactatacaccacccaatgttgcacacactcccgatgagaatacacatgaagcaccccaagaccacactctagccgactttgagcctcacctcggatgtgctacagaggggcaagcatttggcagaggttatgcctttgctcacatggcagaactgtgcctagtgcctgatgtcgttatccctccaaagtttagggtctg

SEQ ID NO: 5761 - DNA, 1224 bp, Glycine max
  Peptide Sequence Number=SeqID_122539
gtcgactctagaggatcccacatacctgattgcttatacggtcttcatcgtctcaagtctttggacctaaattcctgcgacttgcatgggactatttctgatgccttgggaaatttgacttctcttgttgaacttgatttgtcacataatcaacttgaaggaaacattccaacttctttgggtaatttgacttctcttgttgaacttcatttgtcatatagtcaacttgaaggaaacattccaacttctttgggtaatctctgcaacttaagggtgataaatttatcatatctcaaactcaaccaacaggttaatgaacttttagaaattcttgctccttgtatttcccatggactcacaagacttgcagttcagagttcacgactttcaggcaatctgacagatcatattggggcatttaaaaatattgtgcagctagatttttccaaaaacttaattggtggtgctcttcctagatcatttggaaaactttcatcattaagatatctcgatctctctatgaataaattcagtggaaatccatttgaaagtcttcgatcactctctaaattgttatctcttcatattgacggcaatctttttcacggagttgtcaaggaagatgatcttgcaaatcttacaagcttgacggagtttgtcgcatcggggaacaatttcactttaaaagtgggtcccaattggattcctaattttcaacttacctatttggaagtgacatcatggcagttaggtcccagctttccatcgtggattcaatcacaaaaccaacttcattatgttggactatctaacacggggattttcgattctattcccacacagatgtgggaagcactttctcaggttgggtatttaaacctctctcgtaatcatatccatggtgagattgggactacattaaagaatccaatatctatcccaactattgatctaagctcaaatcacttgtgtggtaaattaccctatctttcaagtgatgtgcttcagttagatctttcaagcaattcattctctgaatccatgaatgactttttatgtaacgatcaggacaagccaatgctattagaatttctgaatcttgcatcaaataatttgtcaggagagatacctgattgctggatgaattggacatctcttgtggatacctgcagtctttacaaattcgtaacaacatactctcaggaatatttccaaccagtttga

SEQ ID NO: 5762 - DNA, 418 bp, Glycine max
  Peptide Sequence Number=SeqID_122540
atgaccctgtttgtctgctttctggccgctctggcgggcctgctgttcggtctggatatcggcgttatcgccggtgccctgcccttcatcgcgaaagatttcaacgttaccgcacatcagcaggagtggatcgtcagctcaatgatgttcggtgctgcggtcggtgccgtgggcagcggctggatgtcttcgcgtctcggccgtaaaaagagcctgatggccggtgccatcctgttcgttatcggttcactgtggtcggcgatggcgccaaacccggaaatgctgattgccgcacgcgtggtgctcggccttgccgtcggcgttgcctcttataccgccccgctgtatctctcggaaatcgcaccggagaagatccgcggcagtatgatttccctgtatcagctgatgatcactatcg

SEQ ID NO: 5763 - DNA, 210 bp, Glycine max
  Peptide Sequence Number=SeqID_122541
atgacgctgccaaatataatcaccgcaatacagtcatctattacagataatggtgttatgcctataattaatgccctttggtatcgttgtcatgtatatcaattcaatggtgaagttcaatataggagatgcggagcaatgtcaaacctaaccctcacatgcactaacaccccattaaagtgcggtgttgtacactgttcactcacatgc

SEQ ID NO: 5764 - DNA, 529 bp, Glycine max
  Peptide Sequence Number=SeqID_122542
atggattctgtaggaataagatcggctaacccttatttggcgactcctggagcaacggttcatggccattatggggaaatactttctgaaggagatatattagttacatttatctatgaaaaatcgagatcgggtgatataacacaaggtcttccaaaagtagaacaggtattagaagttcgttcgattgattcaatatcgatgaacctagaaaagagagttgatacttggaatgggcgtataacaaaaattcttggcattccttggggattcttgattggtgctgagctaacgatagcgcaaagtcatggaatgtctaatgtttttttgcccggtgaactaattggattgttgcgagccgaacgagcagggcgttccttagaagaggcgatttgctatcgagttctattattggggataacaaaaacatctctgaatactcaaagtttcatatctgaagcaagttttcaagaaactgctagagttttatcaaaagccgctctccgggggcgcatagattggttgaaag

SEQ ID NO: 5765 - DNA, 315 bp, Glycine max
  Peptide Sequence Number=SeqID_122543
atggccaacaaaaacatatcatccaatgaagcatccacccccacacttattcccaaaacaattccaaaactccaaaattccttaagggtaggaaaggggaacataagctcaaaggggctatcaaaggaattaattcaaggtaggctcatttggctagaggcttataagaacaaaatgcctaaatcatctcccaacatgcatgcgaagcaagaagtatcaacaagagtcaagccaaggctactatgcaagcaatcaatggggcaaaacacaccgaataaaatagatgatgatggctcaaattctcaccaagggtaa

SEQ ID NO: 5766 - DNA, 156 bp, Glycine max
  Peptide Sequence Number=SeqID_122544
atggcgagtgaagtgggagcggctatcaatccgtatatattccgtcatcgttgctgggcggacaacggatcatccattgtctcaaaggaccgggcgatgatgctcaccggttctttgacgccaaggaaaatggcgattgcggtggcggcggtcaag

SEQ ID NO: 5767 - DNA, 168 bp, Glycine max
  Peptide Sequence Number=SeqID_122545
atgggacaccttaggtttgtcatactttttggtaggaataatcaacatgaaaatacagaaaaaggggttcccatgaaccctaagagaataaaggtcattcctgagtggcccgctccaccaagtgtgttgaggaaaaaagcccagcgtttcaagaacctcgggatttga

SEQ ID NO: 5768 - DNA, 864 bp, Glycine max
  Peptide Sequence Number=SeqID_122546
atgcagatcttcgtgaaaaccctaacagggaagactataaccttcaaggtcgaaagcagggacaccatcgacaatgtcaagggcaagattcaagacaaggaagatcagcagtgcttaatttttgtcgaaaagcaacttgaagatggaaggaccttggccgattacaacatcaagaaggaatcaacctttcaccttctcctcaagcttcgtggtggcatcatcaagccttcctttatggcattggctcgcaaatacaacctagacaagatgattttccataagggaacagacacagaaggtttgggcgaagaagataacggtggagggatgggcaatgagatagggggcaccagtggggtcctcgtattgggagggtgtgaagcgggtttgaagggcatggaggaaaataggccaggagtctttcatgttctctattcaaagaattgggttatcttgaatatccaacccaatggattagagccgtcaaagcgcgggacgtctaacttcatacagtggggctataaggaaggagaagatgatggaatggtagtggacgaggaaggtgagggtataggggatttaggagtggccagggtagtgataagtgtgtcaagataccttagagcgagtggactccgccattcgaacaagagcaccaaattgttaggctacagtagccaatcctggacttcgagggctagaacctcccttgagaagagaaaatggaaaggcccttatggaaagaggaaaatattcctagtggcagacaagatcaaggagttgcctctctgccagccatctcagcagaaacggttatacgaaacctttgagattctgcagaaaattgattacaaagatatatag

SEQ ID NO: 5769 - DNA, 840 bp, Glycine max
  Peptide Sequence Number=SeqID_122547
cttgggaggattgatggggacccggtgttgagagaaacgaggatatgggctacgtgggagtacgtgagctcagatggaggtgggcaacaggggatggggtcaggagaccttggggacgtcaggcgagctcctggcagtcaacagataaaaggaacaaagaccacaaagcaaggaggcttgtggtggctggccagctgtgaatcttgtgtgatatatgggttatggcctctggtaatcgattaccaagggcttgaaaacgaggtcagaaagctaggggagcttctggtaatcgattaccagggggatgtaatcgattaccaggcttcagaaaggaactggaacactgtggaggcctctggtaatcgattaccagcctgtgtaatcgattacacagagggatggatcgtgatggcggcgcagctaatccgtgatcgagtagagatggagtgcctagagggagcttgggagaccctcgaaggcaacacgaggtgccgatttcggggcaccattcgattcacggctacttctttggtgcatccagatgaacctgcacggacgcttcagctcacggtggagtggatactacccacgcctacaccatatcgtctagtggagcccgtccaagtgatcgaggtaacgtcatccgaggaagaccctgaggaggatcccaaggagctacctcctgagcctgctgtggatgctcttgactttctagagggcgatgaggacccacttcttgaggtggattctcccgaggaagtcatgtcggcatctgaggcagactctacggaggatagtggcccgggggagatggcgatcagcggaggctcttcatcatag

SEQ ID NO: 5770 - DNA, 249 bp, Glycine max
  Peptide Sequence Number=SeqID_122548
atgcctaaaaataaacaaagaaatttgggactcattgagtataacgaaggcacaaaaggtgtcaaactcaaaaagggttccattttgataagacattatgagaaattcttcgtgaaagaaggagaatttgtggataacatgcatgggagattggaagtgctcctaaatggtattaaggatgtaggtcacaccaacaccaaagctcagataaatctgaaggtgctggacagttttcccaaggtgtggtaa

SEQ ID NO: 5771 - DNA, 734 bp, Glycine max
  Peptide Sequence Number=SeqID_122549
gggcaccactagaggaggagattgtacctgtcatttcacgaggtttcaataagaccaacgtggagacacttcagaaggtccgcaaggcatgggaggtgttgcaaaagaaggacaaggaactcaggggcagtaacaatgggcccatcggtggctatcgtaagtggttaaaagcccacgtgcaaggtttggattggctcccgagtctgagaaccgctaagagggaggaagatgaggcaccggaggaagacgaagaggtgcaggcccttaggacggaactcaagcaagctcaaacagtcaaagaaaggttcaaatcagcagctcttaaaatccgaaaggagaatgccgaactgagagatataaatatagctaccaccaaggctttggaacaagagaccaagagggctcgtagggaagaacacggccggaacaagtccaaaagaagtttgtctcagcggttatgtgagacagagaccaacatgttagctatcatcaccaagtaccaagaggaactaagtctagccacgacccacgagcatagagtggcggacgggtatgcccaagtgtacgcagaaaaggaggctagaggaagggtgattgactcgttacaccaagaggcaaccatgtggatggaccgatttgctcttaccttgaacgggagccaagaacttccccgattgctagccaaggccaaagcaatggcggacactgatggagcccgtcccggattcaaataa

SEQ ID NO: 5772 - DNA, 516 bp, Glycine max
  Peptide Sequence Number=SeqID_122550
atggagaagcagtttgtgggaaaggtacatggatgttggaattggtctgagaactgggtaaaacaatatgagtggaaggaggttcagtttggcctaagaaagaagagtgagaccaagctccactatgttcctgtgcttgtgttcaactacaccattttgatgttggagatagtagcagaggaagataagctgaaagtagagaaagcaaagtttgaagctcagtgggagcttcttcatgaaaagaaagaagagctgtggaaagaagcagaatacatagtagaggaaaacaaggcagtttcagaaattcggtatctatctatccatcccatgtggtggcatcaaagtctctgcaactggcagaaacacacatcttcttgtaacaatagtcacagaacaaatttcagcaatggcagcccatgtggtggcatcttcttgcaattttcagtatctatctatccatccagagactttgcagaaaatcaaagaaagaacaaggctctcaatgtagaatcctaa

SEQ ID NO: 5773 - DNA, 417 bp, Glycine max
  Peptide Sequence Number=SeqID_122551
atggacaagtttttttgggcccttatgagtgatgggagattctatacaaagtctacttatgatcttttagcttgtcctaatgtccagagtgacccctctttgaggaattgtctgtggaaaatccctggtagacctacaactagggatttgcctaagaataagtattgccatattcgaggaatggctgagcataatgattggcccttgtgtgacctggagcctgattctgagttacatctcaggcccaatgtttttaatatggatttggctacatgggtggagctgaatataactttaaagggtgttatgggggttatgtggattggcatatttgctttattgaagttacttaccaaatatggaactgggaaaggaataggtttcctcattgggaacctccaccaccagcatttctga

SEQ ID NO: 5774 - DNA, 162 bp, Glycine max
  Peptide Sequence Number=SeqID_122552
ttgagaggtacacgaaggtctaaaaaggttatactaagaatcaatatcaaccagaagcttccattgttgaaagggtcatgggaatttcgccaaggtccccttcacattcagatggtgattgagaggttccgtctaggaagagtagacaatccacatggctaa

SEQ ID NO: 5775 - DNA, 756 bp, Glycine max
  Peptide Sequence Number=SeqID_122553
atgggactgtggcacatgtgccttctcatccaaagcgcaaagctactcatccttacccataaaaggcatcaaaaaatggtgcaacatttcatgcatccctgtcatgctactttctggttttctagttttggtgccactactagctttcgttggttatacttcatcaagaaatacgcttgcacctggtctacatttacttactatactaaatggaattgccaaccacatattatgttatatgacattacaaatttagatgatattggatcaaaggggataacaaaaattaccaacaacagtctcagaggtgttggaaattctactaaaacactaccgacttctgagatagcaaagcaagggaaacaagctccagtgcttcatgaccgtagctcacccaggctagcctctggctcgcctgggccaccaaataacttcatggtgaagaaaccaacttgcctgggcaagctacaactgcctcaaagtaacctttttcctataaataggtgttctaagggtggttttaagggtgagaaggtccagaaggtgagggaattaagagaagagagaaagaagacgaagaaagaagagaaaatgaggccgaagcgctaccgaatcgcgatcatgatcattccctacatcgttccttgtacaatgttctttgtgcgaccgtcggggtcccccttgttattatgtgcacatccatcttctccatctatcatcggcgatctcatttttctttataaaattcaatcttaa

SEQ ID NO: 5776 - DNA, 267 bp, Glycine max
  Peptide Sequence Number=SeqID_122554
atgtcagaattcacaagcaattgtcctcctcgaattttagccagcctccatcaattagactttgcaccttatgtttcagggtcatacaatgctcaatggaatgccccgaaattcctcaatgataagcatatgttgcattcgagttgtatcctcgggaaaatggaggttgaggaatctttgctgggattatggctaccattgcattattgtttagatatgagaatggtgtttggtatcggatgtgcaacatgcgggttctgtgggtga

SEQ ID NO: 5777 - DNA, 186 bp, Glycine max
  Peptide Sequence Number=SeqID_122555
atgaagaaatttctcaacaagaaaaaagaagaagatcccgtgaccattcccaagaacggaaagaaagggattcgtgaggttattgtatccaatgtgagactaagagcgtttttcatgatcaagtcacctactttggagttgattttctctatgatagaagtcgattttggttttcaaggtgtatga

SEQ ID NO: 5778 - DNA, 164 bp, Glycine max
  Peptide Sequence Number=SeqID_122556
gggttttaagcttgtgtgaagagatagacagaaaaagactaagaaatttttttgcaattgtttatccgctaagcacagtccttgcgccaagcgctcagtcttcacatgctaagctaagcttgctcgcgctaagcgcaaagacccctgattggttggctgaatag

SEQ ID NO: 5779 - DNA, 711 bp, Glycine max
  Peptide Sequence Number=SeqID_122557
atgtacttaaatgcaagttatgacgttgagcattcacattctacacaaagaatacagcatgagctgtggcctctagatccaattgatccaaagaaggcaaagtttccatgttgtttggtttggaatccacttcctgtggtgtcatggttggctcccttcattggtcatgttggcatttgcagggaggatggagttgttttagatttttcaggatcatatcttgtgaatgttgatgattttgcatttggtccagtggcaagatacttgcaactcgatcatagacaggttgcatttgcacctacagggctctcaagtcaaaacctacaagtcatgtcccccatttgtatcttagagtgttgcttccctcctaacctatctgcgcatacatgcaagcatggttacctgcatgctgagtatggtactgcaatcacatgggaccatgcattacagacaagtttgctgtattttgagaacaaaactcacaaccttttcacttgcaactgccactcgtttgtcgcgaactgtctgaatcgactgtgttatggtggatcaatgagttggaatatggtgaatgtaggagctttggtactattcaaggggcactgggttgatttcaggtgtttttatggttggatggcccttcttacttgggctactatccttctctttactcttaatagggtggtttatattgggtacttacctatttag

SEQ ID NO: 5780 - DNA, 168 bp, Glycine max
  Peptide Sequence Number=SeqID_122558
atgcaggagctggtggaactatttactcataatgattaccaagatagacagatacattcaacggtggcactgacgcccccgtcacgaagagccgttgttgttcctactactgctgctactgctgaacaagagcttgtgctgggaatcagaaataatggtgatggttaa

SEQ ID NO: 5781 - DNA, 951 bp, Glycine max
  Peptide Sequence Number=SeqID_122559
atggatgaaactaaaattctcttagagttgaagtccgtttcgtccttatgtgttcatagcttcatcaaccttctatgcgaagaaactatttcttttctctcagtgttctcttcagatcctctgtttcattgcatcgtggcgttttgcaccttggttttcctctatttgccacaccttttcttgaaaataattctatctccagtgcccattctcactgcgattctccttctctctattctccgtctcggtgcaattcaaaggttacaacatgaaagaagggagaatcatgtgaaacacgaagaacaacccatcgtttacgaagaaaacaagggaagtaaatacaagggagagaaacagagtccatgtaccattgaacctgacgaaacaaagtccgtagaacaagtgcaccaatgggtccattcagaaacagaggtcatttccgacatgggttttgaatcaagttctcgttttgttgaatggaacgtgaaagcaccgttggaagtgatatatgaagagtatggtgaaggtgaagaagcaggggatgatgcaaacgagaacgtgggtattatgaggtacccttcgttgtcgcgtttttacccggaatcggattccgatagcgaatcggagagtgagtttccggcgatcggagattgggactcgccggaggaccttgagtttcgctggggtgaagaagaagaagaagatgatggtgatgatgatgatgaagaagaagaagacagagaagggttgattgagatagctctcgatggatgcaagaggaagaggaacttggaatttaactttgatgaagagaatttgattgagatcgatatttctccgtcgaggtacagagaactttccggcgacgacgaggtgttttccggtatacgtggcatttgtagtagtgaattgaggatgaaactattccagcatgaaactccacctccatga

SEQ ID NO: 5782 - DNA, 447 bp, Glycine max
  Peptide Sequence Number=SeqID_122560
atgtggagtttcactttctttgaacgagtttctagagctttccgtgatcatgggtccaacttcaagcttgtacttctctgcaccaccgtaagtggtggaggggttctggcttacggagaggctgtagccgcatctgaagcagcggcgacgaccacggagaagaagaaggtggtggtactgggaacagggtgggctggcacgagtttcttgaggaatctggacaaccccaaatatgaggttcacgtggtgtcccctcgcaattactttgcattcactcctttgctgcctagtgttacctgtggcaccgtcgaagctcgcagcattgtcgaacccgtccgcaacattttcaggaaggtgatatcacaacaaaatactcatttggcccctgtttcatacttctgcattatgagattgagagccactataattgtgctctaccttgcttaa

SEQ ID NO: 5783 - DNA, 132 bp, Glycine max
  Peptide Sequence Number=SeqID_122561
atggtgatgagaggaaccatgaagaagctagccttctgcattggctggtcaatgctcttagagaatattgatggtgtagagacattagaggctgttgcaactggaaattattttgaaaggtggttatcataa

SEQ ID NO: 5784 - DNA, 1151 bp, Glycine max
  Peptide Sequence Number=SeqID_122562
ttcatgtcgaagctcgcgaaggcgctaaggccgacatcgtcggggtggactgggagcagcttctgcgactggaagggcgtgaagtgcaacgccaaccgcatcaccacaatcaacatcgcttcgcaatcactcggcggaacgcttcctccggatctgaactcactctccagaacaacgcgctctccggcgcattgccttcacttgccaacctctccatgctcgaaagcgtgttccttagcagcaacaacttcacctccgcccccgatggttgcttccagggactcaccagcttacaaaccctcagcatgaccgataggatcaacctcgctccatggacgattcccgtcgagttgaatgataacaacaaccttgtcaaactcgaacttggaaacgcaaacctcatcggtaccttgcctgatgtattcgacaagttcgtgagtttgcaggagcttcgtctctcttacaacaacctcaccggtggcttacccaaatccttcgctagatctgcgattcaggatatgtggctcaacaatcagaacggcttcgggttttcgggtaccattgagactaacagacgagccatagctactgatgaatggttgagagttgaagcaacaaacaacgtgtatgcacttggtgattgtgccacaataaaccagcgaaaagtcatggaagatatcgcggcaatatttaagaaggctgacaaagacaattcaggaactcttactgtcaaagaatttcaggaggtattggctgatatctgtgagagataccctcaggtggagctatatctaaagagtcaacagatgcacaacattgctgatttgttgaaaggatccaaggaagatgttgaaaaagaatctattgaactgaatatcgaagaactcaaaaccatactctctaaagtggattcccagatgaaatttcttcctgctacagcgcaggttgcatctcagcaaggcacctacctggccaagtgctttaaccggatggaagagtgtgagaaaaatccagagggtcctatcaggtacaagcatttaggtcaattcgctcctctaggaggagagcaaacagctgcacagcttcctggggattgggtttcaattggacacagctctcaatggttgtggtattctgtctatgcaaggtag

SEQ ID NO: 5785 - DNA, 1701 bp, Glycine max
  Peptide Sequence Number=SeqID_122563
atgagcgatgaagaagcattcgccgaagcttcgggtctccggcgagcggtggagctaatcttttcagtgctctctctctcgtacccgattcgcgtcttctccggaaaatggcagctgattcgggccaagttggaggagcttcacgccggcctaatcgccgccgagaaatgcgactccggcgagagcccgtccctctcgcggctggctgcggcggtggtggccaccgcgacggagtgccacgatctgtgccggcgttgcgtggttttctcatacagcggaaagcttctgttgcagagcgatttggacgtggcgttcgcgaagctcgatgcacacgcgaagaagctcaacgagatatacaagactggaattttaactaatgggttcgcgttggtggtttcaaaaccgagtcttgccgcttccaaagaggacatgaggttctacgtgagggacttaacgacgaggatgaaggttggggatttgggtatgaagcgacaagcgctgaagaatcttctggaagttgtggtggaggatgagaagtacgtgaaggtgattgttgatgttggtgacgtggttcatttgttggtggggtttttggggtcaaatgaggttgagattcaggaggagagtgctaaggttgtttctgttgttgcggggtttgattcttacaaaggggttttgattggcgcgggtgtaattgctcctttggttaaggttttggattgtgggagtgtgttaggtaaggttgcggctgcaaggtgtttggtgaagttaactgagaattcggataatgcttggtgtgtttctgctcatggaggggttagtgtgttgttgaagatttgtggtggtgattgtggtggtgatttggttggacctgcttgtggggtgttgaggaatctcgttggtgtcgaggagattaagaggtttatggttgatgagggtgctgcggtaacattcattaggcttgtgaggtctaaggaggaatcgattcaggtgaattcgatagcgtttattgtgagtattgcatctggtgatgaggttgttaggcagatggtgatcaaagagggagcgattcacgctttgttgcgcgttttggatcctaagtggtcttattcttgtaaaacaagggaggtggcaatgagggctattgaggatttgtgtttttgctcacctagttctgttggtgttttgatgagttatggctttgtggatcaattgatatattatgttcgaaatggcgaggtttcgattcaggaattggcattgaaggtggcgtttaggttgtgtggaacatcggaggaggccaagaaagcaatgggggatgccaggtttatgccggagtttgttaagtttctcaatgcaaagtcatttgaggttcgggaaatggcggcggaggcactctctggcatggttatggtgcctagaaatagaaagaggtttgtgcaggatgatcataacatagcccttattctgcagttgcttgatccagaggaggggaattcaggtaataaaaagttcttgatctctatattaatgtccttaactaattgtactagtgggaggaaaaagattgttagttcaggatatgccaaaaacatagaaaagcttgcggatgctgaagtttcttctgatgccaagagacttgtcaagaagctatccacaaaccggttccgcagcatgttgagtggaatctggcgctcgtga

SEQ ID NO: 5786 - DNA, 357 bp, Glycine max
  Peptide Sequence Number=SeqID_122564
atggagaaaaaaaaaaaaaaaggagaagaggaaagtctcacactggccatattcccagctgtcgcctctcagctttcacaccggccaccatggcaccgccccccacttccttcttcaattttccctttgtctcagtctcacacgaaagcggaagtcggaaagtccagttctcgtcgcgacggcgctcacgctttgttcagtcgctgcgatgctgctgttgttgcctccattgacattggaggttccttgaagaacagaatttttgactatattggtgcatgggtcgtagtgaacatgagcatcgatcatcatgtggtggatgacagtatcgatctctttggaattcatagacagtga

SEQ ID NO: 5787 - DNA, 567 bp, Glycine max
  Peptide Sequence Number=SeqID_122565
atgggtcatacacaggataggagtaggatggctaaaatgaagaaagtgacaagagaaaaaggtgggagtagcaaaaatgagaatgttaagatgaatgtctggttacacaacagagtctgtgattttggtctgtcacgaatgaagcaccatacatatttgtcatccaaatcctgtgctggaacgccggagtggatggcgccagaagtcttgagaaatgaaccagccaatgagaagtgtgatgtgtatagttttggtgtgatcttgtgggagttaactaccacaagaattccctggcaaggtttgaacccaatgcaggttgttggagctgttggatttcaaaataaacggcttgaaattccagaagatgtcaatccagtagtagcacagataatacgtgattgctggcaaactaaccatgttccatctctttatgacattagaatctggactgagattcacattcttggaaagaggcccttttctgatactcattcgatgtctgaaaatttgagggcagattgccactgctgtaattatcgaagttttgctatcttcctgcccttttaa

SEQ ID NO: 5788 - DNA, 681 bp, Glycine max
  Peptide Sequence Number=SeqID_122566
atgggggtcaatggagattgttatgatggtagaaacaaggaagttaacccagttcttggtgaaagctcagaatgggaaattcaatgggaggatcttgatattggtgagcgtattggtattggttcttatggtgaagtttatcgtgccgattgtaatggcactgaagttgctgtaaagaagtttctggaccaagatttctctggtgatgcactagctcaattcaaatccgaagttgagatcatgttaaggctgcggcatccgaatgtcgtgctcttcatgggagctattactcgctccccacatttctctatcttgacagagtttcttccaagaggcagtttatataggctattacatcgacccaatcttcgacttgatgagaagaaacggttgcgcatggctctagatgtggccaagggaatgaattacttgcacacaagccatcctcccattgtccaccgagatttaaagtctccaaatcttcttgttgacaggcattgggctgttaaggtctttggaccgagaggtaaggaacttttgtggtggaatggaagtagtcaagacaaggtaagaaacaaaagagaatgtttaaaagccttacatgggaccaacaacgatgaaaattgggcaaggtatcaaaatgctagaaatgaggcaaggagcactgttagtgaaacatga

SEQ ID NO: 5789 - DNA, 202 bp, Glycine max
  Peptide Sequence Number=SeqID_122567
gctaaacgcaaagaactcccaggagaaggccgctgattcgattcagaaactggttgccgaaaaagggagggaaggcctgaaggcctttagtgcatctcaagcggtagcagatgaggcgagagctatggagagtgctgaccaggttttaagcaaagagatggccaccttgaagaagctatatgaggatttgatcatgacttag

SEQ ID NO: 5790 - DNA, 190 bp, Glycine max
  Peptide Sequence Number=SeqID_122568
atggcagctcaggtagcaaccccaatgattgagagagagttgatagcaatgatagtagacatgttgccggtgtcctactacgagaagatggtggtttacatgccttcaagctttgccgatttagtgttcgccggtgaaaggatcgaagtgggtctgagaagaggaaaatttgattgtctcgcattgacaa

SEQ ID NO: 5791 - DNA, 664 bp, Glycine max
  Peptide Sequence Number=SeqID_122569
atgcaaattaagcattatgacatcttgactgagttatttgcaactgatagggcaaaaggaaatgttgcgaaaacagctaaggaaaggaggaaacaatgggagaaggagaatattgacttgaataactattttgaagatacagaaatgtatgtgccaaatgttggtatgtttgatgaaaaccaattttcaccccccaactttgaggatgctagtccacaaaatggtcaaacaaatcctagtggcttaaatacttcaaggggtacaaaacggaagagaaatgtggttgagttagttgaagatcaatatgagcgaatgaatgaaagtatcatgacaattgctgaagctttgaaagagggaaattctgtttctaaggagctgcaccaagttgcagagcgtcaagttgaagttgctgaaagacaagttgcagtcattgaaaaacaagttgaaattgctgaaaaacaagttactgtgatacaacaaactcgtcctcgtcattattcagaatctgatgtatgggatcttttagaggaattaagagtcacagatccatttcgcatgaaggtttataaccatttatgtgataatgagcacaaaaaacgtaagctttttggcgtaccacctcatatgagaggagaagctctcattcaaatgatgactgatgcag

SEQ ID NO: 5792 - DNA, 462 bp, Glycine max
  Peptide Sequence Number=SeqID_122570
atgtgtccatatgagcatgcactttacatcaaagcccaaaataatgattttttgattgtgtgcttgtatgtagatgacttgatcttcaaaggtagtaatccaagcatgttcaatgaatttaagaaagagatgatgaaagagttcaagatgactaacattggtctcatgtcttactacctcaacattgaactaatgcaagaagataaagacatcttcatcattcaagaaagttatgctaaggaggtgattaagaagtttaagatggatgactctaatccagtcaacataccaatggaatgtgaaatcaagctatcaaagcatgaggaaggagaaagagtggatccaacactctttaagagcatagttggaagtttgcggtatttaacatgcacaaggcctgatactatctatgatgttggagttgttagtggctacatggataatccaacaacactcgtttga

SEQ ID NO: 5793 - DNA, 663 bp, Glycine max
  Peptide Sequence Number=SeqID_122571
atgacttcccctttgtttcagagcccatgttattgggacatgttgcaggagcatgacccttattcatcagaagttttgttcgattcaatgtcaagcactaatgctgttcttgaccctatccacgattctctttccttcgatatggttgacttctccacagcaccaacaacagaaggaaaccacaacgatgaggcaaagcaattggtggtgaaatctgaagggcagaataagcaaaggtcttacattggtgtgagaaaaaggccttggggaaaatttgcagcagagatcagagacacaacgaggaatggcactagggtttggcttggaacctttgacactgcagaggctgctgctttggcttatgaccaagctgcattttccatgagaggccaaagtgctgtactcaattttccagtcaaaagggtcaaagagtctttgcaagagatccaatatagctgcttcttcaatggatcttcttctcccgcacttgcactcaaagagaggcactgcatccaaagaaaattgtcatcaaaaggtaaaaagtgtaaagggaaagagacatcagaaagtgtggttgtgttagaagatttgggagttgactatctagagcaacttctaagcttatctgatcaaagtgaaagccctagctacttcaactattaa

SEQ ID NO: 5794 - DNA, 288 bp, Glycine max
  Peptide Sequence Number=SeqID_122572
atggcatgtgagatttttgtgttgaaaaaccttcttgatattgtgaaaggcatacagcttgtcctaatgattagtgcgcaaatcatcaaagatggaagaagcttctatgatccaaagcttttgagagcaactagaggctctccagaaaaagaacgcataagaaatgatcacgctgagacagaaacaataagtagacctccaagcactacaggaggaaaacaacaccatctaagctcagttgcaggcatcggaggccaacatggttccaactcatctaggagaaactaa

SEQ ID NO: 5795 - DNA, 366 bp, Glycine max
  Peptide Sequence Number=SeqID_122573
atggtggtatctcatcgagggttcgaccaaccatcattcgatttgggcatcgatgatgatgatgacaaagaagttgatgatgtggtagtggttgagaagtcacaagagaacaacaacgatgagccagcgtacaattacaatcatgttgtgtatcaagattcacaagggtatgatagtgagaatctttcacttgaagacttgtttgataatgatggattgactcaagatagttgctttgaggtcagctctaaagagaatagagaattcatggcaaatagaacaaagcctttgaatgaggttgaaaatgaagcatttggagagtctcaaaatgaagaagcaatgaaatcaagagtcaatgaaatctag

SEQ ID NO: 5796 - DNA, 428 bp, Glycine max
  Peptide Sequence Number=SeqID_122574
ttccgcaactcaaacctagggttcatcctcggggaggattggttgacgaagcacgaactgaaggtgaaagagtacgtttccaagtacgagcacgtgggatggaacaaggtttttctgtcgctgccggaaactccgacggcggagcaagctagggcgatcttggagtgtttcgacgtcgcattccatgatgcgtgcaaggcacagttttcgtgggtcgtacccgacccgaaactgcgagaggaaataaaagcttcaatagcttcgaaattcgttccaagtcatagggaactctttgagaagtatcaggtcgggtcagaaaccgtgttcgggcttacacccgatgatttggagcatagtctttctgacattttatcgggtagcgtttcgtcgtcgcattctccttcacctccacatcgcttcaaacgccc

SEQ ID NO: 5797 - DNA, 903 bp, Glycine max
  Peptide Sequence Number=SeqID_122575
atggcttccaataactatcagtttgatctaaatgaaattccttacatagaaggggttaatgaaattcaatatcaaaacgaagaacttgatgaggagaggcaagcgacagttccattggtagttcgatctttggtcgatgacactcttgttcttgatctcaatacagatggaaatcgtcattatcccgtgttttacctgaacctcgattatttgcaactagatgctaacgatgatttaaatattgaagacactgattccatcctcaatgaagaagaatacactgattatgtccttgatgcgggtgatgacactgatttcgtcttcaatgctggaaatgttaatgtatcacataaagatactacagtaaggaaaaaaaagttcttatcaaatgagcaaagatgggcaatatatactacattacttgagaaaaatgtcaacagaaaattgaaacgcactacaaccaatgaggtggccactttattttcagtttctttacgaactattcaaagaatttggaaacgggcaaaggatactccgcacgaccacactagtctacctgatgaaccaaaattcatcgatatgtataatattgtgtatattgatgaaaaatggttctacatgagtaaaaacactgaaaagtactacttgttttccgtggaagaagatcctcttcgtcaatgtcaaagttcacattatatagggaaagtgatgtttttagttgctatgggtcgtccaaaatttgataatgaagggaatgaaattttctctgggaaagtaggcgtctggccttttgtcacacgagaaccagctttgagaataagtgtgaatagagaagctggcaccttggtgatgaaaccgattacgtcagtcaatagggacatcaacagaaagtggttgatttaa

SEQ ID NO: 5798 - DNA, 878 bp, Glycine max
  Peptide Sequence Number=SeqID_122576
atgccgaaaatgggactcaaaaacctgttcttcttcaaaacatcaccttcgccaccttcctcttctcccacaagaaccttctccgattcactaatggacgaaaacatcgaaaccgctcgcgccatcatttccaaatgggaacttatttccccttctgaccaagccgcccctctattcagcaacacacgccaagaagccaaacagtaccttaacgctgtcatgagcctgcagtccactatgcagcacctcgtcgcactggattcctcctccgacaccctcatccaagcccacttccttatgcaactcgccatgaagagactccagaccgagttctatcggatattaacccaaaacagagacaatctcgatcctgaatctgtcgcctccaccgatcaccggagcagcagcgtctccgacgacggcaccgatttctccgacgacgagttccgctttgccggtgactcggtctccacggttgccatggcggacttgaaagccattgcggagtgtatggtttccgccggctacagcaaagagtgcgtcaagatttacatcttaatgagaaagtccatggtggatgaggcactgtaccatttcggagtggagaggctcactttctctcagattcagaagatggactgggaggtgctcgagtcgaagattaagtcctggctcaacgctgtcaggttcgtcgtccgcactctgtttcacggcgagaaaacgctctgtgactacgtcttcggttcgccggagaggaagatcgcggagtcatgtttcgccgcggtttgcagagaaggagcggagtcgctgttcgcattcccggaaaaagttgccaagtgcaagaaaacgccggagaaaatgttcaggacgctggattt

SEQ ID NO: 5799 - DNA, 816 bp, Glycine max
  Peptide Sequence Number=SeqID_122577
atgcccattgaaaaccttgagcatttccagatcgagaaggagccacatcagtgcattaagattgggaaagagatgggagacgaagtgcaaaaggagataactcaagcgctctttgacaatgccgacttgtttgaatggagtgcttctgacatgtcaggcatcgaccctgacttcattttccataagttggcaatcttccctaaggataaacccatagctcagaggaagcgcaaactgagagacgaaaggaggaaaacaattgaggtggaaaccgagaaacttttggttgttaaattcattagagaagtggaccacaaaacttggctaaccaacgtcatcgtggtgaagaaagcaactaagaaatgtaggatgttgctccactttttggatgcctactttgtctataaccaaattaagatgtacctgcccgatcaggagaatacaacattcatcactgaagctgccaattgttgctacaaagtcatgcctttcagcccaaagaatgcaggagcaacctaccagagactcatggacaaagtttttaaggagaagatcgacataaatgtcgaggtttatgtagatgacatggtggtgaagtctgctaccccagatcagcatgccaaagacttggtgaagattttcacagagcttaggaagcacaacatgaggctaaaccccaagaagtacactttggggtcaacgaagaaagttggcctctctatccagattcctacccaagatggcagagaagtccaagcttttcttcaagttgttgaagaagtcctaagaccagtttatttggaacgaggagtgtga

SEQ ID NO: 5800 - DNA, 354 bp, Glycine max
  Peptide Sequence Number=SeqID_122578
atggacacccgagcatgcattttggaggaggctttcaacacaaagatactagcattgcctcgacctttaggctctcacaaccaagctaaccatagcaaacaatgcagataccatcaaaactattgccactatactaaagagtgcatagttttgaagaacaaaattaaagagctcattcagaaggggtgcttgaacgactttgtgagcggaaataattacaaccgcgaacgctatagagccaaaggcaatggtggttgccgcgatggttaccgaggaggatacgcaggcaatcgcttcaattaccagcaacatccaacaggagaaggcaaacaacaacaaaaggaaactccttag

SEQ ID NO: 5801 - DNA, 210 bp, Glycine max
  Peptide Sequence Number=SeqID_122579
atggagctattagtgttcggcctaaaatttgaacctcggggggcgatcaaggctcaattcttagccgatttcatggcaaggttacctccaaagccaagttgcaatagcgaaggagaatggtggatgctctatgtagatggagcatgtaatccaaagggcaatggagctgaaattacactcaagggaccagaggacatctcactcgagtga

SEQ ID NO: 5802 - DNA, 123 bp, Glycine max
  Peptide Sequence Number=SeqID_122580
atgcggcataagaagtcacaggggaatgagggtgtagttctatgtgtctccctacgctcacactcaatcaatgttccacaaactgagacgttattccttgaagaagagggatcatcggcataa

SEQ ID NO: 5803 - DNA, 390 bp, Glycine max
  Peptide Sequence Number=SeqID_122581
atcgccgttggcactctctttcacggcgagagaacgctctgcaactacgtcttcggttcgccggagaggaagaccgcggagaaaatgttcaggacgctggatttgtacgaagcgatctctgaaaaccgtcaacaaattgagtccatcttctcctctgaatcaacatcctccatcagatcgcaggtacttgcttctcaaacgaggctcggcgaggcggttcggacgatgttaaacaacttcgaatccgcgattcagaagggatcctccaagattccggtgcctggtggcgagatccacccgctcacgagctacgtcacgaactacatcgcgttcctcgccgattggccgcaaaatctgttgccggagtcttactaccgtagtcccgattag

SEQ ID NO: 5804 - DNA, 558 bp, Glycine max
  Peptide Sequence Number=SeqID_122582
atgaaaggaatgaatctgttctgctcttccatttcttccacagcagtaacctctagtactacggatcatcattccacggtgcgcagaagcaccaaaaggcacgccggtattccaaggaaaagccaacttcgtgtcccttgttcatccagattattgcctatcaatcctaagcctcaaaacggcgatgttcgcagaacaggctccattcaagttaacaacctatatgattcatcgtcaactagatatctcctcggtgattgggtgtctgagtctgataaaatcccttcaaactcacacaagaccaccctgcagaaccaggttgtggttttgagggtctcattgcactgcaaggcctgtgcaagaaaagttacaaaacacatttcaaaaatggaaggagtaacatcattcagtatagacatggaggcaaagaaagtaacaataattggacacgtgacaccattaggggttctggcaagtgtgtccaaggtgaagaatgcacagctatggccatcttcgacatcatctttgccatcattgtcttcgtcaatgccgatgtaa

SEQ ID NO: 5805 - DNA, 285 bp, Glycine max
  Peptide Sequence Number=SeqID_122583
atggccaagtttgatccagaaatagtccttgagttttatgccaatgcttggccaacagaggaaggcgtgcgtgacatgaggtcctgggtaaggggtcagtggatcccgttcgatgcagatgctatcggtcagctcctgggatatccgttagtgctggaagagggccaggagtgcgagtatggccagaggaggaaccggtctgatgggttcgacgaggaggccatcgcccaactgctatatatggatgacgttgctcctcagcaacatcctgcccagcgatcataa

SEQ ID NO: 5806 - DNA, 303 bp, Glycine max
  Peptide Sequence Number=SeqID_122584
atgaatgtggtgttcaagtggactgatgtgcatgagaaagcttttaatttattgaaagataagctgaccaatgcaccttttctttgtttgcctaattttgatgaagcttttgaaattgaatgtgatgctcctggtgttggaatatgggttgtactgatacaggactctaaaccagttgcatactttagtaacgaatcaaattcgaggatgaatcctttcgaagagggagggaataatggaggtgaaaccagcttgtctaatgatcctttacagggaattagaggtcctatgacaaggtcctag

SEQ ID NO: 5807 - DNA, 150 bp, Glycine max
  Peptide Sequence Number=SeqID_122585
atggcttctactcggctggatatttctttctctcatgtctttcgggaggccaacaaagtggatgatgcgtctgggtcggtcaaagaagcgctgcagttgcaagaagatttctatgactcagtaggactatcgttcttcaggggtgtttaa

SEQ ID NO: 5808 - DNA, 492 bp, Glycine max
  Peptide Sequence Number=SeqID_122586
atggctcctgcaaagggtggtgtgttatggcatggccggagtaggggtagaggcagccatgggtgttcttcttctattattttatggtctaccatgtttgctaattcaagcacaagggggaatgccacgtcaaaccgtctttgctattgtcgtagaagagctaccattcgaacaacaaggacgacaaggaataatgggagactgttttatgcttgtccattaccacaacaagatgcagatcgatgtaatttcttttcgtgggttgatgaagacattgatgttggtgcaactgaaataggtagaatagaaccaataccagacttttgtctaaggttgagactggagattctgcaaagagaagttaggatgttaacatattgtgtagttgtagggtttgtagtggtggtgacatttaacgtgtcatatcacacatttactaacggtcttaggagactactaatgacaggggctaacgtggcaaacgaaatgtaa

SEQ ID NO: 5809 - DNA, 237 bp, Glycine max
  Peptide Sequence Number=SeqID_122587
atgggctcagaaatctaccctgaggatcatgagaaccctagggccttctttagtagctttagcccaatcctcttggattcttctatccaatacccttgggggggggtccacaaaatacgcgtgacaagcaatgtggccctcaaatacacatgtttgccctccatgttagccctgcctcatgagcatggacgttccacgcttagtaggcgggttcccaaactgacaggttatctctaa

SEQ ID NO: 5810 - DNA, 545 bp, Glycine max
  Peptide Sequence Number=SeqID_122588
ggtccgggcacgacggggctctcaccctctctggcgcccctttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggtagatga

SEQ ID NO: 5811 - DNA, 222 bp, Glycine max
  Peptide Sequence Number=SeqID_122589
atgactgcaggtgatccaccccagcagaagacaagtcaaggaaatgagaaaaagaaagaagatgataatattactcaaggcgatccacctcaagaggagagaagtctacgaatcgagatagaggaagaactcaagaatattacagaaggtgatccacctaaacaaaagagaagtcaaggaaatgagaaaaagacagaagacgacaatattactcaaggttag

SEQ ID NO: 5812 - DNA, 821 bp, Glycine max
  Peptide Sequence Number=SeqID_122590
atggtcttaaaggaggagttagctgcttgctcaagatccaagaggagtttggaccaacacttagaagccacggagcaaagcatgctagctataatagggcagtacaaagaagagttaaaccaatctttgacccatgaacaaaaactagtagaggacttcgctgacttcgcacaagcgtacgccgagaaggaagcaagagggagggtgattgatgtattgcatcaagaagcgaccatgtggatggataggttcgccttgaccttaaatggaagtcaagacctcccgcgactactagccaaagcaaaggccatcactgaaggagtgcaagaacagatgaaggccgacctatcggccttaaaagatcaaatggcttccatcacagaggccatgctaaagcttcaaaaaactatagaagataatgctacggcgcccgcttccaatacagctagggaagcggaaccagtgctacagcccgcaataaacttgggccgagatagaaacatgacaggtttcaatcgaaggtatagtcctcaagcctacccttatggtttgcttccggacttcactccccgtaccgctccagacgattggagccaagcccctaccatcgagggacagctccctcctcatgttgactatcctctgcaagaagatgatgaaggagatgcccatttaggccctctgcttcccctcaaggaaccagccccgcatgagttgccccaaccaaacatagtctgccatgtcccgtctccatccgcacccgttaaggaacttgttccctttgcaaaagacaagggaaagtttgatctacttgaagagag

SEQ ID NO: 5813 - DNA, 819 bp, Glycine max
  Peptide Sequence Number=SeqID_122591
atggcctttagcaacggaatgatcaacctattaagtagtcatctcttctcaagggcatcaggctacccggcaataattttcggtcttttctctgatgtcacaaagggctggcaccaatcacaaaagggagactcggtttccggcttgtacaatataactggcggcacagcaactgctattggttctatccttatgttagagggaggcttagccatcgccggcccgacattctttattccttttgcgggttgggctgcagtggggatcgtgctgataggggccacactaataatcgcaggactatatctctattcgaaagcgcacgagcgcttgcacagtccgatagagctatgggcaagcaggtgtatttttgggactagggaaaacgatggtgaaatccggcctggcttgaacctagactttcaaaacaagctaccccgcttcgccagccttatcgaagaagtcgaatcatggcatgctgagacgtatgccccaatagcaatttccctagaacaatcagcgcagctcggcttaggagcgctaacaacaaagcttagtactaacagccattggccaacgccggactgggcaacaattatacatggccaagtatcaattgaggtgcccacgattgagttcacgatattactacccgacttcatgatcgggcaaagcgaatggtctggcacattaagaatcgaagacaccgacggaaacgcaagaaaaagccagaaatgcaaaactatcaataagctatcacctcaaccactacctggctacttcccccaaatcccacgccgtctttttcattcagaataa

SEQ ID NO: 5814 - DNA, 342 bp, Glycine max
  Peptide Sequence Number=SeqID_122592
atgacgaagctcggggccagccgcgatcgtattgctgcctcgctcggcccctccatcagccaggacaattatgaggtcgggccggaatatgtcgcgcgtttcaccgatatcgagcccgcttacgcggattatttctccagggcggagaaagagggccacgccttgtttgatctcaagcagttcaccatcgaccgcctgaccaaagccggtgtgaaggcggaaaatcttggtctctgcacctacccggacgaagaacgcttctattcctaccgccgcaccacccaccgcgccgaacccgattacggccggcagatttccgcaatcgcaattctggaggactaa

SEQ ID NO: 5815 - DNA, 237 bp, Glycine max
  Peptide Sequence Number=SeqID_122593
atgaggaagttcttccacgagcattccatggaagacacttcttccgcagttgaaattacaacggcggaagaagttcttctgcgagcattccacggaagaaccttcttccgccgttgcaatttcaattgcggaagaagtgtcttccgtggaatgctcgcggaagaaccttctttcgtacactcttgcggaagaacttcttccgtgtctttccacggaagaaccttcttccgcagttga

SEQ ID NO: 5816 - DNA, 636 bp, Glycine max
  Peptide Sequence Number=SeqID_122594
atgatgtttttggttctgcagaacttggaattgcttcaagattcactggagaaaccctacaagtacgcaacctcattagtgcctcgagtcaaactctacctcatcaaagatgaaaaattggaaaagacaagatggggtcagattgtcgtgtacgttcgacctgagcgggttattcgacaatttggctacattccgaccgtccctccgccgtcggttagtgattctttgacggatgatgacatagacgaccagtggctccatttttcagaccatttggtaggtgcgggggagatctgtgtagttcttgggcaggtggcgccagactacatggactggttctttcggatatcccacccgtttgtgacgcctaccgaagagactgctgagccgagacatcatcctctccctcatgttgaggagttcgtcaagccacctatccctgaggtttcagtcgcgtctgatctccctacgcattcagtggttgactgccaaggatgtgcagcgattgctgaggaattggagcgggtcatcaacctcaagatggtcactgaaggcactgacttatatgatatcatggctcgttgtctgaggatagctagaggtgatgccgcagataagagtcttaggccgcgatag

SEQ ID NO: 5817 - DNA, 506 bp, Glycine max
  Peptide Sequence Number=SeqID_122595
gtactcgcggaagaaggttcttccgcaggaaagaaatccttatcgcagaagaaccttcttccgcagaaacaggcggaagaaccttcatccgagcactcccatggaagaagcttcttccgcggatggcagcggaagaaccatcttccgcgagaaggaaatgtaacgtcctagacacccgcggaagaagcttcttccgtgggttcccacagaagaaccttcttccgcgtgtgtcaaagatgttccatttccttctcgtagaagatggttcttcctcggaatcacgcggaagaaccttcttccgctgccatccgcggaagaaccatcttccgccagacctcccacaacacattcacacacgcggaagaagcgaaccttccatggaagaaggttcaaagcttcaatcggccgacaatggacgacgcgcgcgcagagaagaagaagaattggaagctggaagcggggagaggaagaagcttttggtcgtggaagaagattttgaacgttag

SEQ ID NO: 5818 - DNA, 183 bp, Glycine max
  Peptide Sequence Number=SeqID_122596
atggaatctgatgctgtgtggataacagaagaggaagatgatattttttatgaagacaatgtccaagttaagcaacctcttggtgaaagaggaagtttaactgatccaactttggatacatttgatattgacagtttagttttgaatgacaatgttgacgatcacttctcaactgaagaataa

SEQ ID NO: 5819 - DNA, 825 bp, Glycine max
  Peptide Sequence Number=SeqID_122597
atggatttgaaattgaaaaaatgcagtgaaccgacaaggaaaaagattagtggacgagttcgaggaactgcaacaagaaaaccgtcaagaaagcctctgggattcaataaactagccccagcagagggtttggcaagtcaaactcagacttcccagaaggtcaatggtagatctttccacatccttgaagaagagaagattaaaataggtgacaaagcacaaaagtcatccagtggtaaacctgaagatgctttccatatgaagaatgcatcgcaaggagatattcccctttctggaccattacaagtttcaacatcaagtggctttgcatgggcaaaaagccgtaaagatgacacttcatttcgatcccattgtcgaactatttcaagaggacatattttcaatgcattagaaccttctacattaaatacaagaaataatttggacaccacaaaccaggaaaataaggagttttgtgggagataccccaattctaggggccatgacctacttgaaatttctaagctttcaatgcagaaccagtggagtaagtttgatcgcccagactcatttgatgcttcagatgagtaccactcacaagaattgtctacggccctttatcacagagaagattcagtatccaagagaagtaacctgacttttcaagatcaaggagaaaaggttgaattttctggacccctactatctcaaatgcacacagttgatgagctcttggaaaggcacgagcgccacatccggcgaactgtccggagatcatggtttcagagaggtataaaggcataccaagctcatggttacctttga

SEQ ID NO: 5820 - DNA, 1014 bp, Glycine max
  Peptide Sequence Number=SeqID_122598
atggggtgcgtgagctcgaagcaagcggtgtcagtgacgccggcgattgaccactacggcgccttccggagcaatgcgggtggtccgtgcgagccggagaagaagaggaccgagtctggaggaggaccgagtcagagcgaggtaggtgagtctggcagaacgagttcgaattgcgagtcgctgagcttcaggctggggaacctccagaagtacgtgcagggcgaacacgttgcagccggctggcccgcctggctcagcgccgtcgccggcgaagccattcaaggctgggtccccctccgcgccgacgccttcgaaaaactcgagaagatagggcaggggacgtacagtagtgtgtttagggcgagggagcttgagacgaggaagatagtggcattgaagaaggtgcggttcgacaatttcgaaccggagagtgtgcggttcatggcgcgtgagatactgatcctgcgacggcttgatcaccccaatatcataaagcttgagggtttgattacttcgaggttgtcgtgtagcatatacctcgtgtttgagtacatggagcatgacattacagggctcttgtcttcacctgatatcaagttcactgaaccgcagattaagtgctacatgaaacagttgttggctggtcttgagcactgtcacttgcgaggagtgatgcatagggacattaaggggtcgaatcttttggtgaataatgaaggggttttgaaggtggcagattttgggttggcaaattatgtcaattctgggcacaggcaacctctgacgagtcgtgttgtcaccttgtggtaccggccgccagagcttttgctcggttcgacagattatgatccgtctgtggatctttggagtgttggctgtgtgtttgcggagctgcttgttgggaagcctatacttcaggggagaacagagaaatatgacaatgcctcaaccctcaaggaagcaactgatatgaaaatgcttgccatgggatggatatttgagtttctatgttaa

SEQ ID NO: 5821 - DNA, 174 bp, Glycine max
  Peptide Sequence Number=SeqID_122599
atgccccatgggttgtttccctatgaaaaccacgcgctaatgccattgaggcatttcaccgaacacttggtgggcgcgcgtttcggcactaatagcaagagaacggggacaatgtggcgcaaaacggaatcgaagaatgcgaaaagtagagatcctaggggtgcaaactcgtaa

SEQ ID NO: 5822 - DNA, 379 bp, Glycine max
  Peptide Sequence Number=SeqID_122600
gttgccgtctcttgtgacggacgcgtggggtgttaataccttccccgtgtgtaaatacaactcctcaaataaatgttggtggcgactccgcgcgtattcccttcttggaacacgcacccacgagtcacgcgtcgccctcccgtcaaaggagggtacatctacttgggttgttgtgactgagaacaagagagggtacatctcttgtggatcagttctagtggagggtacatccactaggtttttcaaagagaacaagggagggtatatcccttatggatctttgcttgtaaaggaatttacaaggttgaaaagaaatctcaaggaccgcaggtcgcttgggaactggatgaaggcacgggttgctgtcgaaccagtataa

SEQ ID NO: 5823 - DNA, 542 bp, Glycine max
  Peptide Sequence Number=SeqID_122601
atggccgacttcgccgtgataaaatggtggatgagccacgctcgagaccaatcacgtgcgagccggtcagttctggacccatcgacgaccctttgcgtgcacgcacgctcccaacgagacctcagggtgagagccccgtcgtgcccggaccctgtcgcaccacgaggcgctgtcggcgagtcgggttgtttgggaatgcagccccaatcgggcggtaaattccgtccaaggctaaatactggcgagagaccgatagcgaacaacggatgggggccggcgatgtgtcccggtcggatgtggaacggtgagagccggtccgccgatcgactcgggacattgaccgacgcggaattgcgatgggtggcccaagcccgggctgttgatatgctcgtggagacgtcatcatcgcgatttgtgggatgggcagcgcgcgcccttgggcgtgcctcggcaccctgcgcgctcctgggcggtcggcctggtgggctccccatttcgggcccggtctttgaaaacacgggaaccaaggagtctggacaatg

SEQ ID NO: 5824 - DNA, 336 bp, Glycine max
  Peptide Sequence Number=SeqID_122602
atgtttagtgaaatgttatacaagaaaagcaaaatttcacctgcaatggtccttctgtggatgaaagaaatagcaagctcactcacctctaatatagtgcaaatcaaagggcctgaccctagtctcaggatatccaaagctagaaacaaaggtcgtgccaaaggaatgctttcgtgccaaaggaatgtctgcaaggaaagcaacaaaggtcgttcagagacaatggcagtgacaaggaatgcaccgaagctcgttcaaagacaatggcagtcacaaggaaaacaacgaaggccattcaaggaaaacaacaaagcttaccaaggtagacggcggtga

SEQ ID NO: 5825 - DNA, 225 bp, Glycine max
  Peptide Sequence Number=SeqID_122603
atgaccctgccaaggacatctcatcttgtagtgcatgatactttggatccatgggagccaggaaacaggatggagaacaaggcttggatggtgacactctccaaaatcagccacacacaccctttggcctcagagttacatagacacacagttggaacaaaattgatagtggctaacatgcgccaaaataggtgcaggggtgttgtgggacctacttcagtgtga

SEQ ID NO: 5826 - DNA, 237 bp, Glycine max
  Peptide Sequence Number=SeqID_122604
atggttttaagagacattatgtttctacatatagtggatggcatcagaaatcaattgattcacgtatacacttacctatgtcatgacggcacagacaaactgacacttcggcagggggagatcggagttgtggtgttggccctcctccgagatcaggggggcggccaaggaattgataaagggaaactactggtgcctcacccgggagcgcaagtctcggttaagcattatgggtag

SEQ ID NO: 5827 - DNA, 537 bp, Glycine max
  Peptide Sequence Number=SeqID_122605
atggaggagcaattcatacttagagttccacctaatgtggcagagcggatagagcgtcttctgaatgaaaacaatgcttcttcatctgaagacaagtcactagatttgtcatttagagaggatggaagaagtggtacgtttatgattgggaatgaacaattcccagcttctctattggatcttccttgcgttgttgaatcctataagacttatgatgataactctttaattaagactgccgatattggtcagatgattatggtgagggaatctggtgatgctgctccagatgtaattgagtacagacatggcctcactccacccatgagagatgctcgcaagcgtagatttcgcagggagcctgatcttaatcctgagcttgtctcccgtgttgagaaagatcttctcaaaatcatggctggaggaacagcggacaatcttgatatccttacatctttgtttgtctcaaatagcaatttagcaaaattttcaatccttaaacacaaatttgactctactttgaattgttctctttaa

SEQ ID NO: 5828 - DNA, 285 bp, Glycine max
  Peptide Sequence Number=SeqID_122606
atgacatcagaactcacgagtgattttcctcctcgaatcccagccagcctgcatcaatcagactttgcaccttatgtttcaagatcatacaatgctcaatggaatgccttggaactctcccatgataagcacatgtcatgttggtgttgtatcctctgggaaatggaggggtggtgtttggtcttgggtgtgcatcgggtggattttgtggccgatttgggggtggcctttatggatgattgggcattcttggctgttagggtggtgggtaatgagaaggactga

SEQ ID NO: 5829 - DNA, 303 bp, Glycine max
  Peptide Sequence Number=SeqID_122607
atggcattcggagaccatcctggtcatcatttgcattttgaagatgagaatgtctttagtcattgcatgccttcaaaggcgacaatgaccatcatttgcattttgaagatgataatgtcttcaatcattgcatgccttcaaagtgattgcatgctttcaaaaggcgacaatgaccttcatttgcatttcgaagacgacaatgtcttcagtcattgcatgccttcaaaggcgacaatgaccattatttgcatttcgaatatgacaatgtcttcagtcattgcatgccttcaaaggtggcaatga

SEQ ID NO: 5830 - DNA, 1020 bp, Glycine max
  Peptide Sequence Number=SeqID_122608
gaaaccctggcagaaaaaggaattattttctgctctatttccgaagcgataaaaaatcacccagacctggtgaaaaaatatcttggaaaagtagttccaagaggagataatttttattctgcattaaactccgcggttttttctgacggaagtttctgctatattccaaaaggtgtaagatgcccgatggagctttctacttacttccgtatcaatcaggctggaacaggacagttcgaaagaacccttgttattgcggatgaaggaagttatgtttcttatcttgaaggatgtacagctccttccagagatgaaaatcagctccatgcagctgttgtggaattaatagcaatggacaatgcagaaattaaatattcaactgttcagaactggtatccgggtaacgaagaaggcaaaggaggtgtattcaattttgtgactaaaagaggactttgcgaaaaaaatgcaaaaatttcatggacacaggttgaaaccgggtctgcagtaacatggaagtatccttcttgtattttaaaaggagatggctcaataggtgagttttactccattgcggtgaccaataatcaccagtatgctgatacaggaactaaaatgatccacatcggaaagaatacgaaatcaacgattatttccaaaggtatttcagcaggaaaatctcagaactcatatagagggcaggtaaaagtaatgccttctgcaaaaggagcaagaaacttttcacagtgtgattcattactgatgggtaatgagtgcggtgcgcatactttcccatatattgagatcaaagacccgactgcacagctggagcatgaagctactacttcaaaaattggggaagatcagatcttctattgcaatcagagaggtattgatacagaaagggctattgctctgattgtaaatgggttcagtaaggaagttttaaataaacttccaatggagtttgctattgaagcccagaaattattagagatatcattagaaggttcggtagggtaa

SEQ ID NO: 5831 - DNA, 246 bp, Glycine max
  Peptide Sequence Number=SeqID_122609
cttgggaggattgatggggacccggcgttgagaggaacgaggataagggctacgtgggagtacgtgagctcagttgaggagaccttgaggacgtcaggtggggtgctattgcccaaaaccaagcttgaccaatcccgatccaacccggtgagatttgggatatggcctatggtaatcgattaccaagggcttgaaaacgagatcaggaagctaggagggctcctggtaatcgattaccaggcttag

SEQ ID NO: 5832 - DNA, 639 bp, Glycine max
  Peptide Sequence Number=SeqID_122610
atgacgtttgaggcaccaaaggaaatagctgatagaattgatgtcctcactgctaccattggacgaccagagcatcctggccgtgttcgtgttgctggagtcggtgtcaccataaagcaatactttggatcgccttcacgaacgtcccgtagttcttccgacatttctcttgaagaccttcaacagctgacccaacaaatcagagaccaactagaggagtcaatcacagaaaaaatgcaatcacagggacttgcactacctccagagccagagattggtcccctaggtcctcgtgtcagcacaaaggagagttgtgttgctctctcagggaacgattcagggacgagtgactcagaaaaatgcgggctatacattgaagaaaatctttcccgcctggttgccctaggaagactttatgagggatccacaacagttcacaacatccctttgttgcatggccaagtcaaggtttgtgttgaggaggttaaagatgcagaggctctcgttcctgtatccactgacgatgttacactattagaaaatatgctttctacatcggtttttcaaccgatgttgaaagtaccgacgttgatagtattatcgttaacatcggtttttcaaaaaccgatgttaacgtaa

SEQ ID NO: 5833 - DNA, 282 bp, Glycine max
  Peptide Sequence Number=SeqID_122611
atggagaggagtgtgattgatgctgccagtggtggagctcttggtgatttgacccctactgaggctaggaatttgattgagaagatggcttccaactcccaacaattcactgcaagaaatgatgctattgttcttagaggagtccacgagatggccacagattcatcttcatctactgaaaataaaaagcttgaaggaaaatttgatgccttggtcaacctagtaacccagcttgccttgaatcagaaatctgttggatcgagtggcctccgaataatttag

SEQ ID NO: 5834 - DNA, 462 bp, Glycine max
  Peptide Sequence Number=SeqID_122612
atgaccctgtgggtgctcggactgaatcaccagaccgcaccggtggagctgcgcgagcgcgcggccttcgccggtgaggcgttgccgcgcgcgctcggttcgctgcgcgataccccgcagatcgccgaggcggtgctgctgtccacctgcaaccgcaccgagctgtatgccgtggccgattcggcacaggcgctggaccagtggctgcacacccaggccggcgacctgcagggctacctgtaccagcacgccgatgccgaagccgtgcgccacctgttccgggtcgccaccggcctggattcgatggtgctgggtgaaccgcagatcctcggccaggtgaaggaggcctggtcgaccgcgcgcgaccacggccttctcggccagcgcctggaccgcctgttccagcagaccttctcggtggccaagcgtgcgcgcaccgatacccaggtcggcgccaacccg

SEQ ID NO: 5835 - DNA, 992 bp, Glycine max
  Peptide Sequence Number=SeqID_122613
atgcccgcattgattcgcatccccagtgttctgctgctgtccctggcctgcagccaggccctggcggcggtgccggccaaggcccctgtaagggccccggccactgaggaactggcgctggagccggtgatggccggtgagttcgccctgcaggccggcaagctggctgaggccgcgcgctggtacctgcaggcggcccagcagaccgacggcgacgccggcctggccgagcgtgcgacccgcatttccatgctcgccaacgatgatgccagcgccgccaagggcctggccctgtggcaacagcgggccccgcgctcattgaccatgcgcagtgcggccggtgcgctggccatgcgccagggcgatgtgaaggctgcccgcaccgaactgcagggcttgctggccgactccgacgagcgcggttggaagtttgccctggccgccctgatcggtggggggcgcgatccggcggtgcccgcgcaggtgctgggtgagctggtcgacgccaacgccattccaccgaagatcgaagcctggcaggagttcggccgcctcgccctgcgcatggacaagcccgaactggcgcggcgcatgatcgatgaagtggtcaagcgcttccctgaagaaccgcgtgtggcgttgctgcgtgccagccagctgcagcaggccggggagaccggcaaggcgctgtcgctgctgcacgatgtggagcctaagacccgccaggacccggaactgcgcaatgcggtggccattgcctacgacagcctcggccagccgtccgcggccgagcgcgtgctggccttcggcccgcaggacgtgcagacctggggcatgcgcgcttcgctgctggccaagcagggcgacaaggcggcgctgtccaacctctacaacgaactgtcgcggcaggcggccaagccggacccggcgcagcgcctgctgctgggcaagatcgccgagtacctgaagcgttatcccgaggcggtgcagtg

SEQ ID NO: 5836 - DNA, 2448 bp, Glycine max
  Peptide Sequence Number=SeqID_122614
atgagtgtttccctgatccggccgatgctgttggtggccgtgaccctggcggtgaccgcctgtaccagcgtgggtacgcagaagaccgcgccaccggcggtggtcgagacggtttcggccgaagcggcgcgggccgaggcggcgcgcgtggccgcgctgcaggcacagtcggactgggccttccagggccgggtcgcggtcagcaagggcaaggacggcggcagcggtcgcatcgactggaagcaggaggggcgccgctatgtggtcgagctgagcgcgccggtgacccggcagagctggaagctgaccggcgatacccattccgaagccggtcgccttgagggactggccggcgggccgcgtgacggcgaggacgcccagcagctgctgctggaggcgaccggctgggacatcccggtcaaccagctgccgcagtggatccgtggcctggtggctggcgatgctgccggtccggagaaggtcgagcgcgacggtgcagtacctggactggtacccggccgaggccgggcgtccggcgctgccacgccggatcgaggccagcaatggcgacgccaaggtgcgcctgctggtggatcagtgggggcagggcgccccatgagtgccgggtgcgatgacgcgggctggtcctggtggccggccccggccaagctgaacctgttcctgcatatcaccggtcgccgcgccgatggctaccacgagctgcagaccgtgttccggctgctggactggggcgaccgcattggtctgcgcctgcgtgaagacgggcaggtgcgtcgtgagggcgaggggctggccggcgttgccgaggcggatgatctggcggtacgcgccgcgcggattctgaaagacgcggccaatatcgcgcaaggcgccgacatcatcgtcgaaaagcgcgtttctgccggcggtggctttggcggcggttcctctgatgccgccaccgtgctggtggtgctgaaccggctctggcgggccggtctggatgaggacgcgcttgctgcgttgggcctgcgcctgggcgcggacgtgccggtgttcgtgcgcgggcgcaatgcctgggccgaaggggtgggcgaacgcctgcagcccatcgtgttggaaccggcctggtatgtggtggttgaaccgggcgttcatgttcccaccccggccctgttcgcagacccggatttgacgcgcgacagcccagtggcgaaaatagaggacttcgcttccgggaccctggtcgggaacgcgttcgaaccggtgctgcgccgccgtgagcctgccgtcgaggcagcgttcgccgcgttgagcgatatcggcacggcgcggctgaccggttcgggaagtggttgtttcgtcgagttcgcatcgcagtctgccgcagagcagggacggtcgaagttgccgaaggagttgcgggcaagggtggcagcgggcgttgcgcgggcgtcgccaagaggcccaaggcaccaggttttgatcctggcattcgtaggttcgaatcctaccgcccctgccaatagcggctgtgtccgcgccttccagcgcatcgcccgcgcgggacgtggaaacaaccgcggtgttgtcagcagcaagggtccatcagggtccttgccgactccggatccccgccactcgtccccgcccgagacaatcatgatgcaagagtccccgaacctgctggtcttttccggcaacgccaacaaacgtctggcgcagaacatctgcaaggaactgggggttcgcccgggcaaggcgctggtctcgcacttctccgatggcgaagtgcaggtggagatcgaagagaacgtccgcaagcaggacgtgttcgtgatccagccgacctgcgcgccgagcgcggaaaacctgatggaactgctggtgctgatcgacgcgctcaagcgcgcatcggtggccagcgtgaccgccgtggtgccgtacttcggctactcgcgccaggatcgccgcatgcgctcctcgcgcgtgccgatcactgccaagctggcggcgaagatgttcagcaccgcgggcgctgatcgcgtgctgaccgtcgacctgcacgccgaccagatccagggcttcttcgatattccggtggacaacgtgtatgcgtccccgctgctgctggccgacatctggcgcgcctacggcaccgagaacctgatcgtcgtctcgccggacgtgggtggcgtggtccgcgcccgtgcagtggccaagcgcctggatgacgccgatctggcgatcatcgacaagcgccgcccgcgcgccaacgtctccaccgtgatgaacatcatcggtgacgtcgaaggcaagacctgcgtgatggtcgatgacatcgtcgataccgccggcaccctgtgcgccgctgccgctgccctgaaggcgcgcggtgcgctcaaggtcgccgcctactgcacccacgcggtgctgtcgggcccggcg

SEQ ID NO: 5837 - DNA, 279 bp, Glycine max
  Peptide Sequence Number=SeqID_122615
atgtcatggttcctcttgtataagatattcccactcaggaagaagttggctgccaacctttgcaatgtcctcttgtcgttgttagaggcctcatgcgggtatttcttgtcttcgatgtatcgtttgatattgaagtaccaaggcttagcattcttctcttcttctattaagcagcaatgtgcaagcttaccacaacatctaaattcgatgttcatcaaatctctgtgcgggcttagctggaacatggacgttagtgtggcaagggcatcgaccatctga

SEQ ID NO: 5838 - DNA, 708 bp, Glycine max
  Peptide Sequence Number=SeqID_122616
atggcgtcgggcttggcgccaaatcagcttgagcacctggcccgtgacgctggtgtcggtgcggctgtacttttcgatggagacgatctcgatgcccttggccttggcggccttctgcatcacgtccaaccagccgtcgccgtaggcgtcggcaaagccgatgaagcccagcgtcttgaccttggacttggacatggcgtcggccagcgcgccggccatcagggcgtcgttctgcggggtcttgaagacccagcgacgcttgtcgtccacgggctcgacgattttggcgctggcggccacgctgatcatcggcaccttggcttcggcggccacgtccaccatggccagcgagcccggggtgaccgacgtgccgatcagcacgtcgaccttgtcgtcggaggccagcttgcgcgagttcttgacggcttgcgtcgtgtcggtggcgtcgtccaggacgatccattcgatcttctggccggccacttccttgggcagcagcgcaaccgtattgcgctcggggatgccgagcgacgcggcgggaccggtgctggacaccgtgacgcccaccttgacctgggcgctggccagcagcggcagggtcagggcaacggcggcggcggccgcggacaagccgaagtgcttgcgcatgttttgtctcctgtggtggctctgttatgccccggtcgaggcggaagcgagcctagttaa

SEQ ID NO: 5839 - DNA, 1338 bp, Glycine max
  Peptide Sequence Number=SeqID_122617
atggcgtcatcgccgccgacgacacgccggccgccgcgctgcgctggtaccgggaccgctgcgcgtgatcgagcccctatatattcccggcgactcgccgctgcaccggctgcccgccggcctgaagctgctggcgttggccgcggccggcgccggattgttcctgctgcgcgatcccgccatccttgcgggagcctgcgcgctcgccggcttgctgctgtggtgcgctggcgccacgccagccggcgtctggcgccaggtgcgcggcctggtctgggtgctgctggccgtcggcgtcttcacggcctggttccagggctggcgcgaggcgttggcggtactcttgcggatcgccgcgatggtcgggctggcgctggcggtgacgctgtcgacccgcagttcagacctgatcgccgtgtgcgagcgggtgttgatgccgttgcagcgcatcggcctgctggacgcgggcaaggtgtcgctggcgctggcgctggccctgcgcttcgtgcccgagatctggcgcaatttccacgagatccgcgaagcccaggcggcgcgcggactgggcgccaatccggtggcgctgatcgtgccgctggtggtgctcacgctgaagcgggcgcaggaagtggccgaggccatcgacgcgcgcagcctaaagggcattgccatgaaatccaacaacactgtgctggtggcgctgttcgccgcgctgatcgtggtgctgagcctgattccgccgatcccgctgccgggcataccggtgccgatcacgctgcagacgctgggcgccatgctggccggcgccatgctggggccgggccgcggcgcgctggcctgcctgttgtacctggcgctggcggccatcggcctgccggtgctgccgggcgggcgcggggggctgggcgcgttcttcgggccgacgggtggtttcctggtgggactggtggccggcgctttcgtcaccggctggctggcgcggcgcctggcggggcgggcggcggggttcggcggccaactggccggctgcgccatcgcctgcgtggtcggcggcatcgcggtggtctatgccttcggcgtgccgtggctggccacggtcaccaagatggggctggccaaggcggcgacggcggtggtggtgttcgtgcccggcgacctgatcaaggccgcgctggcggcgtgggtggcgacgcgggtcgagcgggtctggccgatgcgtggccggtgggcgcgacgcagcgatcatggccccagggaatcccccaactgacgcccgtttggctttcaagtacaagttcgccattaacgaatgcgtttgctgaaacatggtttccgtag

SEQ ID NO: 5840 - DNA, 126 bp, Glycine max
  Peptide Sequence Number=SeqID_122618
atgggtgtaaataataaggcagaaaagagaaccagcacaaagtccttgaaaacttcaacgcagaagtatcgaggagcttgcttctcgaagcggggattcggactgtctgcaatcaaaacatgctaa

SEQ ID NO: 5841 - DNA, 246 bp, Glycine max
  Peptide Sequence Number=SeqID_122619
atgaggatgacaaagatagtgacggcaatggtggtagtagtaatgttggtgacgatggcgatgaaagtgtggtggcggtgttgtggtggaggtgacggaggtggtattggtggtggtggtgacaatgacagtgatagtggtagtgtggtggtggcagtgataacaacattgacaatagtggtggtggtggtagaagcaaaaaatgcgattgtcaaatgtgggaaatgtgtgctttttcaaaactaa

SEQ ID NO: 5842 - DNA, 153 bp, Glycine max
  Peptide Sequence Number=SeqID_122620
atggtgttggttgaggtatggagagtgttgattgaggttgggaacttggttatggtggttggccttctatttgaggttgagagggtttggttgaggttttttgatatagctaacgtgatggaccaaaaaagggttaaaaactcgttgatttaa

SEQ ID NO: 5843 - DNA, 801 bp, Glycine max
  Peptide Sequence Number=SeqID_122621
atgtggagacagagcgctttattggtgttcgtgttattactagtccagcaaatttgtgctaccagtgagcaagagcatgcttgccccccttcttcctgtggcaaaatcacccacataacttatccatttcgattaacaggcgacccaaaaggttgcggtgacaaatggtatgagctagcttgtgaaaataatgttacggtgttatatttgtactctggaaaatatcatgtgcaggctatcaactacaacaatttcacaatccgtgtggtggatccgggtgttcaacagccatattgctcctccattcctcgctacttcttgtctcaatcaaatttcagtgcaattgatgaaggggatccatacctagcctttcaaaatcgagattattcttgggagtacgttttccagcatatagttttcttaaattgtaggcatgcagtgattgacaatgagaagtatgtggaaactgatccttgcatcaagtggcactccaaagggtacatatacgctattgctggtgacttaatagcaaaggactttgaagttggttgtgaggtaaagctggttgctcccacatcattgtggggtttggatacatacactcagatgcacagagcgcttatctatggatttgagctttcatggatgaatctcgcctgtgaggattattgtggaaatccctcctgcacatttaactcttccagtcagatgcttgaatgctcctccctccgcgtctgccgcaatttcgtggtgggatggcagtaccttactcaatgtggtaaaggatgtaaaaattattaa

SEQ ID NO: 5844 - DNA, 894 bp, Glycine max
  Peptide Sequence Number=SeqID_122622
atggctagaggtttcaaggagaaattgggtggaggaggctatggctttgtattcaagggaaagttgcgtagtgggccttctgtggcaattaaaatgctacataaagcaaaaggctcaaaacgtgcccttgtttatgaattcatgcccaatggatctcttgacaaatttatttttcccaaagatggaaatatacatttaacatatgacgaaatatataatatagcaattggagtagctcgtgggattgcttatctccatcatgggtgcgagatgaaaatattgcattttgatatcaaaccccataacatccttcttgatgaaacattcaccccaaaggtctctgactttggattggcaaaactatatccaatagataatagcattgtgactaggacagaggcaagagggacaattggatatatggctccagaattattttatggaaatattggaggaatatcccacaaggctgatgtttatagctttgggatgcttttgatagatatgacaaataagaggaagaacccaaatccccatgcagatgatcattcaagtcaactttactttcctacttggatttataatcaacttgaaaaagagacagatatagaaatggaaggtgtcacagaggaggaaaagaagatgatcattgtttcactttggtgtatacagttgaaaccaagcgatcgcccctcaatgaacaaagtagtggaaatgcttgaaggagatattgaaagcctagaaatacctccaaagccttctctatatccacatgatacaatggaaaatgatcaaagcatctactctagtcaaacaatgtcaacggacttcattagttcttctagttattccaaggaaattgtgactaatcctttggtagaggatgttatttga

SEQ ID NO: 5845 - DNA, 213 bp, Glycine max
  Peptide Sequence Number=SeqID_122623
atggtgaacatgcaccaaaacaccatagaagagcaaggatacttgtactttatgcttaatgacaactcttatgcttcttctgcaccagagacctcagcagaagaagttttatgggatggtctgtggaacatagatcatgttcatggaaattttagtgtagctagtgcagcaagcaaagtcgatctatacaatttagttgctcccttctgttaa

SEQ ID NO: 5846 - DNA, 237 bp, Glycine max
  Peptide Sequence Number=SeqID_122624
atggccaaaccaaactccaaccctaaccattctaatggtgacatgaactattctagaccctacacgactcacgtgaccttttgtctcctctatcatcgacaagttcggcgtgctcataaagacgctttaagaggccaccgattccaagatctgaatctaggacactacatgtccaaaagttctatcatcagcctgatccaagtatttgtctttgacattacctatggtgatggataa

SEQ ID NO: 5847 - DNA, 594 bp, Glycine max
  Peptide Sequence Number=SeqID_122625
atggaaatcaccaccattcaaagaaacaattattcatccatccatgtagaacactttttcaacattcaagaactcaaaaaaacaggtctaaagcttaatgaaaccttactattttgtggtgtcagacagttcttcaatgagccaccaaccatctatcctgaactaataagaactttctggagacatgctaagttcataaacaagaagactattgcctccatggttttaggagtgaaggcagatgtttgcatgagagcagtaccaaccaggaaggctgagagcagaagtatgactctcaagtcactagagcactctacaaagacaatgttgacaaggatgaaaaggttggccaaggccatcattgatgaagacctaggttcaaacaactttggcatttcaagaaaaattcagaagatcatggttgagcaacatcagcaaaagaagaccagaaaactttcacaaagagatgaagaagaagaagagcttttggccaatgagcatagaactaaaagaaggcataagtctactacgcctgcttctgcacgtccaccaatagtgacctcaatcccacataggttgaaagatctaacttag

SEQ ID NO: 5848 - DNA, 384 bp, Glycine max
  Peptide Sequence Number=SeqID_122626
atgaaagtagaagaagaagccttttgcactcctgggcaaaatgaaacaaagaacaaaatccaaggatatcaaagggagacaaacaaaaacattcacatatttctcaatgaacatcaaggaatgaaaggaatggcctttgagaaacaacatttcattcagcatgcttgtagtgagcttcaaaacaaggaaagggaaacaaggctcaaaagggctatcaaaggaattaattcaaggacgcatcaacaagaatcaagccaaggctattgtgcaagcaatcaatggggcaaaacacaccaaatgattataatgatggatggctcaaattctcacaaaggtaaaatcatcactttcaaattgagctttcaaaactatcatgacatgtag

SEQ ID NO: 5849 - DNA, 381 bp, Glycine max
  Peptide Sequence Number=SeqID_122627
atgtggatggactctcaaaaagcatccacttctggctatgatggaagcgacaatgttgtgcactgtgacgttattaaggtgttacgtcctattaggaagtatcactttgatggaacttatgtctgctttaccaaagatgttgacaactactccttcgtacaacatcttctcaagcttccaaccattcagtataaggccacctataacttgaaaaagatcgtccaagctgaagcatctgctaaagctatggatgacaccattatgcgtggggtcatcattgatcttacaaacattggtgttatggacaaaactggtgaagcgtctagtacaactatggctaatgaagttgaaccctatattcaagaccttgcatccaaatag

SEQ ID NO: 5850 - DNA, 297 bp, Glycine max
  Peptide Sequence Number=SeqID_122628
atgagtttgaagataaaaagattgaagaacatcattgtcagtcttaagatgacggtggtggtggagtttgagaaggtggtggtgttatcgaagccaagggtggtggacgacactgaggttggagaactgagttgtaatggcattttgcatagagaggcgaaattgctcattctcttggagttgacgttcgacaaagaacttcatcttcatggcttggacaatcatatcttggactttatcacaagcgacattggtgggttgtgcatagttcagaggagtggggctagagctggttga

SEQ ID NO: 5851 - DNA, 135 bp, Glycine max
  Peptide Sequence Number=SeqID_122629
atgaatgatcttattgtgagagttgtatatcagcagaatgcactggcaggagtaggagcatcaattgatggttcccttggagctgcgtttctgaatttgtccatatgcagaggagatagaggtggaggcaattga

SEQ ID NO: 5852 - DNA, 204 bp, Glycine max
  Peptide Sequence Number=SeqID_122630
atgaacaacaacagaatcaggataggacttactctctatgatccttcctttgatgagcatgctagtggtcatcatcacagtgacattgcttgttcaaaaaggaaaaagttgcttgaaaggctaaagagatgggttgatgcaggcagtgaaaaacctagagttaggcattctatttccaaaggggtagaggaacattgcacctaa

SEQ ID NO: 5853 - DNA, 675 bp, Glycine max
  Peptide Sequence Number=SeqID_122631
atggctaagttcgacccagatgtagtcctagagttttacgccaatgcttggcccaaggaggagggcgtgcgggacatgcgatcatgggtaaggggccagtggattccttttgatgcagatgccctcagccagttcctgggagacccgctagtgttagaggagggccaagagtgcgagtatacaacgtcctgcccagcgatcataactcccgacctccccctgccgaagtgtcagctggtgtatgccatcctgacacggatgagcgtccatgtggctcagttgatcgctgatgccatttatttatttgcagataagtctaacaaggccctgggatttccggcgttgattacgggtctctgccagtcattcagggttcccgtcacacctagcaaggccacagacgcaccgccaccacctcatcaggctgatccagctgggtcatttggcatggagcggtatttacagcacttggttcgccagcaggcggccaaccacagggggcaggtgcagactcacgagtgtctctaccagctcagcctcagtctgcagagccagggtttcgctccttttccgtgccctactctagatcagtttagggctgaggtcgcatggcccggagattggcccgaggaccagacagaggaggcatctgcagaggctcctggcgatccatag

SEQ ID NO: 5854 - DNA, 249 bp, Glycine max
  Peptide Sequence Number=SeqID_122632
atgacaaaggagatcggaagcatgggagaaaaattccgaggaaggcacagcacggcaagttctcaggaacgagaggaaattttagggttcagaaaaatgaggaggtctaagaagcacaaacgtgacacttcagcggcgtgtctcgcgtcggactcacaccgaacacacatgcgagtacgactccggtgcgacgcggtgtccgttgtttccgcagtcaccggacacggttggacaaaaggacacatgtga

SEQ ID NO: 5855 - DNA, 231 bp, Glycine max
  Peptide Sequence Number=SeqID_122633
atggtgcctttcattgccccagtgtggggctttgagggaacctattgggtgagaacttctaatatgcccccaggttcacttaagggaacctattgggtgagaacttctaatctgcccctaggttcactcgaggttcattcacgatgcccctcatggccccagtgtagggctctgaggtatccatctttgtttcacaacctggtagcaaggaagaatgaaagaagcggttga

SEQ ID NO: 5856 - DNA, 942 bp, Glycine max
  Peptide Sequence Number=SeqID_122634
gggctacacatcctcaccttcagagggctacacgccctcactttcggaggactacacgtcttcaccttgagagggctacacacccttgccttcagagggctacacgccctcacctttagaggactgcttgccctcaccttcagaggacttcacgtcctcgccttcagaggactgcacgccctcagctttagaggactacacgtcctcgccttcagagagctacacgccctcaccttcaaaggactacacatcctcaccttcagaggactacacatcctcaccttcagaggactacatatcctcacctttagaggactgcatgttctcaccttcagaggacttcacgtcgtcactttcagaggaatgcatgtcctcgcctttagagggctagacgtcctcacctcaccttcagagggttgcacgccctcgccttcagaagggctgcacgccctaaccttcagaggactacacgtcctcgccatcagagggctgcacgccctcacctttagaggactagacctcctcaccttcagaggactaaacttcctcgccttcagagggctgcacacactcagctttagaggactacacgttctcgccttcagagggctgcacgccctcaccttcagaggagtacacatcctcgccttcagaggagtacacgccctcaccttcagaggactacaagtcctcgccttcagaggactacacgtcctcgccttcagaggtatatacatcctcatctttagaggactacaagtcctcgtgtttagagggctacacgccctcgccttcagaggactacacgtactcaccttcagaggactacacctcctcgcgtttacagggcttcacatcttcacctttggagggctacacaccctcgccatcagagggctacacgtcctcaccttcagagggctacacgacctcactttgtga

SEQ ID NO: 5857 - DNA, 519 bp, Glycine max
  Peptide Sequence Number=SeqID_122635
atggagcttgatagtatggatgaggaaacaacactacttactctcattgaaggtgttcttgctgcaaacatttttgattggggatctcgtgcatgtgtggatctctatcataaaggaactattattgaaatttacagaatgagtcacaacaaaatgcagagaccttggcgagtgaatgattttgatgcctttaaacaaagaatgttaggaattggggacaagaaaccacccccacatagaagagctttactttttgtggacaatgcaggaaaaaaattaatctacgtcggtgcttacgacagtaatgatgtagttggacatgcattcaacggcggtcgttgccgatgcaacgacatacccgaccttaaaagcgtatgtttcaacgtcgttgctgacgtcaacaacgtcttcgaaggcaaagcttcaactacggccatgaagtcatccaagtcacaggaatcgcgtccttctaaaatggtgtttagagaccgtcgtagattggtcggaggtctacaatga

SEQ ID NO: 5858 - DNA, 474 bp, Glycine max
  Peptide Sequence Number=SeqID_122636
atgattcaggccgactgggcaaaagtgggcatcaaagccaacatcgtcagctatgagtggggcgaatacctcaagcgcgttaagggcggtgagcatcaggcagcgctgatgggctggaccaccgccaccggcgatccggataacttcttcgggccattgtacagctgcacctcggcgaacggcggctccaactcgtccaaatggtgctatgcgccgtttgagaaaatcatcaccgaggcgcgcgccgagcaaaatcacgacaagcgcgtggcgttataccgtgaggcgcagcagatgatgcatgaccagatgccggcagtcatgattgcgcactcaacgatttttgagccgctgcagcgtacgctggctcagctgatcgatattgaccgcgcgcatcaccagaccctgctgctgggcctcttccgccagggtaaaactgctgcaaatggtcaccgccagcggcgtgcgcagtag

SEQ ID NO: 5859 - DNA, 176 bp, Glycine max
  Peptide Sequence Number=SeqID_122637
attcacttcctgcatccgaccggcgatacgcgcgactggcagctgtggctgtccgcccaggcggagcagctgccgatggcgcgcaatcagcacttcgccaccatggatttggcgatcagcgcggcgattcagggatttggcgtgacggtggcggatattacgctggtggagaatga

SEQ ID NO: 5860 - DNA, 1116 bp, Glycine max
  Peptide Sequence Number=SeqID_122638
atgaccaaagtgattattgtgtcggcggtagtattcggcttattgattctgctgttcaccgaccgttacctggtgacgatgctggtgaaaccactggatcgcattcgtaaccatttcacggtgattgcgcagggcgatctcagccagccggtggaagaatttggccgcaactgcgtcggcaaactggtgccactgctgcgggcgatgcaggacagcctgcgtgaagcagtcagcgccatccgcagcggcacggagaacatctatcgcggcgcggcagaaatttcagccggcaataacgatctttcatcgcgcaccgaagaacaggcggccgcgctggaacagaccgcggccagcatggagcaactgactgccacggtgaaattcaacgccgacaacgcacgtcaggccagcgcgctggcggagaccgccaccggcaccgcgcagcagggcggccgtctggttggcgaagtggtgaccaccatgcagggcatttccggcagttcgaaaaagattgccgaaatcaccagcgtgatcaacggcatcgctttccagaccaacatcctggcgctcaacgcggcagtcgaagcggcgcgtgccggtgagcaggggcgcggctttgccgtggtggccagcgaagtgcgcaacctggcgcaacgcagcgccggcgccgcaaaagagatcgccacgctgattgaagattcggtgtcacgcgttgaaaagggctcggagctggtcagcagcgctggcagcaccatggatgacattctgaagtcggtgcaggatgtgaatgagatcatgaagcacatcgctgccgcgtcggaagagcagagcaaagggatttcgcaggtcggtaccgccgtcaccgaaatggacagcgtcacccagcagaacgcgtcgctggtggagcaggtgtcggcggcggccagcgcgctggagcgtcagaccgaagagctgcaggcgtcggtggcgaagttccgtctgtccgacagcgcaccgcgcgcgcaggctgtagcatccgccgctgcgcctgcgactgcgctgcgccggccggtgttatctgccgccgcaggcgctcagggtaaacccgccagcagtgtagagtgggtttcattctga

SEQ ID NO: 5861 - DNA, 297 bp, Glycine max
  Peptide Sequence Number=SeqID_122639
atggccgacaaggtaccagcaatgggaacaacagtcctatcggtctttgggtctcatatttcgtgtgttgacagtctacacatgaagcaacgaatctttccacatctttacggataccctgccaataaaaattcttggttagtcgagccaatgttttcgcgacacccacatggccacttgtgggtgtacaatggtattccagtaacagagtgtgcaagaatggattttgatcagggtaatccacaatgctttgtcagagctggatgtagtctgaggattgatccagctgagccttga

SEQ ID NO: 5862 - DNA, 447 bp, Glycine max
  Peptide Sequence Number=SeqID_122640
atgtggaggaaggcccaccatgcgatttgcgatatcttcgaactccgaaagggtgcctgtgggatcctcatactgctaggacgcgaaccaggtttgcaaagcatggaggaaacctgcccaggaagagagctggccgttgctggccatccactggtaccaggccaaggcacggccatccataaccatcgaacctggggacatcaagctttacatggggaggctaagaagaaggggaaggtgagggaacatggtgagaagaggttggggaagagtcaggggatttggatgtggataagaatttgtattttagtgtggacaggtcctaacagaaagggaatattcctagtaatagcagacaagatcaagggttattcccttgatatccaactcagcaatatccaactcagcaggtatcaaccgcaagcatcaacaggcactaacggctag

SEQ ID NO: 5863 - DNA, 969 bp, Glycine max
  Peptide Sequence Number=SeqID_122641
atgcttccaactcatcatacagcgtatacggtggccgtcctcttcatggaccttgtcggaaaactccacagcatgccacgaagcttagtttcagactgcgatcctctgtttctcagcaaattttggcaggaactttttcacttgagtggtaccaagttacggttaagctctgcttatcatcctcaatcagatggtcaaacagaagtcctaaatcgggtaattgaacaataccttcgggccttcgtccataagaagccttcatcatggggcaagctgctgggttgggtggagtggtcttacaatacctcctggaactcaagttcaggtctcaccctttacgaaatcacctttgggaagaagcctttcaacttcccacaatatttgacaggggactctaacattgatgttgttgatgtcatgctcactgatcgcgaggctgttttcacggaaatcaagaagaaattggagaaagcacaaaatcgcatgaagtattttgcagataaaaagcgtcgtgaagctcagttcaaagttggtgatatggttctggtcaaacttcgtccacaccgacaaacttcggtctcggcttacaaattgttgctaccggaagaagctcgtatacatccggttttccactgctccctcttaaagccatattactcaacagagtctgataccagctcacactccaccactttacccgtgctttcaaaggatgatcatcttctgatccaacctttagccatattaaatacccgccaaaataaggactctgaacaagaggtacttgtgcagtggcagggactatcgtcggatgacacgacttgggagaaatgggaccagttgcaggctgagtatcaccttgaggacaaggtgctttcggaagcggcgaggaatgatagcaacacaggagcaagaccaaggaggaagagtagagcaccaacctacctcaaggatttcactagccgttag

SEQ ID NO: 5864 - DNA, 1156 bp, Glycine max
  Peptide Sequence Number=SeqID_122642
atggcaacaagtgtaggaagaattgtggtaaagttagatgatggcttagatgtaagggaagaagcgagctctggtccaggaaccgtggtactggattctatgatgaaaaagtggaaaagcattgagaggttgaaattcttgaaaattatcaagagcatatgggtgtggttgatcaaggtggaggagtactttgctgcaacaggaacacttgaggcagagaggctaccaagggctgtaaagactcttagaagctgtgctttcaactggtggcttcggtggaagttatgcaaccctcaagcaactttgtttgagtttgattggttagacattgattttggtatttctgagggtgttgattttattgctatttcatttgtcaagtctgctgaagttattactcatcttaaaagctatattgctgcacgatctcgtgatagtgatatttctgtcattgcaaagatagaaagtattgactcattgaagaacatagaagagatcattctagcggcagacggagctatggtggcacgaggagacttgggagctcaaatacctttagaacaggttccatctgctcaacaaaggattgttgaaatttgcaggcaattgaataagcctgtcattgttgcctctcagctacttgaatccatgattgagtaccctacacctaccagagctgaagttgcagatgtttctgaagcagtcaggcaacgagctgatgctttgatgctttctggtgaatcagccatgggccagtaccctgagaaggccttaactgttttaaggagtgtcagtttgagaattgagaaatggtggagggaagagaaacgctatgaagctatgttgctcccatcggttgggtcttatttttcagagaagatatctgaagaaatctgcaattcagctgctaagatggccaataatttagaggtggatgcactttttgtgtacacaaagacagggcacatggcatctctattgtcacgctgccgtcctgactgcccaatctttgcttttactaccacttcatctgtgcgtaggcgtctgaatcttcagtggggcttgatacctttccgcttgagcttcacagatgatatggagagcaatctcaacagaaccttttcattgctcaaggccagaaatctgatcaaatcag

SEQ ID NO: 5865 - DNA, 308 bp, Glycine max
  Peptide Sequence Number=SeqID_122643
agcttaatcgtgcctaccctgactcgtttagtcattgcctccaacatgctttagtaccttgcaccgctgcaacacctataggagacctgctacctaacctccaagaagactttcgatataaggaatctccatgtccatggataccatgggccatgaacaatcatataagtgaaccagacaccacacttaacccaaaaccttatggctctaataccaattgttatgcaatcgagggggataaacactggggagatttacaccaatgggtcatgagcaaccatattagtgaacctaacatcacaccttaa

SEQ ID NO: 5866 - DNA, 192 bp, Glycine max
  Peptide Sequence Number=SeqID_122644
atgggtgaaatgggaaggagaggggtggtaaggctaggaattaggatgcaggaaacgcagcttgcgcaggattccatcctgggatctagagcttacagattaaattccttagtctttgatgaaaatatatgggaggaagagttggaacaacttgaaaagacggagaaagcatctacaacgtgcaaagtgtaa

SEQ ID NO: 5867 - DNA, 249 bp, Glycine max
  Peptide Sequence Number=SeqID_122645
atggcgtttttcctaagctacttggactacaaggctcaaaacgcacaagtgagcaatgctctcggaaacggaaatttcacgcacactccagacatcttctccaagatcgcaacgctgcaaaccaaatttcgagaagatccagcggttaacaaaggctgggcagcatttttaccgagacagcttcatgtagcttccttgagaagcttcattaagaggcttcctcaagaagcttcctcgtggcttctttga

SEQ ID NO: 5868 - DNA, 1509 bp, Glycine max
  Peptide Sequence Number=SeqID_122646
atggggaagaaaagaggtacaaattatcagaagaaagataccaaaagctctaaaagtaaaacaagttctcgtcatgctacttattccagtgacgacatggacgacgaaattgatgcctttcataagcagagggacattgtcccccttgacattaatgatgatgctgaagaatcggaagacgaggagctccctatttttgatgttcaggatgttgatgaagatgaggatgaggatgaggatgacgaagatgatgatgatgatgatggggatgacgatgtggcgaagatgattaggcaaaggaaatatttacgggcaaagtttggtggaggagatgatgaaatgcatgatgttgatgatgaggaagatgaggaagattataaacttacattaggtgggaaaaaattctcacacggtgctgagaatcgaaattttgagatacaatcaagtgatgatgaggccccaaaagaagaggaagaattggcattacaaatacaaagggagaaggcaaaatccttaacaatggaagactatgaccttgtggatataagtgaagacaaagataacgaaaaattaactttgaaggatgtgtctgataaaggaaacgaagcaataaaatcactggatagagatataattttcactgttgatgaactgaatgctttgtcaaaggaggagcaaatgaatgctttatacaggtctgctccagaattagttgattggttgtcagaactaaatgaggtgcacagacaactcgaatgtgaaattaacccatttttaagcaaggttgttcctcttgtggtttttcttttttccctgatccatggtcatgcaaaccatgttaaaaagggggaaatagttatgaaaggagaagtgcgttattttgagttgaagcagcttatttttctgtcctattgccaagcaataacgttcttccttctcctcaagtctgaagggcagccagtccatgatcatcccataatagctcgccttgaagagatcaagaaattattggatcagataaaacaacttgacacaaaacttccatttgaacttgaggacattcttaaagaaaataatgggttagaaacagtactaaattcagatattgagaacgctccaacgacaaatgattctatcgttaaaaaccaagagcagcctcttgtctctgccaaatcaacagaagaaacagtggtgcctaacaagcaagttgagatacaagaattggaatcctcaaaggatggtgtacagaaaacaagaaaagttaaacctcagaaggatcacattggcgcacagagtttggaaatgctaaaagttagagcttccctcgaggaaaaactgaaaaacaagggtctgtacagctccattgctccaaagcctagtaatgcattaaagcgtttgagaccagttaatgggtatagcttcactcttctatcctttacactacttgtttcaagcatgttggaacttattagccacttacaaatttcacagccagctcgaaacatatga

SEQ ID NO: 5869 - DNA, 924 bp, Glycine max
  Peptide Sequence Number=SeqID_122647
atggtgacagcatgcgcaaatttgggtggtgcgaggtgtgtgcgcgaatctgggtggtgttgggtggcggcacatgtggaggaaatatgtgagagcgggtcaaacgggggtagtggtgatggtttagggaggaggagggagagaggaagaggggcaaaaaagggcacccggttccgacacaggaacagcacaaggttcgtttctcttccatttctctcgcggtctctcttcttccatgccgtgacttgcttcaacgtctatgctgtgactgtcactgctatagcaacaaacctcacacaaatggcgtgttgctataagtaccataacctatttctccactctcatttcttgttgagaaagcttccgttcccgagccacgtctacgccacgagtttctctcgcaatcttcgaaccccgtggctgcttcgttcttcgcgcgcgccactctctaagggctattgtagtgctacttcagaatcgccgggagctgttcccgcgactccgccaaccgccgcggcgacgttggttcccggcgccggaatcggaaccgctcgggcgatgcagttaggttctgctgtcaatgcggaacgcgtgacgaacagcgatcctttgaacggcagagtgatgatcattgacggccagaattttcggcacaatctataccctgcatacaagagcaaccgtcctccaactcctgataccattgttcagggacttcaatacttcaaagcatccatcaaggctatgtccataaaaatcatcgaggcaagtgtagaggcagatgatgtgattggaacattagccttaaggagtgttgatgctgggtacaagcccaatctgtattctgttcccaatgcaattgcccccataactggtaatgtgcctccatccctggtcctaggtgtgagagtggagatcccatga

SEQ ID NO: 5870 - DNA, 1326 bp, Glycine max
  Peptide Sequence Number=SeqID_122648
atggcatcaaatagccattcaccatctctcgagatattaggaccagaggatttctcgctctggaccggaccccccttcgcgaacgatcaaccaagcgtcaagctcgagaaagtgaactgcatcaatgcgaagttcagcgacgacggatccaatctcatggtgacgaaatcgaactcgctgattagcgtgtacgattgcagcactgccaaggagattagggtttttgaagtgcccaatgtcgttgctgcggccttgtcacccaaaggaacttacttgcaaaccttccagaagccttcggggccgcaggagaagaatgtaacgctgtggagcatcgagaccggtgctgcggtttaccagcagtcgcagaagaacatgacgaaagccaattggcctgcgattcagtttagttctgatgaagctactggagttgctgctgctgagctttctagtttaccgggatctcatgtagctgcatttgttccagaatccaaggggattcctgctagtgtacagatatttgcttgtggaaatgcgtctcaaagtcaacctgttgctcgacgtagttttttccgatgttcaaccacccaacttaaatggaatcatggctcaactgggcttctagtggtggtgcagtcagacgttgacaaaactaatcagagttactatggagaatcaaaattatgctatctgaccacagatgggatgcatgaaggacttgtgcctcttcttatgcctgctaaagcaactctgtttgacaagaagtgcaatcctctactagagcttggaactggtccttacaacactattcgctggaacccaaaagggaaatataagaaacaacttggagccactaaggctgaatggtctgtgactagtgaatggtctccggatgggtgttatttcatgacagctacaacagctccaaggcttcaagttgacaatgggatcaagatttttcactacaatgggtcattatacttcaaaaagatgtttgataaattgtaccaggctgattggaaaccagagtcacccagtaagtttggtgatattgctgaattaattaagtctctaaatttggtacaacttgaagataagaaaccatcaggaccaccaaagtcaacccagacttctacaaaagcctcctctaccaaccccccaacacaaaaacctgctgcatatcgtcctccacatgctaagaatgcatctgctattcaggcagagttcttcgtgatggaatcaatgttcttcctaatgcattctaaattgcttttcgactactgcactcgtgcacctgaaaatttgaggcttcaggttttgctttactag

SEQ ID NO: 5871 - DNA, 735 bp, Glycine max
  Peptide Sequence Number=SeqID_122649
atggtgaacgacttcattgtctgcattgaccggatcatagcctccacgacctgttttggatcagtgaatgaaaaacactgtgatggtgttgacccagttataatccccgtctctgacaatggtggaaaagtgtgctcctcttcttcttcttcttcatcttcaaacaaggatgatgatgttgttgttgttgttgagtgcagaatatgccaggaagaagaccaagcacaagccatggaggcaccttgttcttgcaatggcactctcaaggaagaggaagagggttgggagttcagtgaagtttttgtgattccttgtggatactggtctggtgtagtggttttgagttttgacttcaagttggcttatgaacttgtttgctcactatttcttggcatgcagtttgctcatagaaagcaagaatgggggcacaatgctgatctccgtgtggctctagcttcagcagagcagcagttgctgcaaactgaatatgaagattatgccatgtcacaaaccagtagcattgctttccttcgctctgtgactctcattatgctgatgattttgcttgtacgtgaagctttaatggtcacaaagaactctgtaactgggcaagatgcatcgataatctttaattttgaggtgtcactccttcaatttgctggtgttcttttgccatgctttgcaatggcacgttcctggtatgccatacagaaccgtaggagaagacagggctga

SEQ ID NO: 5872 - DNA, 369 bp, Glycine max
  Peptide Sequence Number=SeqID_122650
atgagtctggtactaattaactatgctgagagacctcttcgtgagtcagcaagtaaagaaaaagatgaagtagatattgttataccagaaggtacaaacccggaagtttacactgaagagcaggataagcttctgggagactgtgagagtacttgggaattgtatgtagatggatatgatgaagatgggaaccgtatatatgatccaatcaaaggagaggcatgtcatcaatgcagatatggagaaaatgtggtagaagtccaccataacacaaaatggacttgcctccttgtcgggatatttgccactacagtccttgccgcaggggaaaaggttggatgtctactggcaaaatatacagtaggttag

SEQ ID NO: 5873 - DNA, 645 bp, Glycine max
  Peptide Sequence Number=SeqID_122651
atggccgtggaggtggccgcaactcgtggtggctgcggtggtggtcacggctatggtgatggccgtgggggtcatggtggtcagttctctaacatacagtgtcaaatctgtcataaatatggacatgaggcttcctaccgttattacaggcatgatgataactatgtccctactcgaccaatgaactgtccaaaccagaatcagtactccaactcaaaccaaaatcccaatcaacagtgcaacagaccacaccctttgaaggaccagatcaaattattattgttttgcctggtcaaatctcaggtctctaaagaggtcctgcttcaagtgttggttcgtgctgatggccttaaccaattccttaatcttcttcagtcatctagactgccactcaaatctcatatcactgtcaataccaattcatctgatgtttcagaacctgtcttcagagcatcttcaaattctgttttgaattctgtaaaaggaatcaatgatgcttctgttgtaaatacagtttctagtggttctacatcttttgccacttggcattctagattaggacatccttctgttgatactatgaaacttgtattcaaactttgtaatctgcccattatcaataaaacaggttctgacttttgttaa

SEQ ID NO: 5874 - DNA, 1551 bp, Glycine max
  Peptide Sequence Number=SeqID_122652
atgggcagtgatcagtcaactaatgtagcaagtcaccatcatggtcattctgttgccagtgagggtggacacaacaatctcacagcctctaataagcatccatctttaaatcaaggaactggtatgatattggctaaaacgagtgatcagggagggacattgttacaagatagcattctccatcaagattcttcacaagtcaggcctgctgattgggcacgaatgttggaggttgtaaatcagaggagaactgaaattcttatgcctgagaatcttgagaacatgtggacaaagggaaggaattacaaaaggaaagagaacaaaattatcaaaactggctctcaggatcttcctgcaaagagtccatctacagacagttcactgcctcatagaaaattggctcaggaaacatcagcaagtaaatgtggaaagtatgaagttgcagaggggaagtcttctctgccaccattgcctgtcatgggttcagctcccctgcaaaatgttggagatgcaaaaagtttagaatcttctaaaaaccctgacaaggaattatctattgtgggagatcttgcttctgatggttataaaagcccgctgaagaggtcgagtagtgcttcttccttaggaatcctatctaataaagaagactccataatttcagaatttttcaacccggaatttgagaggcacagtgaaggatttcggggaaagagttcttctgatatgattgttaggaaagaagggccattagttcctaagctccggaattttgagcggttgcatcggcatcttaaagatattcccaattacacattgcatttgcctcctaaaaggatattttcctcaagcacagatgatgcctttgtacatcaacgttgcattcaacttgataaatatctccaggatctcctgtcaatagctaatgtagccgaacaacatgaagtatgggatttcttcagtgtttcctcaaagaactactcatttgggaaatctccttcggtgatgaagaccttggcagtcaatgtagatgatgctatggatgatattgtacgccagtttaaaggggtttcagatggtttaaggcgaaaagttgttggttcatcatccctcatcaatgagggatctgctacatctaataccacatggaatttgtcctggaatgcagatgaaattgacaaaagcattccgaggcaaagtactgcagaaagtgtgtttagctctgataatgaggaaggtgaaaagaacaattttgaccgtgacaatattgatagagcagtagcacaagatagtgggttgcattctgacaatgcattgatctcaaagggcaactcatcacgaataaacaattgtgatgaagagtccagcaacttggaatttgatagaaagcatgatatggtggttgaagctagggttggcaatgatattcctgctacaaatttcattctggttcatggtaatttggaggatccagttggagtgccacctgaggtcattgttttaggtactaagatgctggctagaatactgcccacttggtcaagctgggaatag

SEQ ID NO: 5875 - DNA, 816 bp, Glycine max
  Peptide Sequence Number=SeqID_122653
atggagagtgtgaatgatctgatccaagaggccaagctccgcactctctggtgggccctctgtatattcgtcgtttcctatttcctaactcatactagtaaatcaatgtggatgaatgtacccatgtcgatcctatttgttgtggggctgcgcattcttttcaatagggtggagttccgttggaaggttccacagcctagactgcagacctatctatctcatttggagaaaaagcagttgtctctgaatgatccacgcctcactagtttgcctccccctgcgaaatggaagaggaaaattgattctcctgctgtggaggctgcaatgagtgatttcattgataagattttgaaggattttgtggttgatttgtggtactcagagattactccagataaggagtttccagaacagatacgggcaataatcatggatgttctagctgaaatatcaggaagggttaaagagataaacctggttgacttgctgacaagggatttagtagatttaataggtgttcacatagaacttttcagaagaaatcaagctactattggtgttgatgttatgaaaacattatcttctgaggagcgggatgacagattaaaattccatctgttgaattctaaggagcttcatccagcactaatatctcctgagagttcttcagcggctaatgagtgctgttttagctacagtactaagacaacgagaagctcagtgtcctgtgattcgttctatatctcgggaattattaacttgcttggtaatgcaacctattatgaatttggcaagccctggggcttacttagttaa

SEQ ID NO: 5876 - DNA, 2214 bp, Glycine max
  Peptide Sequence Number=SeqID_122654
atgggtattaggcaaatggcaaaggattacaattttcctcaatggcttagaggaatgagggcactaggaaggggaaatgagaagagaaatgggacggagtttataatggagacacttgcacctggaataccatgtttcgttttccacttctgcacaatgtctctgtttctccggctctgctttgtgggcacctggaagcgcaaccgttggaaacggaatgaaagattccgacttttcacgacccatttgcaaactacggagccccatgtcggtaacgtgatctccaccaacatttccatcgcccaacgcttcaaaatgggtaaactcgaagaagcccgccacctgttcgatcaaatgccgaaccgaacagtttcctcctggaacaccatgatttccggatactccctattggggaggtaccctgaggcattgacccttgtttccttcatgcaccgctcttgtgttgcgctcaatgaggtttctttctctgcggtgttgagcgcgtgtgcgcgctcagggtccttccttcttggaaagcaagttcattccctgcttttgaaatctggctatgagaggtttggcctcgtggggagtgctttgttgtatttttgtgtgcattgctgtggaatcagagaagctgaggtggtttttgaggagctgcgtgatgggaaccaagtgttgtggagtttgatgcttgcaggttatgtgaagcaagacatgatggatgatgctatggacatgtttgagaaaatgccggtccgggatgttgtggcttggactacgttgatctcggggtatgctaaaagggaagatgggtgtgagagggctttggatttgtttgggtgcatgaggaggagttctgaggtgttgcctaatgagttcactttggattgtgttgtgagggtttgtgctagacttggggttctgcgtgcagggaaggttgttcacgggctttgcattaagggtgggcttgattttgataactcaattggcggtgcggttactgagttttattgtggttgtgaagccatagatgatgccaagagagtttatgagagcatgggaggacaagccagtttgaatgttgccaactcactgattgggggccttgtctcaaaaggaaggattgaagaagccgagcttgtcttttatgaattgagagagacaaatcctgtttcatataatttgatgattaaaggttatgccatgagtggtcagtttgaaaaatcaaaaaggttatttgagaaaatgagtcccgagaatttaacttcattaaataccatgatttctgtgtattccaaaaatggtgaacttgatgaagctgtgaagctttttgacaaaaccaagggtgaaagaaactatgtctcatggaactcaatgatgtcgggttatattattaatggtaagtacaaggaggccctgaatttatatgtggctatgcgcagattgtcagttgactatagcagatcaacattctctgtcctatttcgtgcttgctcttgtctttgttcttttcgacaaggacagttactccatgctcacttaatcaaaacgccattccaagtaaatgtttatgttgggactgctcttgtagacttctattccaaatgtggtcacttggccgaagctcaaaggtcatttattagcattttttcgcccaatgtagcagcatggacagctcttataaatgggtatgcgtatcatggactgggatctgaggcaattttactctttcgctcaatgttacatcaaggcattgttccgaatgcagctacttttgttggtgttctctctgcctgtaaccacgccggtctagtttgtgaaggccatctaaaagaagctgaagagtttatcataaaaatgcctattgaagcagatgggataatatggggagctttgcttaatgcttcttggttctggaaggacatggaagtgggggagagagctgctgagaagttgttcagcttggatcccaatccaatttttgcttttgttgttctgtccaacatgtatgccatactaggtagatgggggcagaagacaaaacttaggaagagattgcagagtttggaattaagaaaagatccagggaatctaggctcaaacgacactgcaagcgacagagagctgaccacggatgggctaggtggtattgtttctaagcccaaatgttccacaaagaagcctcaaggatgggatgattacatacattag

SEQ ID NO: 5877 - DNA, 588 bp, Glycine max
  Peptide Sequence Number=SeqID_122655
atgatcaacaatcttaaaaggacttattggctgatcacatggaggagaatgagccttaggtgtgagaagttgaaggcaaacattgtaactaatgtgagcaaatgggtggtaaaaatgatgaatgtcatgttaattagttcctttgcacctagcaacctttggggagaagccgtgttaatcacctatttcttacaaaataggattccctacaagaaaactggcaaaacaccttatgagttatggaaagaacataatgtgtttcctttgaaatctaggcaacctacaggaaccgatagtgatagcttcaggatcaagccagaacaatccttagaaaaccataatgagttcatggctgaggacctaagaagaagtaaaagacaaaggaaagaaacatcctttggagatgatttttatatttaccatgttgaggatgaccctctaagtttcacaaaagccattagttcttctggtgcactctcttgggaacaagcgattaagatagaaattgactttactaagaagaataacacatggaccttagtagacctaccccaaggagtgagacttgtaacaccctgtttttcgtaa

SEQ ID NO: 5878 - DNA, 708 bp, Glycine max
  Peptide Sequence Number=SeqID_122656
atgtatatcgagataggtgtcacaaaaccaataaggtgtaagtggatctttaagaagtacaaccctaatggatttatcgataagtataaagctagattagtagctaaagggtttactcagaaacaaaatgtggattactttgactcctttgtccctatgactaggatttcctctattcaagtgttgatagctttagcttccaaacataagttggtggttcaccagatggatgtaaagactgattttttgaatgatgatcaggaagagatctatatgactcaacctaaagggtgtgttatacttggtcaagagaacaaagtatgcaaactcttaaaacccctatatggacttaaacaggcacgtaaacaatggcatgataaattcaaccgtgctttgcttgatgatgtccttaggactaaagcctttctttcttctaagtttgacatgaaagatagaggagaagcaagtgttatcttaggagttagaattataaggaagggtgatagtatcaaactatcccaaggacattatgttgagaaatttcttaagaggtttggttaccatgaccttaacccaatgagacaaaatccactggtggttatgtgttcacacttggcggtggtgcagttgtatggagatcaacaaacaatccataattgcaagattaacaatggaatcagagtttgtagctttggagttagttggtaa

SEQ ID NO: 5879 - DNA, 180 bp, Glycine max
  Peptide Sequence Number=SeqID_122657
atggtgtttttcatcttaaatagtctaagtgtgaatttggccaaggccgaattgagtatctcagccatattgtctcagttgttggagtcgagcttgtctcaaccaaaattcaggttttcatcgcaagttcatcagggattactcttgcattacaacatcattgacaactctactttgtga

SEQ ID NO: 5880 - DNA, 324 bp, Glycine max
  Peptide Sequence Number=SeqID_122658
atgaattcatatctcacagagttcaagagcctcgcaaaccatatcatcgaccttctccatacttttctcctcagttgtttcatctcagggagttggcatctcgacgggagaagggcttatgttacaattgcgacaaccagtagagaccccaacatagatgtccaacccacaatgcctctttctgttacggtgggagatgggaatgagttttcttgttccagtgtttgcaagaatgttccagtggtgatccaatctcaaattttccatgttgatttgtttgccatgtccattgttggtgcaaatcttatttttggtgtggaatga

SEQ ID NO: 5881 - DNA, 486 bp, Glycine max
  Peptide Sequence Number=SeqID_122659
atgtcttcaggcattgcatgctttcaaaaggtgacaatgtcttcatatacatttcgaagacgacaatgtcttcttctcaaaaaacttcaatgtcttttgtccttgtgcttcataggatacgacgccctaagtttctatgcttttaaagaaaatgaaatgaaaaaaaagaagaagaagaacttcagtgtcttcatgctttcacgggttttactgcttggacttccgctagtggccggttggatgggttttgcgacgtttcaaaaggaaatgtgcaaaatattcaaaagaggggcaaaatggtcattttggggacattttctagcccctgggcccattagaaaacttaaaggtgaagtaaccagctcacctgggcgagcaagttacttcagaattaagtcatcagctcgcctgggtgagctatcttcatcccaaatgcctcattttgctataaataggcgtggggggctgaaggaaaagggtccctga

SEQ ID NO: 5882 - DNA, 381 bp, Glycine max
  Peptide Sequence Number=SeqID_122660
atgggagaggtcgacccagctttcatccaatacctacaacacaggccaaagttctctaccatccaacctgaagacattcctgtgatagatatctccccaataaccaaccacacagcttcagatccatgttctattggaggcttagtgaaggagataagaaatgcaagcaaggagtggggtttcttccaattatcaaaccatgctgtgcccctcactctaaggcaaaacattgagaaagcctcaagattgttctttacacagaatttggaggagaagaggaaggttagtaaagatgagaacaataccaccggttaccatgacagagagcaccccaagaacattagggactggaaagaagtgtttgatttcctagccaaataa

SEQ ID NO: 5883 - DNA, 300 bp, Glycine max
  Peptide Sequence Number=SeqID_122661
atggaaaagctgtgctttaagctgttggagcttatagctttaagcttaggtgttgaagcaaagaggtttgaagaacttttcatcaaagatcaaactagttctattctactcaactgctatcctccatgcccttaccctcaccttgctcatggcgtttggagcaatgatgcatatgagagtgtggaacacagagtggtggtcaactctgagaaagaaaggttctccattccattcttctacctttcgcatgaaactgaggtcaagcctttggagaagctgataaatgagcaaaacccttga

SEQ ID NO: 5884 - DNA, 147 bp, Glycine max
  Peptide Sequence Number=SeqID_122662
atggggcatgctacattgcccccactctcttgctattcatgcctaaacatgtgcccaccaaatgctccgtggaatgcctcaatgacatatgagcatggtttgggacagcgtgaaggatttaaaatgagtgcccgaatgcaattctag

SEQ ID NO: 5885 - DNA, 409 bp, Glycine max
  Peptide Sequence Number=SeqID_122663
atggatacctcaaagccctacactggggcaatgaggggcaccatgcataaacctcaagtgaagctaggggcagataagaaattctcacccaataggttcccagctacaagtacctatcgccttcagagggccgcacgccctcgacttcagaggactacatgtcctcgacttcagaggactgcatgttctcgccttcagagggctacacatcctttagaaggctgcatgtcctcgccttcagagagctgcacgccctcgccttcagaggactacacatcctcgccttcagaggactacatgtcctcgccttcagaggactgctcatcctcgccttcagagaactgcacgtccttgccctcacacgtgtcgcaacgtacccttcgcgggcgagcgagggcgaggctcacgg

SEQ ID NO: 5886 - DNA, 108 bp, Glycine max
  Peptide Sequence Number=SeqID_122664
atggaaaagtgcaaagaagcatcaacaccaatggcaacatccacttatcttgacttagataaaaagcttctttctccttgcaatgcgttagatgccggagtgcgatga

SEQ ID NO: 5887 - DNA, 108 bp, Glycine max
  Peptide Sequence Number=SeqID_122665
atgacgaacgcaaagatcgaacctggcaccgctgtttacaagaagaatcggagtttgtgggagaaaggaattaataaacaaaacattgaggcttccttcctcgtatga

SEQ ID NO: 5888 - DNA, 855 bp, Glycine max
  Peptide Sequence Number=SeqID_122666
atggcctacttaatgctaagtggtgctgaaagtacaaagctcattagtggtagtggcatagctccatctgggtttggctcggttggtcttaactttcataagagtcctgcttctcaacctggattcaacaaggaggcattttggttctacaagtttttggctactactgtgtatgatcatgtcataaacccttggcattggactgaagacatgagagataatgccttggagcatgctgatgtctatgaccgtaaagtgagaatggtggatgttgagggaggagctgcattcaccactcttggaatagtgaagcatgtggatgctaagaatgttacaattcttgaccagtcccctcaccatctagccaagaccaagcaaaaggaacccttgaaagaatgcaagataattgagggtgatgcagaaaatcttccatttccaactgattatgccgatcatatatttctgctggaaggtagcatgtgtattgaatactggcctgacccacagcgtggcattaaggaagcatacagagtgctgaaaataagaggcaaagcatgtatcataggtcctgctgatttcagaaatatcaagttgaaaaggataggtccaaaatggtatcgtggcgtaacacgacatggcctcaacatgggttgttctgtgactggaatcaaacctttgtctggggactctcccctcaagcttggtcctaagacagaggatgtaaagaagccagtaattcccttgttgcttctctcgcggttcattcttggtacaattgcagctacttactatgtactagtttcagtttacatgtggatcaaggacaaaattattccaaagggcatacccatctaa

SEQ ID NO: 5889 - DNA, 900 bp, Glycine max
  Peptide Sequence Number=SeqID_122667
atggttaaggaaggtgaagagcttgctgcactacatccgagaattgttgtaaaagtacccatgactcaagatgggattaaagccatccgctatttttctgaaaagggaataaagaccaactgtacgcttgtattctcttccggacaggcattgctggctgccaaggcaggagccacctatgtttctccgtttctgggaagactggatgatgtctctacggacggccttcatctgatatcggaaatccgggagatttatgacaattatgcttttcagacacagatccttgctgcttcagtccgacacagcatgcatattatcaattgtgcaaagattggtgctgatgtggaacagttaatcaacccaaccatacaaaagtttaggaccgaattcaaagcagagcctgaacacatcttcctttctcccgggagaattaatattatcggtgagcatgtagactatagcgacggttttgtattacctgctgccatagataaatacatttgttttgccgtccgcaagctgccacagtctaatttttgtaccatcatagccaaagacctcggagaagaatatacatttgatgtcacaatagaggtaaaacctgtaccgcaaatgtggatgaattatattctgggcgttttcagccagttgcagaagtcggaaaaccagttttgcggaatggaaattgtcttcagtagtaccattccaatgggatccggactttcttcttcggcagcccttgaatgtggctttgcctatatcctcaatgaactttttgaccttcatctcaccaagaaagaaatcgcggtgatcgggcaaaaatcagaacatacttttgcaggagttcagtgcggaattatggatcagtttgcctccgttttcggaaaggaaaataag

SEQ ID NO: 5890 - DNA, 270 bp, Glycine max
  Peptide Sequence Number=SeqID_122668
atggagtatggggaggtgtgtagagtctgcgttctcatcaatatccaatttccacacaccacccacccaaagaccacgctagctggttgctttgcttgcaccagaagactgactcagacactaataaagcttgtcctcggtaagaaacagactcatccgatgagtcagatgacagtgtcaacgcggttgaggaatgaaaatgaaaagaaacacgcatacatacgcgttgtttgtgttgtaccaaagaaaaatgggatgtacaacgtgtga

SEQ ID NO: 5891 - DNA, 1416 bp, Glycine max
  Peptide Sequence Number=SeqID_122669
atggccctcgagacgctcctcgtgaaggtcaaaaccgccatatcaaacagcatcgactcggttccgccgaagctcctgaagaagaaaccttctttcaaagcgaagcagaacgtcggcgttctggcattcgagatcggcggcgtgatgtcgaagctcctccacctctggcactcgctctccgacgccaccatcgtgcgcgtccaaaacgatgccttgaacctcgagggcgtgcggaagatcatctccaacgacgagtcgttcctcctcggactcgcctgcgccgagttcgccgagtcgctccgagtcgcggccaactcggtgacgcggctcagcgcgcgctgcgaggaccccgccctgcgctccttccactgggccttcctcgagttcgcggactcgggccgcgacccgaacatgtgggccctctccggcccaaaagataccgattcgaagctcaagaaaatggagcgttacgtgaccctcacggcaacactctaccgcgaaatggaggagctcacggttctggaaaactccttcagaaaagccctgaatcacgctgacggcaacagcaaagatcagcagaaactctacgagcttcagcagaagatcttttggcagaagcaagaggtgaaggatctaaaagaaagatctttatggagcagaagtttcgacagtgttgttgtactcctcgtgaggttcagcttcaccgttttagcaaggattaaggttgtcttcggaatcggtcgccacataccttgtctatcttgtactttgtcggcttccgccactgtttatccatctgaccaaaaccctaatgggtttgtttatgagtcattggaagaagaagaagatttgaagcttgaagaagaagaggcgaatgggttttttgcggcaaactcgaagcttttgaggccacccgagagcacgttgggggcttcgggtttggctttgcattatgcgaatctgatcatagtgatggagaagatgataaagtcaccgcacttggttggtgtggatgcgagggatgatttgtatgggatgttgccgaggagcataaggtggggtttgaggggaagattgagaggggtggggttttgtgcaagtgatcctgttttggctggtgaatggagagatgcgttagggagaatattggggtggttgtcacctttggcacataacatgatcaagtggcaaagtgagagaagctttgagcaacacaatttggtgcccaagactaatgtgttgctgttgcagactttgttctttgctaacaaggacaagactgaggctgccatcactgaactgcttgtggggttgaactatatttggaggtttgagagagaaatgactgctaaggctctgtttgaatgcgccaattctaatgggttattgttaaagttgaacaaacccagtcaatga

SEQ ID NO: 5892 - DNA, 201 bp, Glycine max
  Peptide Sequence Number=SeqID_122670
atgtcgctgcatgttctttatctttatgtgttttctgggtatcccccagggattccccgtctactatatctctcgttacaatctttcaaagaagtaaacgtgggggctggatcatctcgagctaccttttggggtagagacaaagttaaagcagcagaaaaccaatcaaggtacttaggaacggacgcaaatggaggatag

SEQ ID NO: 5893 - DNA, 561 bp, Glycine max
  Peptide Sequence Number=SeqID_122671
atgtgtgtacagataacccttgggtgtctccgcatgctacctgactcctcaaaggtcaaggcagcagaattgtgtgtacagataaccattgggtatgtctgcctgccacctgacctgtggatgttgtgtttgtatggacaaccgctgggtatgtctgcctgccacctgacccatgggtcaggatcatcagatgttgtgtttgtatggacaaccgatgggtatgtccgcctaccacctgacccgtggatgacaacattggcctctgcttgtcaatcgaacttggggtctctgaatgacgagataaccattgggtgtctccacatgccatcggactcatgggtcacaatagcaaaaggtggggtggtcgacaaaagtggggcttttgctcttacttatcctcaatttgtgatgaggaactcaaacctacgtagttcttgcgaaatgggatggaaattctcatccttgttcaaggtttatggtggtttaaggtcttggctcaaaaggcttgcagaacggccagacatgatgtatgtcagggtgttggtttggccagtggtttag

SEQ ID NO: 5894 - DNA, 417 bp, Glycine max
  Peptide Sequence Number=SeqID_122672
cgaccacgactccaatttccccctgccaaagtgtcagctggtttatgccatcatgacatagggatcgtgcccacaagacacccagtggacccgaagaagtccaacaaggtcctggggtttccagctctgattacgggcctctgtcagttctatggagtgcccgtcgccaccagcaaggtcatcaggccctctattaatagggctttcatcgaaaagtacagtgcccccaggcgggcgcagggcgaggtaccacagcagcttagggacggccaacagcaagcaacagatgcaccgccaccacctctagggtccacctcagctcatctacaaaggttggagtgttgcccacgacccatggctgaccggcaggcgaccaagtccaaagccaaatgtagcaaaagtaccttgaatgtttag

SEQ ID NO: 5895 - DNA, 1821 bp, Glycine max
  Peptide Sequence Number=SeqID_122673
atggcttggacaaccctcaaaggttctcccagaatgtcttctcatccaaggcctctttcttggattgtgattatggtgggagcactggcatttttcttaatttatgcttcctgggttcttgtatcatccccaattggtgccacggttcagggatatttttatagtgtaggtagttcagagaagctagatttgcctgtgtcttcagtgaatgaagcttctattaatgatggtcactcgaatacgagtttagatcttgttgataaaaacccttcctctgaggatctgcaatcttccacaatttccactgaggtgcctagcgatagtaagacagaacaaactgataccactttaaactcacaagtggacttgagtgactctacttcagtgaaccttacaatgaccaaggaagtgaataataacgccacagatgtagccaatagtagcttgcctactcaagaaaattcacaagttgatttgaattcaaaaacaactacgtcattggtaggtatcaattcttctaatgagacagataatattagaatggaggaacccacttcagtggcttcgatcaatccgtccagtgctgtaagtacagcaccaaatgagacctctatctcttccggtgattccacttcaactgctgttccagcatcagtagagaagccaaataacacaccctctgctggctgtgatctgtaccgtggaaattggatacatgatccattgggaccgttatacacaaacaattcgtgccctgtattgacacagatgcagaattgccagggtaatgggaggcctgataaggattatgaaaattggcgatggaagccctttcaatgtgacctcccacgatttgatcccaaaaagttcttggagctgatgagagggaagaccttggctttcattggagattcagtagcccgaaaccagatggaatcaatgctatgtcaagaattgtcttcttgtggccttggtgctgcagctgcaactgcaccatgccatgttcatgatcaaatggtagagacaccaaagaatcggggaaatcgtaacatgcaacgatattattttaggtccacttctgttatgattgtcaggatatggtcctcgtggcttgtcaaactaacatccgaaccatttgactatgctcccggcggtgtggataagctccatcttgatgcccctgatgagaagttgatggaacacatcccaaactttgatgtggttgttctttcttctggtcattggtttgccaagcagtctgtgtatattttgaacaatgagatagtgggaggacagttgtggtggcctgacaagtctcgaaagatgaagattgacagtgttaaagcatatggcatatctgttgaaacatttctaactgctattgctacaattccaaattacaaagggcttacaatagtgcgatcctactcacctgaccattatgagggtggagcatggaacacaggtggatcgtgcactgggaaggctaagcctcttgcacctggtgaactggtggaaaatgtgcacacgaatataatgcatgagcaacaggtgacgggctttaaccgtgcagtggaaagggcaacaaatggatcaaagttgaggctaatggatatcactgaagcctttcaatacaggcatgatggtcaccctggtccttacaggagtcctgatcccaataagattacgaaacgtggacctgatggaaggccaccaccacaggattgcttgcactggtgcatgccaggccccgttgatacatggaatgaacttgtgtttgaaatcattaggagagaatatgaaggtggaagtgcatcatga

SEQ ID NO: 5896 - DNA, 351 bp, Glycine max
  Peptide Sequence Number=SeqID_122674
atggtgaacgacattttcacactatctaggtacaaggaaaacatggtgcagcccaaaccaagtgttggccttaaggggaaacctcaccaacatgctctcactcatcatgccttcttgtatttcaacaaacaaaggcttgggccccctaggcctaagtcatgttttggcatttatcctaattctcgcaagctatccgcatccaaaaatggcaaaaataccattgaggcatttcaccgagcacttggtgggtgcacttttgggtaccaacaacaagggaatgggggcaacgtggcttgccccatcatctcagaacacaacataggcctaaggccatcccctacaaccccttaa

SEQ ID NO: 5897 - DNA, 1413 bp, Glycine max
  Peptide Sequence Number=SeqID_122675
atgcagtttgaggcggaagtagctaggttagaagcgttaaaatcaagcaagatgaaagagcttgtattaaagaaaagaacagagctggaggagatttgtcgaaagactcatttgattccagaaatagataatgcagtggaatccgctgttgatgccatagaatctggtagctttctgctttctagcaagtcaattgcaattatttcttacgcaaacttaaaagtctgcctcttcctgtttgatgcaggatctgtggaccctgcttgcattcttgaacaaattgaacttcagatttcccaagtcaaagaggaagcttttggcagaaaagagatacttgaaaaggttgagaaatggttggcagcatgcgatgaagagtcttggcttgaggagtacaacagggatgataatcgatacaatgctgggagaggtgctcatcttactcttaagcgagctgagaaagctcgtgccttggttaacaaaattccagcaatggtagatggtctgacttcaaaaactattgcatgggagaaggaaaaaggcattgagttcacgtatgatggtattcgtcttctttctatgcttgaagaatacaatatattacggcaagggaaagagcaagaacgtcgtaggcagcgggatctgaagaaactccagggacaaatgatagctgaacaggaggcactctatgggtcaaagccaagcccttcaaagccccaaagtgttaaaaagggacctaggatgtcaactggaggtgcagctagtagaagagtctctttgggaggagcgatgcttcaaactccaaaacctgattcaaaagctactcactcacgtgccacaagaaagattgacaaagcgcaccaaattgagcatctaaattacctggatgatggcattgctggtttatcagcaggaggaagtcaaagccacatcacagctgctagaagagggctggacattgctggcgttcctgtaaaaaaacactcatttggtgctgggactcaaatcatagaatctcctctgctacgacagcctttttctcccatctcttccaacagtgtatcttcaaaatctaatgtggcaaatgctacagatgaacagaataaacagagtgagaagttgcagagaacactgtcgcttaacaatgtgccatttactactccctccaagacagctactactgtggtagatgaagagaatagaactccaaaggcaatacctattcctgtcccagctaccccttcaacagtatcagttccaatgaatatggccatgactccagttccttcttcaattttcaagaacataagcttgaactcaacaactcccacatcagttcctcatggaaatgacatggttcaagaggctgaatattccttcgaggaaaaaaggctcagttattatatgttagcatga

SEQ ID NO: 5898 - DNA, 495 bp, Glycine max
  Peptide Sequence Number=SeqID_122676
atggaacgcgtctctgaatttcctcacaaaaaggatacagcagtaaagttttcttcagcttggtggttgtgcaacatgatgatgaagaagcatccaacaggcaagttttcgctgctccatggttttgcaacgtcacccgtgaggaagtatccagacattgactcatattcctgcacatcagcaaagagaaggagcaatgatacatcgagaaggtttagaagggtgcaagcgaaacacaaagcaatgaacaatatcaatgattatgcagaatccctctttcagttgtgctcagaaaatggtgcggggccagaaagagatgaacttgattttgagtttttgggaaacaaaacaggagagccttatttgattcagactaatgtatacaagaatgggactggtgggcgtaagatgaggcacatgctttggtttgaccccacagaggactaccacacctattccattcacgagggaagaattagaatgatatcatgttaa

SEQ ID NO: 5899 - DNA, 999 bp, Glycine max
  Peptide Sequence Number=SeqID_122677
atgaaggaggagctgattatgattaacaaaaatggtacttgggaacttactcccaaggacaagcatgtgattggtgtgaaagtggtttatagaacaaagttatatcctgatggtcatgaagacaatgtttataggcttcgcaaagccttgtatccaagagcttggtacaacagaattgattcacacttcctgcaaaatgatttcaggaggagccaaaatgaatctactctttatgtcaaagagtgtgactttggaaagcaaattattgtttcactttatgttgatgatttgcttgttacaggtcttggaatgatgaagtatttcttgggaatggaagtagatcaacttgatgatggaatctttctctcacagagaaagtatgttgttgatttgctaaagaaattcaaattggagagttgtaatcccgttacaactccacttgctgtaaatgaaaagctctctaagaatgatggcgatgcaaaggttgattgtaggcaaaagagtgcagagatatttgaaagacacggttggttgattttggcatttggtactacaaaggagatgagcacaactggatttgtcttttcacttggcaatggtgtgttcacatggaattctaagaagcaaggtgtagttgctcaatcttcagctaaagctgagtatattgctgcaacaactgtctcaaatcaagctatttggattagaaaggtattgactgacttgaatcatgtgcaagaagaatctatcgtggtatggtacgacaacaaattaactattgttattgctaaaattccaattcaacatggaagaaccaagcatatcaatgccaaatttcatgctgtaagagatgcggagaagaatggagatgttcaattgatgcactgcagctctgaagagcaaattacagacattttaactaaggcacttccatgtgctaagtttaatgtgttgaggagcaagcttggaatgttcaagaaaagttttaaggaggagtgttag

SEQ ID NO: 5900 - DNA, 216 bp, Glycine max
  Peptide Sequence Number=SeqID_122678
atgtcattgcctagcgctgttcatgtgttctccattatcaagtgcgaagcttctggtgactgggaagcacgttattctgttgttttccagatcggttccttcgccaaaagaaaaaaaaaagaagaagtagagatgagagtcgtcatcgcgaaaagggcaggacggacgaaatcagtgtcctatctttgctttactcttatctccgataagaggtaa

SEQ ID NO: 5901 - DNA, 177 bp, Glycine max
  Peptide Sequence Number=SeqID_122679
atggaacatctacggcagattctgtgccccaaatcatttatacttatgaaactaagcgggcaaacccctctccaatggaacaaaggggatccgctatccaagtggacaagggacatagctaaggaaaaactcgaatctaactcatcgatgatgcccagaaggaactgtaagagatga

SEQ ID NO: 5902 - DNA, 315 bp, Glycine max
  Peptide Sequence Number=SeqID_122680
atgagcaagatactcataatgggggcaatttttgttaacatggggattttcgttgttcaagttgagctgcttaatagtaatcactgcgcgatccgtaaggtttcgcaacatttcggaaagaaaatgggcaagaaactcaacccctgggcgcacatgggcccagtagatgacttaggggagaagcaactagctcacctgggcgagcaagttgcttctggagtaagtcaccagctcgcctgggcgacttgggcggcaagctcctccccctattttgctataaataggcatgaggggttgaaggaaaagggtccctga

SEQ ID NO: 5903 - DNA, 354 bp, Glycine max
  Peptide Sequence Number=SeqID_122681
atgaaggttttcgtgaagactctcaagggcacgcacttcgaaattgaagtgaacccttcggacacggtaagagtgcaagaccaattgcggctaagtggttgcatgctttctgaagtgaagaaaaatatagaaactgttcagggtgcagatgtctatcctgctgcacagcaaatgcttattcatcaaggaaaagttctaaaggatggtactactttggaggaaaataaagtagctgaaaatagttttattgtaattatgttatcaaagttatctggtgctttgaatctgacatggttgtcaatagttgcggtacaacaaattgatggtgtcagtgattgtttgtgtaaactgtga

SEQ ID NO: 5904 - DNA, 167 bp, Glycine max
  Peptide Sequence Number=SeqID_122682
cggccgtagcggccgtagcggccgctatagcggcggagcggcacccatctgcgacggacatgtgtgtagcggcgcggtttcgggtcacggctggagcagccgctatcgtggcggagcatggcggagcggtttttcgcgccgctacttcgaagcactggtggttataa

SEQ ID NO: 5905 - DNA, 453 bp, Glycine max
  Peptide Sequence Number=SeqID_122683
atgttagattctgtgattgagtacatcactcaggcagcttctagctatgctttcattttctgcttctgcaatttgatcatagtcattatcctagtggacttgaagcccaagcttagttttgatcaagagagtgaacaaatccgtttgtccatgcccacaaacacaggtatagaaggagcaatttccaagagtttagtaaacaaaaacacattttctccacaagcaagagaagtgtcacaacatgccaaagaagaagtggtggtggacaaagttggaagtgaaggtaatgataattgcgactgcaacagtgaggaagatgatgatgagctgaagagaagagtggaagagtttatagagagagttaatgaaggatggaaagcagaacatttgagcacatcaagtttgttgtgggtgtttgggaaataccctactcaagcaggaggattagagtga

SEQ ID NO: 5906 - DNA, 426 bp, Glycine max
  Peptide Sequence Number=SeqID_122684
atgtcgccgtcaccgaccaaggtcacggcatctccacccacccctttcacaaaatatatagcgttacgaaatggggccccagttggaatcgctgaagatatgatgctccggccagatttcgacgtcgaatacttcgatggtgatatttatgcgatttgggttttatctttgttagatctgtgcgatgcagtacattgcctagatggtgcaggacatgccttccaccgacgccacagttgtcgtgaagtaacggcagagccagtcggagaagataaaggtggacgccatcgggaagtcgtcgtgccgaaaacagctccagcggtcagagaccttggagcgaagggagagttcacaggaaattttgtacccatctcctttctttgttcacgcagcgctgcttctctaaaagacctgaaacacgtctag

SEQ ID NO: 5907 - DNA, 1935 bp, Glycine max
  Peptide Sequence Number=SeqID_122685
atggaaaaccttgagattgacttgatggtgttaccttgcagagagagtgtgtgcatcccaagtgagcgtgagacacttttgaagtttaagaataatctcatagatccttcaaataggctttggtcttggaatcataatcataccaactgttgccactggtatggagtcctctgccacaacgtcacttcccatcttcttcagcttcacctcaacacttcaccttctactgctttctatcgttactatgatggctactttgatagggaagcttataggggattccagtttggtggagagataagtccttgtttggctgatttaaagcatttgaattacttggacttgagcggcaatagatttcttggagaaggtatgtcaattccttctttccttgggacaatgacttccttgactcacctcgacctctctggtaatggattcatggggaagattccatctcagattgggaatctctccaatttggtctatcttgacctcgcaagttattatttaaattctctgattgctgaaaatgtagaatgggtatcaagtatgtggaagcttgaatatcttgatttgagtaatgcaaacctatccaaagcatttcattggctacacactctccaatctcttccttctttgacccacctatatttgtcatactgcacactccctcactataatgaaccatccttgctcaacttctcatctctgcaaactctcgatctttcccgtactcgttattcccctgccatttcttttgtccctaagtggatattcaaattgaagaaacttgtttctcttcaattacagggtaatgaaattcaaggtccgattcctggtggtattcgaaacctctcacttcttcaaaatattgacttgtctttcaactcattttcatcttctatacctaattgcttatacggtcttcatcgtctcaagttcctcaacctagtgcacaacaacttgcatgggactatttctgatgccctgggaaatttgacttctcttgttgaacttgttttgtcatataatcaacttgaaggaacaattccgacttttttgggaaatctccgcaactcaagggagatagatttaacatatctcgatctctctatgaataaattcagtggaaatccatttgaaagtcttggatcactctctaaattgtcatcgctttttattaatgacaataattttcaaggagttgtcaacgaagatgatcttgcaaatcttacaagtttgagggcgtttgatgcatcagggaacaatttcactttaaaagtgggtcccaattggcttcctaatttccatctttcctatttggatgtgacatcatggcatataggtcccaactttccatcgtggattcagtcacaaaacaaacttcgatatgttggactgtctaacacagggattttagattctattcccacttggttctgggaagcacagtctcaggttttgtatttaaacctctctcataatcatatccatggtgagcttgtgactactataaaaaatccaatatctatccaaactgttgatctaagcacaaatcacttatgtggtaaattaccccatctttcaaatgatgtgtatgagttagacctttcaaccaattcattctctgaatccatgcaagattttttatgtaacaatcaggacaagccaatgcaattagaatttctcaatcttgcatcaaataatctatcaggagaaatacctgattgttggattaattggccatttctagtggaagtgaatttacaaagcaaccattttgttgggaacttccccccatccatgggttccttggctgagctgcagtcattagaaattcgtaacaacttgctctcgggaatatttcctaccagtttgaagaagactagccaattgatatccttggatcttggagaaaataatcttcaggat

SEQ ID NO: 5908 - DNA, 888 bp, Glycine max
  Peptide Sequence Number=SeqID_122686
atgtgtcaaattatgcaggcaagtgcaactcctacttcaacctctgtgtctgctgcgcctcaagctcctgcttcaactggagcaacgcctacacctgttactgccccagctgctcctgcttctgctgcagctcctgctcctatatcttcaggctctgctgtgccagagtctgatatatatgggcaggcagcatctaatcttgttgctggaagtaacttggagggaaccattcagcaaatccttgacatgggtggaggaagctgggacagggatactgttgttcgtgctcttcgtgctgcttataacaaccctgagagagctgttgaatatttgtattccggcataccagagcaagctgaagctccacctgttacccgagagcctgcaagtgctcaacctgcaaatcctccagctgctgctccacaggcagcacaaccagcatctgttccttctagtggacctaatgccaatcctttagatctctttccccagggccttccaaatgttgggtctggtgctgctggtgctggctctttagactttcttcgcaacagtcaacagttccaagccttacgcgctatggtacaggctaatccacaaatattgcagcctatgctacaagagcttggcaaacaaaatcctcatcttatgcgattgattcaagagcatcaagttgacttccttcgcctaattaatgaacccgttgaagggggtgagggaaatatactgggacagctagctagtgccatgccgcaagcagtgacagtcacccctgaggaacggcaagcaattgaacgtgttttaatgaatgagcttatgtttggaaacatttatttagtgattttgatgcaatgctgtttgagtagtgtaaatgaaaatcacttttag

SEQ ID NO: 5909 - DNA, 276 bp, Glycine max
  Peptide Sequence Number=SeqID_122687
atggacaaagaaattaatggtgctgatggcgtcaacaaattccaatcaggggaagaagaggaagataaggaacagtgcagtccagtatctgttttagacccacccttcgatgacgatgatgatgaccatgaaggggatggttttgattgggactgtagctatgccaatcattttatgttgctgagatgttttgtgctaatgccacctatctttggtgggttccattggaagattgcaatagctcatcatccaacatgcatttcgcattcaatgtga

SEQ ID NO: 5910 - DNA, 2956 bp, Glycine max
  Peptide Sequence Number=SeqID_122688
tgagcgtgagacacttttgaagtttaagaataatctcatagatccttccaataggctttggtcttggaatcataataataccaactgttgccactggtatggagtcctctgccacaaccttacttcccatcttcttcagcttcacctcaactcttcagattctattttcaatgatgattgggaagcttataggagatggagctttggtggagagataagtccttgtttggctgatttaaagcatttgaattacttggacttgagcgccaatgaataccttggagaaggtatgtcaattccttctttccttgggacaatgacttccttgactcacctcaacctctctcatactggattcatggggaagattcctcctcagattgggaatctctcaaatttggtgtatcttgacctgagagctgttgccgacggagcagtaccctctcagatcgggaatctctctaagcttcaatatcttgacttgagcggcaattatttccttggagaaggtatggcaattccttctttccttgggacaatgacttccttgactcacctcgacctctcttatactggattctatgggaagattcctcctcagattgggaatctctccaatttgctctatctcggccttggaggtcattctagtcttgaacctctgtttgttgaaaatgtagaatgggtatcaagtatgtggaagcttgaatatcttgatttgagttatgcaaacctatccaaagcatttcattggctacacactctccaatctcttccttctttgacccacctatatttttctgaatgcacactccctcactataatgaaccatccttgctcaacttctcatctctgcaatctctcattctttacaatactagttattcccctgccatttcttttgtccccaagtggatattcaaattgaagaaacttgtttctcttcaattagtgcgtaatggcatccaaggtccgattcctggtggtattcgaaacctcacacttcttcaaaatcttgacttgtctgaaaattcattctcatcttctatacctgattgcttatacggtcttcatcgtctcaagttcctgaacctaatggacaacaacttacatgggactatttctgatgccctgggaaatttgacttctcttgttgaacttgatttgtcgtataatcaacttgaaggaacaattccgacttttttgggaaatctccgcaactcaagggagatagatttaacatttctcgatctctctattaataaattcagtggaaatccatttgaaagtcttggatcactctctaaattgtcagttcttcatattaattacaataattttcaaggagttgtcaacgaagatgatcttgcaaatcttacaagtttgaaggcgtttgatgcatcagggaacaatttcactttaaaagtgggtcccaattggcttcctaatttccagcttttctttttggatgtgacatcatggcatataggtcccaactttccatcgtggattcagtcacaaaacaaacttcaatatgttggactgtctaacacagggattttagattctattcccacttggttctgggaagcacattctcaggtttcgtatttaaacctctctcataatcatatccatggtgagcttgtgactacaataaaaaatccaatatctatccaaactgttgatctaagcacaaatcacttatgtggtaaattaccctatctttcaagtgatgtgtatgggttagacctttcaaccaattcattctctgaatccatgcaagattttttatgtaacaatcaggacaagccaatgcaattagaatttctcaatcttgcatcaaataatctgtcaggagaaatacctgattgttggattaattggccatttctagtggaagtgaatttacaaagcaaccattttgttgggaacttccccccatccatgggttccttggctgagctgcagtcattagaaattcgtaacaactggctctcgggaatatttcctaccagtttgaagaagactggccaattgatatccttggatcttggagaaaataatctttcaggatgtattccaacatgggttggagaaaagctctcaaatatgaaaatcctccgccttcgatcaaacagtttttccggtcacattccaaatgaaatatgtcagatgagtcgtcttcaggttttagaccttgcaaaaaataatttgtctggcaatatacccagctgtttccgtaacttgagtgccatgacactagtgaaccggagtacatatccccaaatctattcttatgcaccaaataatacagaacactcttcggtatcaggtatagttagtgtgctactttggctaaaaggaagaggagatgagtatggaaacattctgggtttggtaacaagtattgatctgtcaagtaacaaattattaggagaaattcctagagaaatcacagatctaaatggattgaactttttgaacttgtcccacaaccaattgattggtcctattccagaaggtattggtaatatgggatcgttacaaaccattgatttttcgaggaatcaaatttctggtgaaatccctccaaccatttcaaaattgagctttttgagcatgctagacgtgtcttataatcatttgaagggaaaaattccaacaggaactcaattgcaaacctttgatgcctccagctttattggcaacaatctatgtggtccaccactgcccataaactgcagctccaatgggaaaactcatagttatgaaggaagtcatgggcatggagtgaattggttttttgttagtgcgacaattggatttgttgtgggactttggatagtgattgctcctttgcttattttcgtgactcgtggctgcatacaagacttgactctccaagccggcaaggccaagaactttgatgagatatccatagataaccaatga

SEQ ID NO: 5911 - DNA, 528 bp, Glycine max
  Peptide Sequence Number=SeqID_122689
atggcatattttgttgggagggttgaaagaaggcactacggggataccatggctgaacagagagccttatgcttactggaaaggattggtttcgagaatcacaagaggggttcaacaaatcagacttgccaagtcaatgcacttatagatataaggtgtacattgaaggttctgtttggtcagtcagtcaaaaatacattctgtcatgtgactctaccactctacgtgtacgactacatgtttcatctcctgaattcatatgctaaactcttcagatacaaaccctccataagtgctaatgctacagaactatgtgtggagtcaatggtttgtggagcagaaggatcagtaaagaaatttatgatggaatcattggtcaaggttcctgcaaataccgacccttgcaccatgcctgccccttttgaccctccaactttgtatgcaacattagagagaaaggaaagctcaattcaacaagttgaatcatgggagaaaagttattgggataatcaaaccataacatcttaa

SEQ ID NO: 5912 - DNA, 405 bp, Glycine max
  Peptide Sequence Number=SeqID_122690
atgggattctattatttcaatagagagggtgatacttctattcctgatgctacgactaaagctgaagaatttgctcaaagtattgcatcttttgctgacacatttcctgcaaaaaggtttgctagaattattgaagatttcaaaaaagatcctgcaaggcaaggcgtgcctcttgatgtccttgatgtagagaatgcaaatgccatatccctatttgagaatgttgttcgtcttaatgatgccattgtagatgaagggaaacgactagagaatttagttagaggagtttttgcaagaacatacttgatcttggtgcttcacatgttggttgattttctgttccagagaaggaagaagaaagttcagagaggaggaggaaaatatccagagagggaaaggggatga

SEQ ID NO: 5913 - DNA, 1506 bp, Glycine max
  Peptide Sequence Number=SeqID_122691
atggccatgaaagacgaatatgatgctcttattgaaaataagacgtgggacttagttcctcgtccgtctaatgctaatgttattcggagtttgtggattttcaggcataaaaagaaatctgacggatcctttgaaagatacaaagctcgccttgtaggtaatggtgcaaatcaacaaacgggtgttgattgtggtgacacattcagcccggtggtcaaaccggctaccattcgaacggttctaagtgttgccttatcaaaatcatggtgtcttcatcaattagatgttaaaaatgctttcttgcatgggaaccttcatgaaacagtatacatgcatcaacctcctggatttcgtaattctcaatttcctgatcatgtctgtttattgaagaaatcactatatggtctcaaacaagcacctcgcgcctggtaccagcgctttactgattatgtagctacaataggtttctctcacagtatttcagaccactctctttttatatatcatcatggcaataacatagcttatattcttctgtatgtggatgacattattcttgctgcatcatctgacactcttagagaatctattatggcacaactgagttctgaattctccatgaaggatctggggcctctaagttattttctgggtatttctgtcaccagacatcccgaaggcctttttctttctcaaaagaaatatgcagaagaaattatcgaacgagcaggtatgtcttcctgcaaaccatcctccacaccagtagacacaaaggcgaaacttagtggttcatccggtaacccttaccatgatccaaccgaatatcgtagccttgccggagcattgcaatacttgacgttcactcgaccggacatctcatatgcagtccagcaggtgtgtttatttatgcatgatccaaaaactcaacacatgtctgccttgaaacgcattattcgatacattaatggtaccatagatttcggcctccatctgtacccttcatccatcgacaagctcatttcttacacagacgcagattgggccggttgtccagacacaagaagatctacctccggctactgcgtttatctcggtgacaacttgatctcatggtccgcaaaacgccaacataccttgtctcgttcaagtgctgaagccgaatacagaggtgtcgctaatgttgtgtctgaatcatgttggttacgcaacttactcttggaactatgttgtcctgtcacaaaagctactctagtatattgtgacaacatcagcgcagtttatctttccgacaatcctgttcaacatcaacgcaccaaacatattgaaatggatatacatttcgtgcgtgagaaggttgcttgcggtcaagtacgcgttcttcacattccctcgcgttttcagattgctgacatcttcacaaagggacttccgttgcaactctttgatgactttcgtgatagtctcaacattcgttcacctccagtttcgactacgggggtgtattag

SEQ ID NO: 5914 - DNA, 318 bp, Glycine max
  Peptide Sequence Number=SeqID_122692
atggaaggagaaggaggaagcgcaaccagaaagagagggaaagatggtgagactgagacgacgacacgttacaaaggaatcagaatgagaaagtggggcaagtgggtcgctgagattcgagaacccaacaagcgttccaggatttggctcggttcttactccacgcccgtcgcggcggcgcgtgcttatgacaccgccgttttctatctccgggggccctccgcgcgcctcaacttcccggagcttctcgccgcggagggccccgccgcctccgacgccgtcatgtccgcggcctccatccggaagaaggccaccgag

SEQ ID NO: 5915 - DNA, 282 bp, Glycine max
  Peptide Sequence Number=SeqID_122693
atgggatttgtaggtagaggggatatggaggttgaggttgatgtatggagattgaagagtttgcgaggtggaggagtcggaagtgatgtgggggatggggatgatatgatagttggtaatgatgggtttggaggtgatgttatgggtggggctgatgctgtggttggtgaggggtggagtacgattttgatggttagagggtggagcactataggaataggatggaaggaagggtgtgtcgtcatccagaaaattatagccaaccgttgtagggacatttag

SEQ ID NO: 5916 - DNA, 201 bp, Glycine max
  Peptide Sequence Number=SeqID_122694
atgattgctaaaaagtctaggggaaagttgaaacaaggaaggagtgtagggaaagaaaaacaaagggaaagcaaggaggcctgtcggcataaggtggtgcataatagggctcagagacggtggatcatgtcggcaaaggaaagcaattctgactgcctaccaactcaaagactgggtcttgtattagagagcagaatgtga

SEQ ID NO: 5917 - DNA, 2169 bp, Glycine max
  Peptide Sequence Number=SeqID_122695
atggcttccacagtcgcttccgcgatggcttccacctccgccgccgagcccgaccccgatgcggcggcgaggaagcgctacgagggccttctcacagttcgcacgcgtgccatcaaaggcaaaggcgcgtggtactgggcccacctcgagcccatgctgctgaacaacgccgtcaagctcaaatgctccctctgcgactctctcttctccgcttccaacccttcccgaaccgcttccgagcatctcaagcgtggcgcgtgccccaatttcaaccactcttcgttgccttcaccttctcctatttccactgtcctctctcattcccattccaacaacggcagaaagagaacctccacctcaacctcaaactctccgaaccaggaccactctgttcagcatttggtgttgtctggtggaaaagatgatttgtgtgctctcgctgttttcgaggacagtgtcaagaagctcaagagtcctaggaacttgtcgcatgttgctcctcctgagttgaccaaggaccaggttaactctgctgttgaattgctggcagattggttctacgagtcttgtggctctgtgcctctctctgctcttgaacacccaaagtttcaatcttttctcacccagctgggtttgccggtgactctgttaagacgagagatatatgggtctaggctcgatgataggttcggattggccaaggctgagtccgaaactagaatgagagacgctatgttttttcaagtggggtgtgatggttggaagggggaggatggtgtggtgaagtttatagtgaatcttcccaatggtactagcgtgttcaacaaggtggtgtttggtggtggtggaggagtggtgtcttctaagtatgctgaggagattttgtgggagttggtgagtggcgtttgtgggagtgatgtgcagaggtgtgtgggggtagttgcagacaggtttaaggggaaggcgttgaggaacttggaggttcagaaccattggatggtgaatgttgcttgtcaggttcaggggttcatgggtttgatcaaagatttcagcatcggtctaccacttttcagtgttgtcactgagaattgtctcaaggttgctaatttcatcaacactgagtctcaggttaggagtagtttcctcaggtacaggatgcaggagctggaatgtgctgggctggtacgagttccgtctccgaaatgtcatgtgttgaaggactttgcagcatctgtgtttccaatgctggaggacatcctgagctgtgctgcagtgatccaaatggtggtgttggaggacacgtttaaggtggcgtgtatggaggatccactggccagagaggttgctggaattgttcagagtgaggggttttggaatgaactggaggcggtttattcgctggtgaagctaatcagaggagtggttcaggacattggggcggagaggccattgattggtcggtgcttgcctctttgggaggaggttagaaccaaggtggtgaaggagtggtgtgttaagtacagtgttgcggaagcacctgtggtggaaatacttgagaaacggttcaggaagaattatcaccctgcatggtctgctgcattcatacttgatccactttacttggttaaagatgcaagtggaaagtaccttcctccgttcaattgcttaactcgtgaacaagagaaagatgtagataagttattgacaaggctggcttcgcgagaagaagctcatgttgtgttgatggagctcatgaagtggagatcagaagggcttgacccactttatgcacaggctgtgcagatgaaacaacgagacccggttaccgggaagatgaaggttgcaaatccactcagcagtagacttgtttgggaaacttgcctcagcgagtttaaatcccttgggaagcttgcagtgaggctcatttttctgcatggaacctcaagtggatttaagagtaattgttctttcatcaggaagatttctgcaaataagcactccagagtttccttggaaagagctctgaaagtggtgtatattgcagctcatgccaagcttgaaagacgagacttttccaatgaggaagagaaggaagcagaactgcttgccagggaaggtagtgatgatggtatgctggctgaggtctttgctgatgcacccctgctgtaa

SEQ ID NO: 5918 - DNA, 186 bp, Glycine max
  Peptide Sequence Number=SeqID_122696
atggcgaggacgtgtagtcctctgaaggtgaaggcgtgcagccctctgaaggtgaggacgtgtagtcctcgaaagattgactgtccttttgaaagtggtgataattcatgcaaccttatcctatcttttgcaaatctctccgggaactccctcatagtgtatgttctgtttgatttagtcacttga

SEQ ID NO: 5919 - DNA, 412 bp, Glycine max
  Peptide Sequence Number=SeqID_122697
atgtcgggagttgaaaggaagtgtaatgcgcaatccgtaaagttccgtaacattccggaagccaaaagaggggacgattgcataatccataagcaatcaggcccacttgggccttccaggatgttcaaacagaaggcggtgccttctggtggaagcaacccagcttgcctaggcgagctagcggcaaccacctccctcttttcccctataaataggggaaggagggcagaacaaattcgttcaaccctcctagtatctgagaatcacttaaaattagtgagaaaaattgtttccgtgaagaaaatccaagccgaggcgcttccgagacgttttcgtgggcgatttcgcgaaggttttccaccgttcttcatcgttcttcgttcgttcttcgtcgttcttcggtcttcaaccg

SEQ ID NO: 5920 - DNA, 426 bp, Glycine max
  Peptide Sequence Number=SeqID_122698
atgccccgtactcatgacgcgatcctgtattacaacgggaaatggaacatgccaccgcagaacaaatttgttggatgcgcgttcacaggaaaaaatcctaagaaatttcaaattccttcaacatgtaccatcgatgaactgaagaatttaataaagcaagttgcacctaaagggattccccctcttggaattcacgaatcacaaatggtaagacgattgtttttccgccaaccagctcgctttgagtattcagatacgcttataaaatatgaaataaatgagctgaggaccaatgaagaactgctgaaggtgttagtacaatctaactactggaaaaaatatgaaccaatagaaattttagctgtctttactaaatatgttgtgaaaatcgaagacgaggtcactgggacatcgctaaacaactga

SEQ ID NO: 5921 - DNA, 2739 bp, Glycine max
  Peptide Sequence Number=SeqID_122699
atggcaattccttctttccttgggacaatgacttccttgactcacctcaacctctctcatactggattctatgggaagattcctcctcagattgggaatctctccaatttggtctaccttgacctcggaggttattctgatctgtttgctgaaaatgtagaatgggtatcaagtatgtggaagcttgaatatcttcatttgagtaatgcaaacctatccaaagcatttcattggctacacactctccaatctcttccttctttgacccacctatatttgtcaggatgcacactccctcactataatgaaccatccttgctcaacttctcatctctgcaaactctccatctttcccttactcgttattcccctgccatttcttttgtccccaagggtaatgaaatccaaggtccgattcctgttggtattcgaaatctcacacttcttcaaaatcttgacttgtctcaaaattcattctcatcttctatacctgattgcttatatggtcttcatcgtctcaagtatctggacctaaggggcaacaacttgcatgggactatttctgatgccctgggaaatttgacttctcttgttgaacttcatttgttatataatcaacttgaaggaaccattccaacttctttgggaaatttgacttctcttgttgaacttgatttatcaaataatcaacttgaaggaaccattccaccttctttaggaaatttgacttctctggttagacttgatttgtcatatagtcaacttgaaggaaacattccaacttctttgggaaatttgacttctcttgttgaacttgatttgtcatatagtcaacttgaaggaaacattccaacttctttgggtaatgtctgcaacttaagggtgataggtttatcatatctcaaactcaaccaacaggttaatgaacttttagaaattcttgctccttgtatttcccatggactcacaagacttgcagttcagagttcacaactttcaggcaatctgacagatcatattggggcatttaaaaatattgtgctgctagatttttccaacaactcaattggtggtgctcttcctagatcatttggaaaactttcatcattaagatatctcaatctgtctattaataaattcagtggaaatccatttgaaagtcttggatcactctctaaattgtcatctctttatattgatggcaatctttttcatggacttgtcaaggaagatgatcttgcaaatcttacaagcttgacggagtttggtgcatcagggaacaatttcactttaaaagtgggtcccaattggcgtcctaattttcggctttcctatttggatgtgacatcatggcagttaagtcccaactttccatcgtggattcagtcacaaaacaaacttgaatatgttggactatctaacacggggattttcgattctattcccacacagatgtgggaaacacttcctcaggttttgtatttaaacctctctcataatcacatccatggtgagagtgggactacattaaagaatcccatatctatccccgttattgatctaagctcaaatcacttgtgtggtaaattaccctatctttcaagtgatgtgtctcagttagatctttcaagcaattcaatctctgaatccatgaatgactttttatgcaatgatcaggacgagccaatgcaattacaatttctgaatcttgcatcaaataatttgtcaggagagatacctgattgctggatgaattggacatttcttgtgaatgtaaatttacaaagcaaccattttgttgggaacttaccccaatccatgggttccttggcagagctgcagtctttacaaattcgtaacaacacactctcaggaatatttccaaccagtttgaagaagaataaccaattgatatccttggaccttcgggaaaataatctttcaggaagtattccaacatgggttggagaaaagctcttaaatgtgaaaatcctcctccttcgatcaaacagttttaccggccacattccaaatgaaatatgtcagatgagtcttcttcaggttttagaccttgcccaaaacaatttgtctggcaatataccgagctgtttcagtaacttgagtgccatgacactaaagaaccaaagaagaggagatgagtatagaaacattctgggtttggtaacaagcattgatctatcaagtaacaatttattaggagaaatacctagaaaaatcacaaatctaaatggattgaactttttgaacttgtcccacaaccaattgattggtcatattccacaaggcattggtagtatgggatcattacaatccattgatttttctaggaatcaactttctggtgaaatccctccaaccatttcaaatttgagctttttgagcatgctagacgtggcttataatcatttgaagggaaaaattccaacaggaactcaattgcaaacctttgatgcctccagctttattggcaacaatctatgtggtccaccactgcccataaactgcagctccaatgggaaaactcatagttatgaaggaagtgatgggcatggagtgaattggttttttgttagtgcgacaattggatttattgtgggattctggatagtgattgctcctttactgatttgtagatcatggaggtatgcctattttcatttccttgatcatgtgtggttcaaacttcaatctttttactcatgtagtatcagtgtttag

SEQ ID NO: 5922 - DNA, 777 bp, Glycine max
  Peptide Sequence Number=SeqID_122700
atgacaccaccgaaacaactcaaacaaagcatcaagaagagaacacaagcaatgaaaaccgttaacaatctcatcagcaacctcagccaaaagcactgtcacttcgaagcttcaccaacaacaccacaagagaagagaactgaccatgctgctgctcctacagaatatggaaaaagtgttgctcagtctctgacagagaaactagctccagtttctggaaaagttgctggtgtaggaagtggtgtgaagtccaaagtttctggaactcaaactagtagtgtgggtgtggaacaggacaagggggtttctgtgaaggactatttggtggacaaactgaggcctggtgatgaagacagggctctctctgaagtgatatcagagactctgcacaagaaggaactgcccccagtggaagttactgaagaaggtgtgagaaaggtggtttctgatgctgtgcataagagagaggatgatcctgagagaagaatggaacatcaaagaatactgggaaaggtaactgagtcagaggaagtgaagggaaggttaggaggtgaaagtgtggtgacagagaaaaagtaccaagagatgtatgtgaatagtccggggaaaggtgtggttgataagcttaaaggtatggttgggacatggtttaccaacccagcagagaatcaatcttcacaagattcatctatgaattatgaggcaggaagggcagaagtggaacaagttaaccaaggtgcagcaggtgaaagaaggcagcaggagtcatataattga

SEQ ID NO: 5923 - DNA, 558 bp, Glycine max
  Peptide Sequence Number=SeqID_122701
atgaattcctcctccatttatattcttgtctttgtccagctttggttgttcagcttaccatgcagagagagtgtgtgcatcccaagtgagcgtgagacacttttgaagtttaagaataatctgaatgatccttcaaataggctttggtcttggaatcctaataataccaactgttgccactggtatggagtcctctgccacaaccttacttcccatcttcttcagcttcacctcaacacttcaccttctgctttctatcatgactactatgatgatggattctaccgtagattcgatgaggaagcttataggagatggagctttggtggagagataagtccttgtttggctgatttaaagcatttgaattacttggacttgagcggcaattatttacttggagcaggtatgtcaattccttctttccttgggacaatgacctccttgactcacctagacctctctgatagtggattctatgggaagattcctcctcagattgggaatctctcaaatttggtgtatcttgacctgagtttagatgttgccaacggaaca

SEQ ID NO: 5924 - DNA, 734 bp, Glycine max
  Peptide Sequence Number=SeqID_122702
tgtgtgcatcccaagtgagcgtgagacacttttgaagtttaagaataatctgaatgatccttcaaataggctttggtcttggaatcctaataataccaactgttgccactggtatggagtcctctgccacaaccttacttcccatcttcttcagcttcacctcaacacttcaccttctgctttctatcatgactactatgatgatggattctaccgtagattcgatgaggaagcttataggagatggagctttggtggagagataagtccttgtttggctgatttaaagcatttgaattacttggacttgagcggcaattatttacttggagcaggtatgtcaattccttctttccttgggacaatgacctccttgactcacctagacctctctgatagtggattctatgggaagattcctcctcagattgggaatctctcaaatttggtgtatcttgacctgagtttagatgttgccaacggaacagtaccctctcagatcgggaatctctctaagcttcgatatcttgacttgagctacaattatttacttggagaaggtatggcaattccttctttccttgggacaatgacttccttgactcacctcaacctctctcatactggattctatgggaagattcctcctcagattgggaatctctccaatttggtctaccttgacctcggaggttattctgatctgtttgctgaaaatgtagaatgggtatcaa

SEQ ID NO: 5925 - DNA, 3063 bp, Glycine max
  Peptide Sequence Number=SeqID_122703
atggatctgatggagtggctgtggttcatgttgaaaaagttaccttgcagagagagtgtgtgcatcccaagtgagcgtgagacacttatgaagtttaagaataatctgaatgatccttcaaataggctttggtcttggaatcctaataataccaactgttgccactggtatggagtcctctgccacaaccttacttcccatcttctccagcttcacctccacacttctgattctgctttctatcatgatgcctaccattatcgattctaccatagatttgatgaggaagcttataggagatggagctttggtggagagataagtccttgtttggctgatttaaagcatttgaattacttggacttgagcgccaattatttccttggagaaggtatgtcaattccttctttccttgggacaatgacttccttgactcacctcaacctctcttatactggattcaatgggaagattcctcctcagattgggaatctctcaaatttggtgtatcttgacctgagttatgatgttgccaacggaacagtaccctctcagatcgggaatctctctgagcttcgatatcttgacttgagctacaattattttgaaggtatggcaattccttctttcctttgtgtaatgacctccttgactcacctcgacctctcttatactgcattcatggggaagattccatctcagattggaaatctctccaatttggtctatcttggcctcggaagttatgatttcgagcctctgttagctgaaaatgtagaatgggtatcaagtatgtggaagcttgaatatctttatttgagtaatgcaaacctatccaaagcatttcattggctacacactctccaatctcttccttctttgacccacctatatttgtcagaatgcacactccctcactataatgaaccatccttgctcaacttctcatctctgcaaactctcgatctttccggtactagttattcccctgccatttcttttttccctaagtggatattcaaattgaagaaacttgtttctcttcaattagggggtaatgacatccaaggttcgattcctggtggtattcgaaacctcacacttcttcaaaaccttgacttgtctgtaaattcaattgcatcttctatacctgattgcttatacggtcttcatcgtctcaagttcctggacctagagggcaacaacttgcatgggactatttctgatgccctgggaaatttgacttctcttgttgaacttgatttgtcatacaatcaacttgaaggaaccattccaacttctttgggaaatttgacttctcttgttgaacttgatttgtcatacaatcaacttgaaggaatcattccaacttctttgggaaatttgacttctcttgttgaacttgatttgtcatacaatcaacttgaaggaaccattccaacttctttgggaaatttgacttctcttgttgaacttgatttatcagctaatcaacttgaaggaaccattccaaattctttgggaaatttgacttctcttgttaaacttcaattatcacgtaatcaacttgaaggaaccattccaacttctttgggaaatttgacttctctggttagacttgatttgtcatataatcaacttgaaggaacaattccaacttctttggctaatctctgcctcctaatggagattgatttctcatatctcaaactcaaccaacaggttaatgaacttttagaaattctagctccttgtatttcccatggactcacagcacttgcagttcagagttcacgactttcaggcaatctgacagatcatattggggcatttaaaaatattgacacgttacttttttccaacgactcaattggtggtgctcttcctagatcatttggaaaactttcatcattaacatatctcgatctgtctattaataaattcagtggaaatccatttgaaagtcttagatcgctttctaagatgtcatctcttcagattgatggcaataattttcaaggagttgtcaaggaagatgatcttgcaaatcttacaagcttgatggagtttcatgcatcagggaacaatttcactttaaaagttggtcccaaatggcttcctaattttcagctttcctatttggatgtgacatcatggcagttaggtcccaactttccatcatggattcagtcacaaaaccaacttcaacattttggactgtctaacacggggattttagattctattcccacctggttctgggaagcactttctcaggacgagccaatgcaattaaaatttttgaatcttgcatcaaataatttgtcaggagagatacctgattgctggatgaattggacatttcttgcggattctttacaaattcgtaacaacacactctcaggaatatttccaaccagtttgaagaagaataaaaaattgatatccttggaccttggggaaaataatctttcaggaagtattccaacatgggttggagaaaagctcttaaatgtgaaaattctccgccttcgatcaaacagttttgccggcctcattccaaatgaaatatgtcagatgagtcttcttcaggttttagacgttgcacaaaacaatctgtctggcaatataccgagctgtttcagtaacttgagtgccatgacactaaagaaccaaagtacagatcctcgtatctattctcaagcacaatataatatgtcttccatgtatagtatagttagtgtgctactatggctgaaaggaagaggagatgagtatcgaaacattctgggtttggtaacaagcattgatctgtcaagtaacaaattattaggagaaatacctagagaaatcacagatctaaatggattgaactttttgaaccaagtgtgtttcttcccaaattgtgcaaatgctcgtcgacaaatgggtgagatcaaaagctcaggtatggtagctccaggacctgtgcactctcttcaattcacctcaatttctccacaaccttttgatgctatggagctctcagatgaacctgccgttgctccattcccgcaatactaa

SEQ ID NO: 5926 - DNA, 3381 bp, Glycine max
  Peptide Sequence Number=SeqID_122704
atgaattcctccatttatattcttgtctttgtccagctttggttgttcagcttaccatgcagagagagtgtgtgtatcccaagtgagcgtgagacacttttgaagattaagaataatctcatagatccttcaaataggctttggtcttggaatcataatcataccaactgttgccactggtatggagtcctctgccacaacgtcacttcccatgttcttcagcttcacctcaacactacgttttctgctgctttctatgatggctactatcacttcgatgaggaagcttatgagaaatcccagtttggtggagagataagtccttgtttggctgatttaaagcatttgaatcacttgaacttgagcggcaattatttccttggagcaggtatgtcaattccttctttccttgggacaatgacttccttgactcacctcgacctctctcttactggattcatggggaagattccatctcagattgggaatctctccaatttggtctatcttgacctcggaggttattctgtcgagcctatgttagctgaaaatgtagaatgggtatcaagtatgtggaagcttgaatatcttcatttgagttatgcaaacctatccaaagcatttcattggctacacactctccaatctcttccttctttgacccacctagatttgtcaggatgcacactccctcactataatgaaccatccttgctcaacttctcatctctgcaaactctccatctttccttcactagtttttcccctgccatttcttttgtccccaagtggatattcaaattgaaaaaacttgtttctcttcaattatggggtaatgaaatccaaggtccgattcctggcggtattcgaaacctcacacttcttcaaaatcttgacttgtctggaaattcattctcatcttctatacctgattgcttatatggtcttcatcgtctcaagttcctcaacctaagggacaaccacttgcatgggactatttctgatgccctgggaaatttgacttctcttgttgaacttgatttatcaggtaatcaacttgaaggaaacattccaacttctttgggtaatctctgcaacttacgggacattgatttctcaaatctcaaactcaaccaacaggttaatgaacttttagaaattcttgctccttgtatttcccatggactcacaagacttgcagttcagagttcacgactttcaggccatctgacagatcatattggggcatttaaaaatattgacacgttacttttttccaacaactcaattggtggtgctcttcctagatcatttggaaaactttcatcattaagatatcttgatctgtctactaataaattcagtggaaatccatttgaaagtcttggatcactctgtaaattgtcatctctttatattggtggcaatctttttcaaactgttgtcaaggaagatgatcttgcaaatcttacaagcttgatggagattcatgcatcagggaacaatttcactttaaaagtgggtcccaattggcttcctaattttcagcttttccatttggatgtgagatcatggcagttaggtcccagctttccatcgtggattaagtcacaaaacaaacttgaatatttagacatgtctaacgcagggattattgattctattcccacacagatgtgggaagcacttcctcaggttttgtatttaaacctctctcataatcacatccatggtgagagtgggactacattaaagaatcccatatctatccccgttattgatctaagctcaaatcacttgtgtggtaaattaccctatctttcaagtgatgtgtctcagttagatctttcaagcaattcaatctctgaatccatgaatgactttttatgcaatgatcaggacgagccaatgcaattacaatttctgaatcttgcatcaaataatttgtcaggagagatacctgattgctggatgaattggacatttcttgtgaatgtaaatttacaaagcaaccattttgttgggaacttaccccaatccatgggttccttggcagagctgcagtctttacaaattcgtaacaacacactctcaggaatatttccaaccagtttgaagaagaataaccaattgatatccttggaccttggggaaaataatctttcaggatgtattccaacatgggttggagaaaagctcttaaaagtgaaaatccttcgccttcgatcaaacagttttgccggccacattccaaatgaaatatgtcagatgagtcatcttcaggttttagaccttgcagaaaacaatctgtctggcaatataccgagctgtttttgtaacttgagtgccatgacactaaagaaccaaagtacagatccttctatctattctgaagcacaatatgttggtagctcttactcttccatctatagtatggttagtgtgctactatggctgaaaggaagaggagatgagtatagaaacattctgggtttggtaacaagcattgatctgtcaagtaacaaattattaggagaaatacctagaaaaatcacaaatctaaatggattgaactttttgaacttgtcccacaaccaattgattggtcatattccacaaggcattggtaatatgggatcattacaatccattgatttttctaggaatcaactttctggtgaaatccctccaaccatttcaaaattgagctttttgagcatgctagacgtgtcttataatcatttgaagggaaaaattccaacaggaactcaattgcaaacctttgatgcctccagctttattggcaacaatttatgtggtctaccactgcccataaactgcagctccaatgggaaaactcatagttatgaaggaagtcatgggcatggagtgaattggttttttgttagtgcgacaattggatttgttgtgggattctggatagtgattgctcctttactgatttgtagatcatggagcaatttgcataggactatttatgatgtctggggaaatttgacttctcttgttgaacttgatttatcaattaatcaatctgaagcaaccattcgaacttcttggggtaatctcagcaacttgggaacttgggggagattgatttcttatatctcaaactcaaccaacaggttaggaggggaaagtgtggtgacagagaaaaagtaccaagagatgtatgtgaatagtccagggaaaggtgtggttgataagcttaaaggtatggttgggacatggtttaccaacccagcagagaatcaatcttcacaagatttatctatgaattatgaggcaggaagggcagaagtggaacaagttaaccaaggtgcagcaggtgaaagaaggctgcaggagtcatctaattga

SEQ ID NO: 5927 - DNA, 279 bp, Glycine max
  Peptide Sequence Number=SeqID_122705
atgaaggaactgactcacctgggcgagccagttactttaggagtaatcatcagctcgcctgggcgagctgccatttccccaagtgcccattttcctataaataggcatgctagggaggctgaggagaggttccaaggttcagaagttgagggaattgagagaagagagaaagaagaagaagaaagaagaggaaacgaagccgaggcactgtcgaatgacgactgtgatcaatctctacatcgttccttgttcggtgttctttgtgcgatcatcgattag

SEQ ID NO: 5928 - DNA, 153 bp, Glycine max
  Peptide Sequence Number=SeqID_122706
atggtgaatatgagtagagctatgaaaatgggcagtctgcccgctgcccgtgcccggtctatcaggtcaagtctgactgggccaatttggccgacggccataaagcagaagcagtgtaggattaggaagcagcaacactgcaataacctataa

SEQ ID NO: 5929 - DNA, 3348 bp, Glycine max
  Peptide Sequence Number=SeqID_122707
atgaattcctccatttatattcttgtctttgtccagctttggttgttgagcttaccatgcagagagagtgtgtgcatcccaagtgagcgtgagacacttttgaagtttaagaataatctcaatgatccttcaaataggctttggtcttggaatcataatcataccaactgttgccactggtatggagtcctctgccacaacgtcacttcccatcttcttcagcttcacctcaactcttcaccttctgctttcgatgactggggagcttataggagattccagtttcgtggagagataagtccttgtttggctgatttaaagcatttgaattacttggacttgagcggcaattatttccttggaaaaggtatgtcaattccttctttccttgggacaatgacttccttgacttacctcgacctctctcttactggattcatggggaagattccatctcagattgggaatctctccaatttggtctatcttgacctcggaagttatttgtccgagcctctgtttgctgaaaatgtagaatggctatcaagtatgtggaagcttgaatatctttatttgactaatgcaaacctatccaaagcatttcattggctatacactctccaatctcttccttctttgacccacctatatttgtcagactgcaaactccctcactataatgaaccatccttgctcaacttctcatctctgcaaactctccatctttccttcactagttattcccctgccatttcttttgtccccaagtggatattcaaattgaagaaacttgtttctctcaaattatggggtaataaattccaaggtcggattcctggtggtattcgaaacctcacacttcttcaaaatctttactggtctggaaattcattttcatcttctatacctgattgcttatatggtcttcatcgtctcaagttcctgaacctaagggccaactacttgcatgggactatttctgatgccctgggaaatttgacttctcttgttaaacttgatttgtcatacaatcaacttgaaggaaacattccaacttctttgggaaatttgacttctcttgttgaacttgatttgtcatatagtcaacttgaaggaaacattccaacttcattgggaaatttgacttctcttgttgaacttgatttatcaggtaatcaacttgaaggaaacattccaacttctttgggaaatttgacttctcttgttgaacttgatttatcaggtaatcaacttgaaggaaacattccaacttctttgggaaatttgacttctcttgttgaacttgatttgtcatatagtcaacttgaaggaaccattccaacttctttgggtaatctctgcaacttaagggtgatagatttatcatatctcaaactcaaccaacaggttaatgaacttttagaaattctagctccttgtatttcccatgaactcacaaatcttgcagttcagagttcacgactttcaggcaatctgacagatcatgttggggcatttaaaaatattgagcggctagatttttccaacaacttaattggtggtgctcttcctaaatcatttggaaaactttcatcattaagatatctcgatctgtctattaataagttcagtggaaatccatttgaaagtcttggatcactctctaaattgtcatctcttcatattgatggcaatctttttcacagagttgtcaaggaagatgatcttgcaaatcttacaagcttgacggagtttggtgcatcggggaacaatttcactttaaaagtgggtcccaattggattcccaattttcaacttacctatttggaagtgacatcatggccgttaggtcccagctttccattgtggattcagtcacaaaacaaacttgaatatgttggactatctaacacggggattttcgattctatttccacacagatgtgggaagcactttctcaggttttgtatttaaacctctctcgtaatcatatccatggtgagattgggactacattaaagaatccaatatctatcccaactattgatctaagctcaaatcacttgtgtggtaaattaccctatctttcaagtaatgtgcttcagttggatctttcaagcaattcattctccgaatccatgaatgactttttatgtaacgatcaggacgagccaatgcaattagaatttctgaatcttgcatcaaataatttgtcaggagagatacctgattgctggatggattggacatctcttgtggatgtaaatttacaaagcaaccattttgttgggaacttaccccaatccatgggttccttggcagagctgcagtctttacaaattcataacaacacactctcaggaatatttccaaccagtttgaagaagaataaccaattgatatccttggaccttggggcaaataatctttcaggaactattccaacatgggttggagaaaacctcttaaatttgaaaatcctccgccttcgatcaaacagatttgccagccacattccaagtgaaatatgtcagatgagtcatcttcaggttttagaccttgcagaaaacaatctgtctggcaatataccgagctgtttcagtaacttgagtgccatggcactaaagaaccaaagtacagatcctcgtatctattctcaagcacaatatggtaggcgttactcttccacgcaaagtatagttagtgtgctactatggctgaaaggaagaagagatgagtacagaaacattctgggtttggtaacaagcattgatctgtcaagtaacaagttattaggggaaataccaagagaaatcacatatctaaatggattgaattttttaaacttgtcccacaaccaatttattggtcatatcccacaaggtataggtaatatgagatcattacagtccattgatttttcgaggaatcaactttctggtgaaatccctccaaccattgcaaatttgagctttctgagcatgctagacttgtcttacaatcatttgaagggaaaaattccaacaggaactcaattgcaaacctttaatgcctccagctttatcggcaacaatctatgtggtccaccactgcccgtaaactgcagctccaatgggaaaacccatagttatgaaggaagtgatgggcatggagtgaattggttttttgtcagtatgacaattggatttattgtgggattctggatagtgattgctcctttgctgatttgtagatcatggcggtatggtggctgcagaacctgtgcactctcttcaatttctccacaaccttttgatgatgtagatctctcagatgaacctgccgttgctccattcccgcaatactaa

SEQ ID NO: 5930 - DNA, 2856 bp, Glycine max
  Peptide Sequence Number=SeqID_122708
atgaattcctccatttatattcttgtctttgtccagctttggttgttcagcttaccatgcagagagagtgtgtgcatcccaagtgagcgtgagacacttttgaagtttaagaataatctcaatgattcttcaaataggctttggtcttggaatcataatcataccaactgttgccactggtatggagtcctctgccacaacgtcacttcccatcttcttcagcttcacctcaacacttcaccttctgctttctatgatggcaactttcacttcgattgggaagcttaccagagatggagctttggtggagagataagtccttgtttggctgatttaaagcatttgaatcacttgaacttgagcggcaattatttccttggagcaggtatgtcaattccttctttccttgggacaatgacttccttgactcacctcgacctctctcttactggattctatgggaagattcctcctcagattgggaatctctccaatttggtctatcttgacctcggaaattatttttccgaacctctgtttgctgaaaatgtagaatgggtatcaagtatgtggaagcttgaatatctttatttgagttatgcaaacctatccaaagcatttcattggctacacactctccaatctcttccttctttgacccacctatctttgtcaggatgcacactccctcactataatgaaccatccttgctcaacttctcatctctgcaaactctccatctttccttcactagttattcccctgccatttcttttgtccccaagtggatattcaaattgaagaaacttgtttctcttcaattatggagtaataaattccaaggttcgattccttgtggtatccgaaacctcacacttcttcaaaatcttgacttgtctggaaattcattctcatcttctatacctgattgcttatacggtcttcatcgtctcaagtctttggaaattcattccagcaacttgcatgggactatttctgatgccctgggaaatttgacttctcttgttgaacttgatttgtcatacaatcaacttgaaggaaccattccaacttctttgggaaatttgacttctcttgttgcactttatttgaaatataatcaacttgaaggaacaattccgacttttttgggaaatctccgcaactcaagggagatagatttaacaattctcaatctctctattaataaattcagtggaaatccatttgaaagtcttggatcactctctaaattgtcatctctttggattgatggcaataattttcaaggagttgtcaaggaagatgatcttgcaaatcttacaagcttgacggattttggtgcatcgggaaacaatttcactttaaaagtgggtcccaattggattcctaattttcaacttacctatttggaagtgacatcatggcagttaggtcccagctttccattgtggattcagtcacaaaaccaacttcaatatgttggactatctaacacggggattttagattctattcccacttggttctgggaagcacattctcaggttttgtatttaaacctctctcataatcatatccatggtgagcttgtgactacaataaaaaatccaatatctatccaaactgttgatctaagcacaaatcacttatgtggtaaattaccctatctttcaaatgatgtgtatgacttagacctttcaaccaattcattctctgaatccatgcaagattttttatgtaacaatcaggacaagccaatgcaattagaatttctcaatcttgcatcaaataatctgtcaggagaaatacctgattgttggattaattggccatttctagtggaagtgaatttacaaagcaaccattttgttgggaacttccccccatccatgggttccttggctgagctgcagtcattagaaattcgtaacaacttgctctcgggaatatttcctaccagtttgaagaagactagccaattgatatccttggatctaggagaaaataatctttcaggatgtattccaacatgggttggagaaaagctctcaaatatgaaaatcctccgccttcgatcaaacagtttttccggtcacattccaaatgaaatatgtcagatgagtcttcttcaggttttagaccttgcaaaaaatagtttgtctggcaatatacccagctgtttccgtaacttgagtgccatgacactagtgaaccggagtacatatccccttatctattctcaagcaccaaatgatacacgatacttttcggtatcaggtatagttagtgtgctactatggctaaaaggaagaggagatgagtatggaaacattctgggtttggtaacaagtattgatctgtcaagtaacaaattattaggagaaattcctagagaaatcacagatctaaatggattgaactttttgaacttgtcccacaaccaattgattggtcctattccagaaggtattggtaatatgggatcgttacaaaccattgatttttcgaggaatcaaatttctggtgaaattcctccaaccatttctaatttgagctttctgagcatgctagacgtgtcttataatcatttgaagggaaaaattccaacaggaacacaattgcaaacctttgatgcctccagctttattggcaacaatctatgtggtccaccactgcccataaactgcagctccaatgggaaaactcatagttatgaaggaagtcatgggcatggagtgaattggttttttgttagtgcgacaattggatttgttgtgggactttggatagtgattgctcctttgctgatttgtagatcatggcggcatgcctattttcatttccttgatcat

SEQ ID NO: 5931 - DNA, 726 bp, Glycine max
  Peptide Sequence Number=SeqID_122709
atgtgggacagaattagttcactgtacaaacaagagaagagaactgaccatgctgctgctcctacagaatatggaaaaagtgttgctcagtctctgacagagaaactagctccagtttctggaaaagttgctggtgcaggaagtggtgtgaagtccaaagtttctggaactcaaactagtagtatgggtgtggaacaggacaagggggtttctgtgaaggactatttggtggacaaactgaggcctggtgatgaagacagggctctctctgaagtgatatcagagactctgcacaagaaggaactgcccccagtggaagttactgaagaaggtgtgagaaaggtggtttctgatgctgtgcataagagagaggatgatcctgagagaagaatggaacatcaaagaatactgggaaaggtaactgagtcagaggaagtgaagagaaggttaggaggtgaaagtgtggtgacagagaaaaagaaccaagagatgtatgtgaatagtccagggaaaggtgtggttgataagcttaaaggtgtggttgggacatggtttaccaacccagcagagaatcaatcttcacaagcaaagtgccacattaattttgaatttgtgtttgcatgggtcgaagattcatctatgaactatgaggcaggaagggcagaagtggaacaagttaaccaaggtgcagcaggtgaaagaaggctgcaggagtcatctaattga

SEQ ID NO: 5932 - DNA, 380 bp, Glycine max
  Peptide Sequence Number=SeqID_122710
gtcctgacagaaggatcttcttgcctgagggtctcttggaccgatctgagatccccgagtacttgaccggagaagtgcctggagattatggttatgatccgtttggtcttagcaagaagccagaggacttcgccaagtaccaggcgtttgagttgattcatgccagatgggcaatgcttggtgctgctggattcatcattcctgaggcctttaacaaatacggagctaactgtggtcctgaggctgtttggttcaagcctgctaggagcacttctgtgatcagttgcaaaacaggagccttattctcccatgagcagaacaactccaatttacttgagttcatgccatggacaaataccattctattgacttcagattga

SEQ ID NO: 5933 - DNA, 117 bp, Glycine max
  Peptide Sequence Number=SeqID_122711
atgtgtaatccaatgcaacaatgtgattggatttaccctcacacgtggaagatgatggagcttacgtgtgctgctcctgggcgtcttatctcatatctaatggacttactagtttaa

SEQ ID NO: 5934 - DNA, 633 bp, Glycine max
  Peptide Sequence Number=SeqID_122712
atgtcagttaccttcaatgatcagttgatcacctattcacctagtgcaattgacacaaagaacattctttttatatgtggtggagcatttattaatcttgagaaaaccatttcagagagacgacaagattcttcaattggttttggagcacctgtccgttccaatatgagagctggtggaattacaaatgctgcagtcacatcatctttacttgagtcggtcctcatagaaccaaaaaatgctcttgctaagcagtacaagaaattatttaacacgaataatgtaaagctacacttcacagagaaagctcatagattgattgcaaagaaggcaatggccaaaaaaactggtgcgaggggtttaagagcactactggaaagcattttaaccgaagctatgtatgagattccagatgttaaagcaggagatgaactgattgatgcagttgttgttgatgaggagtcagtaggatcagtaaatgcccctggttgtggaggaaaaattctttgtggagatggtgctttggaactgtacctggctaagattgagggttcagtggttaacggggacgtagctgagccagacttacaagaaggggaatcagaaatttcatcaagagccgtgagcatgtaa

SEQ ID NO: 5935 - DNA, 1567 bp, Glycine max
  Peptide Sequence Number=SeqID_122713
agacttggcttcttgcttggataatcacgatatcaaaaactttaccacgctcccttacaaagaacatgatcattcctctgcctataattactacaaaattctcaatttttccatccaaaaccttcggttcgcagaacccgtgattcctaagccgatagccattgtactgccagagagtttggagcagctgcagaaaagtgtagcatgctgtagagaaggcttcatggaaataagagtaagatgtggtggacacagctatgaagggacttcatatgttgctgatgatggcactccttttgtcatcattgacatgatgaatttgaaccatgtttgggtggacatggagacagaaacagcatgggttgaaggtggtgcaacattgggagagacttactatgcaatctctcaggcaagcaatgaacatggattctcaggtgggtcatgtccaactgttggagttggaggacacattggtggtggtggatttggaattttgtctagaaagtatggtctcgcggcagataacgtggtggatgcccttctagtcaatgctgacggaaaattgttcgaccgcgaaaccatgggagaagatgtgttttgggccattagaggaggaggaggtggtctttgggggatcatttatgcctggaaaatcaaggtgttgaaattgcctcaagttgtaactagtttcactgtatcaagaactggcacaaaaaggcatgttgccaatctagtgcacaaatggcaaaatgtagcaccaaacttggaagatgacttctacttgtcatgctttgttggtgctggcttgcctcaagctaaaaccaaagggttatcaacaacatttaacggcttctatctcggtcctagggccggtgccatatccatcctagaccatgcctttcctgagttgggtattgtagaagaagaatgcatagaaatgagttggattcagtcaactgttttcttctctggcctaagtgatggagcctcggtctctgacttgaacaacaggtatctgcaagaaaaacaatatttcaaggctaaatcagattatgtaaagaaacatgttcctcttgtgggcatagaaactgcactagacatcctagaaaaggagcctaagggatatgttattttggacccttatggtggaaagatgcataatataagcagtgaatctattgcttttccccacagaagaggaaacttgtttacaattcagtatctgatatattggaaagaagctgacaatgacaaaaacagtgattatgttgattggataagagggttctatgctgctatgactccctttgtctcatggggtccaagggctgcgtatgttaattacatggactttgaccttggagtgatggagcggattagcaatggtgctaatatgaaagatgttgtggaacatgcaagggtttggggtgaaaagtacttcttgagtaactatgacaggttggtgagggccaagactctgattgatcctaacaatgttttcaccaatgaccagggcattcctcccatatctttgaccatttctgatgtcaaaccacagagcaaataa

SEQ ID NO: 5936 - DNA, 258 bp, Glycine max
  Peptide Sequence Number=SeqID_122714
atgaagaagaatgtcttctccagcctctcagccctatttctctatgtttttcatgaagcaaatgcttggctagcctctggttgtggtgctcatgcccttttgtttccaccaatctcagttttggacatgctaagcgtgagaagagacaatgtcctcgctgagcgggctggctgtgcgctgagcgtgctgatctctgacttatcatcttctgaggttttgcatccgttaagcgagctgactgcctcgctaagcggatga

SEQ ID NO: 5937 - DNA, 336 bp, Glycine max
  Peptide Sequence Number=SeqID_122715
atggctccaaagaaccttctctctaagagggcaaggaaggaggccactgaagaagggtccagtgcggccccacaagaggatatggaatttgatggacaccggttccgaagtgaggaacaccaatgctattttgaagcaatcaagagttggtctttcctcaaggagagacaggtccagttgagaaagggagcatatgctgagttccaggaggaaattgccaggaggcaatggactcaactcgcaggtcccatggctaagtatgatccggaaatagtcatggagttctacgctaatgcatggcccacggaggaaggagtgagggataagcgctcctag

SEQ ID NO: 5938 - DNA, 300 bp, Glycine max
  Peptide Sequence Number=SeqID_122716
atggctttacatgtgctaacatcatttcacaactcaaacttcaccacaacacatgcaaaagtcattgaggcatttcatcgaacagttggtggacgcatgttcaagcatgagatgaaagaaaatgcgaaaaatgaaagcgaaagtgcacaatggaggcttggggctgctgccaagggtgacccccgctctgaaatcgcgccgtcaagcttagcaccactatcgcgcttagcgcgagtaaatggatttggacttggcgccaatgttgcactgagcctagcaagagatggacgactcgcttag

SEQ ID NO: 5939 - DNA, 294 bp, Glycine max
  Peptide Sequence Number=SeqID_122717
atggccttcatcattctcagattcatgcattcattccataaattagagattcatgcaaaagtcattacccaatatccaacaccggtgcaattggtggatcctgaacaatgggctgatcaggcatcgatgctggtgcagatggttgtggatcatcaagaattggagctggagatgactaaggaatgggctttggagggatgggctcgttctcctctggcacaggctcctgggctgcggaggcctcaccccctcccaaaggagaaggctggactcctggccaggccacctaactga

SEQ ID NO: 5940 - DNA, 243 bp, Glycine max
  Peptide Sequence Number=SeqID_122718
gcggccaaccatcggctgcacgtgcagactcatgactgtctttaccagctgagccttagcctgcagagccagggttttacttcttttccatgccctactctggatcagttcagggcagaggtcgcttggcccggagattggccggaggcaccaacagaggctcccgacgaggcagatgaggcccgcgaggacgaggagatgaccgatttccttgatttcttgggagggagcagagccacatga

SEQ ID NO: 5941 - DNA, 716 bp, Glycine max
  Peptide Sequence Number=SeqID_122719
caggggtgccaatagcagaaatcaagtgggctgcacgaagagccgcgcttagcgcgagacctcgcgctaagcgcccagcgcctcattttcatttctttttctacgccctcacacttcctgcactcctcctctctgcatcttcttaccttcatcgttctcttgggaagcgtccaactgggacacttcccgcttcacatctgagattgcctggcacaggtaccaaagacaacattcagctccggaacatccttccggagaggaatgttgaactaagacttgggatgtttgacgagttcctccaggaactcaggaggcgcagatgggaccaggtgctgactcaccttccggagaagcggattgacgtggctctggtgaaagagttctattcgaacctttatgatccagaggaccacagtccacgattctgcagggtgcgaggacaggtcgttcgttttgatgctgacaccattaacgacttcctcgacaccccggttattttcgaggacggggaggagtatacagcatacaccagatacctcagcactcaccccgatcctgacaccatcgcagccacactgtgcactccaggggggcgatttgtccttaatgcagatggtctcccctggaagctcctgaggaaggacatgacgacacttgctcagacatggagtgtcctttcatattacgatcttgcgcccacttctcacacttcagat

SEQ ID NO: 5942 - DNA, 528 bp, Glycine max
  Peptide Sequence Number=SeqID_122720
tggtggtggtggtggtggtggtgatgtcaatgacgacatagtggtggtagtggtaattgtggtggcaatcggtgacgacaatgttggtaatggtgacattagtggtggtaacgatgatagaggttgtattagtggtggttgtcacaatgttgatggtgatggtggtggtagtgacagtgtggtggtggttgtggcaacgttggtggtggtggtggtggtggtgatggtgacaatgacgatagcggtggcgatggtggtggtgggtagcaatgccaatgatgatggtaatttcaatggcgatgatggtgacaatgacgataacggtggcgatgacattgatggtggtgggggtggtcgtcgtagcaatgttaatgatgatggtcatgacaatgacaatggtgtcaattatgatgatgacaaccatggtggtggtgacagtagtgttggtgatggtgatgatgaaagtggtattgatagtggtggcgatgatagtgatgatggtggtggtagtagtagtgacaacaaaaa

SEQ ID NO: 5943 - DNA, 261 bp, Glycine max
  Peptide Sequence Number=SeqID_122721
atgtcgcgaaacttcatggattgcttaatgatgggtgtcaagttcctcgaagcggtcaagcaaaggttgcatgccatcaaaaaatggtccccaaacgaaattagggcaatcaattcgtggggctccagactcgatggtggaggatgcatgaacgacaatcaattcatgaggctccgaataagatttgatggtggaggatgcacgaacagcgctaggcaatcaattcgtggggctccggactcgatggtggaggatgcatga

SEQ ID NO: 5944 - DNA, 663 bp, Glycine max
  Peptide Sequence Number=SeqID_122722
atgggtgaagtagaggaggtacaagaacagatcaagattgacatggaggccatgaaagagcaaatggccacaataatggaggccatgatgagcatgaagaagataatggaggtcaatgcggctgcaatagccactaccagcaccattgctgaggtggacctgacctccccatctggcctcaaccaaatgaatcatccaacctcagatatggtttgtctgggaggcaaagagttggaagatccgggcggccctcatttggtgcgaaaaaacaagcatgccttcctaccatatggcttgcctcccaactatacgccacccaatatggcgtacaatcccaatgagaatgtcaataactccactcctatactcattgaaaaccaacaacctcaatctgatcatgcacatgtctctcgacccatgggggagacacatgaaatgccccaccacaatctagccgacttcgagtctcgcctcggatatgccgctaaagggcaaacagttggtgatatactcttgcaaaacactttggagggccctcagtatcacccacaaccacacctcttgcattccacagcgggtaaaaaccctcatgctatggcagaaatgggaaagttggatcatctagagaaaagtgatgtgccattatttcctcctatttcttaa

SEQ ID NO: 5945 - DNA, 381 bp, Glycine max
  Peptide Sequence Number=SeqID_122723
atgtcaaatcgagcttcttcagagaaatatagaacgaagaggacgctctacatggagcagttggaaaagctaacaagagctctctcgctacaaacctccaacactcgtcaacaatttgaagagactaaaaatttgcaacaaacattgctggttgagcaacatcaattgaaattacaaatagcagcttttgaaaaggacaagatagctaaagaagagagctcaaacttgttctacttctcagatgaaatcagaaagaacattgcagaagtgaataggctgagagaactccaaattaatcaattgcaagctaatcaacatgcaatgcctaattcggatggtggttcgaatgcaattgatgcacaactcgatctcaacctctag

SEQ ID NO: 5946 - DNA, 408 bp, Glycine max
  Peptide Sequence Number=SeqID_122724
atgccctgtctgacaaaagaactgcgaaatatgggagaagctgcaaagaagatctgccttgcttcactgaaaaatcaatcatgccatgtaggggaaggatcctttagtagccctagtactgatgctaaagggagaaacaaccctgagttggatctcacacttggcatatctaccactcattctgcacaaacaagtgacaaccataaccatacttctgatcaagttgagaagaatctcatcaagggtagccctacaactcctggtgccggtgtcaatttcaacattaaccaagtttatgaaagacaattaagtataccaggcttggaactcaagttagccaccgaaaaggaggatataaaaaagctaaaccggtatattttaaaattatttagtcttaaacatgtttag

SEQ ID NO: 5947 - DNA, 1281 bp, Glycine max
  Peptide Sequence Number=SeqID_122725
tctgatcgcactaggttcaactcgtatgatgaggatctattgacccttgtagagagggtcgacaaagcatttttggagcagctatcagtttcactggatgcgcgggccattttgtcgcttcctttggagaacgatcctttcgctgccttgaatagtattatgggtgactttgcttggaggccacatgtgaagctggtcggacctacaggtaggactatgccattgtctgctactgctctagctactggagagaagggtcaacctattggtgagagggatgatgctgctgtgccatctggccacaagaagtcaaaggcccctatcagtcttcgtgtcctgaggcgggttgtagggttaatgacttctgcaagttgccttttgatcgagcaagaggtgcctccggctccaccagccattgaggctcatgctactgttgaaactgttaatcctgttatccctgctttttcacctcgtcctattgctgatgttgtccaggaggttgctcctactactactgaagttattgtgccaaccactcaagttggttctgccatccattgtcgtgactcctttattaagtgccaaatgcaagtgactctacctgggtgtttctccaaaggaatttggttattcttgaggagaatggactgtagcaccaagaggctatgcaaaagggggcatctttggaggtggaggttgccaagtggagggctactgctcggattctttggtgagtggagtgccctaaggtggccaatgccactatttcctttgctgaggctgtggtcgctcagactctttggtgagtggagcaccctaatgtggccaatgcttcactcaccttccaaggttggtggtgcattggccaagttgttgcacacccgattagatggtgatgacttgtttagacactgcaaggacttgcaggctaaaaagatggagctggatggcaaagtggagagcatggcggctgagaaggacaggcctgtcaagaggattgttgagttagaggcccgactaaaggagttaaagtctaggttgtggagtagcatgagaaaggctgttaggcaggtcagtttctttgcgaaggaccttgacttaggtctcttcgaccccttcaaggatgtgaatgaaggtgtcctgcttgatgaggaggaggaggctgttgatgaaaggaagcaagaccttgatgtagcagtaggatcgtggtggtcttgtaaaaaatggaatgatgcggagtcatctcagcaaaagtactcccttgatggttataaggattga

SEQ ID NO: 5948 - DNA, 162 bp, Glycine max
  Peptide Sequence Number=SeqID_122726
atggctcatggtggccatcggtggtcgtgggtggtggagaagaagatctcacttagcgaggttgtcttgctaaaagggagtctaattttagcacttagcatgacaatttgtgcggagcgcaactcgccttgtgctaagcgcaacaattctcgctcagcgtaa

SEQ ID NO: 5949 - DNA, 684 bp, Glycine max
  Peptide Sequence Number=SeqID_122727
atgggtcaacttcaacggcaagccttctgcaaagcctatggtaagatttgggacctagctagggtagaagtctccacagagtccattgcctcccttgcccagtattatgatcatccgttgaggtgcttcacttttggggacttccaactatcacttattgtggaagaattcgaagaaatcctaggatgtcctctagggggaaggaaaccatacctcttctcagggttctacccctcattagccaggatttctaaaaaaagtccaaatctcggcgcaggaattagaccgccaaaggcaagtcgaaaatggggtggtcggaataccgagaaaatatttggagcgatcgacgtttttctcgcctatcataaccacaaggaaagtccggttgtcgctatgctagccgacctatatgacaccttcgaccgaagatgtgaagaaagcaatgcaaggattgtttgctgtactccagctctttatgtggggctggtttcacacctttttctccaagaaggtaggcccgtctatccgctacaaggttaccgctcgtgcgtcgaaaaaggaaaggcgaattgggaccaactcttggctagcatgggggggcgtctgttaattggttccctcgctagaaggaaggaaaaatcaagattctatcttcatgcgaaggatgtccaaatgttcccttga

SEQ ID NO: 5950 - DNA, 312 bp, Glycine max
  Peptide Sequence Number=SeqID_122728
atgacacttccctttgccgttgcacccaatcgtctctgcccagcagagaagaattccgcacgtgcggatgaccataaggtatctccgcccatcacccgactcgctgtccctggattacaaaaggtgcagaatgaccataatttgtctctgcgtgccaacgggctcgcttgcctctggttgacaaaaagctgtgcggatgaccataatttgtctccacgtgccatcagactcgatcgtctctggatggcgaaaaggtgtgcggatgaccataatttgtctgcgcatgtcatcgggctcgccgcctctggatga

SEQ ID NO: 5951 - DNA, 207 bp, Glycine max
  Peptide Sequence Number=SeqID_122729
atgcttactacctcaaaagattggaaggttgtttctaatgactcctccgtggcttccacatatggcatagaggtcgggcaacttaccaagatgtcttcctcccccgacacaataaccaaatgccctccatcaagtggatccacgggcgtcccaaaagacagctgtatggggcgcctatttgtacagggaggtcgatctctcccctaa

SEQ ID NO: 5952 - DNA, 237 bp, Glycine max
  Peptide Sequence Number=SeqID_122730
atgaagctaatcttgatgatttttagcaacttgttgagtgagggacatcctgctcttattgttcgacatcgaccatttcctgtcacgcatcaagctgcagagaggtggttacatcacatgcaacatgcattagacagtactacagatatagatgatgactcaaagaccaaaatgatgactttttcaggtttattttctaccccaaggtcccacttcacggaaaatggttgttcatga

SEQ ID NO: 5953 - DNA, 193 bp, Glycine max
  Peptide Sequence Number=SeqID_122731
ccgatgtctttatgcgcaagctcttcatttctctatcctctcccgagctcaattgcatcgacccttctctatcccacttcgaatcgtacgggaaagaagaggttgatgagaacctagcgacacctaagcaagttagaggttctagactacaagctgtagttcccaacaggagtgggaccttaatagatgagag

SEQ ID NO: 5954 - DNA, 249 bp, Glycine max
  Peptide Sequence Number=SeqID_122732
atgggggtgcagaaagtagaaggagggggtgcagttatgaagaaggggggtgcagaaagtagaaggaaggggggtgcaattatgaggaagaggggtgcagaaagtaaagtagaagggggtgaagagagtagaagtgggggtgtaaagagaaaagcacgaaggctggtggccctaaggcccagccccgcgcttggcgccaccctgcacgctgttgctggcacgcacttagcgcctagagtgggcgcttag

SEQ ID NO: 5955 - DNA, 397 bp, Glycine max
  Peptide Sequence Number=SeqID_122733
gtcgactctagaggatcccaccagtcccctttctagcctggtaatcgattacacccccttggtaatcgattaccagaagccctcatggcttcctgacctcgttttcaagcctggtaatcgattacaccccgtggagctcgcctgtttaggtacatcacaggttctcactgaccgactatgcccgggttgggtcgggattggtcaagcttggttttgggcaatagcaccccacctgacgtccccaaggtctcctgacccccacgacatatctccaggtaccactctgtggtggcggtcgggcgatggtgcacaacaagttttccacatccagaaagcgcgcataaacccaccatcccctgttgcccacctccaactgagctcacgtactcccacgtag

SEQ ID NO: 5956 - DNA, 204 bp, Glycine max
  Peptide Sequence Number=SeqID_122734
atggagaagagagcgcgaaagggttcacagagaagaagaaagcgcgagagggtaaacggagaagaagggagcgcgagcgaaataggtcgagtcaaatataatttaaaattagagcaacaaaacgaaactttacaatggttagaggcacatgcagcccatttgaacaaaaacatgggaatggtgtatgagttcaaaccgacgtga

SEQ ID NO: 5957 - DNA, 607 bp, Glycine max
  Peptide Sequence Number=SeqID_122735
atgacctccttgactcacctcgacctctctcttactggattgatggggaagattccatctcagattgggaatctctcaaatttggtctaccttgacctcggaggttattctactgatctcaaacctcctctgtttgctgaaaatttggtgtatcttgacctgagttcagaagttgccaacggaacagtaccctctcagatcgggaatctctctaagcttcgatatcttgacttgagcttcaatagattccttggagaaggtatggcaattccttctttccttgggacaatgacttccttgactcacctcgacctctcttttactggattccgtgggaagattcctcctcagattgggaatctctcaaatttggtgtatcttgacctgagatatgttgccaacggaacagtaccctctcagatcgggaatctctctaagcttcgatatcttgacttgagctacaatgattttgaaggtatggcaattccttctttcctttgtgcaatgacctccttgactcatctcgacctctctcttactgaattctatgggaagattcctcctcagattgggaatctctccaatttggtctaccttgacctcggag

SEQ ID NO: 5958 - DNA, 294 bp, Glycine max
  Peptide Sequence Number=SeqID_122736
atgtcatttatcagtgcacaatcagctgaagtcacctcacatacaacagaccttggacgtgatggtttattggaggaagatgaaaatggagcagagcaaaggatagaatatgtcagaaaatctatctgcaacagttgtgaatgctgggagaatgccgaaaatgaagggacaagtttaaagaagcaagtccaggcaccgactctcaaaaattcaacacttgaagatagagtcacccatctagacaatgcacttaaggagtgtgttaggcagctaagacaaacaaggtgtttataa

SEQ ID NO: 5959 - DNA, 469 bp, Glycine max
  Peptide Sequence Number=SeqID_122737
ttcctgggccaccccctgatattagagggcgaccaattgtgcgagcacatccagagagggaggctatcacgcatctactatgcataccggggcaagatttcacccgtgccgctgcaaaaagacgagtgtggattatgcgcaccaacatgaccacttttacatggatatggatgacgttgctatttagtaacattctgcacaatgaccacaatgccaatctccccctgcagatgtatcgggatcgtgcccacaagacgcccagtgggcccgaagaagtccaacagggccctggggtttccagctctggttacgggcctctgttagtcctacagggtgcccgaatcgcacccataagacacccagtgggcccgaagaagtccaacagggccctggggtttctagctctggttacgggcctctgtagtcctacagggtgcccgttccccccggcaaggtcacgtcatcatag

SEQ ID NO: 5960 - DNA, 270 bp, Glycine max
  Peptide Sequence Number=SeqID_122738
atggagtgtcctaagacaactttgtttgacaggacttatcaccaatgtttgatcaatgtgttcaaagtgccacttgcaattgattcaaggagttttgatgataacaaagatgatgacaaaaagctcaaaagtcaagatcacttcatgataacaaagataatgacactcaagaatgagttcaagattgagtcaagaacacttcaaagatcaagaggaaatttgatttcaagaatcaagaatcaatattcaagattcaagattcaagaataa

SEQ ID NO: 5961 - DNA, 171 bp, Glycine max
  Peptide Sequence Number=SeqID_122739
atgacatttactctaccctccctactgccagctcaatggatcatggcttctccacttgcctcgcctcctcttcctcctccttctccttctcctcctcctcctcctcctcctttcgacacatcagcttcgccacctaccatgaagcggacatgcaaagcctcacgtctatga

SEQ ID NO: 5962 - DNA, 186 bp, Glycine max
  Peptide Sequence Number=SeqID_122740
atggagaacaatggtggtttgtggtggctaaaggtggctaaacgtcgcgcacactccaaacatcttctctacgatcccaacggtcagaccgtggacaagtgtcttgtgaagctgcaaaccaaatttcgagaagatccaacggttaacgaagtctgggaagcgtttttaccgaggcagctcatgtag

SEQ ID NO: 5963 - DNA, 435 bp, Glycine max
  Peptide Sequence Number=SeqID_122741
atgagagacattgatattcaagcaagctttaatagcacgaagagaaaggttgtatttgaagtacaagatgaaagctttgagaatgatatagatagggaaacggaagaatttgaaaggatgaaagttgaaaggcacaggctggggaagagaaagtggaacagaagttttgaagttgcactttctgcatctgaaacgaacgaaataacggcggattttgtaaatttccatgacatggttacaatgaacacaacgagggtaagggaaagaaaaaagtttgtgttttttggtgaaagaaagtttaaaataacgcttgcaatctttgcaaaagaagatttggtttttgaacttatcatgaccgtttttgatgaagttagaagagccacaatgagggcatttgagttggacattaaccatatcgggatacctccttattga

SEQ ID NO: 5964 - DNA, 134 bp, Glycine max
  Peptide Sequence Number=SeqID_122742
tgggctcatacttagctcatgagctcaaaatctacgctaaggttgatgtaaaccctagggccttcttctgcatctctggccgagtcttcttagagtctcctagccatggctctagtgatgggtcccctccttag

SEQ ID NO: 5965 - DNA, 298 bp, Glycine max
  Peptide Sequence Number=SeqID_122743
tgcattgaagacactaaacagtactttaatcggtaaatctgaacaacctacacctcactgggtagaagtaaagagtcatgttcaaacgggaggctataactgtgactattatgtcatgcattggatgtcgaacatagtctgcggcaatttgacaaacgaatggatgaaggataatcatgtggaaacaaatggtgcattccaaggaaaggcaaaattgctctttgctcatgctggagacaaatgggatgttgagttttatgcaaaagtcaatgatgatgtctatgtaaatattggttag

SEQ ID NO: 5966 - DNA, 771 bp, Glycine max
  Peptide Sequence Number=SeqID_122744
atggcgcaagatgaaaagaaagacatgcagaacatgaaaatcgtgaatcgcaagaaagagagagttcatcagagagagcaattaacaactgataccatcacttctcctgacaatgaatcagtaaagtgtgagtgtattccaagttatatcccattggataatcaagatgtgtccaaagagtgtcacccaccaactacaatcatttattgtgtagagaagaacttcaagctagagtctgtaatggatgattgtaatatcgttgctataacttataacgcttccacctttacatgtgccaagaaaaggctttccttgttgaatgctagaaatagctcttcttcaaagggacaaaaaccactgcttaaagttccaaacaatgagtatgggacatctaataaagctaccaagaagaacaattttaatgtaaaaaacttttttaaagttatgattgcagttactgacacacttgcatgtttctttggtgcccttgttgttgactatcatcctttcactcagagactagcaagaagaaagcagtatctaaatgcaagcgcaattggaatcaacttcagagagttcaccttccaggagctgcatgaagcaaaagatggattcattaggattcttggaaagggatcttcgggcaaagtctatcagggtactttaacaataaacgacacagagattggtattgcaggagaaaggcctcaatggggtcagaggattgaaatggctattgaagtcacaagaggcttactattacttgcatga

SEQ ID NO: 5967 - DNA, 247 bp, Glycine max
  Peptide Sequence Number=SeqID_122745
atggctctcattcctaccctagaagcatcagtctctacaacaaaggagatgagtcaatggggccgctatcgaagcataacctttaatgaatcatcgataaaaaccagacaagcctataaatcctctcaaggccctggtggaacgaggtgtgggccattgttgaatggcttccaccttggttggaacgggctgaacaccattttgggagaccaagtgccccagatattccacttgtctctgagcgaag

SEQ ID NO: 5968 - DNA, 354 bp, Glycine max
  Peptide Sequence Number=SeqID_122746
gtgatatggaccttccggcttcccgtgacaaaagacgagaccaacatattgcggcagtagggactaccaataacaatatgttatcaaatagaaaaactctagatgtgggttcactgttatcaagcaagtcggagactcagcatggccacagattcacctccattccttatgttcccatggacccgggtataggcccccttttcaactcaccgcctaactctctaaaaatagtccccagcggagtcgcctactgtcgcaacctaccctttggcgggaggaaaaaccggaaaggtgtgtgtggtctacggactttgagtgtgaaaggttcgggagttgtatttgcgcacggggaag

SEQ ID NO: 5969 - DNA, 375 bp, Glycine max
  Peptide Sequence Number=SeqID_122747
atggatttgtcttttcttcaaagcccacatgcacagtcttttcttcgtagctcaaaggcacaatatcagatgataaataacacaatgggtgaaggtaatactagtactagagatatgagcaccataaataacacaatgggggaaggtagtactagtactagagatatgagcaccgataaaataaatgttgatttaaatgaatatccaattgaagatatttctttagagaatggttattcaggaacagttagtgaacattttgatcatgatattgtggcaaatgatgtattagaagttgaggaaattgaaacttatgagagagaaaatattgtgtcttctagtcagaatattgagatatatgaatttgcagaagaa

SEQ ID NO: 5970 - DNA, 774 bp, Glycine max
  Peptide Sequence Number=SeqID_122748
atgcaaaatacgctttatcactgggcggccgcagccgtggtcaccgtgtcgctgtcgggtcaggcgctggcggcggagaaaattactgtgttcgctgcggcctcgctcaccaacgcgatgcagcagattgccacgcaatatcagcaaaaaagcggcgttgaagtggtatcctcgttcgcttcctcgtcgacgctggcgcggcaaatcgagcagggcgccccggcggatctgtttatctctgccgatcagcagtggatggacgatgcggtggcgaaaaacagcgtgatcggcagtacgcgctacacgctgctgggcaacgatctggtgctggtggcggcaaaaagcgctaacgcgcagccggtgaccatcaatgcgcagaccccatggcagaacctgcttaagggcgagcgcctggcggtgggcgatccggatcacgtgccggcaggcatttatgccaaagaagcgctgcaaaagctgggcgcgtgggacacgctgtcttcacagctcgcaccggctaacaacgtgcgtgccgcgctggcgctggtggagcgacgcgaaacgccatatggcatcgtgtacgattccgacgcggtagccagtgataaggtgcaggtggtcggacgcttccctgaagcgagtcacaaacccgtagagtacccgatggcggtggtcagcgatcaccagaacgcagcggtgcaggccttctatgactatctgcaggggccggatgccgctgccgtgtttaaacagtatggatttacgccgaagagatga

SEQ ID NO: 5971 - DNA, 539 bp, Glycine max
  Peptide Sequence Number=SeqID_122749
ggaagctaagtgtgaagtatgcaattctgcacaggattggagctgcaaactgggttcccaccaatcatacttccactgttgccacagaatcatttgctgtcaaattacccattgccttccctactgtattgtgtggcattatgttgagtcaacatccaaatattttaaacaacattgactctgtaatgaagagagaatctcctctatccctgcattacaaactgtttgaggggacacatgtcccagacattgtctcgacatcagggaaagctgctgcttcaggtgctgtgtccaaggatgctctgattgctgaactcaaggacacatgcaaggtgctggaagcaaccatcaaagcctccacagagaagaaaatggagctggagctactgatcaaaaggctctcagagagtggcattgatgatgaagaagcagctgaggaagaaggagaagcagctgaagaagaagaagaagctgctgaggaagaggaagatgcagcagaagagacagaatcagatgatgattctgaagccaccccatga

SEQ ID NO: 5972 - DNA, 1156 bp, Glycine max
  Peptide Sequence Number=SeqID_122750
atgcgtattattctgcttggcgctccgggcgcgggtaaaggaactcaggctcagttcatcatggagaaatacggtattccgcaaatctccaccggtgacatgctgcgcgccgctgtaaaatctggctccgagctgggtaaacaagcgaaagacatcatggacgcaggcaagctggtaaccgacgagctggttattgcgctggtcaaagagcgcattgctcaggaagattgccgtaacggcttcctgctggacggcttcccacgcaccattcctcaggctgacgccatgaaagaagcgggcatcaacgtggactacgttctcgagttcgacgtaccggacgagctgatcgttgaccgtatcgttggccgtcgcgtacacgctgcttctggccgcgtttaccacatcaaattcaacccgcctaaggttgaaggtaaagacgacgtgaccggcgaagagctgaccacccgtaaagacgatcaggaagagaccgtgcgtaaacgcctggtggaataccatcagatgaccgcgccgctgatcggctactacaccaaagaagcgcaggcgggtaacaccaaatacgccaaagtcgacggcaccaaagccgtggctgacgcgaaaaccggcatcctgcttgccaatctgggcactccagaagcacctacatcagacgcgactgctgtggtggccgctgctgcgtggcgtgattctgccgattcgttctccgcgcgtcgccaaactctatcagtccgtctggatggaggagggctcgccgctgatggtttacagccgtcgtcaggaaaaagcgctggccgcccgcctgccggatatgcccgtcgcgctcggcatgagctacggaaaaccggtgtagaccatatcgtggtgctggcgctctacccgcaatactcctgctcgacggtggccgccgtctgggacgagctggcgcgcattctggcgacccgtcgccgcattcctggcgtgacctttattcgcgattacgccgataacgatctctacatcagggcgcttgccaacagcgcgcgcgcgtcgtttgaaaagcacggcgagccggatctgctgctgctctcctatcatgggatcccacagcgtttcgccaacgaaggggatgattatccgcagcgctgccgcgataccaccc

SEQ ID NO: 5973 - DNA, 291 bp, Glycine max
  Peptide Sequence Number=SeqID_122751
atgcatagcataggggtcaggaaccctttggaacagccccctctgcctatttatagaaaaaaggaggtggtgcttgccgcccagctcgcccaggcactcccctttttgctaaggttacgggaattttacgaaagcattacggaagccccagaagacatttttcaacaaaacgggggaggaggttgccgcccagctcgcccaggcgagctaggtttcttcctccttaagcaacctagcttccaaaatattctggaaggggccagatttgaaaattgctatttacacccctag

SEQ ID NO: 5974 - DNA, 1221 bp, Glycine max
  Peptide Sequence Number=SeqID_122752
atgcatgaggcagcaactatgcatggttctgttacaaaatcttggactaagcaatctaaacccgaggcttcttctaagccaccattattgcctacacctcctaagactatttccaagacgcaggataccctcaaaacaaaacaacaagcctctaaaactttaacccctgcgtatatgagtgatagaaaggcaaaagtgttatgttatttctgtgatgaatcctttacgcctaagcctggattgagtcataaaacactgaaactgcatgtgatggaagtggatgagttacaggtgggtgcagagaaagaagttttgcttgaaaactcaatggggtccagctctacagatcctcaaatttttgtccatgccctcacgggaattgccaatttccacaccatgcatgtgacaggctactaccaaaagaagcctctccatgtgttgattgacagtgggagatgctgcgatttggtcttgggagtggagtggctggtttccttaggtgatattgtatgggattttaataagttgcagatggagttctttgttaagggaaggagacatgtgttgagaggggcctctactgggttgaaaacagttaagaagaaacaattagggaaggttatgtcaactggtgttcatttgtcaattttgcaagaacctagtgggttacctcctagcagacctggtcatgaccatcaaattccactagttccagcgactggtataattcaaaacaatagtagtccctttgcaagcccaatagttttggtgggtaaaaaggatggatcatggaggttgtgtgtggattacagggatcttaacaagcatacaattaagaacaagttcccaattcctttagtagatgatctattggatgaattggctggttctagaattttctccaaaatcgatttgaggtcaggatataatcaagtgggaatggatcctgatgatgtgtataagactgcttttatgactcatgttgggcattttgaatacttagtgatgccctttggtctcactagtgcacttataacatttcaagggcttatgaactcagtttttaaggagtttttgttggtgttctttgatgacattttgggaggtgtacctatccctgggcccatctggaatattctagagggaggttactttgggtggatgctacctagctcgcctgggcgagctgggcggcaaccagctccctcatttttgctataa

SEQ ID NO: 5975 - DNA, 255 bp, Glycine max
  Peptide Sequence Number=SeqID_122753
atgcatgagcctcaggcaaaactaggggcagatcagaagttctcacctggtcatcaagtttcagcgggatcgatagacccttggcatcactctatgacttgcacataccaaagtatgacaatccattgccatccttcaatggggcacacgatcgatctcaaagccttatgtttccttgctgtgcagaataatagaaggttttcaacagaaagaaagggaaaaaccctaggatcaatatttcaattgattgcgtaa

SEQ ID NO: 5976 - DNA, 237 bp, Glycine max
  Peptide Sequence Number=SeqID_122754
atggagagggagatggtaacaatggtattaaacacgttattggtgttctactatgagaaaatggtgggttacatgccttcaagctttgccgatttagtgttcgctggagaaaggatcgaagtgggtctgagaagaggcaaatttgattatcctgctttgatgaataggaagcctagggaaaatggagagaataagaaggagggaggaacccatgttgtcatttccgttcctacatga

SEQ ID NO: 5977 - DNA, 561 bp, Glycine max
  Peptide Sequence Number=SeqID_122755
atggaacctccaaggaagaacatccccaccataaaaaatgttggagatgcaactcaaatatttcctgaagacttgtttatctcaggaaaatgggtaaacttccaaagcttgaaggaggaaggttttgatgtcaagggactatttgacaaggatgaagtcaacattcaaggagatgttgatgggaccaccattgttgtgtctggatgtgctatggatggtctgaccatgatcaaagactgggagaaggagataacccatgtgctcttcaacatagtcatgccaagagtaggatcaagggactatgttagtgatacagattgcttttgcatgtacaagatcatggtaggggagaagatgaatcttcttgagatcatcttcttctactggatgcaagcgtttaaggaaaagttcagccccaaggtgaagaagaattatattccacaagcaatgctcttcatccaaattctaaggctagttggaatggatgtcttttcattggaaccatcatctggaatcacccagctcaaagtggcaacctttgtgaagatgggaataacttaa

SEQ ID NO: 5978 - DNA, 1869 bp, Glycine max
  Peptide Sequence Number=SeqID_122756
atggatgtatgtgaatcagggaagaacaaagctccagagaccccaagagtaagaccaccctcggttctggcagaaaagaatgcagtcaccatcaccaccacaagacgctcaagaacaagggaaattagttctagatataagtcacctactcctcctgctagcccttctgctcctcctcgtagatgcccttcaccaaatcttacaagaacaacgcctgcatcatcatcatcgtcatcctcccacttgtttccaaagaggtctctctccacagaaaggaagaggccttcaactcctccttccccaacgccacaaagaccttctacgcctgtatctgttgatgggaagttgttgtccagaaggcgtttgccggacggtctatggccttccacaatgcgaagcctaagtgtttctttccagtcagataccatatccatacctgttagcaagaaagagaagccggttgttagtgcttccgaccgctctctgcggccggcttcaaatgtggcacacaagcagcctgaaattccaaccataagaaagcctacgctagagagaaagagaagtccccttaaagggaagaatgcttctgatcagtctgagaattccaaaccagttgatagcagcttgtcttctcggttaatagatcagcatcggtggccaagtagaataggtgggaaggtatcttctaatgtattgaacagaagtgttgattgtgctgatatcagaacgtcaaacacttcggtttcgggaactggtgtttcttcttcactgagaagattttcgttgtctatatcagatgaatccagtaaacccttgcaaagggcatctagtgatgctgtaaggctattgtcgcttgttggaagtggccgaataggaagtgaggtgaaatcagttgatgactgtttgccaccagaattaagacctcacaaatctgttactgcaaagccaacggataaagcaggacttgcatttgcgggagtcagatctcagtccttgtcagctccaggatcacgactgccctcacctagtaggacctcagtgctatcctcttctagttcaagaggtgtcagtccatctaggttaagaccatcaactcctccttctaggggggttagtccatctcgaattagaccaaccaattcatccattcaatcgaacaattcaatttcagtgcttcgctttattgctgattttaaaaaagggaagaagggtgcagccaacatagaagatgctcataaattacgtcttctccacaatagatacttgcaatggaggtttgccaatgcaagagctgaggctgtcctctatatccaaaatgcaattgtggagaaaactctatataatgtatggattactactttgtccctgtgggagtctgttattaggaagaggatcaatcttcagcagctgaagctcgaacttaagctgaattctgtttttaatgatcaaattactttccttgatgattgggctgtactcgaaagagatcatattgatgctgtatctggggctgtggaagacttggaggccagcactcttcgtcttcctgtaactgggggagcaatggcagatattgagcatttgaaggttgctatctgtcaagcagttgatgtcatgcaagcaatgggatctgcaatctgctctttgctctcacaggttgagggcatgaactatttaatttctgaagttgctgtcatagcagtgcaggaaaagaccatgcttgatgaatgtgaagtgctactggcttcagtagcagctatgcaggaaaagtgtttaggaatattggagactttgaatagaaacttgataggaaggagaattctttatggaggagagaactttgtatttttgcttgatacaaatgtgtag

SEQ ID NO: 5979 - DNA, 291 bp, Glycine max
  Peptide Sequence Number=SeqID_122757
atgggtgagagaaactcgcagaaactgcctcgacgtgcagcatttaacattagacgttggttatcgtttaactgcacaataaagttgcagaggaaggaggggttcccttggaaatcggggatactggataagagagaggaattgcgtaaggtaggagtcgcaggtggtaatgttctcggggaaatgggtaaagacatgcagagccttacgattctgccgaaatcaaaggaggaaaaccggtcaccagaggtggagggaggagaggaagaactgccggtcgctggagaatag

SEQ ID NO: 5980 - DNA, 493 bp, Glycine max
  Peptide Sequence Number=SeqID_122758
atggaaggatcatcaggtgtgaggaaaggcgcatggagtcaatttgaagatgaccttctcagagattgcgtgaaccttcatggggaaggaaaatggcaccttgttcctcaaagagcagggttgaacagatgccgcaagagttgtagattaagatggttgaactatctaaaaccaaatatcaagcggggagattttaatgaagatgaggttgatttgatgatcagattgcataagcttttgggaaacagatggtccctaattgctgggagacttccgggaagaacttcaaatgatgttaagaactactggaacgcctacatgcgccgtaaagttcactctcacaacaaagacaacaaaataaagaagcaagagaccaaatcaacagtgaaaccccacgaagtgattaagcctattcctcgagttttaacaaaaacatccccatggttgcaacggaaattcattaatagtcccaaagttggtgttagtgaagaag

SEQ ID NO: 5981 - DNA, 2301 bp, Glycine max
  Peptide Sequence Number=SeqID_122759
atggtgccagaatgggaagaagcatacatggattacaactctctcaaagccactctgaaaaacatgtcaaagtttagagagctaaacgagtcagcaccaatggcatccacaccaaaagggtctctgaagagaaggttaacactctatagagcctttagtggtcttactgatagacaaagagggtctcctaggaagggtgaggatgaagttatacttgttcgtgctgaggagggtgaaggctcagaagggttgtatcagaccatgttcctcaagccttctgaagaaggggcagaacaagatcttgtgtttttcaagaaacttgatcatgagtttaataaggtgaatagcttctacaagaaaatggtgaatggaatggttgaggaggcagaggagttgagtaagcaaatgaatgctctgattgctcttagaataaaggtggacaatgtggggttcagaaatcttggtagcaatgggatctcaacttcattttccatgaatcatgatataaatgatgcaaaaactggtctctcacgtgtgcacatggatgtgattcatgaagttgagatgagcaatggaacgcatttggaaaatggaagtggaaattatgaggaacaaaccacttctaagacttctgttggggcctttagacctgcttcattggagacccttgatcacgtgaagatcaacatgaccacaccagaaactcctttgtcaaccataaaagggcttctctcaagttcaaaatctgaccagtcatttagcaagaaagagctcaggaaagctgaggaacaaataagcatagccttaaaggaattctataataagcttcggcttctaaaaagctatagcttcttaaacttgttggcattctcaaaaatcatgaagaagtatgacaaggttagttcaaggaatgcatcaaaggattacttaaagatggtggacagttcatatgttggaagctcagatgaggtcaataggctcatggaaagggtggaacatgccttcattaagcactttgcaaatgggaatcacagaaagggaatgaacacattgagaccaactgctaagaaggagcggcatagaattacattcttattgggactgtttactggctgctcaattgccctcattgtggcactgattatactaatacatgcaagaaatattctatatagcgagggtcgtactagatatatggacaacatatttcctctttacagtctctttggatacatagtcttgcatatgatcatttactctgcaaatatatacctatggaggcgttataaaatcaacttcccctttatatttggcttcaaggaaggaacagaattgggatacagagaagtctttcttcttagctcaggcctcgcagtactctcattggctgctgtcctctcaaacttggatatggagatggaccagagaacaaaaagtttttcagcattgacagaattagtccctttatgccttgtcattgttctgctgctcataacattttgtcccttcaacatcatatataaatccagccgcttcttccttattcagtgtgcatttcattgtgtttgtgctcctctttacaaggtcaatttcccagaaaatttcttggcagaccagcttaccagccaggtgcaggcctttagaagtttggaattctatgtttgctactatttctggggaaacttcaagaccagatcaaacaactgcctcaaaagtgatgtctacaaagcattttacttaattgtagctattattccattctggatccgttgtcttcagtgctttcgacgcttgcttgaagaaagaaatacaatgcatgggctcaatgggctaaaatacatctcaacagtagtagcacttgtcttgaggactaccaatgagttccaaagaggaatggtttggaaaattctagctgcaacttcttcaggcattgcaacgattgttaatacatattgggatattgtcatagattggggtttgctgagaaggaattcaagaaatccatggttgagagaaaaactctctgtaccaaacaaaaatgtatattttgttgctatggtgttgaatgttatactgcgacttgcatggatgcaatctgttttaggcattagggaaactcctatcctgcatagaacagctttgactgctctagtaacttgcttggagatccttcgccgtggcatatggaattttttcaggttggagaatgagcacttgaacaatgtcggcaactatcgagcattcaaatcagtacccctgccttttaattacgaagatgaggaagagaatacagtcatataa

SEQ ID NO: 5982 - DNA, 423 bp, Glycine max
  Peptide Sequence Number=SeqID_122760
atggcaatggtctctgctgtccaagaagctcagaaggataatctcaagagtttcaatgattatatgatgaaagtattagaggatatctcctttttgggtgaagttaaccttctttgtaatccttatttactctttctgttaaaatttctcattgctgctaacagcaacgtgggtaccctctcgggtcagcttgcatttgtgtcttctacttcacaagtctcttctggtatgcctagcatggagattgttcctctgactggcagacctattgtggagaaaaaggcatctatctatgctgaggctgctcttggtgttggtgttgggaatttgcaaagaatccgtgccttccttcggctaacacagtggattaataaaggaggaatggtaccagaagagattgcagctgccgcatcagaggaatga

SEQ ID NO: 5983 - DNA, 394 bp, Glycine max
  Peptide Sequence Number=SeqID_122761
atggaaggaccatcaggtgtgaggaaaggcgcatggactaaatgtgaagacgaccttctcagagcttgcgtgcaactttatggagaaggaaaatggcaccttgttccccaaagagcagggttgaacagatgccgcaagagtcgtagattgagatggctgaactatctaaaaccaaatattaagaggggagatttgagtgaagatgaggttgacatgatgatcagaatgcataagcttttgggaaacagacttccaagaagaacttcaaatgatgtgaagaattactggaacacctacatgcgccgtaaagtatactctcacaagaaagacaacaacgtagagaagcaagctgaggccaaatcaaacagtgaaacatcacgaagtgataaagcct

SEQ ID NO: 5984 - DNA, 210 bp, Glycine max
  Peptide Sequence Number=SeqID_122762
atgtctcctccacctctagaacctcacaatcactcacaaactcatctcaagctctcaggacggcttcgtcttcaggctccggtctttgcaggtggctttgtttgtgctagcacgctgagcgcaactatggaccgctcaatgcgtattagtggatttcggcttagcgcgtgtttttctcgctcagcggatggactgatgcggtgctcttag

SEQ ID NO: 5985 - DNA, 255 bp, Glycine max
  Peptide Sequence Number=SeqID_122763
acatccccatggttgcaagggaaattttttaatagttccaaagttggtgctagtggagaaggtgcaacttctatatcagggtctgggaattggtgggaaactttgttagatgacaaggaagacaatgaaggtaacattaataacacgtgcttctttggtggggtggagagcttgacctttgggatgaggagcttaatccaattgcttgtgactttcttgctgaaggtgaaaattggagttgacatcaagttctaa

SEQ ID NO: 5986 - DNA, 2256 bp, Glycine max
  Peptide Sequence Number=SeqID_122764
atggcacgtgccacgctctcctcgggccttacatttatcaaagggtacgcagttctggcatcaccattaactaagcttttgagtcaaggccagtttcagtggtcgccggaagccacggaagcatttcaaaagctgaaagatgccatcaccagagctccagtgttagcactaccagacttcaaggtacctttcgttgtggagactgacgcatcaaacacgggtatgggcacggttctatcgcaggggggtcaccccattgcttttttcagtaagcaattttgtccaaggatggccagcgcatccacgtacatccgagagttggcagccataaccgccaccgtcaagaagtggcggcagtatctactgggccacagattcaccatcctaacagatcatagaagcttgagagaactaatgagtcaagcgattcagactcctgaacagcaccgttatctcgtgaggttgctaggattcgattacacgatacaatatcgttccggccaaactaacacagtcgcagatgccttatcgcgagtcaacgaggataaccaggcgtccctctacatgctgaccatgccacgactagtgttcatagaagatttacgtaaagaactcgcacgtacacctgctttcaaagaattatatgaacagattcaagcaaaccctacgaagtatccagatcattcagtaacttcaggcttaatcctgcacaaggggcgtatttggcttccttcaacatcatcattcattaaactactcctcgaagaattccaccaaacaccagtaggcggtcacatgggggtgcaaaagacgttgcaacatcttcaagagaactttaagtgggattcaatgagaacagacgtgcacaacttcattgcaaactgtatcacgtgccaacaaacaaaatatgataatcgtaagcccggagggttgttgtgccccatcccaataccagcgctgccatgggaagacttatcaatggattttattgtagggttgcccgcgtacaagggaaacacatgtatccttgtcattgtcgatcgtttttcgaaatggctacatctgggtatgcttccccctcaccatactgcatacactgttgcattgttgttcatggagattgctagaaagcttcatgggatgcctcgcagcataatttcagaccgtgatcccctctttgtaagcaaattctggaaggaactctttaccatgagtggaacacgccttcgcttaagctctgcgcacccgcagacggatgggcaaacaaaagttgccaaccaaatcatcaaacaatacctgagagcctatgtacatcagaaaccggcgacgtggggtcattatttgatgtgggcagagtggtcctataacacatcatgccattcaacgacatggatgaccccattcgaaataacgtatggccggaaaccaccaagttttccccaatacatcacaggcacctcacgaatagatgtcgttgatgagctactcactcaacgggaagaagtctttgcatccctacggaaaaagttgagcaaagctcaagaacgcatgaaggaaacaacagacaaaggttgtagagatcaggagttcaatgtgggtgactgggtcttggttaagctaagaccccatagacaaacgtcggtggcaggagcgccatatttgaagctagctaaacgatactatggtccatttcggatcctagaccgattgggcaaagtcgcgtacaaactacagttgcctgatcattcgaagatacatccggtgtttcacgtttccttgcttaaagcctacatcgcagcagcagatgccaatcgtagcgcagaactaccaccagaagatgttaacaataaacccatcgtgaagcccttgaccatcatcgcttccaaggttgttccttccgagaccgggccacgacgcatggtgttggtacagtgggtggggctcccaccagaggacgcttcatgggaagactggtctgagtttcaaacacttcatgacctcaaggacaaggtctggtttgaagggcaggggagtgatacgcagcagacgcaaggggtgccattagcagaacaaggggaagacaacaatggaggggtgtctttagcaaggcccaaacggagaatagcgcctccctcttacttagaggactacgtgcatgtttggaaagtgatggggaagagggagaagtcggtggctttgaagttgtggtttaggacgaaggttgtcaggctcactcacgaggacgagatgccttag

SEQ ID NO: 5987 - DNA, 1090 bp, Glycine max
  Peptide Sequence Number=SeqID_122765
atgggaagatcaccatgctgtgacaaggtgggtttgaagaagggaccatggacgccagaggaagatcagaagctcttggcttatattgaagaacatggccatggaagctggcgtgctttgccagcaaaagctggacttcagaggtgtggcaaaagctgcagattgagatggactaattatctaaggcctgatattaagagggggaaattcagtatgcaagaagaacaaaccatcattcaacttcatgctctcttagggaacaggtggtctgcaatagccacacatttaccaaagaggacagataacgagatcaagaactactggaacactcatcttaagaaaaggttagacaaaatgggcattgaccctgtgacccacaagcccaagaacgatgcccttgtctccaccgaaggcccttccaagagtgctgctaacctcagccacatggctcagtgggagagtgccaggctcgaagcagaagcaagactggtcagagaatcaaaactacgtagttcttcacactcatcatcatcattgcaccacaccctaattggtacctctgcagtatcatcatcatcttcttcagctccaatgatacccccatcatcactttctcttgatcatgcatggaacaatggtagtagcattagtactactgttaatgcaactagggttagtgaccttgagtccccaacatctaccttgtctgagaataatgcaccaccaattaatattactagtgttattgagtttgtgggttcttcagagagagggacggtgaaggaagagggagagcaagagtggaacaaattaggttatcatgaaagcttcacccatttgggagaatacaaagatggcaaggagaattcaatgcctttcacgtctagtctgcatgagttgacaatgaccatggcaaccacgtggggttctagcactagtggtgcacatgcacatgcacatgcacatgttgctgaggagggttgtttcaccaatcttttgctgaatgctaactccggtgcccggagtttgtcgccacaggacggtggagagtctaataattgtcacgataatgctcgtaacagtggcagtg

SEQ ID NO: 5988 - DNA, 543 bp, Glycine max
  Peptide Sequence Number=SeqID_122766
atggaagccatattcaagcggtttgaagatgttgatatatgtggcaaagtgactctaaagagtaaaatttgggaacttgcataccctgatctaacttcgatgtgtgttcctcttgaaaaggtgaaaacaaaaggtggtcaaaggaaacatatgaccaaacaacaaagatcaatgaagcgtgatttgtcttactttgagtatatggatgcattacatttggtgcataatagctcctctgcactgaaacggtctgcatcatcatctaaacaatcgcaatcaaagaggaatatgctaatgttgaatctatttcatccatgcatgcaagatttcattaaaaacattattgatgtcaaagatgacggcaattgtggatatcatgtaattgctgccttattaggtttgggtgaagattcgtggtctttagttcacaatcatttgctcaaagaacttgaacaatggtatgatgactatatagtcctatttggtggcgtagatagatatgagcatttcaagcgatccctacttgctaatggattatctatg

SEQ ID NO: 5989 - DNA, 1557 bp, Glycine max
  Peptide Sequence Number=SeqID_122767
atgattagaaaaagaagaggcagaagcaccattacgaacgttggaaccctcaaacagattcacgctttaatgatcgttaacggtttaacttccaacgttggtttcctccgaaaactcgtcctcaccaccgccatgtcaatggtggggcccaatgcaacctccgccgtgatacgatatgcactccaaatgttcgctcaaattccccaaccagacaccttcatgtggaacacatacatcagaggctcttctcagagccatgatccagtgcacgcggttgcactgtatgcccagatggatcagcgttctgtgaagcctgataatttcactttcccatttgttctcaaggcttgcaccaagctcttctgggtcaacactggttccgcggttcatggccgggttctgaggcttgggtttggttcaaatgtggttgtgaggaacacccttttggtttttcatgctaaatgtggagacttaaaggttgcaactgatatttttgatgattcggataagggggatgtggttgcttggtctgcactcattgctgggtatgcccaaagaggggatttgagtgtcgcacggaaactctttgatgaaatgcccaagagagatttggtgtcgtggaatgtgatgatcacggtgtacacgaagcatggggagatggagagtgctaggaggctttttgatgaggctcctatgaaggatattgttagttggaatgcattgattggtggttatgtgcttcgcaacttaaaccgggaggcattggagttgtttgatgagatgtgtggagttggggagtgccctgatgaggtgacaatgttgagcttgttgtcagcttgtgctgatttgggagatttggagagtggggagaaggtgcatgccaagattatcgagatgaacaagggaaagttgagcacactgttggggaatgctcttgttgatatgtacgccaagtgtggaaatattgggaaagcagttcgtgtgttttggttgataagagataaagacgtggtctcgtggaactcagtcattagtgggttggcctttcatggccatgctgaggagtcactgggtctattcagggaaatgaagatgaccaaggtctgtccagatgaggtcacctttgttggtgttttggcagcttgtagtcatgctgggaatgttgacgagggtaatcgttattttcatcttatgaaaaataagtacaagattgagccaactattaggcattgtgggtgtgtggtggacatgctagggcgtgctggacttttgaaggaagcgtttaatttcatagcctccatgaagattgaacctaatgcaattgtttggaggagtctgcttggagcttgcaaagtccatggagatgtggagttggcaaaacgagcaaacgagcagttgcttagaatgagaggggaccaaagtggggactatgtattgctgtcaaatgtgtatgcatcacaaggtgaatgggatggggctgagaatgtaaggaagttaatggatgacaatggtgtgaccaaaaatcgtggctctagctttgttgaggcattcagctga

SEQ ID NO: 5990 - DNA, 438 bp, Glycine max
  Peptide Sequence Number=SeqID_122768
atgaaaagaataggaaagggagttacttacgaattcgacaaaagcctggttgcgattggcgccgacattgcacttggtgttgacgatcttaccgaagggtctgcagagctctctgagctcctcctcggagcattcccaggggaggttgcgaaggtgcaggaccttggaagggttttgatgaataaaaggtgtggtatgagacagggttcattctttgtgcagaagaacaaaactcaggaatgcataaccatgaagaacattcttaccacttatgagaaggctttagggcaggcaattaatctccagaagtctaaacttgtttttagcaggaatgtcagccaacaattacatgaggacatccttgaaattatgaatgttaacgtaggtttgggatttgggaaatatatgaggctttctactagcatggggaaaagttag

SEQ ID NO: 5991 - DNA, 1078 bp, Glycine max
  Peptide Sequence Number=SeqID_122769
atggttcgtggtaaaactgtttacattcagtattctaatagacatgaaattgtcaacaacaaaagccctggagatattcctggaaatgtcttgctggtaactattgaaggtgtggaagctggggatgtgagcattgatgttatccatttggtgttttctgcttttggctttgttcacaaaattgctacattcgaaaagactgcaggtttccaggctctgattcagttcactgatgctgagaccgcttcttcagctagggatgcactggatggaagaagtataccaaggcaaactgctgtaggccctgatgggaagaggaaagaacctgacagcaatgtgcttttggcttccattgaaaatatgcagtatgctgttactgttgatgtcctccacacggtgttctctgcatttggtactgtccagaaaattgctatatttgaaaagaacggtcaaactcaggcactgattcagtaccctgatatcataacggcatcagctgctagagaagctctagaggggcattgcatatatgatggtggctattgtaagcttcatctatcatactctcgtcatactgatctcaatgtaaaggctttcagtgacaaaagtagagactatacagtgccagatcctagtctgctagcagcacaaggtcctgcaacagcttggcaaaatcctcaggctgcacctatgtaccctggcagtgcccctgcttatcatactcaagttcctggcggacaagtgccagcatgggatccaaacctgcaggcagttagaccgagttatgtatcagcacctggtacttttcatgttcaatctggtgcagctcctccaatgccagcctatgcgccagccgcagctatgcctgctgcttcctcacctcatgcacaaagcagccccatggctcataatgcaaatccaatgggaatcgcccagcccagggttccacccaatgcaaatttacagtccagtggtgcttcactttcagctcctggttcctcacctctcatgcaaaccagccaagctgctcaaggattggttcagccaaatgcaagacctggtggtgcttcacctccag

SEQ ID NO: 5992 - DNA, 2052 bp, Glycine max
  Peptide Sequence Number=SeqID_122770
atgactcccaagtttgattatgttatgtgttccattgaggagtctaaggatacagacacgttgaccattgatgaattgcaaagtagtctcctcgtccatgaactacgcatgacttctcatgttgaagaagtgcaagccttgcagattgctcatacagatcaacatgcagaacagggacgaggtcgtggaggctttggacaatgcagaaggggacgaggccgaggacatggcagacaaggacttgataaatccactatagagtgctttacttgtcatcaacttggacatttcaaccgggaatgttcaaaccaaagaaagaaggccaactatgtagaaaacgacgaagacacgttattgatggcctgcacagatattaccaaggcgaatgaagaagtcaaattgggcaataattccagtacggctgtaattggcaaaggtaacgttcggttaaacatgaatggtaacacttatactgtcactagagtcttttttgtaccagaattgaggaataacatattaagcattgagcaattacaagaaaagggactagcattctgtttcaacatggaaagtgcaaaatgtttcatcttgaaaacgatatggacatttaagttttcggggtttaaatacgctttaccagcaccgtatggtatatggtttgccaacaatgaaagtgccaacaaaactgtgcaaggactgcatggtagggaagaaatcacaagcttcattcccaaagaagagtacttggaaggctacacagatttcaccaatttttgctgtgacaatggtatttatagacagctgacaactgcatacacaccacaacagaacgggattgccgaacgaaataacataaccattatgaacatggttcagagcatgctttcagagaagaaaatgcccaaaactttttgggctgaagctgccacctggtctgtgcatattctgaattggtgtcccacactagcatatgaagaaaccatcttatgtgacttagattggggtgataaggatgtggaacctgttgtagaagaaaacattgaagaacatgagtatgaaactggagaaggactttctgaaggtagtacagaagctaatctggctatgtctgcaagtgaaagtgatcctactcactttgatgttgctgttcaaattgcaaaatggaggaaagccatggatgaggagatggaagccataaacaaaaatggcacatggaaattgatggaattacctgatggagcacagaaaattggagtaaagcttgtagtgaaggggtatgcacaagaatataaggtagactatacaaaagtatttgcaccaatagcccgcatggagacaattcgtttggtggtagcacttgcagctcaaaagggatggaccatctatcagttggatgtaaagtcaacatttttacatggagagttggaggaaacagtgtatgtggaccaaccttgtggttatgtacaaaaaggggatgagcatgaagtgtataagctgaagaaagccctttacggacttaagcaagcaccacgtgcttggtacaaccgcatagaagcatatttttttaagggaggatttgagaagtgtgactacgagcatagtttgtttgtgaagagagaaaaggaagatataatattaattgttagtttgtatgttgatgaccttatttttactggaaatgatgagttgatgtttgcaaaatttaaaagctccatgaagcatgaatttgacatgacagatcttgagatgctgcaaaggtttggaatggataaaagcaattcggtgcaaactccaattgttcctggcgttaaactcacaaaggacgacactggtgcaaaggattcacggtggtactgcgaaggccagaggctaaaagtggtggcgcaagtgaggggagagaataagtggttgcccgtattcgaggaagggctcctcctaagatctataggtaatgcttattctcattatcaatatggtaagatccagcagtttatatactgcaaggagtacaagcatgaggcgtctaacggccataacggaatgcgcaactga

SEQ ID NO: 5993 - DNA, 291 bp, Glycine max
  Peptide Sequence Number=SeqID_122771
atggagagtaacattccaatcttgagcaagaagagactgaattggttggacaataggggcatgaggatgagccaaatttactccttcggtgaccagattaagggcactaaaatagaactatttcactttcaagctgcatggttttcccaccctgagtatcagaatgttgttgcctcagcttgggagaagcctaaccccaatattctgataaagctgcaccatgttaaggaagactctcttcttttcaactctgaaatctttggcgaattaaaggagttcataaggaattag

SEQ ID NO: 5994 - DNA, 231 bp, Glycine max
  Peptide Sequence Number=SeqID_122772
atggagaataaaacttctgaatctgctaatcctgggaatcttttagttgagactgatctaataatgtctgaaattcaaaacccaatccatatggaatttggtaggaaccttcgagggaagaatggcctaatttgtgagagtgttcttatggaattgaaggagttcgtatcaatgtgtggagggcccaatgagaaactgagagctgacaggttgataaattgcctcaggtga

SEQ ID NO: 5995 - DNA, 522 bp, Glycine max
  Peptide Sequence Number=SeqID_122773
atggttattcttagagaaattggctaccttatttctgatgggaaggcatctcagaatgatggtaactcaacttctcccttgtttggtctggtgagggcagaggagcaggtatcaaaaccaggggagtttagtcaccaagagaatgagtcaaagggcagcatagatagtgagaattatcttgagagggatgaggtcaaaatggtgatggctaaacttggatttttttgcagctcagaaagtgaggaacttcaggagaagtatggttccaaggagctttctgaactgtttgaggagcaggagccaagtttggaggaggtgaagcaggcttttgatgtttttgatgagaacaaagatggctttattgatgctgaggagttgcagagagttctttgcattttgggattgaaggaagcagcaaaacttgagaactgccacaagatgatcaggatctttgatacaaatcaggatggaagaatagatttcattgaatttgtaaaaattatggaaaatcgcttccgctga

SEQ ID NO: 5996 - DNA, 285 bp, Glycine max
  Peptide Sequence Number=SeqID_122774
atgggggttgaggaaaaaagcccaaagtttcaagaatcttgggatttgaggtcaaatccttttcaagggggagggaatgatgcaatcctaccccgcaaggagggggaggtgaaatttgatgaagaagatcctaggcctacaagctccaatggagcttacataaggaatgtacagggggagtggaatgtggataatatgacaatgtatctatctgctaccattattgatgctataagaggtataatcccttcttcaggttctcagagtaatgatgaaccagcttga

SEQ ID NO: 5997 - DNA, 1347 bp, Glycine max
  Peptide Sequence Number=SeqID_122775
atgtgggaagatgctttacttgaagaagacactaatgacacattgggagaaaaaccaactgatgacaagaaggaagatggagcccccacccaatcatcagaagaggtcaccaatcttgatactgcctctggaagctgtgaagaatctgttgctctgtccaccgagagggaggctactacattgaaaactacgaagactgaagaagaacagagtgagacaagtaattcacaggataagaacctcaaaaaaccagacaaaatactaccttgtcctcgctgtaatagcatggacaccaagttctgctactacaataattataatgtcaaccaaccccgtcacttctgcaagaattgccagagatactggactgctgggggaaccatgaggaatgttcctgtaggtgctggtcgcaggaagaacaagagctcggcttctcactatcgtcagattactgtttctgaagcagcactccagaatcctagaacagacttgccaaatggagcatatcatccttccttgaagtgcaatggtacagtacttacatttggaactgatacacccttgtgtgaatcaatggcatctgttttgaaccttgctgataaaaccatgcccaattacacaagaaatggatttcataaacctgaggaactaagaattcctgttccccatgccagtggagaaaaaggggacgatcaatctaataaatcttcagttacctccacaacgtctgtagaaggtgcaatcaccaatggacccaaagaacaagttgtgcagaattgccagagctttccaccacaggttccctactttccagggaccccttggcctatcccttggaatccagtgcagtggagttctccagtaccaccgcctgctttttgtccacccggatttaccatgccattctatcctgcaacagcttattggggttgtgctgtgccaggcacttggaacatcccatggctagtgcaaccatcatcaccaaatggtgcaacacctaactctggccccaactccccaaccttgggtaaacattcaagagaagacagcacattcaaatcaaatgagtcaggtggtgaggatggacacagcaaagaaaacaacaaagaaaagagcctgtgggttccaaaaactttgaggattgatgactcagaagcggcaaaaagctctatatgggcaacactggggattaaaaatgacaaggctgactcagttcctgggggaactctctttaaagccttcccttcaaagcatgatgacaaaaaccattcaatgcaagcctcgccagtcttgcaggccaatccagcagcattgtctaggtcacttaactttcatgagacctcataa

SEQ ID NO: 5998 - DNA, 603 bp, Glycine max
  Peptide Sequence Number=SeqID_122776
atggcttatttccatagctcaatctccctctgcaactcctccgttgaccaatacatggcgaattccctcgatttcgagccgaaatcgaggcacaggaaaacccccaattccctccagtctccgccgtgtcggcgatcccggtcggcggtggttgacgttgtgatttttgcagcagttatcgcggcttttgggttcttgttgttcccctatgctcaaattttggctagtgagagtgtcaaatttggaattttgattgtgaatttggtcaaagaggaggtttcttttaccccttggatttatatgttcataggtgttagtgttacctttgcagcattgactacttgggttcttgtggcttgcacaataaggaagtgtgggaaccccaattgcaagggtctcaggaaggctgcaacgtttgacattcagttggagactgaggattgtgtgaagaattcaccttcattaactaaggatggttggaggttccgggaccgaagaagaatcgaaagaccaagaagtaggatacagaaaagaagaaacaaaaagtcttataggaaggagaggatattggatacagaatgcagtcttaaattggtagagtag

SEQ ID NO: 5999 - DNA, 195 bp, Glycine max
  Peptide Sequence Number=SeqID_122777
atgtctgaggtaaaagacccggcgatcaagctcttcgggaagacgatccccgtgccggagattcctcggggatccgccggagctccggcgtcgtcttccggtgacgttgttgatgacagtgttgacgcttcttccaccaactcttcaagggagtctcataccaagagagatgcactagggaaagatgttgataag

SEQ ID NO: 6000 - DNA, 936 bp, Glycine max
  Peptide Sequence Number=SeqID_122778
atgtgggattggtcttcaaagtctcaacaggagccggtgatgattgctgacaatcatgaagaagatgatgagagattgtcagatccaacacctgatgaaccagaatcatccaagaggccacggaggaatcctcaactcccagctagattgcaagactgtgtcatgtttaatgacaataatccatctgatgaagagattatcaattttgctttatttgcaggctatggtcctattacttttgaagaagccttaagttacaagaattggagaaaggcgatggatgatgagattcatgctataggagagttgaatgtaaaactgccacaaaatgaagataaaaggactaaaacaaaggagagctcatatagggatggaaatgttccttggcacgttccatgtgggggtgtttgctatggagatggaaatttggccttcatagaaaatgattggcatactgcattgctgccggtgtatctgaaggcatattatcgtgaccagggtttgatgcagtatgcaagatcagttcttgtgattcataacattgctcaccagggccggggacctgttgatgatttcttctttgtggatttacctgaacaccacaaggaccttttcaaattccacattggaggagaccatttcaacatctttgcagctggtttaaagacagcagaccgtgttgtcaccgttagtcatggatatgcatgggagctcaaaacttccgagggtggttggggcttgcatgggatcataaatgagaatgattggaaactggggcattatggctacactaactactcccttgagacactttccagtggcaaggctaaatgtaaagcagcattgcaaaaggagctcggtttgccaatccacgaggatgtcccggtaattggcttcgtcggaggctggatcaacagaaaggaattgatctcatag

SEQ ID NO: 6001 - DNA, 945 bp, Glycine max
  Peptide Sequence Number=SeqID_122779
atggatgcatctgggatcgacatctttgagatttaccgaagatactgtgacataaaatcaggacatgcatatattggtggggaagaagggtacaggcaagacagtgaccttcaaaaggctaaggtttcaagggaggcactcacacagctctccaaattggttgagtctcgtgttactacaggctatgtcgggatagcagatagcgggaagaccactattttgaaccctaaacctttgagaacgaaacaaacatgccaattggctgagtacaatgggaatctgctaggaattggctgggcttgtcagaaatctgcccggacaaggagtcgacgtgggctgctggaatctgtaggaaaagctgtaagcagggcggtaaatgcatggaaattagttcttgctgggaggttttcactgcttcatccatggtgtgactttgttgagaagaatcaacgatacaacatctttgaggatacctggcaacaggttctagctttcagtgggtttacgcatgatagtctggatgcatatgatcctgaaggtgcttggcctgttttaatagatgattttgttgagcatgtgcacaggatgctaggatcgtattatgataattccaacttacattgtaactgtgatgatccagaatctcagtcatgggtttttgatgacccccttcctgctgattatggttttcacacaggactgaccattttttctggtctaaagaggaagttacccgatgactcgagcaaaagtgatgatatggattccaatgacatgattttttcaaactgtaaaagaagtcgagctcacgatgcagaggatttggaggacaatccaccagggaatacagcatatgattgggtttgcaggactactcaacttgttcctatgtgtagtttggtagggagagaagggcttccttttgatgaagctcccctcttatag

SEQ ID NO: 6002 - DNA, 1887 bp, Glycine max
  Peptide Sequence Number=SeqID_122780
atggagcaaaggctgaaacccaaaccaaagaaagttgagtatagtgaaagacaagtggcagttttggatgatacccagatcaggcaaacttcctcttctgggctctgtattcagatagagaagttggttgtgtgtaataggtatagggaggcaatgaagttgtttgaaatattggaacttgaacatgatggttttgatgttggtggtagcacttatgatgctttggtgagtgcttgtgttggtttgagatcgattagaggtgtcaagagggtgttcaattacatgattagtagtgggtttgagcctgatttgtatttgatgaacagggtcttgtttatgcatgtgaaatgtggcctcatgcttgatgcgcgcaagctgtttgatgagatgccggacttagttcaggtgggaaggcaaattcattcttgtgctttgaaaagaggggtcggcgatgatactttcgtgtcttgtgcgctgattgacatgtacagcaagtgtggtagcatcgaagatgctcattgtgtctctgatcaaatgtcagaaaagaccaccgtgggatggaattccattattgctagctatgcacttcatggttatagtgaggaagctcttagtttatattatgaaatgcgtgatagtggtgcagcaatagatcattttactatttcgatagtgataaggatttgtgcaagattggcatcattagaatatgcaaaacaagctcacgctgctttagttagtcatggatatggccaatgctcttcgttatgcgaaggtatgggggagggatgttgtacgcagccttacccttgcatatgcaaagaggctgtttccggattcaaacccatgaccaacaagtcaccaaggcacaactttaccgctgcaccagggctcgccctcaaacatttcaataatataataaacaaatggggtaggatggaagatgcccggcatgttttcaactgggtgcgctgcaagaatgttatatcttggagtgcattgattgccggatatggtaatcacggtcaaggagaagaggctgtagaaatgtttgagcagatgcttcaagaagggatgattcctaaccatgtcactttccttgctgtcttatctgcttgcagctattcaggattatcagaacgaggcttattagatgaggcttatgaaccgattagaagtgctcctttcaaaccaacaacaaacatgtcggcagcattgctgacagcgtgcagaatgcattataatttggagctgggaaaggtagcagctgaaaatctttacggaatggagcctgaaaagctgtgtaattatatagtgcttctgaatctatacaacagttctggcaaattgaaggaagctgctggtgttttacagaccttaaagaggaagggtttaagaatgcttccagcgtgtacctggattgaagtcaagaaacagccacatgccttcctatgtggagataaatctcactcccaaagaaaggagatatatgaaaaagtggacaacctgatggttgagatatctaggcatggttatgttgaggagaatgaaactttgcttcctgatgtcgatgaagaggaacagcgcattctcaaataccatagtgaaaaattggatatagcttttggacttatcaacactccacattggacacctttgcaaattactcagggccatcgtgtgtgtggtgattgccatagtgcaattaagcttatagcaatggttacaagacgggaaattgttgtaagagatgctagtaaatttcaccattttagaaacggtagttgttcttgtagcgattattggtgtgacaaagtgtcattcaagttgcagtcctttatactgagtagcttgttgttaactcaccttagcctcacatttgattag

SEQ ID NO: 6003 - DNA, 1761 bp, Glycine max
  Peptide Sequence Number=SeqID_122781
atggaagaaaaggtaaataaggagcaccaggtttgcacatcggatggagctattgatagccagggtcatcctgcagttcgagagaaaacgggtgactgggttgctgcaattttgattttagtgaatcaagggcttgctactttggcattctttggaattggagtgaatttggtgttgtttttgacgagagtgatgggtcaagacaatgctgaagcagccaacagtgtgagcaagtggacagggacagtttacctcttctctcttcttggagccttccttagtgactcttactggggaaggtacatgacctgtgccatcttccaggtcatatttgttattggtttggtgtcattatcactatcgtcttacatattcctactgaagccaagtggttgtggaaataaagagttaccatgtggatcacactcatcataccaaacgattttattctatgtttccatatacctaatagctctaggaaatggaggataccagcctaacattgctacatttggggctgatcaatttgatgaaggagataccagggaacaacattcaaaaattgtatttttcagctatttttatttggctttgaacattgggtcactcttctccaacaccatattgaattattttgaggatgatggactatggactttggggttctgggcttcagctggctctgctgctctggcattggttttgtttctttgtggcacacgaaggtatagatactttaagcctaatggaaaccctcttcctagattttgccaagtttttgtggctgctacaagaaaatggaaggtcaaggtgttacaagatgataaactttacgaggttgatgaattctcaaccgatgaagggagaaaaatgctccatactgaaggatttagattcttagacaaagcagcatttatcacatcaaagaatttcaaacaaatggaagagagtaaatgcagtccatggtatctatccactgtgacacaagtagaagaagtgaaatgcattctaagactactcccaatttggctatgcaccatattatactctgtcgtttttgctcaaatggcatcactttttgtggagcaaggcgatgccatggacactagaatatcatctttccacattcctccagcaagcatgtccacctttgacattctaagtgtagcaattgtcatcttcatttataggcgagttctcgaccctcttgtggccagaacaatgaaatcaaaaggactcactgaacttcaaaggatgggaattggtctagtcctagcaattatggccatggtttcagcaggattggtggagcactttaggctaaagaatgcaatagaagactgcaatgaatgtaaagggtctagttcactttccatattttggcaagtgccacaatatgtgtttgtgggggcatcagaagttttcatgtatgtgggtcaattagagttcttcaatgcacaaacacctgatggattaaagagttttggtagtgcactttgcatgacttcaatatcacttggaaactacgttagtagcttgcttgttgcaattgtgatgaagatttctgccacagatgagatgccaggatggatcccaggaaacttgaacaaagggcatttggatatgttttacttcctcttagcagcactcaccgcagctgatcttgtaatatatgtactgatggctaggtggtataaatatgtcaaatttcaaggaaacaatgagaatgacaccaacaaagaagaccctgaagtagtgtag

SEQ ID NO: 6004 - DNA, 351 bp, Glycine max
  Peptide Sequence Number=SeqID_122782
atggagttggacttaacaccgaagacggcagaagcattgtttgagggagatggtggaggttactacacttggtcaagttctcaagtgccactcctggctaagaataatgttggtgcaggtcgccttgtgcttcagcctcgtggctttgcccttcctcattatgcagattcatccaaaattggttatgtcattcaagggccactcacttcatgtggatcttgcaagttgagatgcttgttcttatgctcgctttggtcaaatagtattacacttggtggagtgaggttggatcacagagctacgggtggttgttgctctagagattggtggagcattaggttgttgctgtag

SEQ ID NO: 6005 - DNA, 468 bp, Glycine max
  Peptide Sequence Number=SeqID_122783
atggaagcatggattatcacttatatatgtccaatcaaacaattgatcaaatggaaattacttgtgaagaagcaaaatggtcagaaagtgaacacctcaaagttttcccttgaaatcttgaaaaatgttaaaacaacaataattaggaaaggcaatggattgccacaagttcatgactcgcattttctccatgacgagctcgtactcgcacttttcgtaggagtggcactcattctcgcacttccaagggaggtagaactcgggctacctgcacctgttgaaagggatgcacaagtgggtacgctgagaatgaaacacaccactttggggtcgttgcattctactccgcgcatagaagcggaggctgcatgtgaggggagagaagtcaaggtggttgtgtcagtgaaaactaaagggaggaagatgaaggcgtccccgtgggaggccgaatcgggccgctgtcattaa

SEQ ID NO: 6006 - DNA, 654 bp, Glycine max
  Peptide Sequence Number=SeqID_122784
atggaagctccctgttgcagctttcacgactcttacaaaatggacatgtttttcaaacacgctgtgagaaggaattgtggaggctcctatttcaattgcttgatgcattaccctttatttgatattgtagcagtgaaattaccactagacctggaatttagatccctcttttgcgctgcacagttcaaggcttccatatatctgctcttatcaaattgggcaaagacagggctccaacatataagcacttgtaaatatattggaggaacctcaaagtcttgcaaccttgaagcttactccaagccaagttgttggacccttgatttctcttctggaatccccattccaaacaattcagcagctgggcacagaaccgttatctcaccttcttgtgcaggaacatttttagcaagatattacaacaaacaaacaatgataaaagctttggaaaaaatttccacaaattggacaaaggcagttactgatgcaggagttcctgtggtggttcttgtaaaacttttgcactcaacacttagcatagcccttaatgcttcaagagttcatgacagaagcggtgcttcaagtgctgagcagatgatggaagctgttgttggaccttttaagatctcatcattgagaagaagaatctggtag

SEQ ID NO: 6007 - DNA, 405 bp, Glycine max
  Peptide Sequence Number=SeqID_122785
atgaagcgcacccagcagtccccacctttccgccttcttgcttttcttctcttccttcttcctccgcgcgtctcttccttctggctgccatttccgttcgttttcaaagcttttgtggtgtcgttgctgcgtttccgccgtcaagaaattgaagctaccgaaagaagttcttctgggagtgtctccggaaaaacttcttccgatagtgtctccggaagaagaaatatttattcttgcatggtgatcatggttagaacacgaggtttaggtcgtgctttagctagggttataggcagaggtagaccggatgagcatgatgcaattgatgttccccggaggcataggcctacagcatcagcccgtaggcaacaagtacatattgcggttgatgaggatgtttcttag

SEQ ID NO: 6008 - DNA, 558 bp, Glycine max
  Peptide Sequence Number=SeqID_122786
atggatctcaaggtgaaggcattaacttccatgaattcaaatgacaaaaagaaggcaaatttgtttgctgcaaaaaaggagagaattattctgccaacatataatgatgatcttggaggcaataaatatcacatcagtgaatttctgagccaacctagtggaatcgcagccgtattgaacacgaaggccttccaatcatttcaatctcttgatgctaacacatacaggtgtgaactgcctaaacttcaatttttaaactttgaagctgccccattgctggatctgcgggttacctcaacagatgaagattgcttggttgagatgctttcttgtaagtttgagggttcagaagttgtgaaagagcaaaacaaccacttttcagcattcatgagaaaccacatgacatggggtggtgctggtgccgaatcatttttagaagttgatgttaatttgaatctcacacttgagatctacacacaaccatttaccatgatgcctacttcagctgttgagggtcctggaaatatgttatgcactccgcatggtcaagttctctga

SEQ ID NO: 6009 - DNA, 1767 bp, Glycine max
  Peptide Sequence Number=SeqID_122787
gacaaaatcaagggaaaggtgaacagagacaacgaggtttgcacgtcggatggagctattgatagccatggtcatcctgcagttctaaaaagaactgggacttggactactggaattttgattttagtaaaccaagggcttgctactttggcattctttggagttggagtgaatttggtgttgtttttgacgagagtgatgggtcaagacaatgctgaagcagccaacaatgtgagcaagtggacagggacagtttacctcttctctcttcttggagccttccttagtgactcttactggggaaggtacatgacctgtgccatcttccaggtcatatttgttattggtttggtttcattatcattgtcatctcacatatccctattgaagccgagtggttgtggtgataaagaattacaatgtggatcacactcatcatcccaaacggctttgttctatctttccatatacctagtagctttgggaaatggaggataccaacctaacatagccacatttggtagtgatcaatttgatgaaggggaccctaaggaacgactttcgaaagtagcattttttagctacttttatttggctttgaatcttggctcactcttctcaaacaccatattggattattttgaggataagggacaatggactttgggattttgggcatcagctggttctgctgctattgcattgattttgttcctttgtggcacacgaaggtatagatactttaagcctgttggaaatcctctacctagagttggccaagtttttgttgcagccggaaaaaaatggaaagtcaaggtactaagtgaagaaaacctttatgaggatgaagagtcctctcccagtggaaggagaaaaatgctccacaccgaaggatttaggttcttagataaagcagcatttatcacatcaaaagatttggagcagctagaagagaataaacgcaatccatggtgtctatccactgtgacacaagtagaagaagtgaagtgcattctaagactactcccaatttggctatgcaccataatgtactcagttgtttttgctcaaatggcatcactctttgtggtgcaaggtgatgctatggccactggaatttcaagtttcaaaatccctccagcaagcatgtccagcttcgacattttaggcgtggcattcttcatcttcatctataggcacgccctcgacccttttgtggccaaagtaatgaaatccaaactcacagagcttcaaaggatgggaattggtctagtccttgcaatcatggccatggtctcagcagggttggtagagaaattccggctgaagtatgcaataaaagattgtaaccaatgtgatgggtcaagttcactttcaattttctggcaagtgccacaatatgtgctcacaggagcatcagaggttttcatgtatgtgcctcaattggagttcttcaatgcacaaacacctgatggattgaaaagctttggcagtgcactttgcatgacatcaatatcactaggaaactatgtgagtagtttgcttgttgcaattgtgatgaaaatctccaccaaaggtgacatacctgggtggataccagggaacctaaacttgggacatttggacaggttctacttcctcttagcagcactaacaacagctgatcttgtggtctatgttgcattggctaagtggtataagtctatccagtttgaagaaaacgctgaagaagacatcaaaaaggaaaatcatgaggttatggtgtag

SEQ ID NO: 6010 - DNA, 348 bp, Glycine max
  Peptide Sequence Number=SeqID_122788
atggataaaacaagtaatgcatggatcaaatggaacaattctcacaaaaagaccgataacgctatcaggagaagaaaaagaaaaccgccgaagaacaagtgcaaagctcaggacaacatctgcctaacgtcaaaggaggaatctaaggtcgttgatgaggtcttattgggaatcttcctaatgttgtcaacgagcgaccatgaagtccttggcagatctatcatgacgaagtgcagatctatggcgtggagtgcatatgtatcacgatttcgaggttcgttttcacagctttcatgcccctttcattgtgtcacgacttcgatgtcgccaactcagacaaatctataa

SEQ ID NO: 6011 - DNA, 1200 bp, Glycine max
  Peptide Sequence Number=SeqID_122789
atgcgagaacgaggtgctatgcccaacaaactcaccttcccttttctacttaagtcttgtgctgtggcttctgcactttttgaagggaagcaggtgcacgcagacgctgttaaatgtggtttggactctgatgtttacgttggaaacaacttgatcaacttttacgggtgttgtaagaagattgtggatgcaaggaaggtgtttggtgaaatgcctgagagaacggttgtttcttggaactcggttatgactgcttgtgttgagagtctttggttgggtgatgggattgggtattttttcaggatgtggggttgtgggtttgagcctgatgagacttccatggtattgttgctctctgcttgtgctgagttgggttacttgagcttgggaaggtgggttcattctcagttggttttgagagggatggttttgagtgttcagttgggtactgctcttgttgacatgtatgggaagtctggggctttgggttatgcaagggatgtttttgagagaatggagaacaggaatgtgtggacatggagtgcaatgatattggggttggctcaacacgggtttggtgaggaagcccttgaactctttgcaattatgaataacaataacaatgacaaccgtgatatacgtccaaattatgtgacctatcttggggttctttgtgcttgtagccatgctgggatggtagatgagggttaccaatattttcatgacatggaatgtgtccatgggatcaagcccctgatgacacattatggagccatggttgatgtcttgggtcgtgctggccgtcttgaagaagcctatgagtttatacagagcatgcctattgagcctgacccggttgtgtggaggacgttgcttagtgcatgcactgttcatgatgtgcatgaccatacagggattggggaaagagtaagcaagaagttgcttctgaaggagccaaggaggggagggaatttggttattgttgctaacatgtatgctgaagtggggatgtgggaggaagcggctaatgtgaggagggtcatgagagatggagggatgaagaaggtggctggagagagttgtgttgatttaggtgggtccatgcataggttctttgcagggtatgatccttgcccagatttggttcctgtctatcatcttctagatggattgaacctgcacttgaagatggttaactga

SEQ ID NO: 6012 - DNA, 559 bp, Glycine max
  Peptide Sequence Number=SeqID_122790
gtggtctgtggacttttgttgctctccacggcgctttcgcattaataggtttcatgttacgtcaatttgaacttgctcgatctgttcaattgcggccttataatgcaatcgcattctctggtccaattgctgtttttgtttctgtattccttatttatccactgggtcagtctggttggttctttgctcctagttttggtgtagcagctatatttcgattcatcctctttttccaagggtttcataattggacattaaacccatttcatatgatgggagttgctggtgtattgggcgcggcactactatgcgctattcatggtgccaccgtagaaaatactttatttgaagatgtaactggtttatggatgagtgctcttggggtagtcggtttggccctgaacctacgtgcctatgacttcgtttctcaagaaatccgcgcagcggaagatcctgaatttgagactttctacaccaaaaatattctcttaaacgaaggtattcgtgcgtggatggcggctcaagatcagcctcatgaaaccttatattccctgaggag

SEQ ID NO: 6013 - DNA, 318 bp, Glycine max
  Peptide Sequence Number=SeqID_122791
atgctccgtaggccgcagacgcgccgccacctcatcaggctggcccagctggatcatttgatacagagcagtatttacggcatttggttcgccagcaggcggccaaccaccaggcgcatcctgcagagccagggttttacttctttttcgtgccctacaccggatcagttcagggtagaggtcgcatggcccggagattggcctgaggcccaggcaggaggggcgccagcagaggctcccgacgaggcagatgaggcccgcgaggacgaggagataaccgatttacttgatttcttaggagggggcggagccacatga

SEQ ID NO: 6014 - DNA, 405 bp, Glycine max
  Peptide Sequence Number=SeqID_122792
atgacatcggcagaaatgcagttgagaagagaaaggggcctatgctttacttgtgatgacaagttttcccctagccatcgttgtccgaataagcaatattttgttccacagtgggaagaagaggatgaacctgcattacaaccagatccaccagacgaggttttggtgggaaatggaaatgccttgactgctgaaggattaattctagacttggaggtgaaaatccagggtcatacactgaagctaccagtgtacctacttcaagtttctggtgctgatctagtgctcggggctgcatggttggcaacaattaggcctcatctttctgattatagtactctgacattgaagttttacttgggtaatcaatttatcaccttgcatggcgagagaccctctctatga

SEQ ID NO: 6015 - DNA, 192 bp, Glycine max
  Peptide Sequence Number=SeqID_122793
atgttttacacagaaaattccaaaaaggcaaccccacttgataatgacccactaatccaaatgtttgagaaatttcactttaccataatgcccttgaatgtgccttactcaatcccagtagtggagaatcaagaaaacagtggcatcgacagactttggtcagaagaggaaggtttacactaccctttctaa

SEQ ID NO: 6016 - DNA, 1674 bp, Glycine max
  Peptide Sequence Number=SeqID_122794
atggaagaagatcaagaagtgaaacacatgtgcaagttctgcagcaagagcttcccttgtggaagatccttgggtggccacatgaggtcacatgtcaccgccaatgtttcaaccgaggcagagaagctttcatctttcaacaacaatggtggaggaggagattctgatcaaggaggaactaacaatggaggagggtatggtctgagggagaatccaaagaagacttggaggttcaatgattcgagtgaggacaacaacaacaacaacactactttgttggtgttggacaagttgtgcaaagagtgtggcaaagggtttcactcttggaaagctctgtttggtcacatgaagtgccactctgagaaattgtcccaaaacaacaacagcagcagcagcttattattggaggatcaagattcgtggaatgataataacaccaatgctagccagagccagaagatgacggtgttgatggatgatagccactctgagaatgaggccacggctccgaatcgaaggagaagatccaagaggagaaggacaaggtacatggccccttcaacttcttctgtgtcccttgtttctgaggctcatgagcaggagcaggaagaggttgcaatgagtttgatgatgcttagtagggatgtgagtccttggtgcggtctcaattctgttaattcaatgcagtttgaatctccttctttggttccaaccaatttggattctaaggctgagggcaagagggttgttatctctaatggttctgagaaaaaggtcaccaaaccaagggatgtgaagtgggagttttgcaatttggatgtttcaaatctcaactcaaaagggaaaatgagttcagagcttttgggtactcagagtcctggaagtgaatttggggtcaacaagaccatggtttctaattctgcatttgaggacaatgaaacagatgataatcataatagtaacaataagtgcacttcaatcaaggcaaattttatggactctgagttgaagtcaagttctttgaagagttgggtgaacaacaagccctcagaagatgaatttagcaaaagctccaataagagaggaaagtttgagtgtactacttgcaagaaaatcttccactcataccaagcacttggaggccatagagctagtcacaagaggatcaagggttgctttgcttcaagaaatgagagcagtgagaacagcactgagttggaagcagaactctcccctgaccatacaacagaaaataagcttctgaagaatgagtatgtggaagaacatgaaatggttactactgttactactactactacgactactgctattactgattttgacaatgagataaacacagtgagagattccaagaaggggaaagtgcatgagtgttcaatttgcctcaagatttttccatctggtcaagcattgggtggccacaagagatctcatcacttggctggtgggtctgagagtgctagaaattttcaaagtcaaacaattgtacttcaggaagcagcacctgaaattagggacttttttgaccttaaccttcctgcttctacagaggaagaaggcactggccatcgccatgctgagcattacaaaccttggtgggtagtaggaggaaatcacaagcaggaggcactggttggcctcatttctaactaa

SEQ ID NO: 6017 - DNA, 303 bp, Glycine max
  Peptide Sequence Number=SeqID_122795
atggggaaatgcgtgactccgttgaaggagtggagttctattccaaaaaacgtgcatgtgacacaaggcatcacattagaagcattgcatagagataaacaccaagaaataaaactcaaacaaacccaacagattaaggatgtggtttatagataccttttgacaataggtcaagggttactaaggtttgagttgtttgtcacatacgttgatgttgacacacccatcctaattcctcaacaaaattaccaatcataccggccaacatattttgaaacatcccaacaaccaatttacaagtag

SEQ ID NO: 6018 - DNA, 114 bp, Glycine max
  Peptide Sequence Number=SeqID_122796
atggattgtgcaaagaagttagattacttatcgatgaagaagggtgaagggtcagcgaatgcgaaggctcttaaggcaacaaaggcccaagcaaggaaaatgaatgaggagtag

SEQ ID NO: 6019 - DNA, 366 bp, Glycine max
  Peptide Sequence Number=SeqID_122797
atggagggaggcataggtcccatactagacttgactcccaaagaagagaaaaggatagaaggtctcaagagtgaagagagaaaagttccattggctacccttagcttccaagggtatgccctctattggtggacttccattgctatagaaagaaggatttgtggggatccgccagtagagtattgtaatgatcttaagagtatccttaggaagaggcacattccctcctattatgaaatagagcttatggacaagctccaaaggcttagaaaagggagtataagtgtcaaagaatatagacaacaaatggaactactctttttaagagctagacttagggaggagggaaagaacaagcatagctag

SEQ ID NO: 6020 - DNA, 408 bp, Glycine max
  Peptide Sequence Number=SeqID_122798
atgatgttcttacatatcaagtggcatcaggcattgaatgaatctcctattggacataaccaatcccctaaagttacctcagaagttgtggccatcgctgaagatattaatgacatgtcatttatcagtgcacaatcagctgaagtcacctcacatacaacagaccttggacgtgatggtttattggaggaagatgaaaatggagcagagcaaaggatagaatatgtcagaaaatctatctgcaacagttgtgaatgctgggagaatgccgaaaatgaagggacaagtttaaagaagcaagtccaggcaccgactctcaaaaattcaacacttgaagatagagtcacccatctagacaatgcacttaaggagtgtgttaggcagctaagacaaacaaggtgtttataa

SEQ ID NO: 6021 - DNA, 192 bp, Glycine max
  Peptide Sequence Number=SeqID_122799
atggggttaactgtggagtatggtggtgtgttgaatgctgaagtcggactccaacagaccgcggcggtcacgaaccccagcgacgacgatggtgtggaggagaccacagtgacagatcttcgcggcgagggagaaagaggcttttgtttcgtttctgagactgagctagtgcgcggggggagagccttctag

SEQ ID NO: 6022 - DNA, 2124 bp, Glycine max
  Peptide Sequence Number=SeqID_122800
atggtcgtgagcggagggaagggcctcaaacgcgccgcgaagaagagagtcaccgccgatttctacgacttcctcacgttccccacgccgtcgctcgccgaagctgagaacttcgccggtggaccgttccgctccaacgtgcgcgcctttctgacgaagcacgcgcttcttccgccgccgtccgcgctcttcccgcacctgctgacgtggcagatcgtcttccgcgtcggcgagctcaccgagggccccgacgcgccggtagtgtgcctcgacgtcgtcgaggaggacgtcgccagatccagatctgtttactgtgatcagtgccgagttttcggttggagcggccatccggtgtgcgggaaacgttaccattttataatcaaagccgatgggagctccattggtgggtaccacaagccgtgtatgtgctgtggagacatcttgcatttgtcagaatccaaatgcaagtcatgcaaccatgtcactaccactgatgatgtcgaggattgggtgtaccaccaattagagaacacgactcatcttttacatggcgtagtacacaccaatggatatgggcaccttcttcgggttaatggcagagaagggggctctagatttctttctggtattcatattatggatttctgggatcgcctatgcaagactcttggagtcagaaaagtcagcgtgatggatgtttcaaagaaatatgggatagagtatcgcttgcttcatgccattatgaagggacatccatggtatggtgactggggttataaatttggctctggcagctactgtcttacacatgaatcatacaagtctgctgttgaaagcctatccaatctacccttgtccaccttttcccagggaaagatgcctgactctcgtgtgcaggatatgatcaaatattaccaatctttgtcagaacacgagcttgtaaatataagggacctcttttgtttcataatgggtttgattggtgatgctcacaagactgcatcaaatgttgatgagacaacctgcaagaagcgtcgttttaatgcttctggactgtcaatatcttgggataagagtgacattgaacgtgtggagcaagccatgatcagagtgctgcgtgcagtgtctgagtctaagtgggtgagctggcgtgctcttaggggcgcagcctccaagttgggctctccagagctgcttgattattgccttggagaactgggagggaaaatggtctatggtggaatggttgttaatagccgatgcaatcctcaaactggagtttatgagttcagagttgaggctgcaactggtgcttgctatggaattttagcaaacaataattcttcaggctcgaagtatccatctgaagaaaatctcctacaatgcttgagatatttatacgactctttgcttcatcctcagatgatggtaaactatgaagcagggacaaggactcttgtaatgagctcagctcagaagctttttgactgcaagcagtttgtaaaagattataatcctgagatgttgccattgtcagactcgcagatgtttcgcctctcatgtcatgttgaacttgtagatgagtttgaagattcagaagctataactccaccagaattaattgtgctgcccctgaatgccacggtggctgagcttaagaatcaagcagcaaatgctttccaagatgtatatctaatgttcagaagatttcaagttgatgagctacatggctatagcggtgtcgacgattccaccctggtcaagctcttgttaggatcgagagatgtagtttgtgtccgaggaagatgcattgggaaaaatgggttgagcaagttccgaatggaacgtggacttgagaggtggacggtagattgcagctgtggagccaaggatgatgatggagagagaatgttggcgtgtgatatatgtggagtgtggcgacacaccaggtgttctgacatccacgacactgatcctgttccagcacgttttgtttgccagaaatgccaacactctgaatcaaaactcaaatctagtgggcactgcaaagatgagactgtgactaacgttagtggtagtagttgcttcagaaacggcttgccagtgccatctgatgttatttaa

SEQ ID NO: 6023 - DNA, 1878 bp, Glycine max
  Peptide Sequence Number=SeqID_122801
atgttggtgatgcatttgttgtacatgcttgtgataattgttgtggcctttggtgcacctaagagatctcatgaagagtctgttcattcatcttcaaagcacccgaatgaagatttgggtacatattccaagttggtttcatcgtcagtttcaaatgagtaccatatgcctcatgatataactcaggactcccgggtggcaaaagtgcctcgaactgaatttcatgatgcagatagaagatctcctcttaatcctgtgtatcggatgtcgtcaccgttgaatgattctcgtacagatcatcctattggccctgagaacaggattgaatcaagggattccaaggacaatagagatctccggtttgagaaccgcgatacaaagacagagaagaaggagttgcatggtgaagcaagaagggatcctccaagtgctaagagtgaaaaggatgtgcgtgttgaaggtagaggagatgacaacaaggatgtcaggcatgatcgggatagtcataatgatccgaaaggtgacaccaagacagagaaagatggttataatgtggttagcagccacttgaattggaaagattcaaaagagtaccatagaggaaaaagatattctgattcccctggtgggaattgggacacatggcatatgtcacgtggaaatacacaaggctcagttgaggttgggaaggagagttcagcagcaggagaaagagatcatgttgaagctcatgaagctgtttgtgagaacaaagttgatcctaaaggtgatgatagatctaaagagaaagatagaaagaggaaggatgtgaagcatagggaatggggagatagggaaaaagaaagaagtgatcgtagaaacagtccacaagtaacaaacagtaccggtgactgcaaagaatctgccaaggaagatagagatgtagaaaggttggagagggagaaaaaagatcttccaaaagagaaagaaaatttaacagagagggaaagggatcagatgaagagagaatcatggaatggaatggagaaagaggtttcaaataacgagaaggaatctgttgatgcatcagataaactaactgaacaagaaattgtgttaccagagcagaagaaacaaaaagaagttgatagctggaaaaatgtagatagagaagctagagagaggagaaaagaaagggatgctgatttagaaggggataggtctgataaacgtaccaagggccttgacaaggaatcaaacgatgggtgtgctgatgtagaaggggtgatggagaaggagagggaggaacatgaatcatctcaatctgaaatggagaaaaatggtgaaagctctaataatggtcccactctggaaattcggataccatctgagcatgtaacggctacaaaccgccaagatgctctgagacatcaatatccatattctgccaattatctggtacctcttgatttattcaaatcttctgcttcttccatagttccacctgtcagaggtggccagctttgggggaccgatgtgtacacatacgattcagatcttgttgctgttctcatgcataccggttactgtcgcccaacagcatctccacctcatgcagccatacaagaattgcgtgcaactgtccgtgtgctacctcctcaagattgctatatttctacactgagaaacaacatacgttcccgtgcttggggtgcagcaattggttgtagttatagagttgagcggtgttgcattgtgaagaaaggaggtgatactattgatcttgaaccttgccttacacatacatcaactattgaacccacccttgctccagtgactgttgagcggacaatgactaccagggctgcagcttcggcctacttcatttatgttggttaa

SEQ ID NO: 6024 - DNA, 849 bp, Glycine max
  Peptide Sequence Number=SeqID_122802
atggtggcaacttgcaactctaaaaccctttccacacccaacctctcctttcctccacatatggcttccaggcgtttgagggcattcaagcgttggatgaagtcgaaggggttcgaatggagcgatgcactagagtttgtggacaccccagaagagggagtagcggaagcttgcctcaccaccaagactagtggggcacgtgagatcattgaagaggctggtttggatggtcatttggggttagcatttgccatcatgtatgagagaagcttgggcggggactccccttttgctggctaccttcaactcttgcctttccaagagtgcgtgccaattgtttggaccctcgatgaagtaaacgagcttttgtgtggcgctgaggatgtgcatttcactgccatgtcctctaatgatgaatctgatactgatgttgatggctgtaacaatgatgagggcattgtcgaggaggaagcattggctcaaaattcctctatagatatgactgcgttaaataatgggaactgcaatgtcagtgacttggatagttcttcacttagtgagagtgatacttctatgctggagatgattatgacaaaagatgtcagcagtggaagtgaggtatttaatacttatgggatactgggtaatgctgctttgcttcatagatatggatttactgagcaagataattcctatgatattgtaaacatagatatggaactggctattctgtatgtggcagccaagactctgactattttgagatctcatttgatggagaaccacagattgaactcctcagtttgttacacatcatgttattaccagataatgcctaccataagttag

SEQ ID NO: 6025 - DNA, 135 bp, Glycine max
  Peptide Sequence Number=SeqID_122803
atggaggatgacctaatactagttgcagagctagcaggtgaactgtgggatgctggggtgaaagcagaattctttttaaacaaaagcactttgagtatgcaaacaaatcaaggatcccttggatggtacttgttg

SEQ ID NO: 6026 - DNA, 1655 bp, Glycine max
  Peptide Sequence Number=SeqID_122804
cttctccaagaggagaaggttctcgatagtcgtcgttctttccgcgacaaacctactccaattccaccttccaccaccttctcgtctcctttaccttcttccgcaacctccttctctcctttgttacctacaccgtcaaaacctcttccttctctacctaccaagagactgtctctggaggagttaaccttgagatgtgagggtggcctttgttttaattatgatgagaagttctatcacgaccacaaatgtgcctttaaggcctttcttctgattgcagatgatgatgaggcttttcaagaagacaaccctgtcatggaacctttacctgacccaccagatacccatgaactgcttcaggccttgatcaacttacacacactttcaggtcatttagctcctgagactttgcgtcttttgggccacattgcagcacaacaggtggtgatcttagttgatgggggaagtacccacaacttcatccaagaacatctggtacaccaattgggacggtctccttgcaccactactcccctcaaagtcatggtggataatgggcatcagctcgattgccaccttctccacgaagctattccgctacacgttcagaacgtcaccttcaccgttgacctccatgtcttaccgctatgtggtgcgaacctcgtggagacactgattcttctctttatcccattaccccaccatagcgtcgatgagctcattcgtcctagcaccaactcttttccatcgttgatactcttggtcagaaaacatgacgattcctggacattttgtgttgactatcgtgcgttaaatgccatcacaatcaaggattgttcttcaatcctgaccatcgatgagctccttgatgaacttggcggtgcaacttggttttcgaagctagaccttctccagggatatcatcaacttttgatgcacgaggatgatgtctgcaaaacagctattcgcactcaccacgaccactatgaattcaaagttgggtatcttggtcacatggtttcgactcagggagttgaacctattccaactaagactgatgcttctggtctcggcatgggcatcgttttatcacagagagggcattctatccccttccccagcaaaccatctacccccaaattactttgcgcttccacctatgttcacaaactttttgctatcaccactatggctattttgaatgaaccaaaggcatacccacactatgttattgctcaggatttgatcctaaaaggtggctgcatttggttacctcaaggttcatcgtttacttccaccttgctcatggagtatcattcttctcccataggtggccacatgaggcatacgaagtacaagaccataaaggtggttgggctgttgtgccctttatcggtcccattccagccatgggaggacctttctctcgacttcattgttgacttgcttccgtttcactatcttggtggtcgtaggccgtttttcgaaaggaatccatctgggcatgctacccacccaccatacatcacacaccgtcgtcgtcctattcatggatattgttgggaagattcacgggatgccttggattatcacccgaggatacttcatgggaagactgggactagcttaaatccacatatcaccttgaggacaaa

SEQ ID NO: 6027 - DNA, 213 bp, Glycine max
  Peptide Sequence Number=SeqID_122805
atgacttttgagaaaaccatgctaagagttataactcttaactttttcttcaaaactgttcactgtagtagaggcttgcattttgcatttgagagagtgacaagaggagccgatgagaaggaggagaagaggaaagaggagagggaaaggagagatcgagacagagaaagaagcagaaataggagaaggataaaaggaatggaagaggcatag

SEQ ID NO: 6028 - DNA, 471 bp, Glycine max
  Peptide Sequence Number=SeqID_122806
atggaagtgaaggacaaggttgagctcgttccatataggaacttagatgtactagtccaactttacataagggtagagcaacaacttaaaaggaaggctacttcaaaatcttatggctctcactcttatccaaagaaagacaaaggtcaaggcatcttaggggctgcaacttctaagaaaaaagatgataaggggaagaatagaaaaggaaaagaagaacaatctttaatggttaaggagcagtgtaaggagacaatctctgcatcttctccttgcaaaggaacacttgttagcactgccatacctcttaagcttgaggttattcctcaagtaaaggagttgctgcataagggtctggttcataagagcttaaatccttgtgctttgtggtatgatgaatgtgttgagaggtgcaaccctcttatgtacaatcacccatgcatccaacatcttcatgattcacatacatag

SEQ ID NO: 6029 - DNA, 951 bp, Glycine max
  Peptide Sequence Number=SeqID_122807
atgagagcaccaaccatcctaaggagcctccccatgcggcagcttcaaccaagagcgccggcggcagtggcccctttgccggagaaaaccctgttcgaccgggaactcaccgccgagctggacaccctccggtcacaaggtgaattagggttggctcagttgcttgatgctgccatcaccacacagaaagttgcctcagattctcttgccaacgtttgttacaaagactatgctgaccgtggtgctgttgataagtacctagaagacaacgttgagatgcttgatgaatgcaactattttatggacaaaatagatcacatcaataagtacgtggactcattgagagtggtcgttcatttggtcgataagggtggttctgcaaagcctataactcgtgctttggagcttttggaatcatgtcaaggcatggaaaagagatgcaaagcaatggagaaacaccgtggctgttgcttgaagaagatgttgcggcaaaagctgtgtcatgaaactgaactcagtgaggttatgtgtggctctatggccatggccttgctgtgttgtaggtttcttgagcttggtctatcgtttgatccaaaacatggattgcccctgatgaagttttctcagcctatgagttcttcatggttgagattgtttcaggagttgataaatcaagctgagaagaaaagggtgcagagaaggaaaagttggtcttctttgttgatgcagacagtggctgcagctagagaattgaaggagcagatgaagagtaaaagggaaaaggagatgaagtatgctgttgagagacttaagatatgctgcagggaactggggcatggggttgagattgttgaggaaagagtgaaaattctgtataaaagtttgattgacgttagaatgattttgttgggaattctttcccagcccactacagtgtttagatctgattaa

SEQ ID NO: 6030 - DNA, 318 bp, Glycine max
  Peptide Sequence Number=SeqID_122808
atgagagtcaaaggagtattttgcagaatagacttcagtttgagaataattgtgaagttggagtcttctcaaaacttaccaatgcctattgtttgtttgctattggaggttccgaaaaacttctacagtggatttgaggctgagttagcagatgttattcctgtggtcaagacctccattggtggcactcgtatcgttggtcgtctttgtgttggaaacaagaacgggcttctcttgccccataccaccacagaccaaggtgattcctattattctgctgtttatttctattcacagtactgtttgatgctatgttaa

SEQ ID NO: 6031 - DNA, 304 bp, Glycine max
  Peptide Sequence Number=SeqID_122809
atggaactcagctccagttatgatattgtactgacttatggtattgatctttctgacatggctgttgctgaagagcttcaacatttgagaaacagtctacctgattgtcgcgggagaaagctcgaaaaaaccctatttttgagagatcaaaggtccgggggttggttacgcaaagggaagttatacggagataagtctaaacgcgccggatcccttaaaatgacgttggatcaagtgagggcccttttcctcggatacggttcaaatcacatgatcgtcctcggcggaacacacccaaataaat

SEQ ID NO: 6032 - DNA, 300 bp, Glycine max
  Peptide Sequence Number=SeqID_122810
atggggacacagagatccgcgtgcaccatagtattggtcatggcagcagctttaggccgcgtgagtgagtgggttactgtgttcgcgtgggtttctgttctaacgtttcgatttctagggaaggaaatgaatagtatgagcaagatgattttggttttttcttgtgttggtggttcacggagggggagggtggcgctgagtggtggctctgagtggtggctcgtggtggctctgagtggtggctctaggccgatggtggtggttcgcggaggaggagagtggcggttgagtggtggctag

SEQ ID NO: 6033 - DNA, 993 bp, Glycine max
  Peptide Sequence Number=SeqID_122811
atggagtttgaattctccattgagtataagcaaggcaaggagaatgttgcaactgatgccttgtcaaggttgaaggatattgaatgcaaggcactaacggcccaaacaattcaaccaaatgtattggacaggattcaaagctctagggtttctgatgcttcattagcaactatcattccagcattgaaagaaaatagcagctctcataagcattacacttggcttaatgatcaattgaggaggaagggtaaattggtggtaggaaaagatctccaacttagacaagaattactacattggtttcataattctacaccaggaggtcactcaggcaaaattgcaacttgtaaaagaatacaggttgttctatattggaagggtttgaccttggatgtcaaacaatttatgcagcagtgtgccacctatcagcagtgtaagtatgatcattctgcttatctagggttgctgcaaccattgcatgtgccagatcatgtgtggcaacacatatcaatggactttatagagggtatacccctttcgaatagcaaacaagctatctttgtggtggtggatcgtttaagtaaagttgcacattttatacctttatcacatccatatactgccagcacagtagctcaaacttttatggatcatgttttcaagctacatggttttccatcctctataacaagtgacagggattcaatcttcctcaacaaattctggcaagaattaatggcgttccaagagtggtggtacaataccactttccactcagctattcagactacaccatatgaggtagtatatggtcagccccctcctattcatctaccctatttgcctggtgaatcaaaggcctataggcaagtgtccattgctgcgagagctaatgagaagctagcacctaaatactttgggccatatcccatgattagtagaattggagttgttgcttatgaattgaagctgcctgatcatgcaaaaatttga

SEQ ID NO: 6034 - DNA, 366 bp, Glycine max
  Peptide Sequence Number=SeqID_122812
atgttcggccgtcaaggtcttggttgtgcaaatcgcttttcacaactatcactccctcttggagcagcagttagagctgttggtgtttccatgagccacaaccaagcagaggaaagacgcagggataggattattgttctgcggtgtaggtcaccacccaggccactcacctttaggatgttgccatcagacaaaccaaaccatgaggaggcaagcgctaacagaataggagcaggattgctgagctggcattgcgggattgggcccttggatgatcctgtcgggaatatgcttttttctgttaggataattgttgaaattctgttattgctagctttctctagaacctacaaaaggaacgaataa

SEQ ID NO: 6035 - DNA, 1615 bp, Glycine max
  Peptide Sequence Number=SeqID_122813
atggatgaaaggctggccgccaaagacaaggaggatgtcagctcttcttggttatcaagaattgagtttcctaggtttaatggggataatgtgaaagaatggctatatcaatgtgaaacttacttcttaatggatgaaactcctccagaagttaaaaccaaatttgggaatgcttgtgatgatcccatggctgagctaatgaatttgagacagaagggtaccattagtgagtaccatgagcaatttgacgccatcatgacacgattggatttaccagcagactactccttaagttgtttcttgggagggttgaaaactgaagtgcaaatgatggttcgtatgtttcaaccccagtcagtgatgaaagcatataacctagccaaattgtatgaatcaacggctatgcaaggtactgcagtcacattacctagcaagaacaaatatgctgtcccaatcaaatccttgttgggacccaaaccaccagcagtaactgaaccaaaatccatgaaaaccaaaccaagactcaccaagaatttgtcaccagcattcatgagtgaaagaagggccaaagggttgtgttatttctgtgataagccattttctgtggagcatggcttgacacacaagaaactagaaattcacacctcatggagaaccatgcatgtcacagggagatacaacaaaaagcctctgcacatacttattgatagtggcagcacccataacttcttggatgtccatgtagttgcaagaattgggtgcaagattgaagatcttaaacctctagtagtcacagtggcagatggcacaaaaggcaaaagacatgtattaagaggttctaatcaaagcagctgtaaatcagtcaagagcccaactcttaacaaaatagtgaacaatagtgtgcacttgtctatgatccaagtagggatggaagatgtgtttgtgacaccgacacaactaccactaagtagaggtgagcatgaccatagaatccctctcttgcaatctgctaaaccagtcaacaaaaaaccttataggtatgccaagcaacaaaaggatatcattgataagataatccatgagatgttggactcaggaatcattcaaactagcaacaacccttatgctagtccagtagtgttgggacttgaacaagaaactatcaaggatcggtttccaattcctttagtagaagacctcatggatgagttgcacggatctactatcttttccaagattgatcttagggcagggtgccaccaagttaaaatgcatactactgatatttacaagacaacattcagaactcacaatggtcattttgaatacttggtcatgccatttggcctcaccaatgcccctcctacatttcaaaacctgatgaacactatcttccaagagttcttgaggaagtttgtgctagtctttttttatgacatcctcatctatagtcaatccttggatgagcacttacaacacttacacaaggtggagtacttagggcatgtcatatctgttgaaggggtttcaatagaccctgccaaaatagtggcagtccaaaattggcctatgcctgctactcttaaacaacttagagggttttggggcttggcag

SEQ ID NO: 6036 - DNA, 408 bp, Glycine max
  Peptide Sequence Number=SeqID_122814
atggacaaattttcattgagaagtttgctatcatgtgtggaaactgaggagatgattgcagatgttcttggagtagaagttttcaggcagactgttgcaggtaatattctcgttggcagttactgtgtattctccaacagaggtggtttggtccaccctcacacctccatcgaagacttggatgaactttccacacttcttcaggttcctttggttgccgggactgttaaccgtggtagtgaagtaatagctgctgggatgacggtaaatgattggacagcattttgtggttcagacaccacagcaacagaactttcagtgattgagagtgttttcaagctgagagaagcccaacctagtgccattgtcgatgagatgaggaaatcactcattgatacttatgtctaa

SEQ ID NO: 6037 - DNA, 381 bp, Glycine max
  Peptide Sequence Number=SeqID_122815
atggatttgtgtgctaaagatagaatcacgggtcatggagaagaaactgctatggatgttgatgaagcgatgaatagagaaacgagtgaagtgaaattcatgggtttaggtgctactgtagacttagaagaaccaaactctgatacaaaaggaaaaatacaaggttcaacttcttctggcacacattctcacccgggaaagatcagagaaaaaggaggaatagcagcttctttggataaaatgaccaactcttttgacagaatgatagaaaaaatggatggtaaagtcgatgatgaagatactcaggaagtgttacttgacatagctttgataccagatcgtaatagagacaacaatgggctaaagatgttaaatggttag

SEQ ID NO: 6038 - DNA, 384 bp, Glycine max
  Peptide Sequence Number=SeqID_122816
atggagaatggtcacgatgggaaattgactgagaaattctcgggcttgaatatcaaccagcacggtcagcaacacgagcatgatcaatctaacctctcttctaacaacaatgataacttgtatcaggtcatgaaggctgttgaagctgccgaggccactattaagcaacaggttttaaattgtggcagcggtcatggttgttggatgtggttcgttgggatctttgataccacaggaaattgtagacaattgtggtcgatgcagccacatttgtggttgtgttgcggttgtagacaccccaaaagctatgaccctaaaagacaacgttgtgggccccagaagccattacattgcagccgtaatcacgcacagactgttttttaa

SEQ ID NO: 6039 - DNA, 1164 bp, Glycine max
  Peptide Sequence Number=SeqID_122817
atgcctatccttgatccattgtggggtgacttacatagccatgctccaggcccacatagccttgggtgtgaggggttttgtttaaacatttacaggaaaaacttcttctcactgagactaaatggagtctggttaggaaccacagccaggccataccctgattcaaagctaaaggagtcacaatatcaattgacaccttggcgttcagatacgaaccacgctaatgttgccacacaatcacaacctcactcgattggtgcacctttggcaacttcaaataaaaatggccttgaactggtacctcagcatatgtactctcaagtaaagcctcaggtctctgttgatgctcaggcaggcactgattggggtctattgggtcgcaaccagaatggcttgagtggtggtgtggcaacaagtgttgatactgatgatttgggtagattttcacctcttgcaagcaggaattcatcagcccatgatgcatccacccacctggtagttactcagggtgatactcgtcctgctcattatggagacgaagtgactaacaaacaggtcacatttcgtgtccccgtgagcaacaatgaagttgatgatcctgatggagatggaacacatagtatgagagaaacatctgctaactggagttctggcaaccctccttatacaaccactgttgatgatcccagttcttcatattctccttatttaccagcagttcttgaagaaccttcttcttcattttctgaggctgcagatgaagatccattgccggctatagagggtctccaaatttcaggagaagcctttcctggaagggaacttaaggcaggcggatactccatcaatggcactactagttgggcaaagcaaccaatctatcttgtcaatgctgatgatgttggtacattacttgccattgaagtccaacctctggataacaggaagcgcaagggagaacctgtgaaggtttttgccaatgataataaaaagattgcttgtgatcccgaaatgcagaaccacatagagaaggcttttaatagtggacatgcttcatatagagtttctctttcgactggatatcttgatatatgggaaccagcgacattgaccattaagagggaaggttatagtatcaaatgcagtggaccaaatggattgtaa

SEQ ID NO: 6040 - DNA, 498 bp, Glycine max
  Peptide Sequence Number=SeqID_122818
atgggatcaactctcatggccacaacttccattctcctctctgcaggcttggcagctgtgataagcagcacttacagcgttaagaagcctctgaatgacgctatatatggagcccacagtgaattcatggtagcacttaaatacgtgacactcttaaccatattcttattctcatttttctgtcacaccctgtcgattaggtttttcaatcaagtgagcatcctcatttgcacaccacaagatgtcatgtcctcctcaatagtagtgacccctcaatatttgactgagcttttggagaagggaaccattctgagcactgttggcaacaggcttttctactcagcactccctcttctgctttggatctttgggcctgtgttggttttcttgtcttctgtggcaatgttaccgattctttataacctagactttgtttgtgggaataataatgggaagggaaagatcgtcaagaatgacaaaggggaggactatgtttga

SEQ ID NO: 6041 - DNA, 351 bp, Glycine max
  Peptide Sequence Number=SeqID_122819
atggctaatcggatggaaaattttggcataaggatgagctgtacagaggcgctaagccagaagtcgccaacaccagctaagcgagctcatctttcgttaagcgcacgtccaccgcaggattgcactgagaaagaactgagcttgaagaggaagccatcctatagagctttgaatgagattttgagagtttgtgaggtttctagaggtggaggaggcatccccactacttgctcctatctttcatcttctcttttcattgttgtaaaggaaacttccctgttatggagagctaaatcctcagttggttcttcctatggggtacttgatgtaaatattttcatatctatctaa

SEQ ID NO: 6042 - DNA, 489 bp, Glycine max
  Peptide Sequence Number=SeqID_122820
atggaggccatgaaagaccaaatgaccaccatgatggaggccatgatgagtatgagaaaagtgagggaggtcaacatggctgcagtcgctgccacaagtgccgccactgaggtggacccgactcacccagctggcctcaatcaaagcaagcattccttcccaccatatggcttgcctcccaactatacaccacccaatgctatacatgcttctgatgagaacgtcgataactctactcctatacccatcaagagccaacaaccccaatctggtcatgcacagttcaaggtgccaaatttcgataagtacaaggggactacttgccccaagaatcacctgaagatgtactgcaggaaaatgagggcatacgcatctgaatgtcgtatgctaacttactcccatatctactcaataatgcaatggctagctgggattcaaggaggagaatcgctcgtcaattctgatgtcgtcaagcaatattatgcttag

SEQ ID NO: 6043 - DNA, 1971 bp, Glycine max
  Peptide Sequence Number=SeqID_122821
atggccgatttggagaatttgcttttggaggctgcggggagaactggtacagctggtagaaatcgtcattctcttccaccttcaaggagacgacatgatggcgcctattcagatggtgggagtgattctagggatgacgattcagatgacgaactcaattatgcaagcagaaagccctctggatcacaagttcctctgaagaaaagactagatccaacagaaagagatgatgatttaggcagtcaggaagaagcagatgatgatggtcgcagcgatcatgatggtgatagcagtgatgaatcaaatattggcgatgatctctacaaggatgaggatgacaggcgaaagctttctgagatgactgaacttcaaagagagatgatcttatcggacagggctacaaaaaaggatgataaaaatttgttgggaaagatagcatcaaagcgtgagaaaggaaaggcagcagcacccagaaaacagtctccccccatgtcgtcatcgcgcatgcgtgcatcagccagatctgctgacaggtcagccaagaatgatgcgttaaatgaattgcgtgcaaagcgattgaaacagcaagatccggaagctcaccggagactgagagaggcatcaagaaatgcagggccccggcatttttctccgccaaagcgcaaaacgttcacatcaacaagtctcagtagttcaagtcatagtgagagtgaaagtaggtcccatagtgacgatgaagggtcaactggggatggaggaattgctgacagtgatgatgacagggcactagctgggtctgagggtccatcatttcaggatataaaggaaataactattcgcagatcaaaacttgccaaatggtttatggagcctttctttgaggagttaatagttggttgctttgtaagagtgggaattggtagatcaaaaactggaccaatctaccgactctgcatggtgaaaaatgttgatgcttcagaacctgatcgacagtataaattagaaaataaaactacctacaagtatttgaatgttgtttggggaaatgaaagttctgctgctaggtggcaaatggctatggttagtgactctgctccaatggaagaggagttcaaacagtgggttaaggaagtagattgcagtggcggccggatgccaagtaaacaagacgtgctagaaaaaaagcaagctatccaaaaagccatcacatttgtctactcagcggctactgtgaagcagatgttacaagagaaaaagtctgcctcaacaaggccactgaatgttgctgctgagaaggatcggctgaggagggaattggaaatagcacaaagtaagcatgatgaggcagaagtggagaggatcaagacaagactgcaagaattagaggcatcgagacaagcaaagcagaaggatgccaaggcattgaaactggctgagatgaatagaaaaaacaggtttgagaacttcaagaatgcttctgaattgaagccagtgaatataggtttgaaagcaggggaggcaggttatgatccattttcaaggagatggactagatcaaggaattactatgctgcaaaacctggtgaaaaggctgcagctggaaataatattgtcaatggcaatgtggctggtgctggcagcaatgcaacaggagcaccagtgacagccgaggctggcatggtggctaccgctgctgccttggaagctgctgctggtgctgggaagttggtggatacaagtgctcctgtggatcaagggacagagtcaaatatgctgcacaatttcgagctgccaatttcattagcattacttcaaaagtatggtggggctccaggagctcaggcaggatttatggcaagaaaacaaagaatagaatcaacagttggatttagagtctctgaaaatgatggtaggaggcatgcgttgacgctgacagtcagtgattacaaaagaagaagagggcttctttga

SEQ ID NO: 6044 - DNA, 171 bp, Glycine max
  Peptide Sequence Number=SeqID_122822
atgacttgtggccgtgagtatgcacgggtatggaaggtttattactcaagacttgccaagaacgccgattcactatcaggtctctgtacattaggttggcgcttcttggacgccgattcaaagcctccaggtgttgaattgtgggcagttcttgatgtccctgtacattag

SEQ ID NO: 6045 - DNA, 693 bp, Glycine max
  Peptide Sequence Number=SeqID_122823
atgctcttgtttaacgctgctggtgtggaattgaccaagaaggttcttatcagggaagttttcatgctcgagaaccaaattccctttcatgttcttgagcagatcagtggagaaaaaattattcaatcagaatcaaaagtgttacccaaccacactgttcattggttggatctcatgtaccatttgattgtacctaggtctcagcctcagcctcagcctcagccggagcctgaacctcaggcgccggatcccggggttgaagaatttttcctaacatactttggattcgggcaatgggaaatacttgcgttaccgctacttcctgcacagcctcaacctcggctagagtccgaatatgatccgatcttctgcagatgggaatactgtcttccgctggaagatagtagggttaataatccattagtcagatccttgacacaaacggttgcaaatcttatggagatcacagaaaggcgacagacgtcaacagattctaatgaaggtgctccccgggatgaaaagcttccatctgcgaagcaactccgcaatgccgggatcttcttcaaaccagcggaaaggggcatctcatccattgatttcgatgacaaaaactgcgtttttacttgcctagtatcagatttgatgtcaactcagaagtcatcatcagaaacctccttgcatacgagacgttaa

SEQ ID NO: 6046 - DNA, 1221 bp, Glycine max
  Peptide Sequence Number=SeqID_122824
atgccagtggtgatagaaatcaaagagggtgaacctgaagagtgtggtagagcatgcgtgtgccgtgtacccaaatccttgtgttctgcgaagccagaagctttcacccctcaatttgtgggcctcgggccctaccatagtttcgatgacaagctcaccatgacactggaactcaagttagctgcagccaagagggtcttcaagcacgccttcgaaatccccatctccaaatccatttatgaacatttataccacgcagatgcgtttcaaaaacctgaaagttcttacgctctggcgcaagatggccttttccttctagctttacttcactggagtgccgatgccgagcctcaacaacactatagcttcttaaccggaagacaaggccttcccctggtcaactcttttggtctagagttgaccattgacgctgttatcagtgatgtttacatgctcgagaaccaaattcccactcctgtccttcaccaagtcaaccaagcctccttctgcaagggcaaaagcgaaagtgatgaaattcaaccccaagaagatttgggagcaaaaatgcaaagtttatgtgaaaagcactgtccacttgtccacttacaacaactctccaaaaagccacaagagtatgatcatttgttggatctcatgtaccatttcattgtaccggatgagaaacctaaaatagacagcggaaacagccaacttacgatttctcaatccaaccaagatacccactgtttgaatctaatccacagtcctctacggatgaagaagaaggtaacaacagcagaagaaacacatgctgttccagatgctattccttgtgcttgggattcttttccgcacattccagcgttatttatgcgggcgttgcgttctatttatgatctactaaaatacgtgtcaagactcattcagcctacggttgatagtttatatggttccttatcaacccgtcaaagtcaaaaccaactcctcaaatccgttacattgcttgtcggaggagttaagcgagcaagtgaagaaattttgcgggacaagaatctggacaaggatgttcgctcggttgcaacaatcccatctgtgacggaactccacaaagctgggattgggtttcaacctgccaaattaggaggaatctcaggcattgaatacgatgaaggaacgtgcatgttttctttgcctagtatcaagttgaatgtcaactcagaa

SEQ ID NO: 6047 - DNA, 372 bp, Glycine max
  Peptide Sequence Number=SeqID_122825
atgtggcaagcctttctgcttaagcaaattccttgccatatcaaggttggcactattgagaagcattacaaaagccaacaagaacaagccatcaacagtgaggacataggagaaggtatggagattataaatggaattgacatcaagtggaaaaaggaccatgttgtcggggaggaggtgtttgaagacccttttggctgtagccaacttgttttgctctgtcatgatgaaaccaaaatggaagtgatggtatggaccgaggcccacaaactaagggatgaaagcttctttttgctgcaactcaacgacttagggaccttgcagatgcaaactgcgtgggaatcttctgtagagttccaaaccaaaagataa

SEQ ID NO: 6048 - DNA, 1011 bp, Glycine max
  Peptide Sequence Number=SeqID_122826
atgggcttgagctctaagcaggtttctagcagtggacttgattggaaacaaacgttattggaggctcagaatttggaacttccaaagcctaatctgatgaggaaacaacaacaacaacaacaacaacaaactcagccgaattcagagtctttgaagtgtccaagatgtgactctaccaacacaaaattttgttactacaacaactacaacaagtctcagcctcgccatttctgcagggcttgcaagaggcactggaccaaaggtggaactctacgcaatgttccagttggtggtggaaggaagaacaagagggtaagaaaatcaatcactactccaattacaacatcttccaccacaacatcaatcacaaccaccacttctacttgcactgccacagtcacaacctcaattggcaacaacaacaacaacatggatgctatgttgggttgtaatagccacatgacaatccaaactcctcttgcggatgatcacaaaaacatgtcttcctctctctaccaagctctaattcgtccaccacctttgctgctacaacaacagaatctgatgaacaacacaagagacctagaaggcaaagattttggtattggtattggtaatggtaataatggtatctttcctagtttaactttgccttttcctattcatcatcaaagccaaagcctactcttccctttctcaacctcaagcagctcttttgataccaacccttgttcagtagtgtcaacttctcttagatcctccaatgtttataactatggggaggatcagtttaaagcaatagaggaaccaaccatcaatagtactattacaactactactatagtgcctagcaccaacaacacacatcatccatgggagatagcagcagcaacaagtggtgttggcttgggaacttcttcaaattcaaactattggaattgggaggattttgattcattggtctcaactgatctaaaagatccctgggatggttcagatatcaaaccttga

SEQ ID NO: 6049 - DNA, 273 bp, Glycine max
  Peptide Sequence Number=SeqID_122827
atgaccgtcgtgcctccattgcgcctccattatcagcccacgccgccaatagcgtgtcgatggtgcgttggtggtttgattggtgatggtggcttgggttgcgggtggttggtggttggtggcggtttggttggcacactagatgttggttctggtcctggtgctttggttggtggtggtgctggtggtggtgctggtgctttggttctggtgctggtgcaaggttggcacccaaggttttgggacagaaaagataaaggagatgggcattga

SEQ ID NO: 6050 - DNA, 177 bp, Glycine max
  Peptide Sequence Number=SeqID_122828
atgcacataataaacaacccagatcagcaaccgggatatccaacctcagtcatggtgccgaggatgttgctgatgatgggtatggcaaaatggatctcattggcagagatgttgggggcgcaacggagaggatgtggccactatatggatgtcaagggagaagatgacggaggctag

SEQ ID NO: 6051 - DNA, 612 bp, Glycine max
  Peptide Sequence Number=SeqID_122829
atggctgaaaaagtgccgtcattcaagcatggtggagcttcttggtttattgatctctcaactcctgatgccctgtacgtttttccagttttgacagcattgtcattcttaataacagtagagtgtaatatgcaagaagggatggaaggaaatcctgtggctggtaccatgaaaaatgtctctaggggtcttgctgttcttacagttcctttcaccatgggatttccaaaggcaatattctgttactgggttacatcaaatttgttttcacttgtgtatggacttgtttcacaagcagaatgtgtagagctgtttggaaggttttctcaaggttgtcataaatatgtgcttaaagttcctggcgtaaagaaaactttgggtattcctgaaatacctgttgctccacccaccacgaccagtgctactcaatctcccttttctatatttcctgctctaaaacaagctacatctgcaacaagaaatgggtcaagctcaataccagatgaagcttcaaaacattcaaataaaaagatatcttctgcttctgttattagtcaaaggcttagaagtttagagaaacaagtgaaaggaagaaagaagaacaagaagtga

SEQ ID NO: 6052 - DNA, 132 bp, Glycine max
  Peptide Sequence Number=SeqID_122830
atggatggtcggactggtataattgcccaatgggatgtctactttcattgtaacgtcaagtttggtggacgttgcagcagaatactgatgatgctggagtgtgctggagatgtgctgcataatcaacactga

SEQ ID NO: 6053 - DNA, 476 bp, Glycine max
  Peptide Sequence Number=SeqID_122831
gatgtgtacaagaagccatcaagcccttaattgatataggcatagatgccgcggtgttaatgtgccttagagacattaggcataacaaatttgaagattccttgataggaacggtagagacaagtttaggacatggtccagtctacttcaattgctatccaaacaaaatagtgagtctgatggacagaaacattcttgactctctgttcttaaacatccactttcatggccttgacatgaaagaaggatcaattccagcagcactaatctataggattcagtacaaggtcatgaatacttgtgcatcaagattccttctgaaaccacaaagaggagagacaaccttgtttatcatcgatatgacaaaggccaatgtttctcttccaagaaccataaaatgggatgaggtgactcttcctgaaaatgggtcatggacaaggccatgccgtcagttccccgacccactccaaccatag

SEQ ID NO: 6054 - DNA, 111 bp, Glycine max
  Peptide Sequence Number=SeqID_122832
atggccaaggatgttaatagactagtcaacatgtatagagtaacaagagacgactgggatttatgggaggacgtcaaggcttactttgatgtaacaagggattacagctaa

SEQ ID NO: 6055 - DNA, 387 bp, Glycine max
  Peptide Sequence Number=SeqID_122833
atgatgaggtcgggtactaggcatagttcccccatgtcggcaaaaggggccccccatagtgtttggctggggtatgccaccaaatgcttacccctcagcggtatatccggggtatggctcgaagtcagccagagcaaggtctcagggtacctcatgtgtctcccccatgggttgagcgacatgtgcgtgcccagactgaggttgttggctcttagggggtatgggagcggagtggttgatgttctcctcgggcacatgcacaacactgggtggtgcttagttgggaggcaggctatacggtgggaaaggatgcttgctctcgacttgcacaaaatgggggctgaccgtacttcccaatgcttcccatccttgacctatcatatctga

SEQ ID NO: 6056 - DNA, 345 bp, Glycine max
  Peptide Sequence Number=SeqID_122834
atggagagtaacgaggccatcgccgccgccgctagcatggctattgaggcagacctgattctcccgactgctgcacaccatcctgttccaaacattgtgggacgagggagaagcacaccagggcatgtcagcaacccccatctggggtgcaaccaaggttcttacccctacggtttaccacccaactacacaccaccagccatgcatgaagacgtgggtcacattactcccctcatccggtacattaccctagaagcttcccgcatccacacctggaaggatctgattacggccttccttaggcagtatcagtacaactctgacatggctcctgaccgaacttaa

SEQ ID NO: 6057 - DNA, 465 bp, Glycine max
  Peptide Sequence Number=SeqID_122835
atgtttgtatcatacaaggattggcatgagatgctcccctttgcactgcatggttattggacttcgttgcgcacatctactggggcaaccccgttctctttggtgtacgggatggaagttgtgctcccatttgaggtggagattccttctttaagaattctagcagagtcgggattggaagaagtagagtgggcccagacacactttgaccaattaaatcttatcgagggtaagagattggctgccatgagccatgggcaactatatgagagtagagtgaaaaacgcttttgacaaaagagtgcacccgagtaaattcagcaagggggaccttgttctgaagaaggtatcgcaggctcaaaaagatcatcgaggtaaatgggctccaaactatgaaggaccgtatgtggtgaagaaggctttctcaggaggagtgttgttgcttatgaacatggatgatgaataa

SEQ ID NO: 6058 - DNA, 873 bp, Glycine max
  Peptide Sequence Number=SeqID_122836
atggacattttcaccttcagagggctacacgccctcaccttcagaggactacatgtcctcgccttcagaggacttcatgtcctcaccatcaaaggacaacacgtcctcgtcattagagggttgcacgccctcgtgttaagagagttgcacgcccacgccttcaaagggatacatttcctcacctttagaggactacacgtcctcgccttcagaggattgcacgccctccccagcaggggaggactacacgtcctcccctgcagaggactacacgtgctcccctgcagaggactacacatcctcgacttcagaggactacacgtcctcgccttcagaggaatggacgtcctgaccttaagagggctacacgccctcactttcagaagactatacgtcctccctttcagagggttacacgcccttgcctttagagggctacacgccctcatttcaagaggactacacgtcctcaccttcagagggctacacgccctaaacttcagaggcctacacgtcctcgccatcagagggctgcatgccctcaccatcagaggactacacgtcctcgacatcagaggactacacgtccttgccttcagaggactacacaacctcgccttcagaggactacaagtcctcaccttcagaggactacataggactacacgtcctcgccatcagaggattggacgtcctgaccttaagagggctacacgccctcacattaagaggactggacgtcctaaccttctgagggctacacgccctcacttgcagaggactatacgtcctccctttcagagggcaacaagccctcaccttcagagggctacacgtcctcgccatcagagggctgcatgccctcaccattag

SEQ ID NO: 6059 - DNA, 321 bp, Glycine max
  Peptide Sequence Number=SeqID_122837
atggtaatcgattaccagaggcttccatcaactcccagttccctttttaagcctggtaatcgattacaccccttggagctcgcctgcttaggtacatcacaggttctcactgaccgactatgcccgggttgggtcgggattggtcaagcttggttttgggcaatagcaccccacctgacgtccccaaggtctcttgacccccgcgacatatctcctggtaccactctgtggtcaacgaataaaagcaggaagtttcacccttctacacttcctcatctcaagcttgtaggattatggggtacccatcacatgtggtactag

SEQ ID NO: 6060 - DNA, 285 bp, Glycine max
  Peptide Sequence Number=SeqID_122838
atgatgactagagttagtttgaagaatgtgttaagtgcagtgatcaatcaaggagcggcggaagcgcgagcttggatcttcggccaccaattgaaccccgcaggcaacaaaactcctcacaagattcttcgcatgaagctcttcggtgaaaaagtcgctcagtggtaccctcacgacatcaagaaagacgaccctcttgtcatggctcgtcaagaacaagagtactgtagctttctttttacgtccttattcgctcgctacctgtttgtgtttatgcctctgtga

SEQ ID NO: 6061 - DNA, 234 bp, Glycine max
  Peptide Sequence Number=SeqID_122839
atgtacaagaacaagacaacattgatctctggtcggagaaggagcgttcacgatgttattgtgcgcaaggaatgggagagagcgtcgttgaagagaatgcatcttttcaataagtgcccgtctttttaccttttagagtatgtttggtttccggtgacacaggctaacatgcaagaggttataggtcttgtaccatgcaataggagcgcgataggaatgttggccattagataa

SEQ ID NO: 6062 - DNA, 357 bp, Glycine max
  Peptide Sequence Number=SeqID_122840
atggctcaggttcaaccaatcaacaaaagaaggaatgaagtggacagaaaggtggaggcaaaccttaaagcaattgaggaaataaaagctgcaactgatatagctctaaggaatgaagagatggcagattctgcaaaggttgcagttgagggtgaactgaggcttgttgaagaacagtgtaacccgcctcttcgtggttggataaaagggaattctggtggagctacgaaagggtaccttagtcctatggctagtggaggcatttttagagatatttggggaaaagctttgggaagtttatgttttaacattggtattgaaattgctttaatttcaaggagctattttggtcattga

SEQ ID NO: 6063 - DNA, 288 bp, Glycine max
  Peptide Sequence Number=SeqID_122841
atgaaagagaggcctctaagtgacgcaaagaggaaccggcgggaagctcatgatagtgaccttgtcggatgtcccttgtgtgggaaactagagtggttaaagaatttaagcatttctgaggagatgcttaggcgctttaattcatccatgggggtgtgtcacctggtaggaaactcctttgtggcccaggctgatcaccaaggaggtggggagttacggtgtacgactgggtggcctcaacaaatactgcatggtttcctaagtgaggtgtcgagtggacatgcttag

SEQ ID NO: 6064 - DNA, 156 bp, Glycine max
  Peptide Sequence Number=SeqID_122842
atggaggttggtgagtgggtgacgatgaccgtgtggaagatggcgacctgctccaagatgaggcctaggatgggctcattagcggcaatggggggcggaggccaaggtttggatttgtccaaacctaacttcaagacaaaaagtcacacattttaa

SEQ ID NO: 6065 - DNA, 477 bp, Glycine max
  Peptide Sequence Number=SeqID_122843
atggtaagactaagaggagactttgacctagtcatcatcggtgtcattggcggtagcgggatcttcataagagtctggcgaattttcaccagtgacttcgtcgtcatcatcgaaactagtggggcgcaccaccacctcgatctcctcctcgccttcctcttcattgatcttctcattgacttgatccttttcctcggacacacaggaagcattggagagaaccccatagaattggcagagacccgtgatcaaggccggaaatcccagtgctctattggacttttatggatccactgggtgtcttggaggagtgatacctgcaaactgataaatggcatccgagataagttgggccacatgaatactgacctgggtcaagatagtgtagaccaactggcattttggcaaagggagattagaattatgatcgctgggaaggatgttgctgaggagaagcgtcatccagattcgtgttag

SEQ ID NO: 6066 - DNA, 1116 bp, Glycine max
  Peptide Sequence Number=SeqID_122844
atgacaaagcatagggtgttgaaagagcataacaagactttcctaaattggtttaaagataaaatctttggcaacgatagtgcttctgaaacgttaaggaagttagcaaatgggcctaaaagaaatgttagaacttgccaggtatacaatataaacaagtacttattctacaccaaatcacaagatgacaagaatacaatgaaaaacagtggggttagtcttaaggctgaatcccgatactttgctactgtaaatgataacaatccttatatggcattcatgccttactttagagtcattgaagaaatctgggagcttaattattgggttgatgtcaatgtcggtatgcgaatcgatgatttcagatttactttggtagatttgaaaaagctagcttatcaaaatgagcctttcatcatggcagaacaaactaaacaagtgttttatgttcaagatccttgtgatgaaagacagatggttacaccatcgagctccactcctcttgagtcaacaccttcactgtctacgtcaaagagaactagaaaagccacacggctcaaatcattgtctgccaaacctgtgggggtggagagactactgtttcatatggatcataccactaagaaatctaatgaaggcaaggagaacaacgatgacaaagtctatgagaagtacaaatttagcaaagagaagtggaaccaattttgtcaaagctgtagagactcttcatgggaggatttccgagaagagaaatctgcacagggtaactttgtagcccatggacgtcaggatgacccagagacggatgcatcaaacaggcatgggttgtatgttgatgacaatcctccccgccttgtttcccatggaagagtttatgagtggttgacaactgtgcaccatgtccctttgggcaatgatctagtgaaggataaacatgtaccaaagggaccgatgaagcctgttgataggctagaacctgataacgatcccatataccagatgacattaatgatcccgcaacgtttccttaagcctatgcatatgaataagttaagtttgggattggcgaatgcctctatgtatctatgtatggattccttgagccatagtccatag

SEQ ID NO: 6067 - DNA, 530 bp, Glycine max
  Peptide Sequence Number=SeqID_122845
gccgaggaactttgggtgctacctttacacccaagcctctacccattgctaaccttgagcttgtgtgcttccttttgcatgttggaactgacttgtctgcatcttccttgcttcttcttgcattccatcagaatccaacctggcttgtcaggctaagcgccactatgcttctgttagtcagtcctttgaataaggctaagtgcagctgctatgctaagcccttggctaagcgcgacctatgcgctaagcctgagtgtcattttggtgaggctgacctaagcacgccatgctctgctaagctcaagtcctcttctgtgtcaaaaattgccatgagtaattttataaggtgcgctaagcgcgagcttgatgcgctaagcgcccaaaaagaaaggttacttctacaccttcccaagttagatatgacagatctaggttcacctcttaagaagcttgggagagaggagttaatgagaagacactgggacgaagagttgactgattttgttgaaggcaacatcgttgttgccatt

SEQ ID NO: 6068 - DNA, 344 bp, Glycine max
  Peptide Sequence Number=SeqID_122846
atgggaggagtttatcacccacaaccacaatccttgcattttgcgttggaaagactgcctcctgccatcgtggaaagggagaaatttgatcatatagaggaaaggctgagggccattgaaggaggcagagattatgctttcactgacatggcagagttgtgcctagtgcctgacgtcgttatcccttcgaagttcaaggtgtcggacttcaataagtacaaggggactaccttccccaagaatcacctgaagatgtactacaagaaaatgggagcatgtgcaaaagttgaaaaattattgatgcatttcttccaagaaagtcttattggggaagctgtcacctg

SEQ ID NO: 6069 - DNA, 789 bp, Glycine max
  Peptide Sequence Number=SeqID_122847
gggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgaggtcataatccaacgcacggtagcttcgcgccactggcttttcaaccaagcgcgaggaccaattgtgcgaatcaacggttcctctcgtactaggttgaattactattgcgacactgtcatcagaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttccattggctgtggtttcgctggata

SEQ ID NO: 6070 - DNA, 744 bp, Glycine max
  Peptide Sequence Number=SeqID_122848
cgcgccttacaagcacgatctgtttcagctgctgcgccgcatcgacgcccagggcggccagccttacctactggggcgcgcgccgctgccgcgccacgagatgctgcgtctgggccaggagccgtcgctgtcgttcgcgccctccacgctggcgcaggtggcgccgcgcgccaacagcccgctgcacgacgtctcgatcttcagcttcggtctgttcggccccaacgggccgctgccgctgcacctgaccgaatacgtgcgcgaacgggtgtaccaccaccaggacaccaccctgctggcgttcaccaacctgttccatcaccggctgacgctgctgttttaccgcgcctgggccgacgcgcagccgacggtgtcgctggatcgcccggacaaccggcgcttcgacgaatacctgtcgagcctgatcggcatcggccagccggcgcagcaggaacgcgacagcatcaacgcccacgccaaacattttatggccggtcatctgattcgccacagccgcgatccggaaggcctgagcaagattttgcagcagtatttcaaggtgccggtgcgcatcgtcgaaaacgtgccgcactggctgcgggtggaaccgcgcgagcaagctcgcctcaaggctgggcgcggcgcgccgcggctcggcgagtcggcctttctcggcatcgcggtgcgcgatattcagcacaaattccgcatcgagctggggccgatgccgcagcaagactatga

SEQ ID NO: 6071 - DNA, 1482 bp, Glycine max
  Peptide Sequence Number=SeqID_122849
atgaagcggacacgcaaagtgacacggctacgatcgttggccactaaacaacatggtgcaaggagactagtggtcaatgttgatcttaataccgggaaggccgacggtccccacaagaagaaattaagaacatatttggagattgtcgtgcgtgataaggtcgacgtcacatacgagacctggaaagaagtccctgctgctcagaaggatttgatatgggaggatattcatcggaatttgaaatccctgaagcttctgataataggacaaagaagaaaattcttcagactgtcgatgagagccgaacaggatgatgtggatgacattgcttgtgaaaaatatgacattagcaaggataaatgggcccaattttgtgagacacgcagagatccttcttgggaggatgtgcggaaaaaggaacaggccatccagaagcaaaacattgtcccccccccccacgcgttgtctcgtgggggttatgaatatttagaacaaaagctcatggcagagaagacaaaaaagaaactggaggaagctgcccggtctggaagcaatgatggcgtcattgaccctccatcacccatcaaatgccacgtgaagtggaagatggcccgcatgaagaaaattgggcagatgacatctgagataacaaaggaaatcactgagaagattgatgttctgactgctgccattaggcgaccagaacaccctagccgtgtccgtgctactggagccagtgtcacaataaagaaatacttcggatcggttccacgaacctcttgtagttcttcctccctccatcctgaagacctacagcagctgacccaacaaatcagggaccagctggaagagtcgatcacagaaaacgtgactcggcagctcatggcatccttcagccagatgcagtcccaatttcaatcacacatgcaatcacaaggacttgcactgcctccggagcctgaggttggtccctcagggcctcgtgtcagcacaaaggagagttgtgttgatccctcagggaacgatttagagacgggtgactcagacaagtgcgggctatacatcaaagcaaatctgccccgcctggttgccctaggaagactttatgagggatcaacagttcacaacattcctttgttgcctggccaagtgaaggttggtgttgaggaggttaaagatgaacaggctcccgttcctatacccactaatgaggttaccttaatggggcaggcactaaacaccttccttgcttggccgacacgtctcgtgaaggctttatcagaatgggttaactgggatgctaccgtgttcggagtgtttaatccagacttcccactgtacataaagcacaaagatctcttcgaaatcgcacacggtggtcaatgtctcaacatatctatcatacagttgtggattctggacctgactgagacaagtatgcgagcagggaattccgatgtgtatggatttctcgagccatag

SEQ ID NO: 6072 - DNA, 309 bp, Glycine max
  Peptide Sequence Number=SeqID_122850
atggttaacgctgtctctagaacatttccattggatttaatgatgaaatctatgcattttgaagtgaaaaacaggctaagttttgaattgcaaaaagtagtagttgggctaagcgctattccaccgctaagcgcagctttaacatgcttagcgcaaaggagaatttggcagagcatcagcatcaaagccgcacgcgagattagtgcgctaagcgcagcagggtacacacctttggagacttggcacaaaattttaggtggcactggtgcacaacactccacaatgcctattttgggaaaagagccctag

SEQ ID NO: 6073 - DNA, 105 bp, Glycine max
  Peptide Sequence Number=SeqID_122851
atgttatcatgttactatacttctgcaggtggtgttgttatgttttctagagcacttcgtctatacaaacgtgaaggaattcgagtcaatgtgctttgccctgag

SEQ ID NO: 6074 - DNA, 261 bp, Glycine max
  Peptide Sequence Number=SeqID_122852
atgattcattggttgagatcagatgggggcatcgggttcacctttgcaacagcgctggtagcggcaattgtaactgcatcggcttccattatcttcttcatgctcatcatggcctccatcattgtggtcatttgctctttcatggcctccatgtcggccttcatctgctcttgcacctcctctacttcacctattactctagctctagcacgagttcgaaatgggtttatgatcccaacatggttggctcatggtacctaa

SEQ ID NO: 6075 - DNA, 369 bp, Glycine max
  Peptide Sequence Number=SeqID_122853
atgtaccttcagaggactacacgtcctcgccttgagagggtcataggactacacgtcctctcctccagaggactacatgtcctcgccttcataggacaacacgtcctcgccatcagaggactccacgtcctcaccttcagaggactacacgccctcaccttcagaggactgcacgtcctcacctttagaggacctcacgtcctcaccttcagagggatacacacccttatcttcagaggactatacatcctccccttgagaggagtacacgtcctcgccttcggagggctgcacatctacaccttaagagattttaaggtagaaggctacgcgtcctcgctttcagagggctccacatctacaccttaa

SEQ ID NO: 6076 - DNA, 144 bp, Glycine max
  Peptide Sequence Number=SeqID_122854
atgcaagccgacatctgcacggaaagtttaccgatgcagcctacgtctgcccggaaagtttaccgatcaaggtttgaaaaagaagtatcacccgatgacgccgatccaacatttcctaatagacatcatccaaatattatttag

SEQ ID NO: 6077 - DNA, 621 bp, Glycine max
  Peptide Sequence Number=SeqID_122855
atgcttttccataagggtggacccttgggtactagtaccttctccttcagaggacagcgtgtcctcaccttcagaggactacatgtcctcgccatcagaggattacaagtcctcgccatcagagggttgcacgccttcagaggactacacgtcctcacctttagaggactacacgtcctcgcctttagagaactacacgtcctcaccttcagagggctacacaccctcaccttcagaggactacacgtcctcaccgtcggagggctacacgccctcacctttagtgggctacacgccctcgcctttagaggactacgcgtcctcgcctttagaggactacacgtcctcgccttcagaggacttcacatcctcaccttcagagggctacacaccctcatcttcagaggactatacgtccttcccttgagaggactacatgtcctcgccttcggagggctacacgccctcaccattagaggactacatgtcccccttttcagagggctacacgcccttgcctttagagggcgacacgtccgcgccttcggagggctgcgcactccctcgcctttagagggctatgcgtccttgctttcagagggctccacatctacaccttaa

SEQ ID NO: 6078 - DNA, 267 bp, Glycine max
  Peptide Sequence Number=SeqID_122856
atggcctcaacaaatttcttattcccagaaggaaattccatgataactgccattatagaatctaaaaatctatctactatgtctcttgccacattatttgaaaagttgcaggaacatgagatggaattgcaaagactcaatcaaaatgaagaaagcgacaaaagaaaaagaggaatagcactcaaagtctcatcctccatccaagaaggtagcgacaacgaggacttggatgatgaagaagataattctcaagaaatcaaagactaa

SEQ ID NO: 6079 - DNA, 303 bp, Glycine max
  Peptide Sequence Number=SeqID_122857
atggttccccgcatgtcatcgggcccgccgcctctggatgacaaaggtgaaaaaatgcgggaccaaatggttccccgcatgtcatcgggcccgccgccactggatgacaaaggtgaaaaagtgtgggaccaaatgattccccgcatgtcatcgggctcaccgcctctacatgacaaaagacgcagaatgaccataatttgtctctacgtgccatcggacacgactgtgtctgaatggcaaaaaggtgagcggaatgaccataatttgtctcatcatgtcatcgggcctgctgcctctggatga

SEQ ID NO: 6080 - DNA, 1395 bp, Glycine max
  Peptide Sequence Number=SeqID_122858
atgcatagatcctacccgaaagagttttgtgacaattatggtctctgtggagcctatgggaattgcattattaatcaggcacaaggatgccagtgtttgaaagggtttagtccaaagtcaccacaagcatgggcttcatctgattggagtcaaggatgtgtccgcaataaaccgttaagttgcaacggcgaacataaagatgggtttgtcaaatttgaaggccttaaagttcctgatactacacagacttggttggataagactattggtctggaggaatgcagagtgaagtgcttgaataattgttcttgtatggcctacagtaattcagacataagaggtgcaggtagtggttgtgtcatgtggtatggagatctcattgacattagacaatttgaaacgggtgggcaaggtctacatatcaggatgtctgcttcagagtcagaaataggaggaacaatgctggacaagagtgagaaggatattgatttaccaacatttgatttttcattcatttctaatgccacaaatgacttttcgcaaagtgaaaaattgggacaaggcggctttggatccgtgtacaagggcatattgccagatgggcaagagattgcagtcaaaaggctttctaaaacttctggacaagattcaacaaggcacacattattaggttggactaagcgatttgaaattattggtggaattgctcgaggacttctctatcttcatcaagactctagactaaagatcattcacagggatctcaaaactagtaacgttcttcttgatagtaatatgaacccaaaaatatcagattttggtatggctaggacatttgggttagatcaagatgaagcaaatacaaatagagtaatgggaacatatggttatatgcctcctgaatatgtagtacatggatctttctcagtcaaatctgatgttttcagctttggtgtgattgtgctagagataatcagtgggaagaagaatagggcgttttatgacccacaccatcacctaaatcttcttgggcatgcatggagactgtggattgaaaagaggccaacagaacttatggatgacttggtcgataattcagcttgtccatctgaaataataagatatattcatattggtttgttatgtgtacaacaaagacctgaggatagaccaaacatgtcatcagtaactttattcttgaatggcgagaagttattacccgagccaaatcaacctgggttctatacaggaaaagctcatccaaccaagccaaattcttcctcaagaaatattgatgtatattccttcaatgaaatgtctaactcattgttggagccaagatttaaacatgcatgttgcgtggatgtctcaaatgctgatagtaagacagattaa

SEQ ID NO: 6081 - DNA, 402 bp, Glycine max
  Peptide Sequence Number=SeqID_122859
atgggcgacactgaagatgatagagtgagtgaggacatggaaaatacaagcaagcgtttgttcaaactttgcatgaaaggtgaatggggcaaagtagttgagacgtacagtaaggacaagaaggttcacacggccaaaataacgaggacaggtgacactgcactgcacatagcggtcatcgacggccaatacgacgtcgtgcgacaactggtgagactgattcccgaggaggctctgaggattcagaacgagagaaagaacacggccttgcatttggcggcatcaatggggagcgtgggaatgtgtgagtgcattgcttcctcggagccttccttgttgaatatgcgcaaccttgatggcgagacccctctctttctcgctgcccttcatggcagaaaacat

SEQ ID NO: 6082 - DNA, 1182 bp, Glycine max
  Peptide Sequence Number=SeqID_122860
cgtaatctggatgagggagacggctactgcatgaccaacaattcacagcagaaactgaaccgtgagttctcctatcccagcattaagcagagcgcggacggcgcactgcacattgcctacacctattttcgccaggccatcaattccggcattggtgcggcgattgccgatgagctgctgacgcagggctggcaggtcaccggttttagccgtacgccggtggagaaagatcatccggcgtttacctccgtcagcgtcgacctgtttgacgccggtcagctgaaacgggctttggccgggctggcgaaggtggatgcgctggtgcacgcggcaggcatgatgctggccgcgccgctgggtgagctggaggaagagcagggggcgcggctgtggtatctgcacgtgcaggtggcgcaaatcatggccaacaccttgctgccgcagatgggccacggcgatcgtattctgctgctcggcagccgcacgtcacgcggcgcggcgaatcgcagccagtatgtcagcaccaaggcggcgatggtgggcatggcgcgcagctgggccgccgaactggctccgcagggcattacggtcaatgtgattgctcccggtgccaccgccacgccgatgttgctgcagccggaccgcgccagctcgccgccgaaactgccgcctatcggacgctatatccatcccgaagaggtggccgcgctggctggttttgtgctgtcgccggctgccgctgccattaccggacaggagctgcgtgcttctcccatcgtaaaaaacaggatgggagaggctgattatgtctcgtctgcgaaaactcctggcttatcgtgctacgctttctttgggtttaccaaaatgcgctccgcagcagagaagcgcgcaatgaatcatgatgttcttcaggaaataaacgccgaaccactttttccggtacagagcgatcaacatattgtttttggcgttgacggaaagtttaaagcgcatgcgctaatcacgattctgtccatcatgaaacacgccggagaccggatcgcgccacggcgtgacgctgcatcatctgccggaccagctgtttgccacgctgccggtcaccgaactttttacccgtgcgacctactatcgctttctggcaccgctgattttgccgcaggcggaaaaactgctctatcttga

SEQ ID NO: 6083 - DNA, 252 bp, Glycine max
  Peptide Sequence Number=SeqID_122861
atgccgccaatggccgcctgtacgtcactgacaattctaagggcaaaaccacgctggtgttcgatgagcgcagcggtaaggggctcaataaagatcgctcgccgcaagggccggatagcgtggtgcggattacgctggattaaccgcgctaggtttaatcgcggcgcgagggatcgcgccgcagataacccgtacttagcaacgggttacgtcatccattacgccacgccgttcaccagcagtacgcggtag

SEQ ID NO: 6084 - DNA, 276 bp, Glycine max
  Peptide Sequence Number=SeqID_122862
atggtggatgacattttcacaccatctaggtacaaagaaatcatcatggtgcagcccaaaccaagtgctggcctaaaggggaaacctcaccaacatgctctcactttcatgccttcttgcattcaaaaatcaaaggcttgggtccctaggcctaagtcatgttttggcacttaccctaacttctgcaagctgtccacacatccaaaaatggcaatcacacatgcacaaacccaatctataagcaacattcacaaacttatgcgcaaacaccattga

SEQ ID NO: 6085 - DNA, 99 bp, Glycine max
  Peptide Sequence Number=SeqID_122863
atggcgtgtgaaggaagatacttgatgggtagattctggtgctactactcacataagtatgactatgcaaggttgcctgtggagccgaccaccaagtga

SEQ ID NO: 6086 - DNA, 231 bp, Glycine max
  Peptide Sequence Number=SeqID_122864
atgaagtcaggtgacatgcgggggtaccgtatggttatccgcacctttcgtcaaccaggggcaaacgagcctattgacgctcagagactaacatcgtcttctgcaccttttgtcatcctgacccatgaagtcagggacaacgagtcaggtggcaggcggagatacgttatggtcatccgcacctttcatcaatcgaggcgaatgagtttgacggtatcaggaagatgttga

SEQ ID NO: 6087 - DNA, 762 bp, Glycine max
  Peptide Sequence Number=SeqID_122865
atggcccacatgaagaaaaatggtcaaatgacgtctgaagctgcaaaggaaatcgtagacaagagtcctcacagggaagctttgtcgcccatgaacattaggatgtactggcaattgccatttgttgaccagagaccaatgggaggagacacagaaacgggagactcaaacaaatgtgatttgtatgtcaatgacactcctccccgactggttgctcttggaagagtttatgaggggtcaacgactgtccacaatgttcctttgggcaatgatcaagtgatggataaacatgttgttgagggactgacgaaacctatagatatgctagatcctgacatcgatcccttgtacctcatgacattgaccattctgcaacttttcctcaagccattgcaggttccgtgggatgctagtgtgtttgaagtgtataatgataacttcccattttacataaaacatgaagatctttcagaaatagctcatgatgttctccaatgtcgtgcacattggcaaatagttgtcattttgcctaaggacaatgttgtcatctggttttgttccttgcacaatatgtttgacaactacttgaaagaaattattaactgtgctttgaagggattcaatgacagtcaaggaagtaaatccaaggctactgctacatggattgtagttaaacaaaaaggaagcatcgagtgcgggtactacatgatgcattggatgtcaacaatagtcctaggaggtttcaaggataactgggaaatg

SEQ ID NO: 6088 - DNA, 221 bp, Glycine max
  Peptide Sequence Number=SeqID_122866
cggccagggcagaggagatcaagaggctcctcgttcttgttgaggaggagtctattagggctgagacagagtcggaggtttcatgtgaagtaatttcacaaaaatatgctctagaatatggaactgcttgcttggagttgcatgttggttctgtccaacccgaacgtgttggtgctgaagtggtggaatgtgcttgtgtcattggtgtgcctgatgtcaag

SEQ ID NO: 6089 - DNA, 948 bp, Glycine max
  Peptide Sequence Number=SeqID_122867
atgaaggacggtgagttaatccaatcggaattacctcccgcaacacaatatcaactaccaaatgtcaaagacagtaacaataaaccagtcatggcaattccattcaagacaaaagatttcaacgaggaagtaacctccaaagatattaagagcctaatggaacaggcaaattataccaataaatatttacaagttttaggagaaaccattaaaactaaggtagttcctaaacaaaaatcaactgaggaagtttcgccaagtattcccattgaaaaaccatcattcaaacctttcaaagttagtgataaagctaaacggaaaattagagaacttagaaaaactaaatccttagttgaaggagtaggagaaaccattaaaactaaggtagttcctaagcaaaaatcggttgaagaagcctctccaagtattcccattgaaaaaccactgttcaaacctttcaaagttagtgagaaagctaagcaaaagattagagatcttaggaaaactaaatccttagttgaaggagtaggagaaaccattaaaactaaggtagttcctaagcaaaaatcggttgaagaagcctctccaagtattgccattgaaaaaccactgttcaaacctttcaaagttagtgagaaagctaagcgaaagattagagatcttaggaaaactaaatccttagttgaaggagtagaaaccattaaaactaaggtagtttctaagcaaaaatcggttgaagaagcctctccaagtattcccattgaaaaaccactgttcaaacctttcaaagttagtgagaaagctaagcgaaagattagagatcttaggaaaactaaatccttagttgaaggagtaggtgacaatcatagtgaattactaaacaagattggtagtttacttaaggtcattccggaaactccccaaacctcggaaaatacttccaaaatg

SEQ ID NO: 6090 - DNA, 381 bp, Glycine max
  Peptide Sequence Number=SeqID_122868
atgtctccttatcgggttgtcttcggaaaggcatgtcatcttccagtggagattgagcacaaagtatactgggcagtgaagacctgcaacttctctatggatcaagctggtgaggaaagaaagttgcaactgagtgagttagatgagatccgcctagaagcgtatgagaatgccaagttctacaaagaaaagaccaagaagttccatgatagcatgataattaagaaggacttcacggttgggcaaaaaatgttattttataattctaggctaggactcatgagtgttgagatcaaaagtgaatccacagataagagcttcaaggtcaatggacaccacctgaaaccattcctttcaaatccttctttagtggatgcttag

SEQ ID NO: 6091 - DNA, 303 bp, Glycine max
  Peptide Sequence Number=SeqID_122869
atgaccggatctgagaagcttctaccggatatgaaaatgcgcggcgagcgaggcgaggctcacgggtgtgtcttccaaacaaaggaggaaacctacccttttcgggcgaacgaggcgaggctcacaagtgcgtcttccaaaggaggaaaatgcgcggagtcgccaccaacgtttatttgtggaaaacgtcggaaaaaccgaaggaaactggtcatgaagaatattccagattcgggagttgtatttatgtttgaggaaggtattagcacctctcacgtttgtcccaaaggacaacagccttaa

SEQ ID NO: 6092 - DNA, 393 bp, Glycine max
  Peptide Sequence Number=SeqID_122870
agtttacagttggtggcacctccaggatccattccttctgttaagcagtttctggaaagggtagcttggcctggtgcccaaccttctctttacagggaagatgaaggtcccacagcccaggtaccacaacatgtagaggatgcatcatctgaggccaccattccagagccatacatggtagaggaggaggcagatccacccacaccagtggtggacctatcctcacctcaacatgctgtagacccctccacttctatactcaacataccagaggacccgactacaccagtcctgactctaaacacttctccttcagctactcctgtacttcatctgacagatgaggagggtggtcagacacaggatactcaggaccagtcacatgaattttaa

SEQ ID NO: 6093 - DNA, 387 bp, Glycine max
  Peptide Sequence Number=SeqID_122871
atgcaaagaagatctactgtaggtgatttgatccccattgatttggagattaacgccacttgtagaaggcataattcagagagaatcaaaaaatttctgcaagacttggaagcagcagcaactccagaagaagaacctcgatcttccaaggcatcttctagttttcctgttgcagggcattgtcatatagaacctgttgaagacccaatcatggctgaagagccaagaagagtaaccttggaggattattcaagttctattgtgccacaatttttcaccagtattgcacagtgtcataccctaatttcgtccggggattattacttgatgacatgcaatctttggttagccactttgagatacctggcgtcttttgttgcacaataa

SEQ ID NO: 6094 - DNA, 747 bp, Glycine max
  Peptide Sequence Number=SeqID_122872
atgctgtctgggccaactgggttacaccatgaagaccaaaagctgttttacaaagacaaggagagggattcaaaggcttttcttgacatggttggggtgaaggacaaatccaagatagtgctagtggaagaccctattagtcaagagaagaggttgttagagagaaggaagaatgctaagatggagaaagctgcaaagtcaatctcagcaatcagcttggaagtagataggcttgcaggacgggtatcagcctttgagtccattattagcaaaggtgggagagttgtggaaacagatttgcttaatctgattgagttattgatgaatcaattgcttaaattggatggtatagtggctgatggggatgtgaaactacagaggaaaatgcaggtaaaaagaattcaaaagtatgttgaaacacttgatgtgctgaaggttaagaattctatgtctagtagcaatggagaccatgccacagtgcagcttcaacagaagcattcaaatgggcaacaacaaaagcattcaaatggacatcatagatcagccttagcaccaattcaagagcagcaacaagaacaagaacaacccccaaggaattccacctcaggagttgtagttaccacaaactgggaattgtttgattctgtcccaccattaatccctgtgccatccacatccccatccccacatccctcggagaccaataaatcaggtcctcccaagttcaattgggaattcttcaactaa

SEQ ID NO: 6095 - DNA, 339 bp, Glycine max
  Peptide Sequence Number=SeqID_122873
atgtctcactcaaactctatctttcacactgctcttgttgtctccaacatcaagaatcatgtttcaatcattcttgagatggaaaatgtccaatacatgacatgggctgaacttttcaaaccccgtttccaatataaggaaccatatctccatcactcttcaaatggagaatgtttgtcgaagagctgcctcgtcattcaacttgtttcgggtctcacaagtgcatatcgaggtgtagggatgttaattcagcagagtgatcatcaaccttcgttttatcaggctcggttgatgctcatacttgaggaagccggatcggcaatggtggctacctcataa

SEQ ID NO: 6096 - DNA, 216 bp, Glycine max
  Peptide Sequence Number=SeqID_122874
atgcgggtacacgtggcgcgcatcggaggcgtgactaagatacgaaaagataagcaaactacatctttctcgacatattgtcactgctcaaattcaaaggatgtctcctccatttacgatccaccgacagttttggcacgcgcgaggttcgtcgcacgtgagaaagtgctacggggttgtgttcctggatggtgtgctaaatgcaagttccaataa

SEQ ID NO: 6097 - DNA, 621 bp, Glycine max
  Peptide Sequence Number=SeqID_122875
atggagggtttctacgacgatgcaaactcatatgggggtaagaaggtctgggtcttttggcctatcatccgccacccctttaaacaacaccttgtccttaaggtgaccaacaaggatagattccctatcagtgaacatatcttcaatagctgcaatttagaagttcctgataaatattgtggaaagcttggaggtttccttccgaaaactggaaagcccactataaagtctaatgaaaggtccttccatggatggaaaggtactaaaagtggacacaatagacttgcaggtactgatagcaacaagaaggatccttgttggttcttcttgtgtgagcttgaacagagtgcttgtgggatcttcataatgggaaagggcaaagcgcacctccaaggcctaaaggagaccgggccaagaggtgatttggtcgttgcgcatcgtccattgataccacatgagggtcagcctatccatgtaaaaagaggctatcgtcaagtgttccaagtccggcgttgtgtgatactcgaaaaattgggtgatcttgaagatccaccccataagatcggaaccatcaaattgtggcacctccaacttcatacgatgcggcatagaggactatga

SEQ ID NO: 6098 - DNA, 246 bp, Glycine max
  Peptide Sequence Number=SeqID_122876
atggtgggtggaaaggaagagaaggagacaagccggcaaagcaatcttaattttttcatgaatggggcatttaattttgatgaggggagttgttcaaacagtcaagttttacccgccaaagcttcttattggtcactcgcacgtgtgctgtccctccttgcaaaaggaccaagtacggaggaaaacatagacaaaactaccagaacgttaaatcaagctcaagaagagctagagctactcgcctaa

SEQ ID NO: 6099 - DNA, 342 bp, Glycine max
  Peptide Sequence Number=SeqID_122877
atgacccccgaaccaaaagcagccaccaaggacgtcaagatcgaccttttcgaagacgatgatgattttgatgagtttgaaatcaacgaagataattgtgattcaagacttaacaattctactcatggttatcctgacttggaaatctttgagaacttaagcaggtttttgtttttttttaaagaagggcatcatatagtccaagcttgttgtcaaagactgatcaaagagttgataaaggaaaatgataaaattggagaaaattatgttggaccttgtggcctcaataagcttaagagggatagacttaaaatgcagaagaagcaacaacaatcaatttaa

SEQ ID NO: 6100 - DNA, 147 bp, Glycine max
  Peptide Sequence Number=SeqID_122878
atggcggtgcgatggtgttggtggagtcgtagtggcaatggtttgatgatgttgggtgaggtcgtccatggtgggggctcaatcgatgacccgaaccttcgccagcgttgcacttacgtggtgggagcttgggtgacacacaaatga

SEQ ID NO: 6101 - DNA, 531 bp, Glycine max
  Peptide Sequence Number=SeqID_122879
atggtgggcaatggccaacaattggaatgtaactgcttatatgaagtcatcaccataggcattcagtctactaagttcactgttgacctttatgtgttgccgatatcaggagccaacgtcgtcttaggcggggataacatttatttccacatcatggtgctttctgatgactatcaactcaacattagtaaggaccttcctcctgccattcaagctctgctcaccaagttctgtgttgactaccatgccttgaatgcactcacaggcagggatagatttcctattcccaccatagatgaactgggtggcgctcaatgtttttcgaagctggacttgttacaggggtaccaccaaattagaatgcactccaaggacatccctaaaacagcttttcgtactcaccatggacattacgagttcagagtcgaatatatcggtcatctagtttcccacaaaggagtcaaaccagtagcttctaaggtggaagccattcatcaatggcctgttcctcagtccaccaaggccttatga

SEQ ID NO: 6102 - DNA, 171 bp, Glycine max
  Peptide Sequence Number=SeqID_122880
atgtcctttggccaaaccttttgcatcatcaaactacctgcgtcaccgacaggccattttgaattctctgacctcgcacccaaacttcacggcttctcacaatttgatcttgaagaagggacgcatttggcttccatgaggacttccaatgatttccaccttgctcactga

SEQ ID NO: 6103 - DNA, 681 bp, Glycine max
  Peptide Sequence Number=SeqID_122881
atggaacttgtggggaagattcatgggatccctcgaagcttagtctctgacagggatcctctgtttgttagtaaattttggcaagagctattccggctaagtgggatgcaattacgaatgagtttagcataccatccacagagtgatggccaaacaaaagttttgaacagggtcatccagcaatacctttgcgcgtttgtccactacaggccgagagcatggggtaaacttctccttggggttgagcggtcccacaacacttcatggaatgccagaacagggtccactccttatgaaatcaccttcgggcgcaaaccattcaattttctagaatatatcttaggctcgtctaatctcgatgttgtcgaagacatgttgactgatagagaggaaactttccaagccattcgcaaaaagcttatgaaggcacaagctaccatgaaacaccttgctgatgctgagagacgcgagggttcaccagagctcattgaatcagttcagttaccaaagcacttcattcatgatcaacccatcatttctcctctagcaattcttgcttatcgtaagtcttctttgtcaacctgggaagtactggtgcaatggcagggttgtctccagacgagaccttatgggaggattgggatcaattacgcgaggactattaacttgaggacaaggtga

SEQ ID NO: 6104 - DNA, 267 bp, Glycine max
  Peptide Sequence Number=SeqID_122882
atgaagaaaatatgcagtaatctccaaggcaaggacaatgcacctccacctccacctcaatggattgaggcaaagagccatgtacaacaaggagcatatgagtgtggatattatgtgatgcattggatgtggtacatcgttagtggcggtttgaaaaatgaactccacaactatttttctgatggaacatcattagacactgacaccatgacgacactacgcaagaaatgggcagcctattttctagaagttggaaaatggatgtaa

SEQ ID NO: 6105 - DNA, 432 bp, Glycine max
  Peptide Sequence Number=SeqID_122883
atggatcctctgggtgctcaacagaaggtcttagaaatagctaatagcctggttctcaatgtttctgttgctgtggctcacgaggtgtctgtcactaatatagtaggttcaggattttcaccagcaaaatcatatatcatggagggtggtatcagcacctacttgggagctgctcctattgttcgttgccttgaaaagtaccaaccaaatgtaataattacatcgagaattgcatatgctactttattcttagcacctatggtttatgagctaggatggaactgggatgaattagaacatctagctcaaggatctttggctggccatcttctagaatgtggttgccaactcacggggggtatttcatgcatccagcatgttccctcaactcatgagactttttcacaattaaccattatgctggagatgtaa

SEQ ID NO: 6106 - DNA, 729 bp, Glycine max
  Peptide Sequence Number=SeqID_122884
atggttcaccttttcagcgttgtcttcatgtttatttcactcggggtccacgcaacggttgttcctttgcaggacagggtgctgtttagcagtaccgacagcgacaggcgcctgctcatcgtcaacaatgacggacaagcgccggtgcttcttcagagctggattgatgacggtgctacaggtgatatgaacaaagaaaaaaactatccttttgtggtcattccggcggtgacccggatggcaccgggtaaggttttaaacctgaagatactgcccacggaaaaaatcagtgaattaccaacagaccgtgagtccgtcttctggatcaacctctatgaaataccgggcgtcaagcaaactaagcaatcgcaccatataaataaaatagaggtcggattaaactcgcagctgaagattatttaccggccattcaaagaagctatgaatattaacactactggtgaatccatagggttacgtttaacggacggaggaagaatactggaaataactaatcctacaccgtattacattacgcctgtttcggtaaaggtaaattcgcctggcgccgggcagccagtaacacttggcatggatcggttgattgcacctttcagtcataagcgctttaaattatcagaagctgtaaacagtaaaaagacgcctgttgaatacaccatcgttgatgatgtcgggaaaaatgccagatttatgaaggtgcttaattaa

SEQ ID NO: 6107 - DNA, 216 bp, Glycine max
  Peptide Sequence Number=SeqID_122885
atgaaagaggttaggcaagtaaagcgggtcccacgctatccccacgtgccagctaccatgacttttcgaaagttgttggactttagagaaagcaatgggtcccgcggagtaaagatatggacacgtgtcattaagacaacgcttcctctcattgtgggccccgagggcgataatcacttcttaaacacgcgtccacttgcgacccggttcgcttga

SEQ ID NO: 6108 - DNA, 207 bp, Glycine max
  Peptide Sequence Number=SeqID_122886
atggcgctttgcatttcgactgattgcaaatacatggacgccaaatgcggcgattcatacactccgcctgcgcgtcatcccgcgcccgcttgcgcggcccggcaaacgcgccgcgcggcgggggatgccgcgttgtgcgaagcctgccgccgcgctggcgatccgacgttgccggaacgcccgctttacctcatcttgaaagcgtga

SEQ ID NO: 6109 - DNA, 396 bp, Glycine max
  Peptide Sequence Number=SeqID_122887
atggaggaatcaacgatgccgctcgctcatatctcgttgcgtaccggaaagacggaggcttacaggcaggcgatcttcgatggcgtttatcgcgcgatgcgcgagacattcgatgttcccgaagacgaccagttcatgttcctgaccgagcacgaggccgcgaactttcgctacggtgcgacttacctcgatgtcgcccgcagcgacgatctcgtgttcattcagatcacggcgaacaacacgcgcggcgtggagcagaagaaggcgttgttccagcggatcgcggcattgctcggcgacaatcccggcatccggtccgaggacgtgttcgtcagtctcgtcgaggtcgtgaaagaaaactggtcgctgggacgcggcctggcgcagtacgcctga

SEQ ID NO: 6110 - DNA, 234 bp, Glycine max
  Peptide Sequence Number=SeqID_122888
atgcctggggaaaaagacagcgttggcgattctctggatatcacccttgtcgccttgttccaaaaacaaacacggtatccttctggtatttcgctaaccccacagtgcaacccattacatgaaccgaccagatgggatggatccgaggcagacatttttcatcagttgaaggtgttccaaatcgtccttcgcagcagatttgctaaggtgcaatttgatgaaatagggatctga

SEQ ID NO: 6111 - DNA, 174 bp, Glycine max
  Peptide Sequence Number=SeqID_122889
atgatgatgtggctggtgcacctgctactgctggccggacttttttactggctcagcctgcacggcttttccccgctgtggctggtgctggcggtgagctatccggcgctgatgctgaccaaggtgcgctcattttacgaacatcgtgccgatgaggcgccgctggcgcgctcg

SEQ ID NO: 6112 - DNA, 388 bp, Glycine max
  Peptide Sequence Number=SeqID_122890
atggataacgcgctgttgccagggtttgagccgtgtccagtgcgccggcgacagataataggtttccggatcatcatgcggatcggtcagggtgtggttgcggtgatgcgccaggtgcgaatcccggtagagaccatacggataccacaccgccagcggcagcgtgccaaacagctgattaaggcgcggcaggcgcgtcggatggccatggatcagctcatgctgcagcgacaaataccaggtggtgaacaggatcagcagcagcgtggcgaggggcaggcccagcgtttgccagtacagcacgctggcgaaccagccgctataaacgagccagctgcgtgccagctgatgcaccacttcgcgctgttgcgcactgaggtaggcggag

SEQ ID NO: 6113 - DNA, 1104 bp, Glycine max
  Peptide Sequence Number=SeqID_122891
atgattttgaaaaagcttaatgatagagttgattggagcttcttgaggaagactctttgtgaatttggcttccctaccaagattgttgatttgattatgaattgtaccactgaggaagactttttgtatccctttttttcttctcgccatgatcatcgtcagggagatcctatgtcattgtacctattcttattttgtatggagaagcagggccttctcatccaagataaggtaaagttggtacaagatgttctcagagggtttttccttgcctatggtcttaagcgcactcatcaccctagtaaatatctaggctttcctttgatcactagtaagactaaaaaggcatattttgctttcctactggatagagtgaatagtcgcataattggttggaagagtaaacttcttaattgtgctggaagagttactcttgctaactcagtcttgccagctatccccttttatatgatgcagaacttatggattccccaaggtatctgtgatactattgattccagaattaggtgttttatttggggtggtaaccacaaccattgggttgactggggcactatctctaagtctcgacaacatggtggcttgagtgttcacaaatgtaaacaagtgcttatgcaagatctgaacaaactatgggtcaaaatcctcaatgagaaatacgtgcacaactcaaatgtgtgcaatctcaatgtgtctaagggttgttcctattcatggtcctctattatgaaaggcttgtctactcttagatctgggttctatattcaaatacgtgatgggtcttcttccctttggttcaaaccatggctttatggggatactttgtatagtggagttgaggatattcatgaaagggatcttcatctgcgagtttgtgatgtatactttgatggtgaattgcatcttgatgttttaaccactagcattcttggtcatatttgggataaactcctagtcttgttccttgactatacgatgccagatactatcacttggagtcattcctcttctggggagtatgataccaaatccgcttatgtgtggttaaaccatgagcccgctggtcattttaactctacataa

SEQ ID NO: 6114 - DNA, 363 bp, Glycine max
  Peptide Sequence Number=SeqID_122892
atgcctttgggggaagactacgaggatgctaggaaccttaggaagcctttcgtgatcaacaacaacaacaacgttggttatagtgggaatctctttgttgtgctatgtgtcctcatcgtggctttgggtccgatccaattcggtttcacgtgtggctattcttctccaacacaagctgatatgattcgagatcttaatctctcaatttcaaggttttcactctttggatctttatccaacgttggtgcaatggtaggagcaacagtcagtggtcaactagctgaatactttggacgtaaagggtcattaatagtcgcagcaattccaaatatattcggatggctcgccatttctatagcgaaa

SEQ ID NO: 6115 - DNA, 183 bp, Glycine max
  Peptide Sequence Number=SeqID_122893
atgttttacgtacacctcatgcaggtacctgtttatatagcagaggtatcacctcgaaccatgagaggtagtcttggatccgtgaaccagctttcagttaccattggaatcatgttggcttacctgttgggcctttttgtcaactggagaattctagcaatgttaggtgaaattttaacttaa

SEQ ID NO: 6116 - DNA, 399 bp, Glycine max
  Peptide Sequence Number=SeqID_122894
atgggaagcacaagaaatccaggtatcggactacttgtgctccaacagctttctggtatcaatggtgtttttttctattctagcaagatatttgcaagtgcaggaatttcttccagcgatgctgctacatttggacttggagctatgcaggttgcaattactgggattgctacttcgttgttagacagaagtggaagaaggatgcttctaatactatcctcctccataatgacacttagtctcctccttgtagctgcggcattctatttggagggtgtggtaacagatgattctaacgttcatgaagtattggcaatgctctctgttatggggctatgtggctttggtcattggattttctctaggcgttggaccaataccctggatcataatgtctga

SEQ ID NO: 6117 - DNA, 393 bp, Glycine max
  Peptide Sequence Number=SeqID_122895
gatggtgatgttgatttaaatgtttcaccccaagcacttgataagctattgggttatgaacttgcttttaagataaaggtgcaacccaagttcaggaattttgttgttttgaaatgttcaactgacacaagcttaataaatgttgtgatagatatgctagctgatgctgagacatcttcaaaaatcaatatcccagcctttgattccaatcattctacccaacatgaatctcaatttgtgtctgtgacagcagaccatgatccactgcttaagctcccattgacacctacaaagcggcaggcatttcaagattgtgatgatgaagcagggagctctcaaatttcacctgcacagctttcatccaataaattaaaaaaacatggcgcaatttag

SEQ ID NO: 6118 - DNA, 282 bp, Glycine max
  Peptide Sequence Number=SeqID_122896
atggaggaatccaatcgggaaaataacaaagatcacatttcccagtcaagagggtccgctcttgacggtgaagaacacattggagaatggaggaatccaatcgggaaaataacaaagatcacatttcccagtcaagagggtccgctcttgacggtgaagaacacattggagaatggaggatccaatcgggaaaataacaaagatcacatttcccagtcaagagggtccgctcttgacggtgaagaacacattggagaatggaggattcaatcgggaaaataa

SEQ ID NO: 6119 - DNA, 318 bp, Glycine max
  Peptide Sequence Number=SeqID_122897
atggctgctttcctgtctgctttggctgggttagaggttgcacaagctgctgctcaagctgcattgacaactctgtctgagatgctggtatcacgtctaacggtgcttgagaaggaagagttagatgtggaaaaagcaatttctgagattatagaagttcagatgaaaaatatccaagataagcttgttcattttgaagatttggacctgctgatggaaaaagaaggccagcagatggagcaaatgaaaaatatgttttttcttgatcagcttactcttttatttcataaatcatctgcaccaaaaactggagaatga

SEQ ID NO: 6120 - DNA, 1970 bp, Glycine max
  Peptide Sequence Number=SeqID_122898
atgtatgtcgtaaagaggaacgggcggcaagagacggttcacttcgacaaaataaccgcgcgcctcaagaagcttagttatggcctcagctccgatcactgcgacgccgttttggtcgctcagaaagtctgcgccggcgtttacaaaggcgtcaccaccagccaacttgacgaattggccgccgaaactgctgccgccatgaccgccaaccatcccgactacgcttgcgttagtttcctcaattttctgttggctgctaggattgccgtttcgaatctgcacaagaacaccaagaagtcgttctcggagacgatcaagatcatgtactatcattttaatgagagatctgggctgaaggctcctctgatcgccgatgatgtttatgaaataattatgaagaatgctgctcgtctagacagcgagataatctatgacagggactttgactatgattattttggattcaaaacccttgagaggtcttacctcttgaaggttcaagggcaggttttggaaaggcctcaacacatgttgatgagggttgctgttgggattcacaaggatgacatagattctgctgtcaaaacttaccacatgatgtctcaacgatggttcacccatgcatctccgacacttttcaatgctggaacacctaggcctcaactgagtagttgcttccttgtgtgcatgaaagatgatagtatagaggggatatatgaaactttgaaggagtgtgctatcatcagcaaatcagctggaggaattggtgtctctattcatgacattcgtgctacaggcagttatattcgtgggacaaatgggacatccaatggcattgtcccgatgttgcgtgtgttcaatgatactgcccgctatgttgatcaggggggaggcaaaaggaaaggtgcatttgctgtgtacttggagccatggcatgctgatatgtttgaattcttggatttaaggaaaaatcatgggaaggaagagcatcgtgctcgagatctgttttatgctctctgggtgcctgatctctttatggaaagagttcagagcaatggccaatggtctttgttttgtcccagtgaagcaccgggtttgacagattgttggggtgagaaatttgaggagctttatcttcaatatgaaagagaaggaaaagcaatgaaggttgtccaggcacagagcctctggttcgaaattctgaagtcacagatagaaaccggaaccccctacatgctttttaaggatacttgcaataggaaaagcaatcaacagaatttgggtacaattaaatcgtcaaacttgtgtactgagataattgaatattcaagtccaactgaaactgctgtgtgcaatctggcatcaattgcactaccacgatatgtaagagaaaagggtgtaccaatggagtcccatccatccaagcttgttggaagcacatgctctggaaatcggtattttgactttgataaactagcagagattactgcactggtcacaacaaacctgaacaaagtaattgatgttaattactacccagttgaaaatgcaaaacggtcaaacttgcggcacagaccaattggtattggagtacagggtcttgctgatactttcatactccttggcatggcatttgattcaccagaggctcagcagttaaacaaggagatatttgagactatatattatcatgctctaaaaacttcatgtggtttggctgcaaaggaaggtccctatgaaacatacagtggtagtcctataagcaagggaattcttcagccggacatgtggggtgtggcaccctcaaatcgttgggattgggatgcacttcgggagatgatatcaaagaatggtgtgagaaactcacttctcgtggcccctatgcctactgcatctactagccagattcttggaaataacgagtgttttgaaccatatacttcaaacatatacagtcgtagagttttaag

SEQ ID NO: 6121 - DNA, 1284 bp, Glycine max
  Peptide Sequence Number=SeqID_122899
atgactacagttgtgagtttgagacattaccccctctcaagattaggtgctgttttgaactctaacattagctatgtttgtttggatttatgttacaaattatacaatctgaatatcaggagatttagggacaaaaaagaggcagcggagcccgaggcagatccagaaagggatcagagaactgtttttgcttaccagatgcccttaaaggcatcggagagggatgcttatgaattcttctcaaaagctggcaaggtgagggatgtccgtctgatcatggataggaactcaagacgatctaaaggagttgggtatattgagttttatgatgcaatgtcagtgccaatggcaattgctctctctggccaacttcttctaggacaacctgtaatggtcaagccttctgaggctgaaaagaaccttgtccaatctaatgctaccagtggagctgctggagtagtaggaccatatggagctgtggacaggaaactatatgtggggaaccttcactttaacatgacggagagtcaattgagagagatttttgagccatttggtccggtagagattgtacaactacctcttgacttggagacgggacattgcaagggctttgggtttgttcaatttgcccatcttgagcatgccaaggctgcgcagagtttaaatggaaaattggaaattgctggcaggactataaaggtttcatctgtaacagatcatgttggaaaccaagatacaactgccaaatctgcagattttgatgatgatgaaggtggattgtctttaaatgcccaatcaagagcattgcttatgcagaagctggaccgctctggcattgctgcaagcattggtctgcccattgcgaatgggtcatctcctgctcaacaggctattatgcctattggtaatccaggtatagtaccagcagttgcaccagctgtcccaacacaaattatgcctatcccagtgactgaacctgttggaaaccccagtgagtgtttactgttgaagaacatgtttgatccaaacactgagaccgaaccagattttgatctagacattaaagaggatgtagaagaagagtgttccaaatatggacgagtgaagcatatttatgttgacaaaagaagtgcaggttttgtgtatttgcagtttgaaacagtggaagcagcaagtgctgctcaacgtgcaatgcacacaaggtggtttgcaggcagaatgatatctgctatctatatgctacctcagatgtatgaaaccaaatttaaaggtgacgcttga

SEQ ID NO: 6122 - DNA, 273 bp, Glycine max
  Peptide Sequence Number=SeqID_122900
atggataggtatcagagggtagagaagcccaaggcagagactcctataaacgagaatgagatacgcgtcactactcaaggaaggatgaggaattacatcacctacgccaccactctcctccaggagaaaggatctagtgaaattgttctcaaagcaatgggacgtgcaataaataagaccgtaatgattgctgaactgatcaaggtgggaggatcaatatctttatggaatatggtggcctgcacttgttcatcttactttcgtgagttgtga

SEQ ID NO: 6123 - DNA, 321 bp, Glycine max
  Peptide Sequence Number=SeqID_122901
atgactaaaattgaaaatgagaaactccacacgatggtgttctatttcaaaacgtgtcctgaagccgacaatgacaccatcttcatggggcctcaacaacaattggttgttagttgcggtcacacgagagtgaggttagggatggtgctggatgacagatatggacaagaggtgggtggcggtggtttttggatggtggtgggtggtggatctgaggtctcattgatggtggtggttatggaatttttgggtcgtgctggtgtgtttcgaggaggtaggctgtggtggttgatggggtttgaagaagatgaaaaatgttaa

SEQ ID NO: 6124 - DNA, 318 bp, Glycine max
  Peptide Sequence Number=SeqID_122902
atggctgaagcatctccttcacgtaaaagcaaacctcaaatgatggagtcagacatggaagctgcgcagcatcttattcaactgagcgaagatagcagctgcagcgacaacatttccgggaagaggaacagaagctgtgacggggaagaggttcatcacataactgcagccaacaagattcgagagattttcggggaagacaaggtttatcagccgaagaaaaagaagaagaagaagaagagaagatatcggtctcttgtgaacatatacatggccactgcacccatatcaatgcttcaaaggtttttctttgtataa

SEQ ID NO: 6125 - DNA, 177 bp, Glycine max
  Peptide Sequence Number=SeqID_122903
atggaaaatttatccagcaggcctttgatgttaattcaggaggaaattaatgaggaggatgagagactaatggaagcatttgcattgaaggagcctggtcagcagaaaacacttgctgacctcattgtccaaagaataaaagaaaaggatgcgtctgttgcttcaggcaatacttga

SEQ ID NO: 6126 - DNA, 432 bp, Glycine max
  Peptide Sequence Number=SeqID_122904
atgtttgacaatattcttcatgtacagtcacgcacttgcactcttagggaagcagtcatcataggaagcattatagaaaaggtttctattcctccacttcattcaagtgttgcgctattgaagctttctggaatggaatattgtggcaccacaagctatttcataaagcttcttctggagaaaaaatatgctttgccatatcgtgtggttgatgcagttgttgctcattttacaagatttctcaatgaaaccaggataatgcctgttatatggcaccagtcacttcttgcttttgtgcagagggtctctaacactgccatccccatcaaaaaatgccttgttgtcaaagtggatattgggaaactttccattgattaccttcatatatccctttataacttcttccagaagcttgttcccccaatgaattaa

SEQ ID NO: 6127 - DNA, 736 bp, Glycine max
  Peptide Sequence Number=SeqID_122905
ggaggattgcatcattgagcctggccaaaaccaacaattgaatgctttacgtgagagagcgagggtggctgaagtagaagcatatggaatagtggagtaccaaagggtcacagggcgtaaggtatggtgtgttggccctgtatcactgtcaaacaaggatgacttggacaaagatcaaaggggtaataaaagaaacacaaatgatgatgaagttgattatgtgaagtggcttgattcatggcctcaaaggtcagtgatttatgtttgccttgggagcctcaaccgtgtggcacctaagcaattgatagaacttgaggagaatataggagtgaatggaaaggtggctgttggaagagagttttacaatgagaagtttgctgtgcaagtggctgagattggtgtgagtgtgggagctgaaattgctgttcatcttggacaggaagataaggttggtgaatgtgtaagagttaatagggagaaggatatgacaaatggcatggcatctcaggggaggtttgaggtcaaatcaactttagcacaaagccaccttccaccgcctcccccaccctgttcctggagcaccccgacccctcgcaccctcctcctatacttccccattttcgccatcaatgaaagcggatttgttacagtgtttgggttagtgcgtaatccttgtctgactatgagtgttgttcgtgctgcaactacttctgttgttgagagttggttgctttag

SEQ ID NO: 6128 - DNA, 534 bp, Glycine max
  Peptide Sequence Number=SeqID_122906
atgggcactctgtatcagattgcactcttgaacatggttctttatgtatcattaatgatgaatccgacaaacacctcgtcaatggacctaacactcggtttcactgaactcccactaaacaccaccaatttcgatcatcataagccctacgatttacccgttactgaacgctacagcttcacagatggagtgcacaaactgtgggtatattccacagacaaacctctctcccaaaatagcacaacacggcctagatccgaaatccgcattagaggatatgattattcctctggggtgtggcaatttgaagggcaggggtttgtgccaaatggtacttctggcgtgtgcatcatgcaagtgttcggggcagatcctcctcgtgcgacaaccctaatggttagagcctacaacgattcgcttaagtattatgaggctccaatccttgttccaaacatatggggaagatggtttcagttaactgtgatccacgatgtggaggcctcaaatgtgaaggtttattttgatagggttcag

SEQ ID NO: 6129 - DNA, 525 bp, Glycine max
  Peptide Sequence Number=SeqID_122907
atggaaaagaaagcaaattgtcggatacaggaagtacataggtcaagacttcgttccatgacaaagttcttggtggttccaataagagagaagagcatgaaggaagtagtaggctgttgccaaaggttttcttggcggatagtgtgttcaaggaaatatgttactggggaaaaacattggttacaaagtgataaaagacaggttaacaaagattttgaaattacaggggggggcttcagtattatggatgtccacaaccgacttttcatggcaggatttgatttggtagaagatagaaagaagactgttggaaagctaatgaaggttgattttaaaacattacgagtcaagcatggttgttttgcatataaaaagatagatgacccagtggctaccagcgaccacaatgaagcaaattccaacaatggtattgcagtgggcaagcaactaactgaaattataggtgtaattgatcactataatgaaggaaactgctattattcaggaggagcctttgcactgtaa

SEQ ID NO: 6130 - DNA, 218 bp, Glycine max
  Peptide Sequence Number=SeqID_122908
atggatattgggttctttagtcttgttcttaagcgtcatcctgtggagtttttggcttacaattcagggggcactggtgactggggtatcctactacttgcaagcttgggtgatcgaaaagagaggaccattttcccaagtaatgtggaacccactgagttttatacttgctacaacaggttcgatattgttcttgggcgagccactattttgggaag

SEQ ID NO: 6131 - DNA, 1161 bp, Glycine max
  Peptide Sequence Number=SeqID_122909
atgaaaggaaacaacccttatttgattgtggttctcgtacaagccatatatgctgctatgttccttctctcaaaagctgcattcgatcatggcatgaacaatttcatctttgtcttctatagacaggcagtagcaaccatctttctcacccctttcactttcttcttcgaatggaaaactgcaccgcctatgccctttcggaccttctgcaagattttcttcctttctttatttgggattactttaagcttggacatatatggtatcggccttatttacacctcagcaactttggctgctgctaccacaaactgtcttccagctatcaccttcttcttggcgttcctactaaggattgagagtttgaaaataaagacgacccctggaattgctaagttgataggggttgtggcatgcttggctggtgcagcaacctttgccttttataaaggcccttctttgaaatttctaagccattttcatcttttggattaccataaaagcattcaacatcaaggtcatgctcaatccggtgcatggataaagggttgcttcctcatgctcctctccaacacgtttttcgggctatggcttgtactacagacttttattataaaagggtacccttcaaagctgctcttcacaactattcagtgtttcttaagttcaattcagtcttttgtcattgccttggccgtagaaagggacattgaacaatggaagttgggttggaatgtcaggctcctcgccggaattatggtcaccggtgtctcatattacttacaaacatgggtcatagaaaagaaaggacccgtgtttctagccatgtcaactccattggctctcattattacaatctttgcctctgcagctgtgttgggtgagataatcagtttgggaagtgattgctttgatcagtcttctaggagggttcgtattgattctaggactgtacagcgtattgtggggaaagaacagggagcacatgccaaaagccacattagacatggagcaagcatcatcgggttaatgagagttatgggattaatgcaattggcaattgcgatgatatgtgagaagaggaaatatattcttcggagtgttgccaaaattttgccaacaactaataccatcgtaataacatacatcaaagctctttaa

SEQ ID NO: 6132 - DNA, 459 bp, Glycine max
  Peptide Sequence Number=SeqID_122910
atggataccaaggtagtttttccaataaaggtcaaccaaaatctggtcagcattctggtggaaaaccacaaacgaaaactaaacaagagggcgagccctggtgcagcgataaagttgtgccttggtgacttgttggtcatgggttcgaatccggaaacagcctctttgcatatgcaaggggaacattcaaatagaacaaacaagtggaaaaatgaaagtgatattgagcatgatgatgatgatgactcatgtgtaggatcatgttctgatagaactgttctgggtctgcctccaacaggtccattaaagattgaagatgttaaaaatgctttccagttatcagctttaaaatggcatcctgataagcatcaaggcccttcccaggcaatggctgaagaaaaattcaaactgtgtgtaaatgcttacaaaacattatgcaatgctctctccccatcttag

SEQ ID NO: 6133 - DNA, 1017 bp, Glycine max
  Peptide Sequence Number=SeqID_122911
atgaaaggaaacaacccctatttggttgtgattctcatacaaaccatatatgctgctatgattcttctctcaaaagtggcattcgatcatggcatggacagttttatcttcgtcttctatagacaggcagcagcaaccctctttttgacccctttcactttcttcttcgaatggaaaactgcaccacctatgcctttttggaccttctgcaagatttttttcatttctttatttgggattactttaaccttggaaatatatggtatcgcccttatttacacttcagtaactttggctgctgctacttcaaactctcttccagcaatcaccttcttcttggcactcctactaaggattgagagtttgaaaataaagacgacccctgggattgttaagttgataggcattgtggcatgcttggctggtgcagcaacccttgccttttataaaggtcctcctttgaaatttttaagccattatcaccttttggattaccataaaaccctacaacatcaaggtcgtgctccatccggtgcgtggataaagggttgcttcctcatgatcctctccaacacgtgtttcgggctatggtttgtactacaggcttttattataaaagtatacccttcaaagctgctcttcacaactattcagtgtttcttaagctcaattcagtctttggtcattgccttggcagtagaaagggacattgagcaatggaagttaggttggaatgccaggctcctcgccggaattatggtcacgggcgtaacatactacttacaaacatgggttatagagaagaaaggacccgtgtttctagccatgtcaactccactggttcttattattacaaccttcgcttctgcaaccatcttgggtgagattatcagtttgggaagtcttctcggaggattcatattgattctaggattgtacagcgtattgtggggaaagagcaaagagcatcacatgccaaaagtctcactagacgtggagcaaacatcgagtaattaa

SEQ ID NO: 6134 - DNA, 270 bp, Glycine max
  Peptide Sequence Number=SeqID_122912
atgggagaacataaacaagctttgtacagtaagaagcctaagaaggtggtggatcatgggaacgagttgaagcctgaggagctgttaatgcatatcatggaaagtcaaagtcaggaacagcagcaagagatgcagactcagactcagtcatcatctgaagatgctgagagagatcaggatcagaatcaggatcaaagtgggtatcagaatcagatggttgataataataataataataatagtccttcttccattgcaattatgagttaa

SEQ ID NO: 6135 - DNA, 519 bp, Glycine max
  Peptide Sequence Number=SeqID_122913
atgtacaaagataattgggcccaaccttggcccatgggctcagaaatctaccctaaggttcatgagaaccctagggccttcttcagcagctctagcccaatcttcttggagcctcttgctcatgatccagaaaccaagccaaagatgaagggcaaaaggctcattttgcaatattggatagtaccatttgccgaggctagcaaccaacttgtctgggctagtgaagtttcttcaaacttaagcaaacaactcgcctgggacatgcagatcaggagaagaagaagtagtgcaaaactagggagaagccacaacgaagaggagttacttgggatgtttgattcaaaggcagatgaagaaagtcctaaagaatcctctcctacaagcaaaaaggtagtgaacaataaccctcttgaagggcacccactagaacgcaacagtcttcctaaggagtggaaaacagctaaggacctttttgtttacaacatcatagatgatattgcaaagggagtttctacttga

SEQ ID NO: 6136 - DNA, 285 bp, Glycine max
  Peptide Sequence Number=SeqID_122914
atgactcttctagcaattgcactgacaccacaagtgccacttccctcagtgaaggatgttaaagtactagaagccaaggacaatttggaagcattacttgaacaattaaaatgtgctatcaaaaaggccagattagttataaacaacaagaagttgaaagcttacaaaaatttcttgaacttcacaaaagcttctagctcacctttcatggtatgtttagcaactgaaaggaaactgtggtatcttgatagtggctgctcaagacatgtgacaagagatgaataa

SEQ ID NO: 6137 - DNA, 108 bp, Glycine max
  Peptide Sequence Number=SeqID_122915
atgtcttccaataaagaaggtattcatagtcttgggatcaagctccctgagttatggattgtaaggtctcacctctcctttacaacctcaaacattaaagtgtcttaa

SEQ ID NO: 6138 - DNA, 215 bp, Glycine max
  Peptide Sequence Number=SeqID_122916
atggctccgaaaaagctttccgcaaagagatctaggaaggacgccacggctgaagggaccagtgccgcccccgagtttgacagccatcgtttcaggagtgctgagcaccaacagcgtttcgaggccatcaaaggatggtcattccaccgagagagacgcgtccagcttagggacgatgagtacacgggatttccaggaagagatagctcggccgg

SEQ ID NO: 6139 - DNA, 568 bp, Glycine max
  Peptide Sequence Number=SeqID_122917
ggagagtccagtggtggctatcttggcagatttgtttgacacctttgactggaggggttgtattaattataatcccgcactcgccataagaaagctagggtatcccatgaggggagcgccaaccgaagaaagtctctcgcctttccttgtgagggatctaggcgcgcaaggtctcaaggttatacaaagaatccacaaggcgtggaggagtccattgaagaaagacaaggagcttaggggcatccgaaatggcgtaatcggaggttatcatggatggctaagaattcttgcgcaagggttagattggctctccaaattgaaagttatcaatgaggagaacttcgaagctccggcaatacttgccaaggagaagttcaaatcagctgctacacacatccggaaggagtgcaccgagttacaagaggaaaatgcggccactgcaagagcccttgaacaagaaaccaaaagggcccgcaaggaggaatatggtcgagagaaattccgaggagcattgtggggtagcaacaatgagctcaagctccgaagagaggagagagatcggtcacgg

SEQ ID NO: 6140 - DNA, 1147 bp, Glycine max
  Peptide Sequence Number=SeqID_122918
atgtttcaccctcaaactgttttagatccaaatggctatccaatctatcgtagaagaaatgatggccgtaccatttcaaagaatggagttattattgataatagatatatagtaccttacaatgcaaaattgctgaggaaataccaagcacatataaatgttgaatggtgtaatcaaaatacttccattaaatatctatttaaatatataaacaaaggttatgacagagtcactgctgttgttattcatgatgctaatggtacacttgagaatgctatcagtcaaaatgatgagattaaagaatatgtggactgcagatatatttctccatgtgaagctacttggagaatttttggttttccaatacatgctagaaagcctgctgtggagagattacattttcatctaccaggacaacacaatgttttttatgaagatgatgatgatatagatgatatcctgtcaaagccaagtatttcagattcaaaattcttagcctggatgaatagcaacaaatgtttttcagatggtagaaatctgacttattcacaatttgtttccaaatttgtctacaaccaaaaggctagatcatggaaccttagaaagaaagacaatacaattggtaggttaatatgggttccaccaaccactggtgaattgttttatctaagaatgatgcttactgcatgcaaaggagctacttcatttgaagatattagaacagttgaaaatgttctataccttacatatagagaagcatgctttgcaatgggttttttgcaagatgacagagaatttatggaagcaatcaaagaagctaaggactggggtgtcattactaaacctaaagaactttggagtcagacatggaattggttagctgaagacattgcatatcattataaaaaaacaactctgaacacaaaatcacacattgatgatgagcaacttaaaaatttaacattactggaaattgaaaaacttctacatccaaaccaaagatcactcagagactatcctacaatgccatatcctgagggtggaaatcctgcatcgtgtctaaagaatagcttgatattgtctgaacttaattacaacaatgatgaggctagatcagaattcaaaaatctttttctatcgatgacag

SEQ ID NO: 6141 - DNA, 243 bp, Glycine max
  Peptide Sequence Number=SeqID_122919
atgtctccttatcgggttgtctttggcaaggcatgtcatcttcctgtagagatagagcataaagcctattgggctgtaaagacccgcaacttctctattgatcaggctggagaggaaaggaagttgcaactaagtgagctagatgagattcgtttagaagcctatgagatttctaaattctacaagaagaagaccaagaatttccataacagcctgatagctaaggacttcgtggttggatag

SEQ ID NO: 6142 - DNA, 438 bp, Glycine max
  Peptide Sequence Number=SeqID_122920
atgtcgatctccccctgcggaagtatcagttggtctgtgtcgtcccgacatagggatcacacccacaaggcacccagtggacctagaggagtccaacagggccctggggtttccaactctggttacgggcctttttcagtcctacagggtacctgtccccccagcaaggggtcgcgcccacaagacacccagtggacccggagaagtccaacagggccctggggttttcagctctggttacgggcctctttctacgaagcgcccgtcgcccccagcagggtcatcaggcctcctattaaccgggctttcatcaagaagtactgcgccccaggcaggcgcagggtgagacaccacagcagcctagggatggtcaacagcaggcaacaaatgcaccaccgccacctccagagcccctcagctcatccacaaaaaggttag

SEQ ID NO: 6143 - DNA, 369 bp, Glycine max
  Peptide Sequence Number=SeqID_122921
tggagaaaacaccgagactttttaagtctcacaagttatccagaactacgtaggtctgagttcctcattggaggatacgtaggagcaagagcctcgcttttgtcgaccacaccgccttttgttgccatgactcaagagctggtagcccgcggagacaccttacggttatccgcacctcgtcattcagtgaccccaagtgtgattcacgagcagagaccaatatggtcatctacgccctttccggagatgtcagcattttccgatggaaacttttcaagtctcacaagttatccagaactacgtaggtctgagttcctcattggaggatacgtaggagcaagagctttgcttttgtcggccgccccataa

SEQ ID NO: 6144 - DNA, 608 bp, Glycine max
  Peptide Sequence Number=SeqID_122922
atgatgagcatgaagaagataatggaagccaatgcggttgcagttgccgctaccagcgctgttgctaaggtgaactcgacgcccccatctggcctcaaccaaatgaatcattcaacctcagatatggtaggcaaagatttgggaagcatgggcggccccccattatttgcaaattcaaaaacaagcacgctttctcgccatatggcttgcctcccaactatatgccacccaacgtggcgtacactcccaatgagaatgtcaataactccactcctatactcattgagagccaacaacctcaatctgatcatgcacatggcaatagttggtgatatgcctttgcaaaacacattggagggccctcagtatcacccacaaccacaccccttgcattccacaacgggtaaaaaccctcatgctatggtagaaatgggaaagttggatcatctagaggaaaggctcagggccattgcaggaggcgaagattatgcctttgctaacctagaagagttgttcctagtacccaatatcatcacccctcccaagttcaaggtggcggactttgacaagtacaaggggactacttgccccaagaaccatctaaagat

SEQ ID NO: 6145 - DNA, 213 bp, Glycine max
  Peptide Sequence Number=SeqID_122923
atgagggttcactgtaaccaagcaagtcggagacctaacatgatcacagattcacctccactccttatgttcccacgagcccggggcggagattgtagacaaaggatcaagcttaatgttttgatgatgccaaaggattacatgtttctcaaagttttattcaagacaaagaaatcaaagatattcaagatggatgatcaagacagtctctag

SEQ ID NO: 6146 - DNA, 270 bp, Glycine max
  Peptide Sequence Number=SeqID_122924
atgcggaccgaggagactgctaagccgagacatccgcctccccctcatgatgaggagttcgtcgagccacccatccccgaggtttcaatcgcgtccgatctccctacgcattcagtggttgactgcgaaggatgtcaagggatggctgaggatttggagcgggtcatcaacctcaggatggtcactgaaggcactgacttatatgacatcatgactcgatgtttgaggggaactagaggtgacgccgcagatggaagtcttaggtcgtga

SEQ ID NO: 6147 - DNA, 414 bp, Glycine max
  Peptide Sequence Number=SeqID_122925
atgactttggttgtttttgcagcaattgctcgtactgtgggacatctatcaaagagtgctgaggttatgaaacttgtcaataatctcatgaaggctcccgaaatggcggtgacaatgcaagagttcagcaaagaaatgacaaaggcaggagttatcgaagagatagtaaatgatgccattgacacagcgctagattctgaggacatagaagatgagatagaagaagaagttgacaaagtcttgactgcaatagctggtgagacagctgcacaacttcctgaagctgtgagaaaagagagggtgaagctacctggtcaaagtgttggagcagaggaagaggttatagctgagggtgttgacgatgaagaagaaatggaggaaataagggctcggcttgctaaagttcggtcataa

SEQ ID NO: 6148 - DNA, 390 bp, Glycine max
  Peptide Sequence Number=SeqID_122926
atgacagagctttcgatcgcgtgccttctgccatacttgctacgaaatgcgtcaatgaaagcaccaatgatacctagctttcgagggctagggaacctccttgctggcaacgtgaaacctaagaggagcagtggtattcgccgagaaggaagaagggttctagctcaaagggagattgatgaaccgagttcttcagcgggatctaattttcatagattttgccaaaaagatcaaattttgaagcaattgtttttgtgggcaacgttcattctttctgatccttcgaaaaatcaattttcggctttgggatcaatcggaaatggagaaggtgatgaacattctgaagccaaagccaaatccgcagcaactattgagggattggcagcgtag

SEQ ID NO: 6149 - DNA, 252 bp, Glycine max
  Peptide Sequence Number=SeqID_122927
atggagaaagatgcatcgcacataaggccatggaatggaggtttcaatcccttcttcttctctctaacgtttgaaaaacctaacagagcaaccggaggaggagctctagagagcaccaaaaatgccacaattgataacggagaacgcttgagtgactacatcgaggaatgtgataactcactccctgtgtgttgtttgtgtttggatcctgtgatgatcttgaactttgtgtttgggggagcagatgactag

SEQ ID NO: 6150 - DNA, 339 bp, Glycine max
  Peptide Sequence Number=SeqID_122928
atgggatgttacaatcatgctggaagtttctttttatgtcttattgatgaagcaggaagactcaccccttatgttttatttttaggatcacatggcaggcaaggagtcaacactccatctcgaggattcggggactgtaatggacttgtgtgtggtagttacagggactcaagcatgagcctcagtgtcaactatgaccttgttcaagtgagaatgggactcaacataagtctcgatgtcaactatgactcttttctaatgggcatggtacatctcaaaagacgtgcacctttgcatagtggttgtagggacttgttcacaagtctcattgttgactag

SEQ ID NO: 6151 - DNA, 342 bp, Glycine max
  Peptide Sequence Number=SeqID_122929
atgcatgctaggattgttagaaccttaaccaatttttgttatattccaaagcttaagaaaaatctacttgtgtgggtgccttggattcaaaaggggactaagcaaggaaatttgtacatccttcaagtgtccattatggtaggttttgtctccactgtttcacaagctgggagccatgcgtccagtggtgcatccaatgataattgtctatggcatatgcatttgggtcacgtgtttagatgtccaacatattatcacataagtgaaggtaagctggagcctagggctaagaagggtgtctttatggcccatggagaaggagtcaaaggatttagaatctaa

SEQ ID NO: 6152 - DNA, 312 bp, Glycine max
  Peptide Sequence Number=SeqID_122930
atggctccatcaaagagcgaaatggcccgtctcctagtcgagaaggagaggaaggaacaggtggcgacattggcaaccgctagagttgttgaagttgtgatcatcaatgttgtggatgggtcaacaacgtcaatcgccctgcttcagaatgtcttggatgtgaagaatactcccatttcaaggaagaggaacacttcaaggttcaagaggaaatttgatttcaagaatcaagaatcaagattcaaggttcaagcttccaagaatcaagatcaagattcaagactcaagattcaagaatcaagagaagaataa

SEQ ID NO: 6153 - DNA, 429 bp, Glycine max
  Peptide Sequence Number=SeqID_122931
atggccgagaaagtgatgcccaatgttgtggccgtaaataatgagtcaaccattcaatttgttgaagggtttaaaccggtgatggagcaagtgaagttaaagagaggccgttcaaatgcggaatacatgagtggtcatgtcgattatgtcatttcaaccatgtacaaatggtggttccaatgttcatgtcgattgtgtcaagattctgaccatgtacaaatggtggttttaatgttcttgtcaaaagaatatactcaaaaggttggctcgaccacttcaattggtatcatagcatttgatctagcaactagggtaaagagggtttgtaggtggacgagtgaggagttgtgtgataggaccacaaaatccaaaggacccgttcgacccacaatgttcgagcgcgtccaaggtgtgtctttaatccattaa

SEQ ID NO: 6154 - DNA, 273 bp, Glycine max
  Peptide Sequence Number=SeqID_122932
atgcagagtctccagagcttaggcctgccatctattatgagcacagatgagttcctgactcgggtggcttggccaagagtccagccttctccttctgaaggggaggatgagtctgttcctcctaagccatttatctttgagactgatctagtcactcaggaggaagcagcagctcaggagcctacttctccagtttatacctctccagcacctatccttgaggattcccagccatctgcaccagcatcagagccagagcagcctactgtatag

SEQ ID NO: 6155 - DNA, 159 bp, Glycine max
  Peptide Sequence Number=SeqID_122933
atgtgtttccatgaagaaaattcaagccgaggtgcttccgtaacgcatccgagatgtttccgtgagcaaatccacaaagattttccgccgttcttcaccggtcttcatccgttcttcgttctttcttcagtcttcaaccgccgctatctcgccaaataa

SEQ ID NO: 6156 - DNA, 438 bp, Glycine max
  Peptide Sequence Number=SeqID_122934
cgtgactcaaatgtcagtatgacagatcttgtgagcgcggaagatgatgatgtttatacggataaccactcaggtatttccacccgtcagcgtgactcaaatgtcagtatgacagatcttgtgagcgcagaagatgaccaaaagaatgtttatacggataaccacttgggtatttccgcccgtcagcgtaactcaaatgtcagtatgacagatcttgtgagcgcggaagatgacataaatctccgccaaaagaatgtttatacggataaccactcgggtattttcgcccgtcagcgtgactcaaatgtcagtatgacagatcttgtgagcgcaaacgatgaccaaaagaatgtttatacggataaccactcgggtatttctgcccgtcagcatgactcaaatgtcagtatgacagatcttgtgagcgcggaagatgac

SEQ ID NO: 6157 - DNA, 362 bp, Glycine max
  Peptide Sequence Number=SeqID_122935
cgctgcgcgtaaccaccacacccgccgcgcttaatgcgccgctacagagcgcgtcccattcgccattcaggctgcgcaactgttgggaagggcgatcggtgcgggcctcttcgctattacgccagctggcgaaagggggatgtgctgcaaggcgattaagttgggtgttaaaaattgggatttacagcaattggatgttgataatgccttcttacatggcgatcttcataaagagttatatatggagttaccatcgggtcttgttccagctgccccaaatcaagtgtgtcgtttcaccaagtctctctatggtcttaagcaagccagccattaatggtttgccaagctgtccaacttcctag

SEQ ID NO: 6158 - DNA, 1251 bp, Glycine max
  Peptide Sequence Number=SeqID_122936
atggctacggcgagggccctttttctcttaggggctgctctcctctcttgcaccttgataggtgcatcttcgcgtggcgttgagaatcgccgtagcctcctccttccagttccaaataatggtcctgcaatttttgatgtgacgaaattcggtgctgtggcagatgaccagactgacaatattgatgcatttagggctgcatggggagaagcatgcaaaaacagtactactcaggcaaaggttttgatcccagcgggaacatttcgtgcagcacaaactatgtttgcagggccatgtaccagcccaaaacctataattgttgaagttataggaactgttaaagcgaacacagatccatctgagtatgtgactccagaatggttcagctttctagacattgacggccttgtgttgactggcaatggagtttttgatggccaaggagccgctagttggccatataacgactgcgccaagaccaaaggcgattgtgctccccttccagcttctctgaaattcgccaaggttaacaattccatagtgacggacatcacctcgttgaacagcatgcagttccacttccacattcacggatgcagcaacttttcactgtcaaacatcaacataacagcgccggggaacagtccgaacacagacggcatgcacataagctcgagcgacagtatcaaggttttcgacagcgttatcggaaccggcgatgactgcatttccatcggacacagcaccaccaacattgccatcaccaacatcacctgcggccccggtcatggcatcagcgtcggaagccttggtaagaggccagaggagcgaagcgtgaacggcatcagcgttacgaattgcacgttcgtgaatacgaccaacggtgccagaatcaaaacgtggatggggacagtgccggcggaagctacgaacattacctatgaaggtctcatcatgaagggtgttcagaatcctatcattattgaccagagttatggctccaacaagaagacaacgccatcaacttcggtgtggaagatcagcaatattcatttccgtaagatacaaggaactacagtctcaaacattgcagtgtccctgcaatgcagcacaagcaacccctgcgagggtgttgagatagccgatgtagatttggcttattctggcggtcctcacaatacaacttttgtatcctcttgctccaatgctaaagctgtttttggagggatacttaacccaccagcttgctaa

SEQ ID NO: 6159 - DNA, 210 bp, Glycine max
  Peptide Sequence Number=SeqID_122937
atgcttaagattgcaagtctcagtgtcataaaaaatccattagtgctggctgcatggccgttgagctatccaaaccaggggatatttgatagtaacagagcaacaccagaagaagaaatagagaaagcagcagacatgaacacaggggtacaaacagcaaaaccaaaaaggaaggttaccaggcccgcgtatctcagagattatgcttga

SEQ ID NO: 6160 - DNA, 228 bp, Glycine max
  Peptide Sequence Number=SeqID_122938
atggccatgaccaatttcttccgaactgatatgcacagagatttggtgactcatggaggcatacatgtgggcttcctgttttctacaagcaaaagggactgtctcttcttcccttcatgggtatatgctcttcctccatggaatcctaaaaattcccatgacttttttaagaagaggatgtttggggtatccctcaccgatgttattggttttgagccatatgtttga

SEQ ID NO: 6161 - DNA, 162 bp, Glycine max
  Peptide Sequence Number=SeqID_122939
atgttaagaggaaactctggtggacaaaggaaatgtgttacaacagctaaagctcttttcatcgatgaaatattggtacgagactcgtgctcgagtgctggcttcgagggccagaggcctcccagaaagaagaaaagggcagagaaagaatcacgagaatga

SEQ ID NO: 6162 - DNA, 117 bp, Glycine max
  Peptide Sequence Number=SeqID_122940
atgggcgaccaatttggcgaccaagttcaagccaaaggaaggacgcacctagttgctcatgatcctgggaatttaaataaaacaagcgcaagctcggaaggtagaaagataccttag

SEQ ID NO: 6163 - DNA, 723 bp, Glycine max
  Peptide Sequence Number=SeqID_122941
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggggcgaattggagctccaccgcggtggcggccgctctagaactagtggatcccccgggctgcaggaattcgataagggtctcatccattccgaccaagaactcttcaatggtggttccactgactccttagtgcgtacctacagcaccaacccggcctcctttttcgccgatttctccgccgccatgatcaggatgggagacattagtcccctcactggctcccgcggagaaataagggatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 6164 - DNA, 828 bp, Glycine max
  Peptide Sequence Number=SeqID_122942
atgacgtgggtaatcttggtgaaagatagaaaaagaacagaaaaaattgaaatacataactggtgtagagtaatgagaaggaaaaaaacaatggatagaaaagcgataaaagtcatgtataagtatgtagagactgtagtaggagcaggattcatagcaaagggtataacatttgagaactcagcagggcctgacaaacaccaagctgtggcacttagaagtggtgctgacttctcagctttctaccaatgcagtttcgttggctaccaagacactctctacgtgcattccctacgccaattctaccgtgaatgcgacatttacggtactgtagacttcattttcggcaatgcagctgtggtattccaaaactgcaacttatacgcacgcaagccaaacgaaaaccagaagaacttgttcaccgcacaaggcagagaggaccctaaccaaaacactggcatatccatcttgaactgcaagattgcagctgcagcagatttgatccctgtgaaatcctccttcaagagctacctaggacgtccttggaaaatgtactctaggactgttgtcctaaaatctttcgtggaggatctgattgacccagcagggtggttggaatggaatgaaacatttgcattggatacgttgtattatggggagtacatgaatagaggtccaggtgcaaacacaaatggtagggtaacgtggccaggttatagggtaattaacagctccactgaggcaacccaattcacagttgggcagtttattcaaggcaatgattggttgaacagtactggcattccattcttctctggtttggtttga

SEQ ID NO: 6165 - DNA, 402 bp, Glycine max
  Peptide Sequence Number=SeqID_122943
atgggagacagagatgcgctaggcctcaactttggatggttctgtgttcgtgtaacgcttattgctactgctataatcagaattatcagaggacggttggactggcgcggcgtatcggcgaaccggggttcggcaaagtggacagttagagtgagagtggaaccaaatgtcaacgcaatgggcgtggaaagcgtggttacagttcggaaggaagcggccttcttcgccgtcggcgaactccgacaagcagacggcgcaatcgtggatggagaggtgggtgtcggaggaatacgtaaaggtgggaaggaatttgagaacggaagggcaaaggccctcgttaaaagccacggaggaaacggttcgaatggcgtggcggtggcggcggtggcggcggaagcatga

SEQ ID NO: 6166 - DNA, 1662 bp, Glycine max
  Peptide Sequence Number=SeqID_122944
atgggcaagaagaagttaacctttctcatcctcctattagcctctcaagccttggctgaaatcactcccaacacttctgtttctccaggaacaatatgcaagtccaccccagacccatcttattgcaactccgtgctccctccccaaaacggcaacgtttacgactatggccggttctcggtcagaaagtctctttcaaaagccaccaatttcttgaacttagttaacagataccaccgttcctatctttcaacctccgcaatccacgccctggaagattgccaaaccctcgccgaactcaacatagattttctctccagttccttcgaaacgctgaacagaacaacgaggcttttacccacttcacaagctgacgacattcaaacccttttaagtgccattctaaccaaccaacaaacctgcttggaaggccttcaagccaccgcctccgcatggcgcgtcaggaacggactctccgttccgctctccaacgacaccaagctctacagcgtctctctggcactcttcacaaaggggtgggtccccagcgacgctaatgtctccgtgtttcagccaaacgccaagcagcgtggctttcgaaacgggcgtttgccgctcgagatgtccagcagaacgcgcgcgatctacgagtcggtgagtaagagaaagctccttcaggcggcgacggtgggcgacgtggttaaggtaaaagacattgtgacggtgagtaaagatggaagcggaaacttcaccaccatcggcgacgccctcgccgcggccccgaacaagactgcatccacggcggggtacttcctgatctacgtcaccgccggtgtttacgaggaaaatgtgtctattgataagaaaaagacgtatttgatgatggttggagatggcatcaacaagacaattattactgggaatcgcagtgttgttgatggctggacaacttttaagtcagcgacatttgcggtggttggcgcagggttcgtgggtgtaaatatgaccatccgcaacactgccggagcagagaagcaccaggcggtagcactccgaaacggcgcagatttgtccacgttttacagctgcagcttcgaaggataccaagacacactgtacacccattccctgcgacaattctacagggaatgcgacatctacggcaccgtagatttcatattcggaaacgccgcggcagtgttccaaaactgtaacatctatcctcgccttccaatgagtggccaattcaacgccatcaccgcacagggacgaaccgacccaaatcaaaacacgggcacttccatccacaactgcacgatccgaccagccgatgatttggctacgaacatcgatgccgctgaaacttatctcggaaggccctggaaaaattactcccggacggttttcatgcagagctttatggacattgtcatcaattctgctgggtggcgcgaatgggacggtgattttgcttttagcactttgtattatgcggagtttaacaacactggacctggttctagcactgtcaacagagtcacgtggccgggttaccacgtcattaatgccactgatgctgctaattttacggtctctaacttcttgcttggtgataactggctgccccagaccggagtggcttacgccagtaacttgatatag

SEQ ID NO: 6167 - DNA, 1095 bp, Glycine max
  Peptide Sequence Number=SeqID_122945
atgaacaacctcacacttgcatccattctgaccgtgatttctgcgctactactcttcttgggaacaactcatttcactaacaccccaataacaataacaagagccccagatcaaaaacacctccaccatttccaaaagcacatacaagtagtagccaaatccacatgccaaggaacactctacccagacctatgtgtctcaacacttgccacattcccagatctcgccacaaaatctgtcccacaagtgatatcctcagtggtgaaccacaccatgtacgaggtaagatcatcgtcctacaattgcagcggcctcaaaaagatgctcaaaaacctcaacccactcgaccagagagccctcgacgactgtctcaaactgttcgaagacaccaacgttgagctcaaagccaccatcgacgatctctccaagagcaccatagggtcgaagcggcaccatgacctgcagactatgttaagcggagcaatgaccaacttgtacacgtgcctcgatggatttgcttacagcaaaggacgcgtgagggacagaatcgagaagaagctgcttgagatatcgcaccacgtgagcaactcgttggccatgctgaacaaagtgcctggagtgaagaaattaacaacttcggaatctgtggttttccccgaatatggaaacatgaaaaagggtttcccctcgtgggtgtcctccaaagaccgaaagcttcttcaagctaaagtgaaagagaccaagttcgatcttcttgtagcgaaagatggcactggcaacttcaccactataggggaagcactcgctgtggctcccaactccagcacaaccaggtttgtgatacacataaaagagggggcatacttcgagaatgtggaagtgataaggaagaagacgaatctgatgtttgttggagacgggattggaaagacagtagtgaaaggcagtaggaatgttgtggatgggtggaccacttttcaatctgctactgttgaccacggactactacttgggtttgtcagggcatcgtgcactgcattgaaaaatagcgttgtagaggttgatgcattttctgatgcgctctgttgtccttaa

SEQ ID NO: 6168 - DNA, 543 bp, Glycine max
  Peptide Sequence Number=SeqID_122946
atggaaagcaaaacaaactacttgccggtcttggccatatgcatgtgcttgattatagcgcacggtgcggcggaagaaaaaataggcaaggagctaataaagagcatatgcaaaaacaggggaaacgatgaattgtgcatgcaggtgctttcctcggacccagatagtgatcatgcggacctacaggagctggcattgatatcgctgaaggcggcggcatcaaacgcgagcggcatactaaatgattgtaagagaatgatcgacaaccaagatttggaacctaagattcaacaggggttggctgattgcaaagagaatctgttggacgcagagggccaaattcaggatgctgttgcgtccatattgaacaatgacaagcttgatgctcaggtatggctcaaggctgcattggctgcgattgatacatgtgacgattctatccccggggacgatgatgttctgtctagaaagagtgtgtcgtttcgccaattgtgcaacattgccgtcgccatcaacaaggccatgttggccgctcgtacctaa

SEQ ID NO: 6169 - DNA, 1605 bp, Glycine max
  Peptide Sequence Number=SeqID_122947
atgatgcctctaagctcattatttcctgttcttgtaattgctcttgtatcttcatttacatcttcagcagttaacactaattatgaaaacttcattcaatgtctttacagttattcccacaactcctcttcaatctctaaggttgtgtacaccaaaaccaacgcctcgtactcatccatacttcacttttccattcaaaacctcagattctcatccaacacaactccaaaaccccttgtcattgtcacacctacggaagtttcccacattcaagctgcaataatctgttcccaacgccatggcttgcaaattcgaaccagaagtggtggccatgactttgagggtctctcctatgttgctgaagctccatttgtagtcattgacctcataaactatagaaggattgatgtagatgtaaacaaaagggttgcttgggttcaatccggggccactgttggtgaactttactatagcattagtgagaaaagcaaaactctagggtttccagcgggtgtcttcaccactgtaggagttggagggcaatttggtggcggcggctatggattcttgctgcgtaaacatggcctcgcagccgataatatagtcgatgcttacatagttgatgcgaaaggtaggcttcttgatagagaagccatgagtgaggatttgttttgggctattagagggggtggaggagcaagctttggggtcatcgtggcatggaaggtaaaactagttccagttccaccgactgtgacagtgttcagagttgcaagaacattggaacaaaacgcaaccaagcttattcataagtggcaactagtggcaagtaaacttgatggggacatagccatcaatattttagtgcacagggtgaattcaagtagaaaaggggagttcacaatagaagctttatttcaaagcttgtatcttggaggtttggataagctaatgcacttgatgcaagagaattttccagaactagggttgaagagagaagactgtgctgagatgacatggattgactcagtcctttattttgtggggtatcaaagccgtgaagctttgttgaacagaagccaaactacaacggattcattcaaggcaaaatctgattttgtgaggaaccctattcctgaagctggcttagaagggttgtggcaaatgctttatgaagacggtgcacaaggtgcactgttggtgctctttccttttggggcaataatggatacgattccagagtccgaaattccattcccccacagatctggaaacttgtacttggttcagtacacggtgcattggctagaagaagaggatgagatagcacaaaagcacataagttgggttaggagactttacacttatatggagccttttgtttcaaagtctccaagggctgcatatgtcaattatagagaccttgacattggggtaaataataacattggctacacaagttataagcaagccagcatttggggttctaagtattttaagaacaacttcaatagattggcacatgtgaaaactaaggttgaccctcttaatttcttcaggtatgaacagagcataccttctcttctgcctgagggacgcaaatag

SEQ ID NO: 6170 - DNA, 102 bp, Glycine max
  Peptide Sequence Number=SeqID_122948
atggctctggaatctggtctgtgccagtctcctcctcctgagctatgtataaagaagctagaagttggaatggagatggagcaggaaatggtatctgagtag

SEQ ID NO: 6171 - DNA, 504 bp, Glycine max
  Peptide Sequence Number=SeqID_122949
atgttatcagttgtcgttgggtatataagattaaacatcgagttgatggaatgttataaaacatatttggtagcaaagaactgctctcaaatggaaggaatgaactacacaaatatcttttcacccgtagctaaaatcaccactgtccaattactgcttgcactagctgctatgaacaattggtatcttaagcaacttgatgacaataatgcttttcttcatggtgatcttaatgaagaaatctatatgatgcttccaccaggtcttacttcttctaaacttggcaagtttgtctctcagtcttctatgacaacactcttagtcgatgttgatgacacagtacttactgccaataatattactgaaatagttcacatcgctgaagaacttgacaaagcctttaaaaataaagatcttggtgatttgaaatttttccttggttttgaaggaagccaccaattaatccaagttggcacttccatctatacaagatacaccatttga

SEQ ID NO: 6172 - DNA, 576 bp, Glycine max
  Peptide Sequence Number=SeqID_122950
atggatatagaagaagcagcagcaaaccaggtagaagcccctgatttggatgaagatatttcagcagtattttcaccaccatcgttaccgtcatcatcaccgcacaaaaatggttccagtaaccagaatttcaagcgctttgattgtaaattatactttgctgcggtgaaagacgacttcaaaaaattcatgaatatcagaatttggagaattcttgagaagtgcagaaatctagtcctactccctaacgccaagggagaaacactccttcatatcgctgcaaggtatggacactccaatatcgccaaattattggttcaacgtgtcaaagcttttccacctgcagatattgagaatggaattggagcggaccaaaagtttatcagggccacaaatgatgagaaggacactgcattgcatgaggctgtgcgctatcatcacattgaagtagtgaagaccttgttacaaatggatcctgattactcctatcgtgcaaataatgccaatgagactacgctttatctggcatcacaacgacaaatcagcaagtggtggctgagatatcaaacaaagtga

SEQ ID NO: 6173 - DNA, 1287 bp, Glycine max
  Peptide Sequence Number=SeqID_122951
atggagacagaaacaatagcaaaccaggcagaagctactgatttggatgagaatatgtcagcaccaccatcaccatcactgcacgacattggtggtggcagtaacaagaatatcacttgtcgcattgatggtgcattatactttgctgcggtggaaggcaacttccaagagttcatcaatatccacaatttggagaatctgctcaccccaaacaaaaacaccatccttcatatacacttgacttctacaacaagtaaaagtggtaaaacaacacctgcttcagcacaatttgtgactcagattcttgtcaagtgtggacgtctagttctactccctaacgccaagggagaaacactccttcatgtcgctgcaaggtatggacactccaatatcgctaaattattgcttgaacatgccaaagctaaaatttcaccagacattgagaatggtgttggagcagatcagaagtttatcagggccacaaatgatgagttggacactgcattacatgaggctgtgcgctatgatcacattgaagtggtgaagaccttgttagaaatggatcctgattactcctattatgcaaataatgccaaagagactccgctttatctggcgtcagaaagacaaaatctgcaagtggtgcgtgagatattgaagaaagtgaaatcaccgtcatatgatggccccaataatcagacagcattacatgctgctgtgattaaccaagatatagcaatggcaagagatcttctaaagaatgaacatgtgagagtggcggtcaaacttgcggacaagaaaggttgggttcctcttcattatgctgtgaaaacaaggaatgcagttttgactaagttgctgcttaaagaagatgagaacactgcatacatgcaagataacgagggcagaaccgctcttcacatcgctgctgatagtgatagtcggcgtattgtgaaaatgataataaaatactatccagattgttcggagatagtcgataacaaaggttggaatgctcttcattatgctgtgaatggggggaaacagaatacaatacgtagaatcatgagaaacctgtacctgagcaacctttacaatgagaaagatgttgatggtaacacaccccttcattacctcccaaattccaacctcgttgcgtgtcacaaacttgtaggtcaccccagagtcgacaaacttgcagtcaacaagaaagatcaaacagttcttgatgttgcctatgttaagaccgaagatccagatccagaatcagataaacgtacaagagag

SEQ ID NO: 6174 - DNA, 249 bp, Glycine max
  Peptide Sequence Number=SeqID_122952
gcttcaataggtggccttgttggtgcttgcacgcttagcgtaactctggaccgcttagcacgcattagtgaatttaggcttagcacgcgtcttctcgctgagcggatgaactcaagcagtgcgcttatcgggatgagccctcgctcatcaaacacgcacaactcatccttcttcaagattcctcctcacgctcagccaaaggagtgttgcgctcagcagatggctcgctatgccagtagattggcttag

SEQ ID NO: 6175 - DNA, 453 bp, Glycine max
  Peptide Sequence Number=SeqID_122953
atggctacaccattgaacgagacaagggaaccagaatggaagaaagcgtggactgcaaggaacactttgttatctgctcctcctcttccaatactggccatagttggcatcgtggtgtttttgctatgggtttcatcacagttaaataacaacgtactactcatccatgcaaatagccacaaccaacgtgaacttgttcctcttgtttttgcctcagtgttgaccctcatagcccaaggaacacgcctcgtgcttccagcaccaagcgcaacacgtttgcatgatgaagatgtggagtcatcatcaatgccatggggatggatatccaaccgacttcaccttatctttgtaattgcaatagtgtttttgttaggtgttgggtttgtggttgctggtttcgagggtccagcacctttaggagaagaagagaagaaaaagataagctcaaggtaa

SEQ ID NO: 6176 - DNA, 300 bp, Glycine max
  Peptide Sequence Number=SeqID_122954
ggctgggcaaaagctagtgtttctgactttagagttgttcactgtggtgatgagttttatcagggctgggcaaaagctaaattcagtttcaaaccgatggcctcccctgcgactcggaatagcatcaattggtcccctccaatctcgggacacctcaagtgcaaccttgatgctggttttgctcatggcactaacatcactgaaatggggtgttgtgttagaaaccatgttgtggctcttgttgctagttacatgaactcgaggtcaccatgtatggatgttaaggaaggagaaacatag

SEQ ID NO: 6177 - DNA, 1194 bp, Glycine max
  Peptide Sequence Number=SeqID_122955
atggtgaaaatctcacttggtgggtacgatgatggggaaggacccagcaaccgaacccataagcgacgcagggaagaggatgatgatgatgaagaagaagagcaacaacaacaacgaagctttgaaatggtggacccttcaattggaactcaggagcaagaagatcacgctgctccaccccacgatggatcgaattctaacgcaaatggggctggaaccagtagcagggataggtccgttccaatcttcgtttccgaccctgatgtcctcgattgctgcatttgctatgaacccttggctgcccctgtgttccaggtgtttttgtctctaaagtttgcatttttatttggtttttcttatgggattgcatgtgaatgctattttttctcctgtttgcttggtgaactgattctggatggaggaaaaaaagggtcttatgcttttgatcttggaataaaggcacagcctttgggtagtgatttaggttggttagtcgtgaccatgacatgccttaaggctcactgggcactgacagatcacccaacaacaagtaacaagtgtcctatgtgtttaatgcccattggttataaccgttgccgggctattgagaaggtcttggagtgtattaaaatgtcatgcccaaatgcaaactatggctgcaaagagacatttagttacagcaggaaaaacaaccatgagaaggaatgcatctatctaccatgttcatgccctcttactggttgtgattttgttgcctcatccaaggagttattcctccacttcagccatagacatgtaggcatgggaacacggttcgcatatgataaatttttcactgtattcttaagtattaaccagagaacaattgttcttcaagagaaaaatgatggtaatctgtttattgttcacaataaccatgagcatctggggaacatagtccgcattagctgcattggccccaagtccatggcagagtttcagtatgaagtcttggctaggcatcaaggaaacgctctgatactacaatcttttaccaagatcgtgcaagggcaatatgctgatgctccatcaattgttgctggtaaagtttttgtccagtcacattgggcagaacttttcattggattatatgggtattgtggtaacgaaatgtacttcatatcttcggctttcaactggagaattctttgttag

SEQ ID NO: 6178 - DNA, 489 bp, Glycine max
  Peptide Sequence Number=SeqID_122956
atgggtctgcaaccgggcttttcaagcatgacaactgcacttttttttgcactttcctgcatctcgcatagactgggacaacagcacaaagggttaaattgcgatggctgccacagtgcggggttatcgggctatccattttggataaggctcgctataaccctgagttgcagcggggtagttttactttgcgggtgttcgagcgtgatgtctcacaccggcggtaaagaaggaacatatccggggacgcgcgccagcgcggcgatgatctccgatgacgatacaaactggggcaccaaatccctggttatcctggatatgccgtttacggctgtggcggacacgcttctgctgccgtgggatttattccgtaagggacgactccgtgcgctcacgggtagagaaaagcgagcaggaaaatctggcgacaaacgccgtcattccgcccgcaaagatgccgccgcgctagttctggcgcggtttcgctaa

SEQ ID NO: 6179 - DNA, 459 bp, Glycine max
  Peptide Sequence Number=SeqID_122957
atgaagattgtggacttgtcccggaacatgctggagggtgatgcgtcggtgttgtttgggtcggagaaacacacagagaggatatatctggcaaacaacttgtttgcttttgatttgggaaaagtaaggttgtcgaagaccttggggttgttggatgttggccataatcttatatatgggacgcttcctaagggacttacgtcgcttaaggatctgtattatttggatgtgagctacaataatctctgtggtgagattccacggggtgtgtccaatttcgtccgaatcactttcgacttggatctaaggaacaaccgtatctatgggacgctacctcagggactagctacgcttaagtttttgcaccatttgaatggtggaaacttgcaaagatttgacgtgtcttcttatgttaataacatgtgcttgtgtggctctcctcttccagcctgcacttaa

SEQ ID NO: 6180 - DNA, 1584 bp, Glycine max
  Peptide Sequence Number=SeqID_122958
atggttacgatttcttcaacttggtacttgtttcttcccataattttatcgttatgccccataacactatgtgcatcagtgctagaagacctcaaaaacttacatcaaccaccagattttaactctacaattttctccaactgtctcaagaacccgtctctaaggtactgcagttcctctcccatgttggaccttgatgaaatattcaagttcactattgttgcaagccatctctgcaatgagtcaaagaatcccaattgtgtggagtcattccccaaagttgatcttagaaaccgaccaaacattgcacctctttatttgtccttcgatttcttttggaagtattgccccttaagcattatgtccattgatttgtcaaacaattctatgaagggtgattttccaactgatgttctctattgcactcaaatccagtctcttgatctaagtatcaatgcattttctggtgacattccaattcaaagtttctctccccttaccaacctcacttttctcaacctctcctataactgcttctcagagagtaaactctctgattcccaattcttcaaaaggtttaactcttctagttttcttcattctggtgctcttttggatcaaaaaaggtttacagtaaaggctatttttctattggttggctttcccatccttgtcattttgatggtaatttgctttttatggctttgtttccaaaggcctgattttctaccaagtaaacttcaaagaagtaggaggtttacaccggcaattctaaaggcagcaactaatgatttttcaaataagtatttggtaggaaagagtgatgttgttcacatctacaaagggatcttgagagatggtactgaagtgaagattgagatgtactgggatgatataccgagggatagttaccgtaaatttgttgaagaatgtaaggttctgtctaagttacatcacaagaaccttgttagatttctggggtggtgtaggagcagaaaattcagggctattataactgaatggacaagagaagagaatgttgaaatgtggttatcagggtcaggtccaccatggaatcatagactgaaagtgttaatgggagttgttgcatgcatgcgttatctgcaggaggaatggcctgaagttgactatgaactcaacacaagtagtattttattgtctgacaatgtggaaccattgatttcgaggttcaaagttggagatcaaaacagcaatcgaagaaagatacatgggtttggagtatttcttctagagatgatactaagtagaaaggttcaagaggagtttgatggaggtgatgctggatttattagattcatgagaacccttaatcttgcagatttgaagcagatgattgatgagagaatgaaagtaactgaaacaatttttcatcaagttaaacaggcattgtctctaggattaatgtgcatagaccaatcaaacagtgacaagcctagcttggccatgatatttaacactatagcaagagcctacaaggctagccatgctttgccatctgcaaatcatagatttaagagacacatgcctgttcaaaccaaataa

SEQ ID NO: 6181 - DNA, 945 bp, Glycine max
  Peptide Sequence Number=SeqID_122959
atggtgtatttcctttcctcatattctctattgagcacgagcactttgggactcacagcttcgtacttttcttctttctctttcccctcgaactcaaaaataaggtgcatggacgccggcggcttagattccgatggccgtgaattcaacaccgccgaggacatgtggagggaacaggcgggtgaccctagcaagaagacccagtggtatcgtgacggcgtctcctactgggagggtgttaaggcaaatatggatggggtattgggagggtttgcaaatgtgaacgagcctgacataagttgcagtgaggatttcttgaacattctcttgtctgaacgttttcctcctgctgctgatgctagacgccaaccacttgttgctcttgattgtggttctggcattggcagagtcaccaaaaatctgttaataagatacttcaatgaggttgatcttctggagccagtatcacatttcttagagactgcacgtgaaactttggcttcgggatgtcagacaaattcagatatgcacaaagcagttaatttttactgtgttcctcttcaggattttacaccagatactgcaagatatgatgtaatatggattcaatggtgtataggtcatcttacagatgaagattttgtttcatttttcaagagtgcaaaggttggcctcaaagcaggtggattttttgtcctgaaggagaatattgccagatctggattcgtgcttgataatgaagaccgaagtgttacaagatctgatttgtacttcaaagagctattttctcgttgtggattacatgtttacaaatcaaaggatcagaaaggattccccgaagaattatttgctgtgaagatgtatgcactaactacagaccctccaaagaaggctccccgagcaaaatccaaaacatcaactaatagacctagaaccattatgtga

SEQ ID NO: 6182 - DNA, 162 bp, Glycine max
  Peptide Sequence Number=SeqID_122960
atggagttcttggagctcaagcagggaaacatgattgtggctgaatatgcagccaagtttgaggaggtggtgagggtgttcgctagtttccactcttggttaacatgtgccggatttgggatgaagactctcgagatagggcgagctattataggagtatag

SEQ ID NO: 6183 - DNA, 553 bp, Glycine max
  Peptide Sequence Number=SeqID_122961
ggcgatcggtgcgggcctcttcgctattacgccagctggcgaaagggggatgtgctgcaaggcgattaagtggggtaacgccagggttttcccagtcacgacgttgaattcgatcgcgcgcgccgaccccgttgaccgggtgcgcctcaatcatgcagacggccgcttcccagatccgcgcgcgaccggacagcgcttcgtcgaccccccgttcgcctccatcccaggccatcgccgtacgtgcaaagcgttcgcgcagctgcggcacgcatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccggtgcgtcagcagaatatgtgatacaggatatattccgcttcctcgctcactga

SEQ ID NO: 6184 - DNA, 237 bp, Glycine max
  Peptide Sequence Number=SeqID_122962
atggttaatgttgactctagaacatttccattgcatttaatgatgaaatttatgcattttcagcgcaaaggagaatctggcagagcatcagcatcaaagccgcatgctaagcgcaagatcagtgcgctaagcacagcaggtgccttcagccaggctaagctcgagactagcctaagcccaatttcacttagtcgcgctaagcgcgagggtggcgctaagtgcagcgttgcgatttga

SEQ ID NO: 6185 - DNA, 1011 bp, Glycine max
  Peptide Sequence Number=SeqID_122963
atgtcacacttaagcattctctttctcttgctcgtagccctatccttcactcccgcactgtcagaactatgcaacccactagataaacaagccctccttcaaatcaagagagagcttggcaacccaaccaatctctcctcatggaacccaaagacagactgctgcaacaacaactgggtaggtgtctcatgcgacaccgtcaccccaacataccgcgtcgacaacctcgacctctccgaaatttacctcaccaaaccctaccctattcccccctccataggcaaccttccctacctcaaatttcttttcatcaccaactcccccaacatcgttggcacaatacccaccaccatcaccaaactcaccaagcttcgtgaactctatatcagatacactagtgtctccggccagataccccatttcttgtcccaaatgaaaaccctccaattcctcgaattctccaactgcaaactctccggcaacctccctacctggcttccttctctccctgacctctacggagtcgccttcgacaacaatcgcatctccggcgccatcccggactcgtttggcttcgtctcgaagcggttcgggtacatgacactctccggaaaccgcctctccgggaagattccgtcgtcgctggggaagctggacctgaagactgtggatttgtctcgtaacaagcttgagggtgatgcgtctgtgttgtttgggtcggagaaacgcacggagatgatatatctggcacacaacttgtttgcttttgattttggaaaagtaagggtgccaaaggtcttggactcgttggatgttgggcacaatcgtttatatgggacactacctaagggacttacgtcgcttaagaatctgtaccggttcgatgtgagctacaataaactttgtggtgagattccacggggtggtaagttgcaagaaattgatgagtctttctatgctaataacaagtgcttgtgtggctctcctcttccaagctgcaaacgattctag

SEQ ID NO: 6186 - DNA, 390 bp, Glycine max
  Peptide Sequence Number=SeqID_122964
atggggtatctggccggagatattggtgtatctgatgttgagctcacgaagcttggtgagtttggtgatggtggtgggtattgtgccaacgatgttggggttgttggtgatgtaaagaaatttgaggcagggaaggctacctacggaggggggaatagggtagggtttgcggaggttaagttcggagaggtcgaggttgtcgacgcgtcggtctttgggtgccatgaggaaagagtggttgggttgccaagctctttcttgatttggagtagcgtttgtttgtcttgtgggttgcatagttctgagagtgcgagagagaaggacatgactatgagtagaagaatgcttaagagagacatctttgaagggattttgattaattcagtatga

SEQ ID NO: 6187 - DNA, 1011 bp, Glycine max
  Peptide Sequence Number=SeqID_122965
atgaccttcaatacaattgtgagaatgatagctgggaaaagatttggtggggacacagttaatcaagaagagaatgaggcatggaagctaaggaagaccatcaaagatgccacatatctatttggtacttttgtggttgctgatgctattccatcacttagttggtttgatttccaagggtacctaagtttcatgaagagtacagctaagcaaactgaccttattcttgagaagtggttggaagaacatttaaggaagagacgcgtggaaagagatggtggatgtgaaagcgactttatggatgctatgatatcaaagtttgaagagcaagaagagatttgtggctataagcgagagacagttatcaaagcaacatcaatgcttcttatccttactggttctggaagcatagccataacactaacatggacactctccttgctcctaaaccatccaaaggttctgaaagctgcccaacaagaactgaacacacacataggaaaagaaagatgggtcctagaatctgacataaaaaacctaacttatctacatgccattatcaaagagacccttcgtttgtacccaccagcacccttaacaggaatcagagaggtcatggaggattgttgtgtggcagggtaccatgtgccaaagggaacacgtttgcttattaacctttggaacttgcaaagggatccacaagtatggcccaaccccaatgagtttcaaccagagaggttcctcaccactcatcaagacattgactttatgagtcagaactttgagctcattccatttagctatggaagaaggtcgtgccctggcatgacatttgggctacaagtgttgcacttgactttggctcggttgcttcaagggtttgatatgtgcccaaaggatggtgttgaagtcgatatgacggaagggttaggattggccttgcctaaggaacatgcacttcaagttattctccaaccacgtcttccattggaactttatgaatgcctttga

SEQ ID NO: 6188 - DNA, 645 bp, Glycine max
  Peptide Sequence Number=SeqID_122966
atgcatggtttgaagctaactgaacgtttcaagagcactgaggttcatgctttcggttcttcttcatcaaaaacaaattgtggcaatagcagcaaagccttagtggctgctgccaccaaaccacacaactaccttaacagaaacaaaaccatgttaccatcatggtcaaaaaccaaatccagaactaccaacaacaactcaacctcatcagtagcagaccttgcccctagtgttgtctgcgtggttgagcttgccactatcgcagaggagggtagtgtcaacttgacagcagagagaaattttgttgtaccaacgctacactacaacaaaatcccgttacattacagctctaatttgtgggcatgtacaattaccaagcatactttagatgcatttacaaggatagaagttgtagggcacaacaactctgaaaagggaaacaccgtagcttgcagtggcgcgacaagatgcgacacagagaccaaggacgggcgacaatgtactacaccaccttcctttggtcgaggtcacgatggtgcgactgagatgcaggcaaacgacagagctcacgacgaggtcacagcagaaatttcagacaaacggggagggaagcttgagcgcgaggtaggagtgttcatcaattag

SEQ ID NO: 6189 - DNA, 306 bp, Glycine max
  Peptide Sequence Number=SeqID_122967
atgatttatctaaaagatgtgtttctccgacctgaacaacaccgacacatcacacaccaacatgttctgagacaagtccacaaaatcaaagacgagcttcgccagtgtctccagaatccccctagtgaggcagttgttagagagagttatcagcttgaagggctccgagaaggagccgaaggagttcgagatggtggcagagatgcggttgccatcgaaggagactctgtagaggttggagatcaaagggagcctaagagggaggtttccggagaagttgttatagaggaagataatggtttctag

SEQ ID NO: 6190 - DNA, 616 bp, Glycine max
  Peptide Sequence Number=SeqID_122968
ggtttctacttttgacgatttactgccatgtatcgagaagatcactcttttgtttgaggaagaggataggatacttgaggcacatgaagatgctcccccttctcagccacaatttgaacatcaacagtttaatatactacggcaaagtgtggagactcgaggcttagcgcgacgtcgggaaactgttgatgcagcaacatatagtttgcctccgatgccagaacgacaacatggaatgtattacacaccgtcgacattcacccaaaaaccgtctcagatgccgccgatgtattcatacccacatgattttcaaccagggtatagttttgcaggcatatttgggtcctctccttcttcaacggaaactccttcatttacccaaagtggtcaagtatcgaccccaaatgccccacttgctggtccgtggaatgtacctggagatatacccgacatggacgacttattaggggtcgatttacgtcatgatttctctgccgaggctgaccaagtggatgaaagggcgaatcctagaagaagaaatcctgatagggcagctagaaattgggaccggccatgtggaacttcgtcgcgacatcacagacatagtgatgattga

SEQ ID NO: 6191 - DNA, 675 bp, Glycine max
  Peptide Sequence Number=SeqID_122969
atgtatcatgcatatttttattggatgacaaaggaagggagcaagaaaacgagcacatgtggtatgatatcccttgtagtgttttttccattatttgtcacccagtgctttggtcactcacagttagaggtccaaaaaacaactaggggttactatagatgcagcagctcaaagggttgtccagcaaggaaacaagttgaaaggagcagaacagacccaaacatgttggtcattacttacacgtcagagcacaaccatccatggccaacacacagaaatgctctcgctggttcatctcgatcccaaccatcgaaaaacaacaacattgctgcttcaaagaatgaggaagaagaggaggaggagagcaacagtggcagcaataatgtaaataacagtgcatttgtgagggaagaagagaagcagcttgagatggatgatggagaattcagtgatattggaatcccttattgcaagccaatatctaagatgaagaacagccaacaacttgatcagggtttgttagcagaattgggagaaatagaatttgctgactcagtaaacctattgtctccaccacaaggttttgataatcagaaaagggaatccaacactttagattcattccatttctttgactggagaggtgacaacagcaccaagtaccaccttgtttga

SEQ ID NO: 6192 - DNA, 623 bp, Glycine max
  Peptide Sequence Number=SeqID_122970
atggacaactatcaaggtgatttaagtgacataattcgtgctagtggtgcatcgtatggcacttgcagcacgggaactccatcatctgaagctgctaatcccttctctcgtggtcacttgcaattctcttctgatcccatgattttctcttgtgttttggaagggttcaatagcaacttcggtgatcccttctcaaacatgagagatccctttctacacgagcttgatttgcctccttctgcctactttaacatcacaacaagttcatctgcagaaatgagcagttctggggcattggaagaagcaacttgttttggtggtggggttgttgctggtagtagtagtagtagtagtaatagttgtgttttggcacagaagattcttgaggatgatgatatgagaaggccatgtaacagcatattttcaaacatgattcagatctctcccaatgataagttacccatctcgccagcggtggatgctttgtcaagggcactcaagccttctagtatggtaatttcaggtgacaacatgattgattcaaagacctctatagatcattgcttggtggacaacacagaagtgcagatctcatctccaaggaatccaggtcttaagagaag

SEQ ID NO: 6193 - DNA, 786 bp, Glycine max
  Peptide Sequence Number=SeqID_122971
atggttagggtgtcgccgtcctcagcgagaaggagaaatacccgagaggcacactggtgtcctcgatggtatttctcatcacagctgaagcatagtcctcgttctcggcgagaagctatctcgtccgaggtgaggcgcttgaacggcgggggtgggttggggcgaggatttggggagggtaacagagggttctgtttgggagagggtgagggaaaagaggatggtgaaggagaacgaagaggtgggtttggcgaggcccgcggcctgggtgagggtaaggggttggtgggcttggacttcacggcggatttccggcgtgaggccggaaatgaaacagccaatgaggaaggtggggggaatgccaacgatgcggttcgcgatatcctcaaactccgacaggattgggaaagacgcgaggcaaggaagagggaatggcagaatttggatatttgcagctcaaggaatcagaatccgttaagcttgtcccccactaccaagcaagtatcaagcaagctaaaataccaagctaaattcctatctcgccccttatacataatctctcagtgggttgcagtgtttgttcctccgtatcaacctctgtggtctctcattttcgtccctcactctctcgctcaacctctctgtctctgctctctctgtatctcattctctcgtgagacgttaatagccaccgagagccaacgtgagcaccactatcgcaagtctcggcctttacgcagatctgctaccttagccaccgtgagccagagcccagagccaccgtaa

SEQ ID NO: 6194 - DNA, 624 bp, Glycine max
  Peptide Sequence Number=SeqID_122972
atgtcagctgccgtggccgccaccgctgccgccgccatgtcagtgtaccagcacagctcctcctcgagacaagaacaacacagagaccacgaattgcccttaacaccccaacgagtgtgtgtgtctccacctctgagccgcggcgcgcacgtgctggaattcctccgctacctcgaccagttcggaaaaaccaaggttcacgccgaaacctgcgcgtacttcggaaactcccaccctccgggtccttgcgcgtgtcccctgagacaggcgtggggcagtctcgacgcgctcatcggccggctacgcgcagccttcgaggagaacggtggcacgccggagatgaacccgttcgggacacgcgcagtgaggctgtacctcagggaagtgagggacgcgcaggccaaggcgagaggcatagcttatgagaagaagaaacggagaaataagccacaacatagtggacatgatcatcatgatgaggtgatggtgaattattcttcagggtatggtggtggctttgttcctcagcagcaaatgttgtctgattcgaatggaacggcttctacatctgatggggtttcgtatttctcatcatcatcgtcccagtgtggtgggtttaattga

SEQ ID NO: 6195 - DNA, 3987 bp, Glycine max
  Peptide Sequence Number=SeqID_122973
atggcgggccacctagctcctaaaacactctgtttcattgccacgattgccagcaatgatgtagtgctccttgtagacggcgggagcagtcataacttcattcaacagcagctagtgactcaactgagcctcccttgcaaaaccacaacccccctgcgtgtcatggttggcaatggcaaccaactcgagtgcaacaccatttgcaaggacattctggtcaccattcaggctcacaattttcacgttgacttatatgttcttcccatttccggcgcgaacgtggtgttgggcgttcaatggctgaagtccctgggaccagtattgaaggactacaatacgctcctcatgaagttctttcataatggtggtctgatcacactacagggagacatggatgcttccttgacttcactatccttcttccgccgtttatcccgaaagcccgataatgccatgtattatcatatcaccctattaccagacctcaattcaacaacccaccctcttcctcagcccgtccaaacactccttgacaaattcgactcctttttccaaccccctaagtccctcccacctccgagacacactgaccaccacattcatttgttaccacacgcagctccggtcaacgtgaaaccttatcgataccctcattatcagaagcgcgaaattgaagagcagatggattcgatgcttcagaggggactcattcagccaagcaccagtctcttttcatctccggtgctcttggttaagaaaagcgatgggtcgtggcgtttttgtgtggattatagggcactaaatgccttgacagtgcgtgaccggttcccaattccgaccatcgacgagctcttggacgaattaggcggagcttgttacttttcgaagcttgaccttctgcaggggtatcaccaaattcgaatgcatcccggcgacataccgaaaaccgcttttaggacccatcacggtcactatgagttcaaagtcatgtcgtttgggctctacaacgccccttcttcatttcaggccactatgaaccagattttcaggccgtacctccgtcagttcatcatcatcttcttcgacgacattcttgtttatagttactccatggatgaccatttgcaccatttagagcttacattccaggtactgcttgccaatcacttcatcctcaagctttctaaatgcttctttgctcaacttcaggtagagtaccttggccatctggtctcacgttccggtgtcgagccccttccttccaagatcactgccattcagcaatggcctgtgcctcagaccaccaaggcagttcgtagtttcctgggcttagcagggttctatcgtcgctttatacgagggtatgccaccattgctgcccctctggtcaaagcaacgaccgttgaccctttacagtggacgccggaaactcaacttgcgttcgaaaatttgaagcaggcgttatcctctgccccagttctagccttgccggacttcagtattcccttcacagtggaaacagacgcttcgggtgtgggtatgggagccattctatctcagaaaggtcacccaattgcgtttttcagcaaaccgtttagcgccaaattacttcgctcatccacctacgttcaggaactctttgcaatcacggccgccatcaagaagtggcgccaatacctgctgggtcaccgattcatcattctgacggaccatagaagccttaaggaacttctcactcaagctgtgcagacaccggaacaacacatgtatttggcccgtctcatgggctatgattatcagattatgtatcgatcaggagcccacaaccaagcagcagatgccttgtcgcgcgctcctgttagtccctccacgctctacatgattctttcagttccctgcttcaccttcttggaggaactcattcaacaactgaaactccatgatgattatctccgacaacgtcagaacatcacgactgatcctaccaacttcgaggggtttaccttgactgaagatttcatcctctttcgcaatcgaatttggcttcctcgcgatctgcccatcatccccactctgctccgagagtaccacgctacccctactgggggccatgccggaatcaccaaaactctgaccaggctttctgagaactttttttggtcaggaatgcgtagtgatgtctccacctttgtcgccaattgctttgaatgtcaatgcacaaaatatgaaacaaagaagaagcctggcctattatgcccattaccagttctccagcaaccttgggaggatctctcccttgacttcattacggggttaccaccttaccagggccatactgtaatacttgttgttgttgatcgattctccaagggagttcatttaggaatgttgcccacagctcacactgcgcatgcagttgcttcattgttcctgaacattgtagtcaaaattcatggtccaccgcgaagcttggtgtctgacagggatccattattcataagcaatttttggagagagctttttcgcatgagtggtacccagctaaggatgagctcggcataccacccagagagtgacgagcaaactgaagtcatcaatcgggttatagagctgtacctgagggccttcgtccatcggaaaccaacttcttggggcagacttcttccttgggcagaatattctcacaacacgtcatggagctcttccacggggaccacaccttatgaagtgacctttggaagaaagccttttaattttctcacttacctcacgggtcaatccaccattgacactgtggatacgatactcacagaccgcgatgaagttttccacatgattcacaagaagctgttgaagacacaagaggccatgaaacataaagctgatctcaaacgccgtgaagtcacttacaaccctggtgattgggttttgcttaaacttcaccctcacagacaagtctctgccaaaggttctgagcaggtcacgaacaaactctctaagcggttttttggccccttccaagttgtcgagcgcgtaggcaaagttgcttatcggctccaacttccacccaaggccaaattgcacccagtctttcattgttccttgctcaaactcttccatggtgatccagcagtggcgtcgaacactttcacaagtatttccttcgatcaacaaagaccagtggctccattggttatcttggccacacgtagaaagggtgatgcactcatagaagttttggttcagtggcagggattgtctccagatgatgctacttgggagaattgggatacccttcgcgatgaatttcaccttgaggacaaggtgcttttccatgggccgtggaatgatacggaggaacaaacactgcaacccactataacagaggaacgagctactacaatggcagcaaatcaggaaaatgcagaggcaacagaacagagggtccctggttcctcgaaaaccagtttcctttcccaaccccgtatcagaggtcaagtcgagagtgagaatctgagagacggaggagagagagagtgtgcgcgacgcaagcacaacagaagagaaaaattgatagcgcttacagtaagaggtgagaaagagagacaaatcggcagaagcaaggaggctgagagcgagagagcaactgcacgcactgtaactcctaacttcccagatcgtcttcttcctcttttctctccggtgattgttggaactcagagagcttctttgatggaacagtacgagaaggttgagaagataggcgaaggaacatacggcgtcgtttacaagggtcgcgaccgcgtcaccaacgagaccatcgcgttgaagaagattcgcctcgagcaggaggatgagggggttcccagcaccgccattcgcgagatttctctcttgaaagaaatgcagcacaggaacattgagtttgatcctcatgtctgtgtgtatggaaaaatatcggttgtgagaggtcaacctcttaagtga

SEQ ID NO: 6196 - DNA, 336 bp, Glycine max
  Peptide Sequence Number=SeqID_122974
atgcatgcttgcggcttgatcacccatttgtgtctaaggtccaagctcaaagtggttggaaagcattctgccaaccctcacgagcttgtaggggtggatattcagggagttgatgctgaagttgtttccagcatagatgttgttgttgatgattacttactagttttgagtattcgccttgccttctctgcaatcagacacttgtcttctgcagctaaagaggaaggcagcccttttggagaacctgatctctgcaatcaatatgggctggcttatgctgcactttctatggcggtatggaacatgttaattttgaagttgcaagtgctgatatag

SEQ ID NO: 6197 - DNA, 189 bp, Glycine max
  Peptide Sequence Number=SeqID_122975
atgaagaacctcatgctagaggacacgggaacacaacgctctgataggatggtgtcacagaagacaaatttgaagtcggtgattttgaaaagattaatgattgagttcagagttcttcccctacggtcaaagatgaagagggatttactcaatctagtagagaacaaggagaggggtggggggatatag

SEQ ID NO: 6198 - DNA, 252 bp, Glycine max
  Peptide Sequence Number=SeqID_122976
atggcagcagaggaatgtagaacatctagagatgaacacaagttgtctggtcaagtagaacctaatgaaatgatgctttccaatactaaggttaaaactttccaaatattatcagactttgaagacagttcaaagaggttcatgcatggcccatgttaccatgattaccaacattatttattctgtttggataacaacccaaagaacagcattgtcaataaccctagcaaattttggctgtctaaaatatga

SEQ ID NO: 6199 - DNA, 1029 bp, Glycine max
  Peptide Sequence Number=SeqID_122977
atggcaaaaggtagcaggggaagacacaggattgcttctcgtcaattcagagtgactccatacccactggcttcttgcaaaagggacatttgtgaggacctctgccaaaacaaatgttctaaggctttggaaaagaaagagtgggaagatgttacatgttctgtgtgcatggaatatccacacaatgctgttcttcttctttgttcttctcatgacaagggttgccgtccctatatgtgtggaactagctttcgtcattccaactgtcttgatcagtacaagaaagcttataccaaggcaatttcacctaataggcaacctatgcaaggcactccaggtctgctacaagattcaaacatgcatcttgagaagagtgaatccacagagcttgcatgtcctctatgcaggggtcaggtgaaaggttggaccgttgtggaacctgttcgggactatctgaatgcaaagaaaagaggctgcatgcaggatgactgctcatttgttgggaactataaggagttgaagaagcatgtgcgggcagagcatccctcagcacgcccacggatggtggatcctgccgatgaacagaaatggagatggctcgagtgggagcgtgaaagagaagatgttatcagcacagtaacatcagcaatgcctggggcagtagtttttggagattatgttatagaaggtcatcataatgactttgatacagatgaagaggagggtgcaggtaatgcagaaagaaatggaagatttcagatgggtttagaggcaatgaatttcttcctcctgttgcatgcggttcggcaagggaatgagcttaacaaccttggtagacggctgaggcctgagctgacccacaacagggttgcaggtcagaatgcagctgccgtgctggatatctcagatgaagacaatgataatgatggcagccgtctccaccgccatggtggtggcagagttttattgggtcgttctggtaggaggcggagatgtagagaagcacgtgcaaggattggagatagttga

SEQ ID NO: 6200 - DNA, 1503 bp, Glycine max
  Peptide Sequence Number=SeqID_122978
atgaaagctgaactacaagctctgcaatccaatgacacctggagacttactcctcttcctcctcataagaccgcaattgggtgcagatggatatataagatcaaacatcgagcagatggttccatagaaaggtacaaggcacgtctagtagcgaaaggctacactcaaatggaggggctcgattatcttgatacattctctccagtagcaaagctaaccacggttcgtctcctccttgccctggctgcccttaaccagtggcatctaaggcaattggatgttaataacgccttccttcatggcgagttagatgaagaagtttatatgcaagtcccacctggattatcggtcccgaactcgcaaatggtatgtcgattgcagcattcactctatggactcaaacaagcgagccgtcaatggttcacgaagttattgggtcttctaacatctcacggttttaagcagtcccactcagatcattccctttttctatgtttcactggctccattaccacaatactcctagtatatgtggacgatattattttaactggaaacagcgactctgaaatacaagatgtaatcatgcttcttgatcagacattcaagatcaaagacctcgggaatttgaaatacttccttggtctagaaatcgcacgttcttcttcaggcatccatttgtgtcaaaggaagtatgctttggacatactatccgattcgggaatgcttggttgtcgaccaaatgcaactccaatggattactccaccaagctgcaagctgcaacaggtactccattatcagcagaagcttcttcttcctaccgaaggctcgtcggcagactcatctacctcaccaatactcgtcctgacatcacgtacgccgtgcaacagcttagccagtatatgtccagccccacaagtgctcatcttcaagctgcttatcgggtactttggtacctcaagggaacgccaggctcaggcatcttcctttccgccaccggaactcctcagctccgagcttttagtgactcagattgggcaggatgtcaagattccaggaaatccaccaccggtttcatggtctacttaggttcatccctcatttcatggcaatctaaaaagcagtcgacagtttcgcgcagctcttcggaggctgaatatcgagccttagcttcaaccacctgtgaactacagtggtggacttatcttcttcaagacttccgactcaaattcactaaaccagctaccatctattgcgataatcaatcaacaatccagatttccattaatcccgtcttccatgaacgcacaaagcacatcgagatagactgccatatagttcgtcagaaagtcaccatgggcctccttaaactactcccagtctcgtcttccttgcagctcgcggatatcttcacaaaagctttgcctcccactatttttcaaaacctttgtaacaagctgggaatgatgaatatccattccaacttgagggggggatcttag

SEQ ID NO: 6201 - DNA, 1156 bp, Glycine max
  Peptide Sequence Number=SeqID_122979
atattcgcaaggagacctcttgagaatctttgatctccagcaagaagcatcaacgttaaggcaaggagctctctcggtgacgaaatacttcacttggctgcgcgtgatttgggatgaaattgaaaacttcagacccaacccagtctgtacctgtaacatcaggtgttcttgctccgcctttgccattattgcacagagaaagcttgaagaccgagctatgcaattcttgcgtggcttgaatgaacagtacatcaacattcggtctcatgtgctgctcatggatcctataccagctatatcgaaaatcttctcgtatgtggtgcaacaagaacgacaactgctaggtaattcctctcctaacctcaactttgaacctaaagacgtttccattaatgctacaaaaaccatctgcgatcattgtggacgtatcggtcacaccaaaaatgtctgttacaagaagcatggtatgcctcttaaccacgaagcaagaaacaaaagcatgggtggaagaaaaacatgtactcactgtggtaagataggccacaccattgatgtgtgctaccgaaagcatggatatccgccagggtataaaccctacaatggaagacccactgtgaataacgtgacgatgatggatagcaaacccttggaagatcaaaatcagcaccatgagtcccaggacctcgtgcgattctcgctggagcagtataaagcccttctcactttaatccagcagtcatcaggcggaaacacgacattggagcaaacaaaacaggttgcctcgatttcgtcttgcgccattgataaaccttccagcccaggtatgtttcaacctttcacaagctcctggatactagattcaggagcaacagaccatgtaacttgctccctgaataaccttcattcgtatgaacgcatcaacccagtcacagtaatgctccctaatggtaatcatgttcatgctactcactcaggcaccgtgcacctctcaagaaccataaccctattcaatgttttatacatacccacgtttactttcaatctcatttctatttctaagctagtatcttccactaattgtgcattaattttctcttccacctcatgcatgctacaggatgcaagcaatcgtatgaagattggtatagttgaatag

SEQ ID NO: 6202 - DNA, 1503 bp, Glycine max
  Peptide Sequence Number=SeqID_122980
atggactggaggcgcaggaccaagaacaagaagcaccaccctcctcctccgccgcagccgcaaccgcaaccgcaaccgcgcttggagcgtcttaacgccaaaaaaggcatcaattaccaaccaccaccttctcctccttcaccatcttcttcttctgcttccgtttcttcttcttctctcttggatcaccaaaccagcttccgcctcttcggcttcgacggcgagttcgaccgcatcttccagacgctgggcctctccggcccagaagacttctccatccccaccgcagattgggaggcccgcaaggcccgcttatcagggcccaccactcctcctcctcctcctcctcctcctcacgcgcttcccacttcccttcaagatgacgccgtttcgcttcccgttgcggtttcttcttcctccccctggtcttccggggagcacaacgtgggtactaggggcagtgtcggtagattgaatttgagacacggcgaaaggagcgtgcttttcaccgattccagttccttcaccacttcccacgacgatgacagtgatgttggttgcgagagggagagggagagggagagggcttgtttggctcctaattctgcacccgctgatgagttggttattccgtttaactcctccggcgagtggttcagacagaccttcacctcgtggcagaaaggtgacgtcttgggaaatgggtccttcggaactgtctatgaaggcttcactgatgatggattcttttttgcggtaaaggaggtgtctttgctggatgaaggtagccagggaaagcagagttttttccaacttcagcaggaaatatctcttttgagtaagtttgagcataaaaacatagttcgatattatggctcagacaaggacaaaagtaaactatatatcttccttgagcttatgtcaaaagggtccttagcaagtctctatcaaaagtaccgtttaaatgattcacaagtttctgcatacacaaggcagattttaagtggcttgaagtatcttcatgatcataatgtggtccacagggatatcaagtgtgctaatatactggttgatgtaagtgggcaagtcaagcttgcagattttgggttggcaaaggcaacgaaatttaatgatgttaaatcaagcaaaggctctccatactggatggcccctgaggttgttaacttaaagaaccaaggtggttatgggctagcagctgatatatggagcttagggtgtaccgttttggagatgttgacaaggcagcctccttattctgatttggaaggaatgcaagcattatttcgaattggcaggggtgaacctccacctattcctgaatatttatctaaggaagcccgagatttcattcttgaatgcttacaagttaacccaaacgatcgtccaactgcagctcagctatttggtcatccatttctaaggagaacatttctatctcccttaagttttgcttctccacacaggaatatctatcggctataa

SEQ ID NO: 6203 - DNA, 135 bp, Glycine max
  Peptide Sequence Number=SeqID_122981
atggtagtttccaacacaatagttgctattggttgtgttgacttgctcgtcattgtcatgtcaaaattcaacatgggattatccattttccatggtgacaagcataaaaaaactctttccagagtcaagggataa

SEQ ID NO: 6204 - DNA, 565 bp, Glycine max
  Peptide Sequence Number=SeqID_122982
atgtccaaatcttgtggatttgggatgaccggccctctcgatgagtcgatctctagctttctcataagggtggacccaggactacttgtacctatcacttttagaggactacacgtcctcgccaacagagggctgcacgccctcaccttcagaggactacatgtcctcgccttgagagggctgcatgccctcaccttgggactacacgtcctcgccaacagagggctacacgccctcaccttgagagggctacacgtcctcgccttggagggctacttgccctcaccgttgagaggactacacgtcctcgccttgagaggactacatatcctcaccttcagagggctacacgtcctcgccatcagaggacttcatgtcctcgccatcagagggctgcacgccctcacctccagaggactacctgtcctcgccttgagagggctacacgccctcaccttgggtactagttaccctcgccttgagaggactacacgtcctcaccacgagagggctgcacgccctcacctccagaggactataagccctcgccttgagagggctacac

SEQ ID NO: 6205 - DNA, 312 bp, Glycine max
  Peptide Sequence Number=SeqID_122983
atgagttggtttcttcaccatgaagttatttggtggcccaagcgagccagaggcttgcctgggcgagctagggtccaggaaaataatggaaaagatccttttgccctttttttggcggaagttgaacatcaattacgggcctcaatggattgtggtgatggactattgatttgtttggttaatgtttatccgcttatgtttttgaaagatatttgtatcatgggaactgcttggggcaccagcatatttgcaggtacacccagcagttttcaaaaacaccgaaaatatccttatgggtattttcggttataa

SEQ ID NO: 6206 - DNA, 183 bp, Glycine max
  Peptide Sequence Number=SeqID_122984
atgtcatgccggcgtggtgtgcggccatcgtcagccagaagttcgggcagtgcgtatgcccaggctttgacaaaaaatgcagggcttggctggaaacaaagccagggagcattgggtattagtaggtttgagttgaaacagttgagagagaattgcatgttgcgtgaatgcggacctcactag

SEQ ID NO: 6207 - DNA, 240 bp, Glycine max
  Peptide Sequence Number=SeqID_122985
atggggagtagccttagatgtagttttggtgtagtggtgcttgagagtgtaagtggacttaaggctgtggattttaggcaacttgaggtgctattggtaaagaaggttcatcaatttgaggtgacaaaaagcccacttgaggcattagtagatatgggactaaatggagagtacaatttgaaggagttaatgacattggtaagcttaggagctgaacatgggagagaacatggagagtag

SEQ ID NO: 6208 - DNA, 534 bp, Glycine max
  Peptide Sequence Number=SeqID_122986
atggataaagatgctaattcaaaaatccaactccctcctggatttagattccacccttctgatgaggagctaattgttcactatctgagaaacaaagtgacatcatcaccctttcctacttcattcatagcagaaatagatctttacaactataatccatgggagctcccaagtctatgcaaagctttgtttagggaggatgagtggtatttctttactcctagagacaggaagtatcccaatggagtgaggcctaatagagcagctgcttctggttattggaaggctattgggactgacaaacccattttcacttcctgtgggataaagagcattgttgtcaagaaggcactcgtgttctacaagggtcgtccaccaaagggatcgaaaaccgattggatcatgcatgagtatagattgcatgattccacaatctccaattccaagcaaggagggtccatgagagtaggccaatttcatgagttcaatttttcaatttggtggtttttaatgaccaatagtgtaaattattga

SEQ ID NO: 6209 - DNA, 1313 bp, Glycine max
  Peptide Sequence Number=SeqID_122987
atggcatcgctggaagaagaaatggatgaagaagaagaagttgaatcgtcaccggttccaccgatgcagaagaaagcacaaccgaagaagaaagcggttatcggtgatgacgtggagacggtggaggtgcaaaagcctgtggagaagaggaacattccaaatattttgaatctcgaggaaggtgagtttctggaagagtgtaggtggttccttctcggtaagaaggttgaggttgcagtttcaacggctagaagagtgagtagattggtggataatgaaatcgttcatttcaattttccgtgtcggagttaccccagtaagtctcagtggattgttcgagcgtcaaccaagtgttatggagaggacatgaccaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaaggctaatccagatgaagcttcagcgttgcctttgatcaagcgaagaaagggtggtgagcccattgtagagcaaaataatgatgaacaagctcttttagagtcagctttgactaaacttgttggagctgcaaaaatctacaacctaaggatagagaacttagtgtttcaacttcaatttttatcttcaaacttatctctagtgtctcttgttatcaatccttttgcgtcttatatgtctttaggagaaggcttaccagatgagctaaccactatgaaatttgattctttgggatccagtgatgttgatgctttgacatttacttcactatatctccagataatagagcttcttgtagatgtatgggacgacttgttgcctgcaaaaaggttgtatgctcagggaatgggaaaattggaattcaaactgggaaagcttgataggagggttaaagaattgataagtaggttgagtactctatatttacgtgttgaatctatgcttaaagaaagttcagctttgccatccaattccgtagttgaacttgggaaagtattcagtagcacttctatcaatggagcttcctgcagaaagggatggatactgagagtgcagaaagaaatctacatccctgctggtcagcctacactatgcaataggacaatttatgtgaacatctttactggagaagtgtcaaaaaagcttcctaaggcaatgcagatggcaagaggagtgagcaaatgcaatgggacttggaaagattgttatgacaattgctttgatactccgtaccgcaggcaggg

SEQ ID NO: 6210 - DNA, 423 bp, Glycine max
  Peptide Sequence Number=SeqID_122988
atgtttgatgtttgtcctctttgtgtgaaagctgcttttgagaaattttacagaaaacctactaaattcataggaaatatcttcctttgtcactttgccataactatccctcccttacctatgagtttaaggtatggagatttaggatttacaattgtacatgagttaacattaaggatagataattttgggatcagattgaagaaaaaagagcgctatagaccaaaacttagctacagtagtgctggttttaagaaaaaaactgaagccaataacccgagaccagaaacaagaactgcttgtcttgcaatgatgagttttcttggagcagaaaattcaactgcattggctactcttcaaggatttgactcaaaacctactgtaagtgaatatatgttacctcacaatgctcatatgccctaa

SEQ ID NO: 6211 - DNA, 195 bp, Glycine max
  Peptide Sequence Number=SeqID_122989
atgactctaatcacgttgacatggatgtggatgttggggggatgtggcacagccaacaattatagtgaaaaagaacacatcgagcggcgtgagggggaggcgctctctggcgaggttggagcgaagggcggcagtggtggtgaggaggtggtggtgctgcgacacagcggagttggcgcggcagcgcggcagtga

SEQ ID NO: 6212 - DNA, 1383 bp, Glycine max
  Peptide Sequence Number=SeqID_122990
atggaagaggcttcaaagcttttcagggaaatgcctagtcctgatgtactttcgtggaattcaataatatctgggttggcacagaagggtgacttgaatcttgcaaaagatttctttgagaggatgccccacaaaaacctgatctcatggaacacaataatagctggttatgagaaaaatgaagactataagggtgctattaagctattttctgagatgcaactagagggagagaggccagataaacacacattatcttcagttatcagtgtgtctactgggttggtggatctttaccttggtaagcagttacatcagcttgtcacaaagaccgttcttccagattcacccataaacaattcccttattaccatgtactcaagatgtggggcaatagtggatgcatgcactgtatttaatgagataaagctttataaagatgtgatcacttggaacgcaatgattggaggctatgcatctcatggctcagctgcagaggccctagaacttttcaaactgatgaaaaggcttaaaattcaccctacctatataacctttatttcggttttgaatgcatgcgcccatgcaggattagttgaagaagggtggaggcaattcaaatccatgattaatgactatggtattgagccacgggttgagcactttgcctcccttgtggacatcttgggacggcaagggcagcttcaggaagctatggatttgataaataccatgccatttaaaccagataaggctgtgtggggtgcattacttggtgcttgtagagttcataataacgtagaattggccctagtagcagctgatgctttgatcagacttgaaccagaaagttcagctccatatgtgttgttatataatatgtatgctaatttaggacaatgggatgatgccgagagtgtgagagtgttgatggaagaaaagaatgtcaagaagcaagcagggatttcaatcagcactagatgtcagatcatgccattgttagagatgcttgcattcaacttaaccatgttaatactgtcagataggaaaaatgatcttgactgttttccagtgtcaacagtacgtgatttcaaccttggatggctggaagattggagatcaaacttcaaatcccaacccttccatcaatttagatatgcagaatatcatgacattggaccaagaatggaatgctttgggttatcatcagagaaagctgaagttgcccgtggagcatggtacaaggtcacgctgacaggacttcacaacatcctcaagttgtcagggactataagtttgctcaaagagatccatgaagcatatcttgaaatgagacgaggcttcttcaatgtgaacttgtctctaaagtttgaagagcattaa

SEQ ID NO: 6213 - DNA, 688 bp, Glycine max
  Peptide Sequence Number=SeqID_122991
atggaggtggtgagaaaatttgattactctccctttcaaatatcttgggaagagggtgatagggattatggtgatggtaaccctattgttgtttctagctcctcagagaaatcaaaggtcaagacagggcagcagcagtatcccttctcccattcacgtcgacccaatcattctttacatggtgctcatctaaacttagatatacagaaaattagttctggtaattcccttaatgtcagtacttcacgagagttgaatggtgtgtcttcagcttcaaaggacaacttaagtcccaatagtagagtagttcttagtccagttggtgccactagatccacttctatatctgctccctctaggagcttaagtaacaattcaaccccttctgcatggataacattggaaaagagacctacttttcctatccagagcaggaatgatttcttcaagaatctttcaaggaagagttccgtggaaaaaccttgttctgatgtcttgcctattgacatgtcttgtgccttggagaagtctgaagccagcacaaggagtgtctctagttgtcccattctggagtccagagatgcctctttagtggatacatccgctgtgaacatgttgactgactacggctccacaattactgagaatggcaatgctgccaatgaacctttgaaactttcaagcagca

SEQ ID NO: 6214 - DNA, 357 bp, Glycine max
  Peptide Sequence Number=SeqID_122992
atgaccctttcatcatggcagaacaagctagacaagtattttatgtgcaagacccttgtgatgaaaggtggtgcatggatcatggcttctccacatgcctcgcctcctcctcctcttcctcctccttctgacgcattagctttgccatcttccatgaagtggacacggaaagcctcacgtctacgatccttgtctactagaccacctgatgctgagagaccagtggtccacgttaatcctgctaccggcaaggctgacggtccccacaggaagaaattaagaatatatttggggattgtggcacgtgataaggtggacgtgacgttcgagaactggaaggaggtccctactgcttag

SEQ ID NO: 6215 - DNA, 612 bp, Glycine max
  Peptide Sequence Number=SeqID_122993
atggaaggaagtgatcattcattagtaccacaatggttgaaaggcagtggaaatgatagtagggtggctggtataaacaaccaattcacatcatcaccatactctgatcatattgcttattctggtcgtcaatggagttctagtagcaaaggtcttggccactcaaggtcatatagtagttctgagagaagctggcaggatacagactgggagaaagttgatggtaatggcctgacctcagtatcacatgatattcttatgacagttggaagcagtatcaaggctatgacgatgcatcagtataatgtttctacaagcacatcttctattactctgggcacaatgggcctcagtatggccgagacattggctcagggtccacctcgctctcactcaccacaaaatttcagtactctcatggtgtatttttccttacagttatctgctagtactcaaaagcttgaagagttggcccttaagcaatctaggttattaatccctgtgacaccatccacaccaagatccctgggttttatgtgcaatagaaaatttcatggtacatctatatgtggcatcatgattgatgttcctcctgagaatctgctaaactag

SEQ ID NO: 6216 - DNA, 2838 bp, Glycine max
  Peptide Sequence Number=SeqID_122994
atgcaattcttgcgagggctgaatgaacaatacaacaatatacgatctcatgtattactcatggatccaatacctacaataccaaagattttctcgtacgtggcacagcaggaacgacaactaacaggtaacaactctttaccaagcttcaatcttgaaactaaagaagatccttccatcaatgctgttaagagcgtttgtgaattttgtggacgtattggccataatgagagtgtttgttataagaagcacggtgtgcctccgaattatgatggaaaaggcaaagggaaacttggctacaccatagatgtttgctacaagaaacacgggtatcccccaggattcaagttcaacaatggcaaagtaatagctaacaatgtagtggcagtagaaggaaaggccacaaatgaccaaatacagcgccaagaatatcaagaattggttcgtttttcacctgagcagtacaaggcattcctggctttaatacaacagccatctgcaggaaactcaacatccaccaagcctcgggtcgcttccatttcatcttgttctagtaacgatgcaacaggtataaccctatcttacgaaaaagcaaactctacctcctggatattagattcaggagccactgatcacgtttcctcctctttaacaaactttcactcatatcatcaaattaaccccatcacggttagattaccaaatggccaccttgttcatgctacccactcaggcacagataccaataccaaggcgaggattggtatagctgaagtgagtcgcggtctctatcagttcacacccgaaacaacaaaaccacataccatatgttctgctattactcacccaaaatgtaaagtcattcccataaacctatggcactttcgtatgggccatccttccctcgaaagtactcttcagaatcacagacaaaagcttgatcctcgagcacacccatgcatttttcttggttttaaaccacatacaaaagggtatctcgtttataatcttcattctcataatataactgcatctcgcaatatcgttttttatgaagatcattttccattattacatgaacaccaagactccaataacacgcatactcgtatctcaccaactctcttttccaacaacactgaaatccttgacactattataacacccacaatcaatctaaacaatcctacccccctcacgataccaactatcaactcactttcctcacctactcataacccaaacctacgtcgttctacgagaacaaggcatccacccacatacctccaagactttcatcacgctctcacttcccttgctgataccacctcgaccaaggttgagttaaaggctcttcaacagaaccaaacttggattctaactacactccgaccacacaaaacggccattggttgtcgctgggtatacaaaataaagcacagcgttgatggaaccattgaaagatacaaagcgcgcttagttgcaaagggatacactcagatggaaggcttggattttctcgatacattctcccccgtggccaagcttaccactgtccggttactccttgcccttgctgctcttcataactggcaccttcgacaactggatgtaaacaatgctttccttcatggggatcttaatgaagaggtttatatgaagctccctccaggacttattgtggataatcccaaccttgtttgtcgccttcagcattccttatatgggctcaaacaagccagtcgccaatggttcacacggctttcgtcatttcttctctcccagggattccgtcaatcctcagttgatcactcgcttttcttatattctgataatgataatgatataacagctattcttgtttatgttgacgacatcatcttgacaggaaataatctcgagactatagcacatgttaccaagcttcttgatcaaactttcagcatcaaggatcttggtattctgaagttcttcctcggtctcgaagttgctcgttctagccatggtatacacttgtgccaaggcaaatatgttctggatatcttatcggattccggtatgcttggttcccgtcctacttctacccctatggattactctacacgcttaagtgcttccatgggaaccccactatcagaaacttctgcttcttcatacagacgcttgattggacgactcatatatcttacgaacacacgaccagacattgctcatgccgttcaacaactttgccaatatatggctaatcccacttccacgcactcacaagctgcttttcaggtcttacgttacctcaaaggaactccgggttttggcatcttcttcgcagctcaaggtacactcactctcaaagctttcagcgactccgattgggcaggatgccgcgacacacgacgctccatcatcggcttctcagtctatctgggtgagtctctaatttcctggcggtccaagaagcaatctacggcctctcgcagttcacctgaggcggagtatagagccttggcttctactacgtgtgaacttcagtggctcacttacctccttcatgattttcgggtcccctttcttcaacctgcaactctctattgtgataatcaatccgccattcagatagcctcaaaccctgttttccacgaacgaactaaacacattgaaatcgactgccatatcgtgcgagacaaagttaacaaaggattgctcaagcttcttcccgtttcgtcttcaatgcagcttgccgacatcttcacgaagcctctttctcctgctctttttcatggtttatgttccgagctgggaatgatgaacatccattcccagcttgcggggggctcttag

SEQ ID NO: 6217 - DNA, 729 bp, Glycine max
  Peptide Sequence Number=SeqID_122995
atggctccaagctttgatttttccaataggtggatgaaggagactcagaagagtaccccagttgtggtgacaatggagaaccccactttctcggttgtggagattaatggtgttgatgctgcattcaggccagtggagaaaacccgcagcaagaatgctaagcaagtcacatggttcttgtttctcaaggcttaccatgctattggttgtgtaacttggtttgccacagttttgtggtctttgatgggagctaaaaggaagaggttgattgatagggagggtgtgaccttggagagtgagaaaatggaaaaggggaaggtgctgtttacggtcatcaaggtgttccttgtgagttctttggtggttctggtgtttgaggtggtggcttatttgcaaggttggcattttgggaatcccagtttgcacattcctcgtgccgcagatttggaaggcttgatgcacttggtttatgttgcttggctgaggttccgtggcgagtacattgctccaccaatgcaggcactttcaaagttttgtattgttctgtttcttatacagtcagtggaccgtatggtgctttgctttgggtgcttttggataaagtacaagcggattaagcctaagattgatggggatgccctcaaggttgatgatattgaaggatctgcgtgtagccatccaatggttctggttcagattcccatgtgtaatgagagggagatttggtaa

SEQ ID NO: 6218 - DNA, 669 bp, Glycine max
  Peptide Sequence Number=SeqID_122996
atgaagcgccgagataccgttacttggaattccatgattagtgggtacgtgcagcggagggagatcgccagggcgcgccaactgttcgacgaaatgccccgaagggacgttgtgtcttggaacctcattgtttcgggttacttttcatgttgcggaagcaggtttgttgaggaaggaagaaggctgtttgagctgatgcctcagagagattgtgtctcttggaacacggttatcagtgggtatgctaagaatggaaggatggaccaggctttgaagctcttcaatgccatgccggagcataatgctgtgtcctacaatgctgtgatcactgggttcttgctgaatggtgatgtggagtcagctgttggttttttcaggacaatgcctgagcatgattcaacctctctctgtgctcttatatcggggcttgttaggaatggtgaattggatctggctgctggaattttgcgtgaatgtgggaatggggatgatgggaaggatgatttggtgcatgcttataacaccctgattgcgggttatggccaaagagggcatgtggaagaggctcggcgcctttttgatgtgattccagatgatgacgatgatggcaatgaagggaactctttgataggatggtggagcgggataactgttcttggaacactctga

SEQ ID NO: 6219 - DNA, 405 bp, Glycine max
  Peptide Sequence Number=SeqID_122997
atggtaatgatgaaagagaatattattgaagtgaggcttggaaggagccaaatgtctatggtagaaggtgagttccaaggaacatggggtgtcaagagacgacaaagagaggttgctgcagcagcaagcagcggtgatgataaccaccaccagcagttaccacagcaagaagttggtgaaaattcttcaatcagcacaacaaagagaagctcaagacttcgcggtgttaacagctcactagtgggacaaactctcttggaacataacacagaagaagaaagggaagcaagatgttattttttaaatattgctggggcttatgatgaagaagaatctgctacacttaagtattggggaaattcaactttcaccaattttccacatcttacagctgcagatggatag

SEQ ID NO: 6220 - DNA, 306 bp, Glycine max
  Peptide Sequence Number=SeqID_122998
atgacagaacccatcaatgcactacttctaagagtaaagtcccgcgccgttgcacgagcacaacctccaaccgccgtcgcggcagccactggaggcccgtccggcgccactggttgccgcgccaaccaccaggccgccgccgtgcgttgcagtcgcaccattttccagaagcagaaaaacaacgagaagaaagggactgtggtgccgacactcgtgaaggtgaagcaacgctacaaagatgttgatgattacattgccacatacgagtccctcgtctttgaagaagccaaatcccagatcatttag

SEQ ID NO: 6221 - DNA, 270 bp, Glycine max
  Peptide Sequence Number=SeqID_122999
atgcagctgtgcagcttatctaccattgctcgtgagtatttggctgtacgaactataagctgtctcccatacaaggatttaatattaaatgcagttggagagaattttggcacagaagccgagggttggaaaatcccaatccctttgagggaatatgttgaaagtgctttcaatcagtaccaacgtgaggccataacagctggtctatcatcaaaagtctttgtcctgatacaggtaatatttgatgttatgtttatcggtgtatgctga

SEQ ID NO: 6222 - DNA, 933 bp, Glycine max
  Peptide Sequence Number=SeqID_123000
atggctaaaatactgcttagaaggcttgggctatccttcccccttgaattagaggttcttgagatgagaagaatcatccaacctgaagagggggtcacctctctaagtgagagaggggggttatgtgaagagaggataagaagctttccctctagagagttttatgaagactccttggaagatggggatgaagtcaaatcacgggcaatacacgcatggcatgattaccgctgctttggccccttctgcttctttgacattcatgagggaaaagaggctcggccacctgggagtggctcatggataaatgttgaggaagttgactttgttctattcttgtatcaaaaacttatttcactttatccgacactgaagtctggtaaccaagttgcaattatatcaccctatagtcaacaggtcaagctcttccaaaaacgttttgaagatacctttggaatgtcagctgagaaaatagtggatatatgtactgttgatggttgccagggacgggaaaaggacattgcaatattttcatgtgtcagggcgagcaaagataaaggtatagggtttgtggaggatatccggcgaatgaaagttgggatcactagagcaaagtctgcagtgttggtggttggatctgcctcaacattaaggaggagtgaacaatggaacaagctagtggaaaatgcagagaaaaggaactgtttcttcaaagtttcacaaccatattcctcattcttcagtgatgagagtctgacatccttgcaaacaaaggtggctgaaccatctcaggtgactggacctgttgatacattagataatgatgtgcagtctgacaatgctgcagcatttgatgttcaagcacaagctgaggacaatgacgatggagaaggcgatgtcggcatgaatgatgcgtgttttgatgacgattag

SEQ ID NO: 6223 - DNA, 240 bp, Glycine max
  Peptide Sequence Number=SeqID_123001
atgatgaagaagaagggtcccgtggaagatccggattcgtcgagacaagcttcgacgacgccatgccgcgtttctagccgtcttttgttcgacttcaactgtcaccaaacaacactcgcaggaggtgacgagggaggcgacatcgacgtcggggatggagacaaaggtggagtgatgacaatagatctagaccatccaagtggtggtggtggtagggttggccaggaatgggggtggtga

SEQ ID NO: 6224 - DNA, 1140 bp, Glycine max
  Peptide Sequence Number=SeqID_123002
atggtaggtcttgataaatctcgcacttctttttcatcgcaagtttttcactcacttagaatccagagaaaaatcactctttgtctctctcccacttccggggttgttcaacttggaaaagtggcgcatgaatcccaacctgggtctgaaattttcagatctcttactttaacaggtaaactaaaaacccatagcattgaggcagcggcattgtcaaccagaagtgaacggaacagaagaggtgctaagaaacaaaggccaatggcagatagtgccttagcatatctctccacagtcaaggatgcatttaaagatgatagagaaaaatttgataaatttttggaactcatgaaaaatttcactgctgatagattcaaccttgttagtggcatagaagaagtgaaggagctgcttaaagggcatagagatctaatttttggatttaatgttttcttgccgaagggatttgaaatcaaacttccattggaggatgaacaacctccacagaagaagcttgatgtgtttgttgaagctaaaaaaattatgcacaagattgagactcggttccatggccaagataatgtctacaaggcatttctagccatattgaagatgcacaaagacggaaacaggactcccctgcagcttacgaggagattagagagcgatttgagtgaatgggaaaaggattacagagattattatcaagatggtattcagaagcttctatcgctgaaatggagatatggttgtatggttagaccattttgtaatgctgatgaacattttggtatgcaccccatgtcatgcacttgttctgatcaaagttctaagaaaagtggtgaaaggtttgctttctgtgcaaaagtcaaggataaagtacaaaatcctaagaattacttttcaaagcatgtgggtatctacagcaaggaaaaaattactcaacaagaattgcagttatgggcaactgatttcctaagagtatatccggatctcatgaagggatttaatgaatgtgtaacccaatgtaagaagatgaatgaggaagtctatgttggcagtgtgaagaaaagtaacttaacattttcagctacttctggtactaaaactcatggatttatcagaatcctcgagggatga

SEQ ID NO: 6225 - DNA, 315 bp, Glycine max
  Peptide Sequence Number=SeqID_123003
atgaagggttggaaagttccattagctggaaatcgaaaatgcaagagtattttaagatttaccgcatcaaactttaggacaaagaaaatgtttctaggccttgaaggttttcccaatcatactgaaaatgctactgatgtacaggatgggatggataggctatcaaaattacttgacgacataagttctgtgcacaatgaagcggttcctatatctataaactatacactgcttgatgatcaaagagagggagtgaggtttttacatggttttctcaacaacgatcatggaggcatacttggagataacatgtga

SEQ ID NO: 6226 - DNA, 325 bp, Glycine max
  Peptide Sequence Number=SeqID_123004
atggtgtttttgagtcaacgttttaagaaccgcatcaaagtgttatcatggcttcaagattggaacaacaacaacaacaacaacaacccattaatgaagaacataggtggtgaaggaagaaacaaaaggatattgagaaccttgtgggtaaacaaggccatggaaatggaattaacctctttaagcctatcacaagccaaagaagagcctgaagtgattgtgattagctttgatggtgaattagaagaaaagccaactgtgaagggaaaaatctaccaagaagaatgccaaagccttcagtttagtcctatatactataagcaag

SEQ ID NO: 6227 - DNA, 520 bp, Glycine max
  Peptide Sequence Number=SeqID_123005
gagtgaagcgaataagtacactcagcaagagcttatgctgatgaagactcaggatatgggttacattctccagaagattcagagtgagagaaataaaattgaaaggcttactgcctcgctgcactctatcgataaacagccagtgaacaagcatgttttgtttgccgaggagagggaagaggctaaagagttagaatcacaatatcaaaaaagtaaaattccatttacttctgaagatattcctgctggcattaagaggaaaacagctcagtcttaccaagagttggaagcaaggagaagtagactcaaccaactagagaaaatctacatggatatggcaatgcagaaggagttgcagaatgctgaaaaaggatattccatctatgaacagaaaaaaggcaggaagcgcaaactaggtgaagacgagattgtctgtccaacctctaaaccgttgaagaatttgcatgtcttagatgaagcaccaacattgctagctgcagcatcgaatgtcttacattaa

SEQ ID NO: 6228 - DNA, 852 bp, Glycine max
  Peptide Sequence Number=SeqID_123006
atggctattttcaacggtcacaatcatttggctttaggttttggcatgctaggtaacgtcatttcattcatggtgtacttggcacccctgccaacattttaccgaatatacaaaaagaaatccacagaaggtttccaatcactgccttacctggtggcactcttcagttccatgctttggctatactatgcctcactcaagccagctgatgctactctcctcattaccattaattcattgggttgtgtcattgagattgtttatattatcatgttcacaatctatgccaccaaagatgcccggaacttaaccgttaaattatttatggtgatgaacgtgggttccttcgccttgatcttcctcgtcacctactttgctatgcatggctccctccgtgtccaagtcgttggatgggtttgtgtatctattgcagtaggtgtttttgcggcacctctcagcattgtggctcaggttattcgaaccaagaatgtggagtttatgccgtttaacttgtcacttttcctcaccataagtgccgtaatgtggtttttctatggtcttttactcaaggacatatgcattgctatcccgaatattctcgggttcacattgggactacttcagatgctgctctatgcaatttaccggaatggtaaaaccaacaataaggaagttgttacaaaggaggagcatgcactagaggcaatgaaaaacgttgtcgtggtgaacccgttgggaacgtgtgaagtgtacccagttatcggtaaagagatcaataacaatggacaaggaatagaaggtgctgaagagaaggagaaaggcgtggaattaggcaaggaatgcccagtgtga

SEQ ID NO: 6229 - DNA, 396 bp, Glycine max
  Peptide Sequence Number=SeqID_123007
atgaaagatttttggggcttgcatatgccactggtttgtccagatggcactgtggttgcatatgcatggaagcgacaacttacaggacaagttggtgcttctaccattgataggaccagatggaaacttggagacctcgaaaagaggacttgtcaagtcctgtgtagattaagggatgaaggagatgaggccaaagagaccttgaaagaagtactttctcaaaattcttcaaagcagtatgactcagactttgctaatacatgtgaatcttttgtcgagacagtccaacgcgcttttccgcttagcgacaagcttatgcttaacgtgaagaaggcctacaaagaagccaaaggcacgtttagcgcgaaagcccgtgctaagcgcgaagacgtttga

SEQ ID NO: 6230 - DNA, 654 bp, Glycine max
  Peptide Sequence Number=SeqID_123008
atggcgaaaacaacacacatagctattatttcaagtcctggtttcagccacttggtccccataattgagttcagcaaccaacttgtgaagcatcaccaaaattttcatgtcacttgcatcactccctcacttgcaccaagtaattttgctagtgctgcttaccttgagactgaaaatgaggatcctttgaaatttttaccaagtgggtgtttggaaaggacaaaggagaaaggtttggttgtggcttcatgggcacctcagccattgtggttggaactcgattttggagagtgtgcaagagggagtgcctctaaaatagcctggccactctttgcagagcagaatatgaatgcagtgatgttagttgatagcctcaaagggaagaagggtcagtctaatttagaagcaaggaatcaagttatacaactgtcgcctaccattagtgtgcaagagggagtgcctctaataccatgctcactctttgcagatcatgatccaatgagcctcatcatctttaaaactgctgcctacctctgtgattggaacttgattttggagagtgtgcaagagggagtgcctctaataccatggtcactctttgcagagcaaaagatgaatgcagtgatgttagttgatggcctcaaagtaggatag

SEQ ID NO: 6231 - DNA, 243 bp, Glycine max
  Peptide Sequence Number=SeqID_123009
atgtatctaaaatttaatgagaatgacatagtggaaaaggaggaaattgcaaaagtgataaagtgtttgatggaaggggaagaaggtaaagggataggtgaaagaatgatgaatttaaaacattatgctgctaatgcattgaaagatggcccttcaacacaaaacctatctcagttggccagtcattgggaatatttggagcagaatcgaggcttttctagagtttctattaattggatatga

SEQ ID NO: 6232 - DNA, 1346 bp, Glycine max
  Peptide Sequence Number=SeqID_123010
atgaagctcgacaagtttttaaggttgtttgagcatatgggtatctttgttagagatcaaggaagcaaaactgaaacagggaaattcaatgcagctgtttctgaggggtctcatgtgatttctgtggttctggttcggtttatcgctgatcttgaggaggcttttgctgaggtctgtgactctgtgacaatgccttctacagaaaatcagggctcttcgtcgtcgttttcctcgtttggccgttccatatttggtgccaggcaggagcaggttcattctgtggaagcaagtaatgaatctgattcctgtaatttagagcttggattgttccagaagcatgttacagatcggtttcaagtcctttctgcggctagtgatgaggaatttctctcaattgattggattcagaagctccttggagcatttatcagctgccaagaggaattcagagccattctgttgaataacaaagagcaggtcacgaaacccccctttgatcgcatgatttctgaattctttgagaggtcggtgaaggcacttgacatttgtaatgctagccgagatgggattgagaagattcgcacatggcaaaagcatctggaaattgtgttttgtgccttgggttcgagtaagagagcattaactgaaggccatttccggagggcaagaaaggcactgatggatttagcattggcaacgcttgatgaaaaagaatctggatcagttttttctcagcgtaataggtcttttgggcgacataactcaagcaaggatcatcactcctcatcagggcattcaagatcgcattcgtggagtgtctctcgttcctggtctgcagccaagcaactacaatccattgcgaataaccttgtttctccccgtgctactgagattgctgcagcaagtgggcttgtgattcctgtttatacaataaactgtattctcctgatagttttgtggacccttgttgcagccattccttgtcaggataggggtctaagcattcatttttcagtcccgcggcaattatcctggagcactcccgttaccgcactttatgaacggatcacagaggagtcaaagaagcgagagcgccgaaactcaaatggtttgttgaaggagatatatcaagttgaggtaagcagccgacgcttgaccgacctcatagattcagctcagtttccgttggcaaatgaccagaaaacggaagttgagcgcgatgtgatggagctaatgagtgtttgtgaagctttcagaaatggattggatccattggagcgccaagtgagggaggtcttccggaagataatggcttgtcgaactgaggggcttgattacctcggcac

SEQ ID NO: 6233 - DNA, 360 bp, Glycine max
  Peptide Sequence Number=SeqID_123011
atggagttacataacatcggttttaaaaaaaccgatgttaactacttcatgttaacatcgtctttcttctctttctcctcccgcctgaaatctgtcggaaaccgctcgctcgacacccacattgttttcaacactggtggaaaccgctcgctcgaacccacagaaccccctactgaagaaaaccctacactgctcttggaactgtggctcgaagaaaaccctacatacactcctccggtaggtactagggtgctgaaacactcatcggtgctcaaagctcaaagctttctccacgagatagagggtaatatggaggatgttgaagaagctaatagagcagctgttgagagctgtcattga

SEQ ID NO: 6234 - DNA, 575 bp, Glycine max
  Peptide Sequence Number=SeqID_123012
atggctaccaatttgtcagagtctgttaattccatgttaaaaaacacaagacatatgtcggtgtcatcgttggttgagaagacgtatttcaagaccgcacaactctttgctaatagaggtcgacgacaaactcaggtaatgatcaactccggctcacagtattctgaagtcgtcttcgatgctaaacacttaccgtgttctcacgtcatggctgcctgtaaatctatcaatgttgatcctatgacctatgtgccgatgttattcactttacaacacatcttgcacatctatgacaactcctttggtttattgccacacgaatcaatgtggcaagaatatgaaggagatcagtggggtcctaatccaaggagaaacaggactgcaaagggtcatcccgtttcaacttgcattcctactgagatggacgaagacgaaaatgaacgaacatgtagaaaaaatgtggactttgcaacatggaaggaacctctgtttgcatctgcttttagtcctctaatgtttgtaatagtgaccctttccgagccattggtactagatgagtgtctcaatgttggaag

SEQ ID NO: 6235 - DNA, 201 bp, Glycine max
  Peptide Sequence Number=SeqID_123013
atggagattgtggtctctttgaaactcgttgttgcagatctgacaaatgaacgtattagttggcaagagagtttttggagaccaccttcttactaccagtgggagttgttctctgagtgcatacttgattatcgggaaattcatttcaccgatgtcatgtcgtgtacttggagaccaatgcaaaatgctgccgaaatttag

SEQ ID NO: 6236 - DNA, 573 bp, Glycine max
  Peptide Sequence Number=SeqID_123014
atggaaacacaaatagaagagattcagagcacacgttcattgagaatccccaaaatctcttcagttgctagagactctgatatcattgaaaatctgcaatacacgagcctgaaggacatcaaatgtaacacaccaacaaggtattatttaaccttgtatgaggaaaatgactttaactcgacccttgctatcagaaacgagttggctaaagaacagggctgcttcctattcaatatggagggtttcagatcatgcaaacccattcagggcttgtcttgccccaatttaccagtttctgaatcacatgttggggagtattcagaagaaatgattctcattaaggacatcctgcctgaaaatactggaattgctaaaagcattgaagctgcaggatccacgatgtcggatacaatgtccaggacatcctgcccgaaaatactggagttgctaaaagcattgaagctgcaggatccacgatgtcggatacgatgtccaggacatctggcccgaaaatactggacatataaatctgttatatcgttaacagattattgtgcagttagcaagagataa

SEQ ID NO: 6237 - DNA, 195 bp, Glycine max
  Peptide Sequence Number=SeqID_123015
atggctctgaggaagaagaagaatgaggtgttgtgtgaggatgaagaagaatcaaaggggctgacagtgctattgcaagccttaggaagtgcttccgctgataatctcaagtttagtgcctaccaattagacttagagaaaatccagattatcactatgtgcatgtgggagctatctaacaaacaagtgccatga

SEQ ID NO: 6238 - DNA, 291 bp, Glycine max
  Peptide Sequence Number=SeqID_123016
atgtttgttaaatttctcattttcttctgcaaagcttcaatttgtagcctcaaatcagccactaccattgtttctcttgagacagaagacgaattagaaattcgaatagctgcacgtcttccatggtggcattgccgaatgaaactaccagaaaatgcacaacaactgccacttgcagacatggacaaatcaagtgaacaagcagcagggactgagcctcagagtagaagaagaagaagcaactcagcgtgggaagaagaagaagaagaagaagcaaccagcagttcgtaa

SEQ ID NO: 6239 - DNA, 530 bp, Glycine max
  Peptide Sequence Number=SeqID_123017
ggaaaagaaggagaagcttgccacccagctcgcccaggcgagctaggttgcttcctccagaaggcaccaccttctggggaacttcctggaaggcccaacatgttacgaaacttcacggattgtctaacgatgggtgccaagtacctcgaagtggtcaaatgagggtcgcatcccaacaaacagatggtccccgggcgaaattagggcaagttgaagttgttgttgttgttgttgttgttgctattgttgttgttgttgttgttgctgttgttgttgttgttgttggtgttggtggtgttgttgttgttgttggtggtggtggtggtggtggtggtgcaattgtgaaggagctatttaaagagcatactgatttaattttgggatgtaacaccttcttgcaagatgaatataaaatcaaacttccattgaaggacaaaaaccctcctcagaagatgcttggtggacttgaagaggctgcacattttgtcaagaaggttaagtattgccacaacatctgttactctccataa

SEQ ID NO: 6240 - DNA, 138 bp, Glycine max
  Peptide Sequence Number=SeqID_123018
atggcctgcataatggtttttggaatggacaagagatactggttcatccctgcttattcaaaggaagatatacgaaggatggctattcttcagggccttgagtatccatcaacaccagacttcaatgcccaagagtag

SEQ ID NO: 6241 - DNA, 917 bp, Glycine max
  Peptide Sequence Number=SeqID_123019
gttcctcggtctcatttcccaagattcccattggttgcggtctcaacaatgctggtacctttgattctaaatgttctggcataatagggctaggagcacatatcaatttggaacgtgttaatagcactgaccaaattctaagcctttgttacaagtctccaccaaataatgcaattgaggttccaattattacaacacattttgctggcacagacattgtgttaaattctttaaacacttttgttagtgtttctgatgatgcaatgtgctttgctttcgccccagtggcatcaggttccatctttggaaacttagcacagatgaaccagttggttggatatgatttcctgaggaagactgtgtcctttaagtccactgctcaatgttttttatgtattgatggcttggtgcagatcaagaaagcgaacccagaggccgaatttaaggaaatttcaaccatggtgattgcaaaggaaaaacgtgaaactgagtcaatgaggttgttggaagacgagcagaagcagaggactgcgatggaattgcttgaacagtacatgcaattcaaacaagaggcagaaaaagatggaaagaagaacaaagaaggatccattgaaaccaaagcaccccatgtcagttatttcttgttcactaatgataggggagcagctcttgctgccgagaacaagaatttcttggaggttccaaaaatcacatccgaagagtggaaaaacatgacagaagaacaaaaaagaccctatgaagaagagcaatatgccctagaaatggaggcttataaacagaagaaagatgaggaggctggccatttcatgaaggaagaggaggaccatatgaaacttcaaaaacaagaagcattgcaactgcttaagaagaaggagaaaactgaaaatataatcaag

SEQ ID NO: 6242 - DNA, 216 bp, Glycine max
  Peptide Sequence Number=SeqID_123020
atgttttattggcttttcatctatgcgataattgttttggaagatacaaaagagtacattagttatgtctcaaaggaagaggctaaaactcaagatagaagacctgctgatcttttggtatgttactttaatacatcattcattagttctcttgaggcaagtgatcctgaatcccaagctagacaagaagggcaagaggactgctctattttttga

SEQ ID NO: 6243 - DNA, 414 bp, Glycine max
  Peptide Sequence Number=SeqID_123021
tgtaatagacaaaaaggaagtactgagtgcggctattatgtcatgcactggatgtccaccatcattttaggaacttttaggaataactgggaagcgtattttaacgatcctagaccattggagccaaagagattaaaggcgttgcggattcagtgggtacagttttatctccaatgtccacagcctaaatcaaaggctcctgctaggtggattgtcgtcaagtgtaatagacaaaaaggaagtactgagtgcggctactatgtcatgcactggatgtccaccatcattttaggaagttttaggaataactgggaagcgtattttaacgatcctagaccattggagccagagagattaaaggcgttgtggatccagtgggcacaatattatctccgagttagagatcagacctag

SEQ ID NO: 6244 - DNA, 783 bp, Glycine max
  Peptide Sequence Number=SeqID_123022
atggaaaagttaaatgtgcgaaccgcagcagggaaggccaaggtgatgggaacaataataggaattggtgggtcaatgttgctgacatttttcaaagggcaagagattaacgttaagagtttcggtactaatcttttgcaaaagaatgagcaggtagtagctttgcatactgactctggtaaaaaatttctgggagttttgtgtggttttggaagctgcttcagttttgcattatggctcatcattcagtccaagatgagtaaagaatacccaagtcatcactcaagtactgcattgatgtccttgatggctgcaatacaagccacagcctttgccctttatgttgagaaggattggagccagtggaagttgggttcgagtattaggattctaactgtggcttatacggcaattgtggcctccggattagtggtaattgtcattgcatggtgtgtacggatgagaggcccaatgtttgtatctgttttcaaccctcttatgcttgtgcttgtggctgtggctgattccttgatgtttggtgaaaatttatatgtaggaagtgtaatgggagccatgctaattgtgggtggcttgtacatggttctatggggtaagagcaaagaaatgaaaaaggcgaatctgtcggtctcatcagaaatcaaccaagagcatgaagcaactgaagttgttgtcatgtccacaacaataaatgatgataattgtgaccgcgttaacaataccgacgccaattgtaaaagcaatatagttgccaaggtttcttga

SEQ ID NO: 6245 - DNA, 1050 bp, Glycine max
  Peptide Sequence Number=SeqID_123023
atgaagaaagtaatgcaggagttgaagcctgtccttctgatggtgttggtgcagcttggatatgcttccacgagtattcttttgaagttcgccataaatgatggaatgagcattcgagtaatcgttgcctatcgtcacattttcggggctgctttatcatgttctcttgctctttttttcgaaagagggagtttattccaaaacctagctttcgttgcgttggctttggtatcagcaacgttccaagttgctatattcaatctggttcctgcagtcacttttattctctccatcttgtgcggctacgaaaagttaaatatgcgaaccgcggcaacgaacgctaaggtgttgggaacaatactaggaattaccgggtcaatgctgctgtcatttctcaaaggggtagaaataaatatttggaaggacattcacatcaatcttttccataaaaatatcaatagtcagctaggaacatcgcatggaagagaatggctaggtgttttatgtggcattggaagttgcttgagtttctcaatatggctcatcattcaggctaaggtgagtaaggaatatccaagccatcactcaagtacagcgttgatgaccttaatggcagcaatacaaggcgcagtctatgccctctgttttgagacagaatggagtcaatggaagttgggttcaggtatcaggcttctcacggcactttatacgggaattgtggccactgggttagtgaatattgccacttcatggtgtgtacggaagagaggtccattgtttgcatctgttttcaaccccctttgccttgtgctcgtggcttttgctagttccctgttattacaagagcacctatacttgggaagtgtaattggagcagtgctaattgtttgtggtctgtacataatgctgtgggggaagagcaaagaaatgaaaacagcaactcacatggtatcatcagacaacaccgtaggagaatttggagtgactgaggctgttgtcgtgtctacgacagacaatagtgacgacggcagtaaatgtcaacatcaatag

SEQ ID NO: 6246 - DNA, 367 bp, Glycine max
  Peptide Sequence Number=SeqID_123024
atgtcatttttgggagaaacaagcagtcagaccattactaactccatattagctttcatttttccaaatggatcaatcagttacaaccaaactggtgtttattttcaaagtctcattccaacaccaatgcgagttcctaacaactgttcttttgatacactcaagcgtagaatgcacaacacccttcaactaaccaacgatcaattactggatgaaatctactaccgacagccattcatagatgcagaattattatgtaccattattagaacaccggatgctatactcaacctgcttcaatcaaccatcactcctactcatgatgcaattatgtattacaacgggaagtggaacataccacgtcaag

SEQ ID NO: 6247 - DNA, 330 bp, Glycine max
  Peptide Sequence Number=SeqID_123025
atgtcacttgttgctttaagtaaagaacttatagatgccatcagaggtgatggttgtgttaagtaccacagtatagagcttaaagacaacaatgatgtgagaaatatgtttttcatcttttcagaatttagttctaaagaaccaatcaagttgtatgcaatggttggccaatctccaaaagacatccttggcttgctacataaaacaagaaagccaagatttgtcgaagagatcattgctctgatgtatggatcaatagcaacaagttctaacgaagatgataactttgtacttgtgttttcaattgatgaaatctatgttggttgttga

SEQ ID NO: 6248 - DNA, 1203 bp, Glycine max
  Peptide Sequence Number=SeqID_123026
atggcgggggcagcctctgctctgttcctcctcgacatcaaaggccgcgtcctcatttggcgcgactaccgcggcgacgtcactgctgtcgaagccgaacgcttcttcaccaaactcattgaaaaagagggggatccgcagtctcaagatccggttgtgtatgataatggtgtgacctacttgtttatacagcatagcaatgttttcctcatgatggctaccagacaaaactgcaatgctgctagcctccttttcttcctacatcgtatcgttgacgtgtttaagcattattttgaagaattggaagaggagtctcttagggataacttcgttgttgtgtatgaattacttgatgaaataatggactttggctacccgcaatacaccgaggcaaagatacttagtgagtttatcaagacggatgcctataggatggaagttactcagagacctcccatggctgtgacaaatgctgtatcctggcgcagtgaagggataaactacaagaaaaatgaggttttcttggatgtggtggagagtgttaacatacttgtcaatagcaatggacaaataattagatctgatgttgttggggcattgaagatgagaacatatctgagggaagactattggtttgagggaaaattcaatgctgtagaagtttacagtggcaaactttccagtagcttttatggcaatctttacaagcaagttgtcaccactggcaaactctccactctccagcaagcttcaactcttggttacgtttccagcaacttccggcaaactttcgactacttttttggcacccttcaagtgccgttgaacttcttcagagaagttaagcctttagtttgggtggaagcacaagttgaaaaacattcaaaaagccggattgagattatggtaaaagctaggagccaatttaaggaacgcagtactgccacaaatgttgagattgagttgcctgttcctgctgatgcaaccaatccaaatgttcggacttcaatgggatctgcatcatatgcacctgaaaaagatgcattaatctggaaaataagatcatttcctggaggcaaggagtacatgttaagggcagagtttcgtcttcccagtatagtagatgaggaagcaactcctgagagaaaagctcctatacgtgtaaaatttgagataccatattttactgtgtctgggatacag

SEQ ID NO: 6249 - DNA, 276 bp, Glycine max
  Peptide Sequence Number=SeqID_123027
atggctagggtcatcgggtttcggttactactgcagttaggaggaattggagcttcggattttgtttcttctgtctatcgttggaaacgtatgttggattcgattcggggcgcggtgcgttcgaaccctcctaggtcgttgatgtcttcgttcgcattatcagcgacaaggtcagcacgacgagttctgatggaagcttgcttaagaagcttctatggaggctcaatgaggtccttccatggtgattttcaaccatggagttgtagcggaagataa

SEQ ID NO: 6250 - DNA, 669 bp, Glycine max
  Peptide Sequence Number=SeqID_123028
atggacagggagtttacaaatggacggattacaatggggatgagcatccagcagctcgatgaatttgagattgccgaaatattccgatctggccaagtacatccagataaggtactggtcatcaatccgttcgaaaaaaacagcgaccagattctaaaaaatcaaaatatcctggcttccgtacagtttaaccctacggaaaaatcgggttggaatggaaattaccggttcatctcgaatgataatctcatcaatgccaatttcagtaatgaagaacgggagcagacctcccacttcctgaatttaggatattggttcaataaagaattcagggtcgactgggaaaattccgttcatgatattaaaaattcttcacaattatttgcgaccagggattacaggctgaataactttgaaaccaagccaaaagccacctataaatttacagacgccatacaggcagagctttcctccgctttccgccagaaacagagaatagacggagaggagttactaaaagcttttgatgttacaggaaccatacaatgggagcgaaaaaaaacctctatcagaggaaatttctcattcatcaacaacaactttaccggaaacaacttcagtattgtaggaaatcagatgctggacggccttaagcctggaaaaaatcag

SEQ ID NO: 6251 - DNA, 189 bp, Glycine max
  Peptide Sequence Number=SeqID_123029
cccaatcctcttgctcatggctctgatgactggtcccttcctagagaggattgcatcaagtttccttgtagtgcggcgatggtcgagtcaagcatgaagataaagagaagggaagagtgtgaagatgaagggaagggtcgagagtctcgagccatcgagcatgatgatgagcgtgaagaagagaagtga

SEQ ID NO: 6252 - DNA, 231 bp, Glycine max
  Peptide Sequence Number=SeqID_123030
atggttccaacaagagaagtgctggaatttaccactcaagatgttctcttagctcgacaaaagctgctcactaggacaattgaagaatttacacaacaagttagtcatctacttcagcaactcaagctacaaccaactacctctattcctaaattcaaatgttttgcttgtgaaacttatggaggaggccatgcaacaaatgagtgtgctatggttcaagaggaagtttag

SEQ ID NO: 6253 - DNA, 930 bp, Glycine max
  Peptide Sequence Number=SeqID_123031
atgaaaagggctcaactcatctttgccatcatcaaagggctatcaattgatattggccaaaccttttctcatgagattttctccatggctgggaagaagagtttacctcctagtttgtcagctctgatcattactctatgtgttaagaaaggcttagatattttcgaagattgggcgcaaccatttgtagaccttcaacctaccattgatgctccttatattgagaaaagaatatggatagatggtgattctcttccaaggttggaacctcttcctcctaaaccattatctttaaatgaaatattggagaagatgcatgaagaaataactttaaagtttgacgctaagcatagatcaaatctaattctctttgaccatttgagaggtaccttaaggccaaaggggttgtgggcaattgagactggtggagctgatggtgatgctactaatgaggatcatgttgtcagagttaatgtggatgttgctaaaaatatggagcctaccactgagactagaactgatgaagatgtggagcttaatgatgttggtgttgtggatggtgatgttgtgtttgagaagactagtgctagagatttcactactgaggatgatgaaattgcttctaaggagactaatgaagttcttaacatcatcggaaatgccatctttgcaataaatgaagaaaccatttttgagaaggaagctcaaaaagatattgttgtagaagttgaagcaactggtgacactaccgagagtgttactgatgaagttgctaacatcattggaattgtcattttttccataaatgaagaaaccattgttgaaaaggaagctcaaaaagatattgttgtagaagttgaagcaattggtgacactactgagagtgttactaatgaagaccaaatagaggaggagattgctactaaatga

SEQ ID NO: 6254 - DNA, 310 bp, Glycine max
  Peptide Sequence Number=SeqID_123032
atggcagcgcagttcatccatgaccgagtggagatggagtgcctagagggagtttgggagaccctcgaaggcaatgcgaggtgccgattccgtggcacgttccgactcacggctacttcgttggtacatccagaggaactagcacgcacgcttcaatgcactgtggagtggatattacctacacctactccatatctactagtggagccagtccaagtgattgaggtgacgtcatctaaggaagaccccgaggaggacccagaggagctacctcctgagcctgctgtggatgctcttgactttctagagg

SEQ ID NO: 6255 - DNA, 879 bp, Glycine max
  Peptide Sequence Number=SeqID_123033
atggagcaggtggtagaggtcgctcgcgtattgcgcgaggtacatgatttccgtggttacatccacctcaaaaccattcccgatgccagcccggaactgatggcacgtgctggcctgtatgctgaccgactgagcatcaatgtcgagttgccgaccattagcagcctgcagacactggcgccggagaaagatgggcaggccatccgccgttccatggggcaattacggctcaagatagaggaaagcaaggacaagacactgaccggcaaaaagcccaagcgtttcgcgcctggcggccagagcactcagatgattgtcggcgcggatgccaccgatgaccgtgccatccttgataccagcgctaacctgtatggcgcttatcgtttgcggcgggtctattactctgcctttagtcccatccccgatgccagcaagatgttgccgctaaaggcgccaccgttggtacgcgaacaccggctctaccaggccgattggctgctgcgcttttacggttttgaagccgacgagatcgtgaccgggcacgatggcatgctggacctggatgttgatccgaagacagcctgggcgctgcaacatcgcgaacagtttccggtagacctcaaccgtgcatccaaagccatgttattgcgtgttcctggattgggggtcaccagtattgcccgcatcctggctgcgcgcaaagtacgtgccatacgctacgatgacctggcccgcttgcgggtttcacttaaaaaggtgctgccgtttattctgctaccggattatcatccaggacatcgccttgacgaccaatacttaaaacagcgtttgcagcggaccatcccaccgcaacagtttggtttatttgagtccgtctag

SEQ ID NO: 6256 - DNA, 228 bp, Glycine max
  Peptide Sequence Number=SeqID_123034
atggggtgccccaaatgcttatttaaaattgaatctaaccagccttcactaaaaaatcatcgcattagaaacattcatacatgcacatgcacatgcatatcttgtgatagcaaggagcagaatcgtctcaggccacggtcagaagtcaggacaagtcgatggcagaaatcaaccaaggtgtgcgtgggagaaaaacgaaaaagatctttgaatgtaaatagggtttga

SEQ ID NO: 6257 - DNA, 1191 bp, Glycine max
  Peptide Sequence Number=SeqID_123035
atgaacaaacgtcatgattctgaggaggaatctgatgttgacagtgaggaaaagaaatatggtagacttgagaagcagaagacaaggaggcataattctgatgatgaggactctgataaagatggtgttaggcgtgcattgggtcaagacagatatgttagtagggggtcatacacttcctctaacaagagtagcagtgacagtgattcagacagcggttctagtgatcacagacgtgaaaaaacaaaaaaaggtgggtctgttgctgcaaagaaagttaaaggatatggcatggaagaaaatagattcagagatgaagccagagatagtggtgcagataaagggaagtatggtgctaatgttgatgcattgggctctcttacaaagtcatatgggagagatattacaaagggatcaaatagtagaagtcgagagatgacacacggtaacaggaaaattgatggagacagagagagggagcctgtcacagtggtcaagcatgatgaagatgatagaaaaatggagtctgaatctaaatcagctaggtttgcagggcctgatgatgatagctctgagcagagaggaagaaattataacaaggatgttgaatcacattttgttggtcgaactgctcggtatggtgaggatcatgaaaccagaaggcgtagaaaagatgatgataatcatagggagcatgagcatacaagggataatgatgaccatggagaaagaaagcatggaagggatgaagatgatcgtacaggaagaaagcatgcaagggaagaggatgtcagagaaaaaaagcatggaaaggatgaggatgatcctaaagaaaagcacagaaggcatgacgatggccttggagactatcgtatgggaagaaagcatgcaagggatgaggatgatcttggagaacgaaagcatgcaagggatgaggatgattccaaagaagggaagcacagaaggtatgatgatggccgtggagagagaaagaacttgagggatgaagatgaccgtgcagagagaaagcgtggaagggatgaagattaccgaactggaagaaaacaggcaagggatgaggatgaacatagagaaagaaaattcagaaggaatgaggatgatcgggaaggaagaaagttcagaagggacgatgatgtttatggagaaagaaagaacttaagggatggggat

SEQ ID NO: 6258 - DNA, 183 bp, Glycine max
  Peptide Sequence Number=SeqID_123036
atgccggggttaacgtgcaacgcttgtaacaccgaattcaaagatgacacagagcaaaagctccattacaaatccgagtggcatcgatacaatctcaagcgcaagtttatccaaatagcgtcttataatgttgggacttgggagggagatgttgttaccaaagaggcatatcaagtgagatga

SEQ ID NO: 6259 - DNA, 1293 bp, Glycine max
  Peptide Sequence Number=SeqID_123037
atgccggggttaacgtgcaacgcttgcaacaccgaattcaaagatgatacagagcaaaagctccattacaaatccgagtggcatcgatacaatctcaagcgcaagtttatccaaatagcgtcttataatattaggacatgggaggaagatgttgttaccatagaggcatatcaagtggctggggttcctggggtgaccgaggcgttatttctggctagacaatctgtgcttgctcaagagaaaaataaactgggtgaaacccccatgctctacagctgtggtctttgtggaaaggattataaaagttctaaggctcatgctgagcaccttaaatcacgtggtcatatgatgcaggcctctgaaggaactagtcacgcagatgagaaggcaatagttaagcctcttccacaacgtgttgtgaataggcctcctcctaggagagaggtagataactctgaaaatgaggaaagtgaagatgaatgggaggaggttgatcctgaagaggatttggttgatggtgctgcaaagtccttgactgatttgaatgtgaatgagcatggtgaaaatgttgatatggaggtagatgatgattttgaggagttagacccctcttgttgctttatgtgtgatcaagagcacaaatcaatagaaaactgcatggttcacatgcacaagcatcatggattcttcattcctgatgttgagtatttgaaggatccaaaaggcctcctcacctatcttggccttaaggtcaaaagggactacatgtgtctgtactgcaatgatcgatgttatccattcagcagcttggaagcagtcaggaaacatatggaggcaaaaagtcactgtaaagtgcattatggtgatggtgatgatgacgaggaggtagaattagatgagttctatgattatagcagcagttatgtggatgatcaaggcaagcagcttgttgcgtcttgtgatgcatctaacaatgtagaacttgttggtgggtctgagctcataatcaccacgaaatctggtgaaagatcatcaaccaaaacactaggttcccgtgaatttttgcgttattatcgtcaaaaacctcggccatcactagcaaatatggctatcactgctgcgttggcttcaaggtacaggagcatgggcttgaccactatccaatcaagggagaagattgtgaggatgaaagtgctgaaggaaatgaataggtcaggtgtggacaatatgcgtactaagatggcgatgaagagtaatgtcatcaggaacctgccaaagaatgtaccatattag

SEQ ID NO: 6260 - DNA, 147 bp, Glycine max
  Peptide Sequence Number=SeqID_123038
atgccctgcctcaaaggagtcaaaaagggacaaggaagggctaacaagacagatggaatatatggtgttgtgaacagaagcatggagggtggcgtggaccctacacgttgtgccatgtttaaaaccaatggacatgtattcatttga

SEQ ID NO: 6261 - DNA, 1105 bp, Glycine max
  Peptide Sequence Number=SeqID_123039
atgggatggggtcggggatactcgatacccgattggtacggggatgagccaataaacttaaacccgtcgggtatggggtacgggtatgagaatatgttggagagtcgggttttaatttcagtgggtgttgacatgtacaacggaatagggttacagaccccaagagggtcgggtacgaatgggtacattcagagcaataagttttttgtgaagccgaagatttcgaaggttgctgagaacacgaaggggtttgaggcggatcagggcactgctggtgttagtagaaagcccaacaaagagatccttgagcatgaccgcaagcgtcagattcaactcaagctcaccatccttgaagacaagctcatcgatcagggctacaccgatgcggagattgctgaaaagctcgtggaggctcgtcaaaatttggaagccgccactgcctccaaggaaacagatggacctgcgtctgtgtctgcatcagataagaaaagagggtggtttgattgggaaagaagcatggtggaagagttggaagcatatgagcagttgtatgatatctttaaaggaccacaagttcaaggcaacttatctcaggtttggagaatgaagatccctctgaagttgggtgcatcaaatgttttctgtcctttatgtaattctggatctgaatctgtgaaccatattctgttttgtgcacaaaggttctacaaatatggcagggtttcaaatacacagactcatcaaattgctgctaggaaggaaaagcagatggaagcattgaaggctgctcttggcatagtctcatctgaagccaatgaaataaatgaagatgggactgatgggcttggaaatgatggaaaaaatggtcctaatgtggagggtaattcaaagcctgaagattcctttttggacagagatttcagtagaaagaaacaaatggatgattcatctgattcagacagcagtttgtctgatgagaagagaggtacaaggaagcgtggtaaagattatacaagcagtagtgatgaatctgattctgatagtgatgctaagaggaagctcaaggctgaaaagaagcggaagatacctaagcaccgcaagaaag

SEQ ID NO: 6262 - DNA, 123 bp, Glycine max
  Peptide Sequence Number=SeqID_123040
atgaattgcatgatctcctttctcctgcatgtaaatcctgctaacaagaaaatgcttgggagtggtggtgctgatggagctatatacagggccgcaggcaccttgttgaagcatgtcgggtga

SEQ ID NO: 6263 - DNA, 317 bp, Glycine max
  Peptide Sequence Number=SeqID_123041
ggatcacgcccacaagacacccagcagacccggagaagtccaacagggtcctggggtttccagctctaatcacaggcctctgtcagttctatggagtgcccgtcgctcccaacaagcctggggatggccggcaacgggcaataaacgcaccgccactagctctagagcccctcagccccaataggcgaccaagtccaaagccaaagctccccgcgaagaggtccaggaagggcaccattgaagaggattccagtgtggccccacaagttgacacaggctttgacaaacaccgattccagagcgtggaacatcaatag

SEQ ID NO: 6264 - DNA, 774 bp, Glycine max
  Peptide Sequence Number=SeqID_123042
atggaggagcaattcatacttcgagttccacccaatgtggcggagcggatagagtgtcttctgaatgaaaacaatgctccttcatcagaagacaagtcactagatttgtcatttagtgaggatggaagaagtggtacatttatgattgggaatgaacacttcgcagcttctctattggatcttccttgcgttgttgaatcctataataagacttatgatgataactctttgattaagactgccgatattggccagatgattatggtgagggaatctggtgatgctgctccagatgttattgagtacagacatggcctcactccacccatgagagatgctcgcaagcgtagatttcgcagggagcctgatcttaatcctgagcttgtctcccgtgttgagaaagatcttctcaaaatcatggctggaggaacagcggacaatcttgatatccttacatctttgtttgtgtcaaatagcaatttagcaaaattttcaatccttaaatacaaatctatgttctctttaaaattagtagttattgtgatcgttgctgttgcttatttctttcccttttacttattcctttcctcacttatagacatatgggattcacatgtggaagcagctgagcaagaggaaggggatgagaatgcccgaggtgccaataaaaaagctgcacctaagcctgcaccaaaacatgatgctccagagaatcttactaatgcaggggaacttgacaggagtgattctgaggaatctgatgactcagtctga

SEQ ID NO: 6265 - DNA, 189 bp, Glycine max
  Peptide Sequence Number=SeqID_123043
atgtgctcaaaagaaacacagaaggtgacaacagaactcatggcgactcacgacatcgataatgagacgatgacgaacaccaacaacaagcacacgcgaattaatgaagatgaaccaccgattaatgaagatcaaacactgattgaagagaagaagatgagaggagaaatgcagaagaaaatcccttaa

SEQ ID NO: 6266 - DNA, 273 bp, Glycine max
  Peptide Sequence Number=SeqID_123044
atgggtaatttttccaattttagtttagcagtcgtgatggttggggttccagagaaggagaaaacaggtccaaaggaagccatttcagacaggtcagcttttgacgacgaggtgacggcgcgtgggatccattgggagcgtgactaccagggtgcaatggcgaatgccgatgacaagtgcgaagatgacaagctttgtgcgacagccgacgacgagcgtgaatatgaagagaagggaagagcatggtggcctgtggccatgaagataagctga

SEQ ID NO: 6267 - DNA, 337 bp, Glycine max
  Peptide Sequence Number=SeqID_123045
aaatccccagagggtggttctaggagattatgtgattgaatatggggatgatgatgctagagacgagtttgaaggcttccctggagatgagggcaactgggataatcgccgtttaagttatgatacttcaaattctgatgaaggttctgtagtatctatggagtatgcagattataggatagaagagattgatgatgagattgttagtactagtggctcttcaaggggtagcagtggttatcgcaggataaacagttttctagcgctaaagctgtatttttctaaagcacaacattctaaacaattactagtttctactgttcctctttcaagatga

SEQ ID NO: 6268 - DNA, 366 bp, Glycine max
  Peptide Sequence Number=SeqID_123046
atggaaagcacaaggcaaattcaaacggctgtaacttttgactcggatgttcgattcaggcaatatattgagacactcaaaattgtacaacagaatctctcaagaaattcaaatggtgataagtttacactcggatctcgattcaggccaataatatatcgagaagctcgaaattcaacaacggaagctctcggcaactcatatggtcaaaagatttcacccgggtgtccaattcaggcacataatatattgagatgcttgaaattaaacatcaaagcacaagggaaattcgaacggccaaaacttttgactcggatgtccgattcaggccaaatatatattgagacgctcgaaattgtacaatag

SEQ ID NO: 6269 - DNA, 606 bp, Glycine max
  Peptide Sequence Number=SeqID_123047
atgaattgcgttttcgttcatgcgtcctccactcacgagtttggagccatgcatagtgattgcttagtgcaattctccattctcaaccctttttcagagccccatgaatgtcattgcctagtgctgttcatgtgtcctccaccttcgagtctggagccccgcgaatgtcattgcctagcgctgttcgccagttctccattctccactttttcggaaccccatgaatgttattgcccagcgctgttcatgcatcctccacccaaagagtttggagctatgcttcatgattgcctaagtgtggaccctctagtgcaatcctccattctcaaccctttttcggagccccatgaatgtcattgcctagcgctgttcatgtgtcctccaacttcgagtctggagccccgcgaatgtcattgcctagtgttattcgccaattctccattctccactttttcggagccccatgaatgctattgcccagcattgttcatgcatcctccacccaaagagtttggagctatgcttcatgattgcctaagtgtggaccctttagtgcaatcctccattctccacttttttcggagccccatgaatgtcattgcctaa

SEQ ID NO: 6270 - DNA, 207 bp, Glycine max
  Peptide Sequence Number=SeqID_123048
atgaccataatttgtctctgcgtgccatcggacatgattgtgtctgaatggcaaaaggggtgcggaatgaccataatttgtctccgcatgtcacatgacctcagcttttgggtcatggtaacaaaaagcggtgcggtcgacaaaagcgaggctcctgctcctatgtatcctccaatgaggaactcaaacctacgtcgttctggataa

SEQ ID NO: 6271 - DNA, 244 bp, Glycine max
  Peptide Sequence Number=SeqID_123049
atgatgttcttacatatcaagtggtatcaggcattgaatgaatctcctgttggacataaccagtcccctaaagttacctcagaagctgtggccatcgctgatgatattaatgacatcagttgtgaatgttgggagaaggctgaaaatgaagggacaagtttaaagaagcaagtccatgcactgactctcagaaattcaacacttgaagatagagtcacccatctagacagtgcacttaaggagt

SEQ ID NO: 6272 - DNA, 474 bp, Glycine max
  Peptide Sequence Number=SeqID_123050
atgggtgaagtagaggagatacaagagaagatgaaggtcaacatggaggccatgaaagagcgaatggccacgatgatggccatgataagcataaggaagataatggaagccaatgcggttacaattgccgctaccagcactgttgctaaggtgaacctgatgcccccatctggcctcaaccaaatgaatcatccaaccttagatatgacacatgaaattccccaccacaatctagccgacttcgagccttgcctcggatatgccactgaagggcaagcaattggtggtatacccctgcaaaacacttcgaagggccctcagtatcacccccagctacacctcttgccttctacaacaagtaaaaaccctcatcctatggcaaaagtgaaaaagttggatcatctagaggaaaggctcagggccattgaaggaggtgaagattatgcctttgctaacctagaagagttgttccta

SEQ ID NO: 6273 - DNA, 324 bp, Glycine max
  Peptide Sequence Number=SeqID_123051
atgattataaggggccaagatagttatagtagccaagatgagggtactacttcaccttcctttagtgaaagtggagacgcaataggggaagaatctagtgaagcaatctacccccaagaagtaagggaccttttaatggccagaaggcttctaggaggccaatcttcaaaagatgatgacaaaggtgatgacaaaaagctcaagatagaatcaagaacacttcaagattcaagtggaaatttgaattcaagaatcaagaatcaagattcaaggatcaagcttcaagaatcaagatcaagattcaagaatcaagagaagacttaa

SEQ ID NO: 6274 - DNA, 416 bp, Glycine max
  Peptide Sequence Number=SeqID_123052
ggggcagcttcaatgcctcacatgcttccatgtttgctcattctcttcattcctaccagcttaattattgacatgaacactgttggaggaatatttacctggcgtcgcaatgggcctaatggcagccagattaacaaaaagttagatcgttgtttggccaattctgattggcacttaacttttcctcatgctttggttgagcttttgcctccttataactcggaccatattccgatattttcctcagttgcagctgcgtggctcactcatccaaggtaccctattgtggttgaatcggcctgggacaaacctagcatgagtgttctagctaagatgaaccatgtcaaaaaggattcaatcaagtctgattgcagcggaattgagaaggagaaagatgaatggagacactacttcaa

SEQ ID NO: 6275 - DNA, 432 bp, Glycine max
  Peptide Sequence Number=SeqID_123053
atgacagttaggaggaagttgttatttcctatatgcagacagatatggcagtgtttctgcacttgtcttgttcttgttatttacagaaaatgttatttgcaggaaactgcttccagtaaaatgcatacttggcacaattgtcagtattcatacaggaggaagaaaccaggagggaaaatcagtaagaattggacagggagcttttcatggctgaaatggagaggtttgctagagctgaggcatcaaactgaggaagatgcagaacatagattactcatggaagctccaatgaaaggtgtggagacatcagcacaagaaatactgtgtcgggctgtcggcagtaagaattacaatgagatctcagaatggagcaagggcttgagaagtaagggtttctgcttcatgaccaagaagaggctcttgcatgattag

SEQ ID NO: 6276 - DNA, 705 bp, Glycine max
  Peptide Sequence Number=SeqID_123054
atggtgtcgtggaacaggttgcggctgggaatggacggtgacggcgaggagttgacggcgcaggagaccgctttgtatgaccgtcaaattagggtttggggagctgatgctcaaagaagattaagcaaatctcatgtcttagtctatggaatgaaaggaactgtagctgagttttgcaagaatattgttctggctggagtaggtagtctgactttagtagatgaccgggctgccacggaggaaatgctttcctccaactttctcatccctcccgatgagaatgtgtatagtggaaagacccttgcagaactttgttgtaattcacttaaagacttcaaccctatggttcatgtttccgttgagaaaggtgatttgtcaagttttgatgttgaattcctcagcaagtttgatgttgttgtcgtcagttgttgcacgctttcggccaaaaaactggctaatggaaaatgcagaaagctatcaaaacgtgtagcattttatgctgttgactgcagggattcttgtggtgaaatttttgttgatttgcaggattataaatattcaaagaaaaaacaggatgaaactgttgagtgcgacctgaaatatccatcttttgagggtcttgatgtgttgcaaattgcaatcgtcaaggccttcactgtgttcgaaatgatctatttttatcatcagcaaacaaaaagaatataa

SEQ ID NO: 6277 - DNA, 114 bp, Glycine max
  Peptide Sequence Number=SeqID_123055
atgacaggcgccgctgatgctgttcaaaccgaaggagtggctactgatgggagcttggggtcacctgctgcagatgaaggaacaacccgatctgaagttggtctcccacggtag

SEQ ID NO: 6278 - DNA, 147 bp, Glycine max
  Peptide Sequence Number=SeqID_123056
atgaagtttaagcgaattgtgaagagtgcactgccgccgaaaatcggtgaacattgctggagggatggtgggacgaggttgggagaatccaataaccattatgatgtaagtatgaactttcgagaaattaggaaaaataaaaaataa

SEQ ID NO: 6279 - DNA, 207 bp, Glycine max
  Peptide Sequence Number=SeqID_123057
atggcgaggacatacagtcctctaaaggtgataggtactagtacccaagggtccacctttatgagaaagcaagagatcgactcatcgaaagggcagattgactgtccttttgaaaaaggtgataattcatgcaaccttatcctatcttttgcaaatctctccgggaactccctcagagtgtatgttctgtttgatttagtcacttga

SEQ ID NO: 6280 - DNA, 300 bp, Glycine max
  Peptide Sequence Number=SeqID_123058
atgaagtcactgaggggaaaggagatcacgttggtgaaagtgcagtggggacccgacgagggtgattcaacctgggaattaaaggatagggtgagagaattgtacccaaccaaaagaattcagaagcttttctccctcattctcacgttgctttttctccctttctcctccaccattgaagcctccatcaaagctccaaactttactcaccatttctgctccaaatcgcaaaaggaagccattttcggagtcgtgaagcgcacctccatgttgtgggacttcaaattcaggtatgggtag

SEQ ID NO: 6281 - DNA, 890 bp, Glycine max
  Peptide Sequence Number=SeqID_123059
caccgctgctgtttgaagggagagatcatgacggcattggcaacgttccgggacttcggcttcgaagagtggctggggaaaatcaacaccgcctgcggcagattctgcgcaaaaacgctggggccgggcttcagcggggcgatgcaggagtttcgcgcccatgcgctgcgcctgagcgtggtcgacgtgtctcaagcccggctgtaccgcacgccgcgcgagatcgcccgcagcgacggcgcgcacttttttaccgtcttccaactgcgcggcagcgcgttgatggagcagggcgatcgccagacggtgctctctcccggcgacatcacgctgatcgacgcctcacggcccagcagcttcaccttccagcgcgattcgcgccaaatctccctgttgttgccgcgcggctgcctgccggtgccgccgccttgcgcccagcgtctcggggcagagctcagcgcggtgcgcctcagccgccagctggtgctgagcagcatgcaggatcctcaactcgccgcggcggaaagcgaggcggtgctgaatgcgctggcggcgctgctgcgcccggcgctggcgctcgaacaggcgcgcccggaggggcaacagccggttttcgacaaggcgctggcgttgatcgacaggcatattcagtcgccgcagctgcgcccggaatgggtggcggccgagttgggggtgtcgctgcgcagcctgtatcggctgttcgcccgtcaggggctggtggtggcgcagcgctgcgcagcgccgccgggcaggagaagctggccggagtcggcctcgactgggggtttgccgatcacagtcatttctcgaccgctttcaagcagcgtttcggcatgtcgccgagcgagtaccgtcggcagtatcagtaa

SEQ ID NO: 6282 - DNA, 468 bp, Glycine max
  Peptide Sequence Number=SeqID_123060
atgggatcaagtcaaatgccttcacttaaaaggaggttctatcaagtcaaggtcaagagcctagggaccaccagtctaaaggagttagggcagttaatgggtcagctccagcggcaagcttttcgcaaagcttacggtaaaatctgggacttagccatggtagaagtctccacaggggccattgcctcccttgcccagtattatgatcagccgttgaggtgcttcacctttggggacttccagctatcacttattgtagaagaatttgaagagatcctaggatgccctctaggggaaaggaaaccatacctcttctcagggttctatccctcattagctagaatttccaagatagtccaaatctcggtgcaggaattagaccacaagaagcaagtcgaaaatggggagcgatcgacgcttttctcgcctatcataaccacaaggaaagcccggttgtcactatgctag

SEQ ID NO: 6283 - DNA, 599 bp, Glycine max
  Peptide Sequence Number=SeqID_123061
tccatgggcccgaaatctaccctaagactcatgagaaccctaaggccttctcttgcatctttggcccaatcttcttggagtcttctatccaatgcccttggggggtaagattgcatcatgaggctcctgcatcttctgaggttttcccttcctcagctccagcacctattccatatgttccctctgcatccacatctattcttccagctcctctctctgcaggtccagtagattttatttttactccacagatgctgcactccatgctccagagcatccatagggggcagtccatcatcatgcagagccttcaaggcttgggcttgccctccattatgagcatggaggagtttgatgctttggtggcctggccaagagaccagccctattcctctggagagggtggggcctctgcagcccaggagcctgtgactgaggagccaccagcaccagcaccatcactgggagcaggagagaaggagaccactccagatcagaccccaaagccatctccatcctctgcacctgctcctaaggagactcagccatcagcactggatcttaatgaagaccagccacaggaggagcaggacgtttaa

SEQ ID NO: 6284 - DNA, 362 bp, Glycine max
  Peptide Sequence Number=SeqID_123062
gggatgagcttgccacccaactcgcccaggcgagccaggttgcttcctccagaagcaaccgccttctggaggaacatcctggaaggcctgagtgggcttgggtgccaagtacctcgaagcgatcaaccaaaggttgcatgccgtcaaacaatagtccccggacgaaattagggtatgacaacggtatagatccgatgatgagtcctgtgaagctagtaaaccaagctgatgatgaagaagaggaagattgggagcttcccccagaactccaaagaatggtcgaacaggaagatcgagaaatgaagccacaccaagaggagacagaaattgtaaacttaggcgttggtgaggaaaagcaggag

SEQ ID NO: 6285 - DNA, 309 bp, Glycine max
  Peptide Sequence Number=SeqID_123063
atgcattctgaagctgaagcactagaacatatgaagaaaagacatacaggtcatcaaagtgtgtcattggagaataagacaggagattcaactgtgctgaagataggagattcggctaaagttgtaataaaacaagacatgaagggaggagagcataaatatgggtttaacaacaataaacgtgagaagccagagaaggaaagggtgatggatgatgaaactggcgacaaacatgagctgtttgaagtcctaaggatgccatctagatgtgtatttttcaaggtcttcatgtcattccttcatcattga

SEQ ID NO: 6286 - DNA, 564 bp, Glycine max
  Peptide Sequence Number=SeqID_123064
gactcattagaagagcagacgacacagggtagttttgttccccatggtcgggatgacatcttgaatacggccattggcaaaccggaacatccaggtcgagttcgtgcagcgggatctggtatgacccttactcaattttatggtagggcaacacgtacgtcaagtagttcctcagcaacactaatgcagcaacagtgggttgacattattggaaacataaaggaacaagtaaggaatgaatatgaagaacaacacaagaggagtctggaggaatttaagaaggagttgtccagtcagatcttcattcagttgagtcagatgggatcacaatactctccccttattgaggtggatttacaggcattggctgcacgtcttagcactaaaggaagtaatgtagaaactgctgatgttgacccatcaggcgacaaaaatgtgagcttaaaacccactatggggttatacgtgcaacgacaacatactacagtgttggtggccttggggaaaatatgtgaggggggatctgccattcacaatgtcacttatgctgatgatgttgtaagg

SEQ ID NO: 6287 - DNA, 150 bp, Glycine max
  Peptide Sequence Number=SeqID_123065
atggacctggcccaggcagggggatttgcctggggagcggctgcattggtccacattgctggatatatgagcactttcctacagtgcatacatgcgtcgtacatgatgcttatgatgaggggagcccacgggcgtgcaggtggcttacgg

SEQ ID NO: 6288 - DNA, 1089 bp, Glycine max
  Peptide Sequence Number=SeqID_123066
atggctacctcaccaaaagaaatttcagctcctggttcaccctctgtaccatcatctccatcatccaccaaagcaccatcacaccaggaacgacgtgaattcaatatccaacccatacaaatgattcctggttcagcccctgttcctgagaaactggtccctaaaagacaacagggagtgaagacttctgaaaaccctagccttgcaacaagtcctagggaagtagacacggagatggataagaagatccgcagtattatgttccaacatcctccaacccaaatgtttctgtccctgatgctgatacagatgttccaacatcttccaccccaaatgtttctgtgcctgatgctgaaaaagatgttccaacatccttccactccaaatgctgaagtcctcccttcacccagtgaagaggaatcaacagaggaagaggatcaagccacagaggagacccctgcaccaagggcaccagaacctgctccaggtgacctcattgacctagaagaagtagaatctgatgaggaacccattgccaacaagttggcacctggcattgcagaaagactacaaagcagaaaggggaaaacccccattaagaggtctggacgaatcaaaactatggcacagaagaagagcactccaatcactcctaccacatccagatggagcaaagttgcaatcccttccaagaagaggaaagaaatttcctcatctgattctgatgatgatgtcgaactagatgttctcgacatcaagagggccaagaaatcagggaaaaaggtgcctggaaatgtccctgatgcaccattggacaacatctcattccactccattggcaatgttgaaaggtggaaatttgtatatcaacgcagacttgctgttgaaagagaactgggaagagatgccttggattgcaaggagatcatggacctcatcaaggctgctggactgctgaaaactgtcaccaagttgggagattgctatgaaagtctagtcagggaattcattgtcaacattccctctgacataacaaacagaaagagtgatgattatcagaaagtgtttgtcagaggaagaatgtgttag

SEQ ID NO: 6289 - DNA, 228 bp, Glycine max
  Peptide Sequence Number=SeqID_123067
atgtcaggacatcgtgtccgacatcgtggatcctgcagcttcacttctgcacttgacttttatcttgcattgtacagcaactccagtattctcgggcaggatcaactccagtattctcgggcaggatgtcaggacattgtatccgacatcgtggatcctgcaacttcacttctgcacttgccattttatcttgccttgtacattgtgcagcccgatcttattccttga

SEQ ID NO: 6290 - DNA, 486 bp, Glycine max
  Peptide Sequence Number=SeqID_123068
atgacctgtttcaactgcaaacagaagggccatattcagaaggattgcccatatcccaagaaggaacaaaatggtagaggtctaaatgaccaaaatggacatctgaaagccatgggaagagtttttactcttaatggcattgaagcttcaaaatccaaagatctaatccaaggtaaatgtttcataagtggtgttgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttatgcacggggaagatcgaagaacgatgaagaacgaatgaagaacatcgaagaacggttgaaacctttgcgaaattcttcacggaaaacgttacggaaacgtttcggaagcgcctcgacttag

SEQ ID NO: 6291 - DNA, 243 bp, Glycine max
  Peptide Sequence Number=SeqID_123069
atgtcacgtcaaaccgtctttgctattgtcgtagaagagttaccattcaaacaggaaggacgacaaggaataatgggagactcttttatgcttgtccattaccacaaattgaacatgggtattttgttcttttcgtgggttgatgaagacattgatgttggtgcaactgaaataggtagaatagaaccaataccagactttggtctaaggttgagacggaagattctgcaaagagaagttagg

SEQ ID NO: 6292 - DNA, 492 bp, Glycine max
  Peptide Sequence Number=SeqID_123070
atgggagttcctaacaattgttcttttgatacactcaagcgtagaatgcacaacacccttcaactaaccaacgatcaattactggatgaaatctactaccaacaaccattcatagatgcagaattattatgtaccattattagaacaccggatgctatactcaacctgcttcaatcaaccatcactcctactcatgatgcaattatgtattacaacgggaagtggaacataccacgtcaaggcgagtttttgggttactcctttgctggaactaatctaataataagatttggcattcctccaggatgtggcatgaagaaactcaaggatttaatcaagcaagtcgcacctataggggtttcccctaatggaattcacggatcacaattggttaggcgattgttctttcgacaatcaggtcattctaagtattccgaaaatttgattgaatatgagataacagaattgaaaaatgatgaagacgtgctaaag

SEQ ID NO: 6293 - DNA, 332 bp, Glycine max
  Peptide Sequence Number=SeqID_123071
atgcaggatttagaagcagcaacaactccagaagaagaacctcgatcttccgaggcatcttctagttttcctattgcagaccattctcatatagaacctgttgaagacccaatcatggctcaagagccaagaagagttaccttggaggattattcaagctctattgtgctacaatttttcacaagtattgcacaaccagaagttcaagctcagacaattacatatcctccttctttgatacacctgattcaaaataatctgtttcatggtctacccaatgaagacccttatgctcacttggcaacctatatagagacatgcaatactattag

SEQ ID NO: 6294 - DNA, 510 bp, Glycine max
  Peptide Sequence Number=SeqID_123072
atggtggaaaggggaaaattggatcatatagaggaaaggctcagggccattgaaggaggtggagattatgcttttgctgacatggaagagttgttcctagtacccaacatggccattcctccaaagttcaagacgtcggattttgataagtacaaggggactacttgccccaagaaccacctgaaaatgtactgtcagaagatgggggcatactcgaaagatgaaaaattgtttatgcatttcttccaagaaagtcttagtggggcagccgtcacctggtggagggatctagcagctcaagtagcgcccctaatggtggagaaggagatgataacaatgatattagacacattactagtgttctactatgagaggatggtgggttacacgccttcaagctttgccgatttagttttcgttggcgaaaggatcgaagtgggtttgagaagaggcaaatttgattatcctgctttgatgaatgggaagcctggggcaaatggagagaattag

SEQ ID NO: 6295 - DNA, 1286 bp, Glycine max
  Peptide Sequence Number=SeqID_123073
gaaacagacaagacgcaaaccgagcaggcgaaggcattggcccagcggctggcaacggcggtggcggaaagcgacaaaatcaacgctgcaactggcgaaaacgacggagcaggtgaaaaaaaacgcattggcgctagcggacgccaaccaaacgcagcaggcattgcgtgaggagctggatgggctgcgctctcgcgccaaatggctgccggatgcacaggcgctcgagaaaaagccggcgcaacagagctatgctgccggtgtcgctttggggcgcgatattcaaacgatgctggcggagcgtaaaaattggggcatcaatcccgataaaaccgtgctgctggcgggcgtgatcgataccttcaacggccattaccagctaagcgatgcgcagttgacccgtgcgctggcggagtcggaaaaagcggtgaacgacgcccggaaccaggcagcgaaggtgcaaaccagcaagggcgaggcgttcgtcaccgagtttaaaaagaaaaagggcacgcagaagtcgccttccggtttctggtatcgcatcgattatgcgggtgatgaagccattaaggaaaacgcgcgggtggacatcgtggtgaaggaaagtttaaccgacggcagcgtgattcaggatatggatcgcagtgggaaggtgatgtcacagccgctctctgcctatccgccgttgttccgcgaggcgatcggccatctgaaaaatcatggttcgctgacgatggtggtgccgccggcgttggcgtacggtgaaacgggctatgcgccgcagatcccgccgaacgcgaccatggtgtatgagctgcggattgtcgatgtcaacaacgggaattcggccagtgattcgctggtcatccagccggctggtgacgcacatatcggcgatcttcacgtcgacgaagccgcacttctccaaccaacatttcagcgcctcggcggaagggatgaaatacacattgcgcatctgcgcataacgatcgcccggcaccagcacctggtggcgatcgccttccaccaccagcgtttccagcaccagttcaccttcagccaccagctggtttttcagctgatacagatgatcgagcggcgagcggcggtgatacagcacccccatcgagaacacggtgtcgaatgccgccaattccggcaactgctcgatgccgagcggcagcaggaacagctgcatcggatcgatgccgacggcgaggtgtgcgccggcgccaatcatgcgccacaggtgataaccgctgccgcagccgacgtcgagaatg

SEQ ID NO: 6296 - DNA, 801 bp, Glycine max
  Peptide Sequence Number=SeqID_123074
atggaggctgggaagaagggtggtgggggttctagtaaccagaagaagttgttgaaggatgttgaaaccatgaacaaagctttgtacttggatagaaactcttcaaggagttcaatacctagtgcaaattctagatctaaattcacagggaaacctcagttgcctgatccaagatccaagtctaaagccagtaatgatcataatggtgagaatgctcagaaggataagaagtccatatggaattggaggccattaagggccctttcgcacattcgaaataagaggttcaattgtagtttttatctgcaagttcatttgattgaggggttgccgccgagttttgatgatgccggccttgctgtttactggaagaggcgggacggggttctcgtgacccagccggccaaggtggttcagtgtgtggctgaatttgaggagaagttgacctacacttgttcggtgtatggaagcaggagcggacctcaccattctgcaaagtatgaagcgaagcattttttgctctatgcttcgcttctcagtgtgccggagatggatttggggaagcaccgggtggatctgacgaggttgcttcctctcactctggaggagcttgaggaggagaagagctcggggaagtggactactagttttcgattaatgggattggccaagggcgctacgatgaatgtcagttttgggtatactgtggttggtgataatgctagtgctaccagagacagccttccgaaagcattgtcctccaggcagaatagtttttctctgactccgacgaagtttgat

SEQ ID NO: 6297 - DNA, 1264 bp, Glycine max
  Peptide Sequence Number=SeqID_123075
cacacttttgagcaggtggtacaaagcctgattaatgcagaaaccttgcaggaagtcctggagaccgatggcggactggaggtgcatgaaatgaccatgcaaacagcagaactactgacgcagcaagtctgggggcaagggtttccgcagccggtattttatgaccgcttccaagtagtgcagcaaaaggtccttggtgaaaagcatttgaagttgcgcctgcaaaaacataaccagcagtttgaagccatttatttccggcatgcagagttgttgccagagcagatagaaattgcatatgccttgcaaagagtctgccctaaatacggtaaaatacagccttcattcaagaggttaagcatggctcgcccatttaaatcccccaaaactgtttccgggactcgtccccccaaagagcaaacaccgctagcggaaaccgcggaaggtgtagacgcaccctctgtgccacgttcggggcaacgtttacacaaactgttggcgttggcagggtttggctcacgccgcgatatggaaacgctgattgaatcaggccgtatcacaattaatggccaggttgcacaggttggcgcagtagtggatgagcacgatatcgatgacccagaggggcgtgctaccgtatttgataagctgccacgcatcaaacagggcaagtggatcgcgattggccgtctggatatgaataccagcggcttgctgattttcaccaactccggtgagctggctaatcatttcatgcatccgcgctatgaggtagagcgtgagtatgcggtgcgtatcttgggagagctcacgccagagcagatgtcacaattgacgcatggcatcgagcttgaagatggcccggccaattttgagagcatttatgccaatggcggcgagggggcgaataaatggtatcaggtcgtgattaaagagggtaggaaccgcgaagtgcgtcgtctgtttgaggctttccacttgccggtcagccgtttaatgcgggtgcggtttggcccgattgcgctgcctccgcgccttaagcgtggcaccatgctaaagctggagcagaaacaagtggtcgctttgctggaatgggccggtttgccagtaccgcgcaaaccgcttaagcaaatgagtccgcatgaccgtgaccgtgccactcgcgtgtttacgcctaaagtgcgcaaacagcgccgtagcctcttggatgcggcaaacaatccggctggcactcagcaagagcgtcctgcacgtgcgccttctg

SEQ ID NO: 6298 - DNA, 300 bp, Glycine max
  Peptide Sequence Number=SeqID_123076
atggacatgtggctttgcttggcattccattgttgcccttcctttttgttctggtttggtttcggcatttgggttttcaattatttttcatcctcgcgtgtaacttccgaacgcaaaaacagcacatcagcccccttaggaatagagagaaagagcatagaaaggtttcattggatcgtaactggggggcacttgtccaaattggaaaattcccgagtgattagggttttgatcggagggggttcatattgtggatttagagctacggtggttgagcattcgcacttgcagattgcttaa

SEQ ID NO: 6299 - DNA, 168 bp, Glycine max
  Peptide Sequence Number=SeqID_123077
atggcggttcaaaaactaaatggggataatttcacactagatgaagatcctagagtctcatctgttttacttaggatgctcctctacaaggagtatcctaatggagctcagtatagttacgacttttgttacggcatagaataccgaacttccgttaaaagtgtgtag

SEQ ID NO: 6300 - DNA, 2304 bp, Glycine max
  Peptide Sequence Number=SeqID_123078
atggttgatactgtctgtacccttggtatatcaggtatacaaatatcttctgaagatagtgttaaacatgattttctggatgaggcaaatgatagttctaaggatcaaggagtggtagaggaatttgctagcataaaggctcctgaggatgcttctacagttgatacttcctgtacccttggtatatcaggcagacaagtatcttctgaagatagtgttgaacatgattttttggatgaggcaaatggcttggacactaatgagctgctcatgcaagaactagaatctgctttaaatagtgtctcgaatttagagagagtggcactagaatctcctaaaactacagaagcgaaatcggaacataaaatgacaaagtcacatagcttggatgatgttacagcatctgttgccactgaatttttaagcatgttaggcttagaccacagtccaatgggcttgagttctgaaagcgagcccgagtctccaagagagctacttttaagacaatttgagaaggaggctctgaatgggggcttctcttctttgtttgattttgacatgaactatgatagtgaagcagctggtggctatgatgcttctgcttcttctgagcagtggaacttttctgaaggtgtcaagtcatcatccttcttgcaagatctgctggaggagcctccagttgaatctcaggatgttaggagcaaacagagggctcaaatgctagaagacttggaaacagaagccttgatgcgtcaatggggtttgaatgagaatgcttttcatcattctccaccgaaagattttgctggttttggaagtccaattcatttaccacctgaagagcctcccacattgcctcctcttgatgatgggttgggcccttttcttcagacaaaagatgggggttttctacgcactatgagtccctcaattttcaagaattctaaaagttgtgggagcttaatcatgcaggtatccaaccctgttgtggtacccgcagaaatgggttctgggataatggaggttttgcagtgtttggcatcagtgggtattgaaaagctctcaatgcaggcaaaggagttaatgccgctggaagatatcacagggaagacaatgcaacaaatagcatgggaagctatgccttccttagagggtgcagagaggcaatgccatttgcggcatgatccaataacagtgccagacagtgctggtgtgcaaagggacttgaaaggaatgccatctaaacaaaagtctggcaagtttagttcaaggacagtggccaaccaaacaggctcggagtttgtttcagtagaagaccttgctccattggctatggataaaattgaagcactttcaatggagggtttgagaatccaatctgggatgtcggaagaggaagcaccatcaaacattattgctcagtccattggagatatttcagctctccagggcaagggggttgatattagtgggtcccttggcctggatggagctgctggtttgcagctgatggatgtaaaagacggtggtgatggtgttgatgggataatgagcttatcattaactcttgatgaatggatgaagctggattcaggtgagattgatgatatagataatatcagtgagcacacttccaaacttcttgcggcccatcatgccaactcttttgacttcattcgtgggagttcaaagggagagaagagacgaggcaaaagcagatgtggtttgctaggaaacaatttcacagtagcattaatggtgcaactccgtgatcctatgagaaactatgagccggttggaacaccaatgcttgctcttatacaagttgagagagagttcatgcttccaaagcaaagaattttcaacagtgtgtctgagataaggaaaaattattatgaggatgacgagagcaatatagtagcaaaattgaagacgaaggacaccgagaaagaggagaaaagttctgaagaggaagggggcattcctcagttcagaatcactgaagtccatgtggcaggtctgaagcctgagcctcagaaaaagaagctttggggcacttcaagccagcaacagtctggttctcgctggttgctcgccaatggaatggggaagagcaataataagctttcactgatgaagtcaaaggctgcgtctaaatctaatgctccagttaccacaaaggggcaacctggtgacagcttgtggagcatatcatctcgtattgatggtgctcgaggaaaatggaaggagttggctgcactaaatccacatataagaaaccccaatgtcattttaccaaattga

SEQ ID NO: 6301 - DNA, 1290 bp, Glycine max
  Peptide Sequence Number=SeqID_123079
atggttcgctccatgttgactgataagaatattcggaaaaccttttggcctgaaacggtgaactggactatctatgtcctaagagttagtgaggaatcaaaaggctacaagctatttgatccagttgctaagagagttgtctgggattgggatggaaaacaaatagcagtagatataaaatgggatgagagtaaaaatgaaaatggagaaaataatgacaaagagataagagagacttgtgatgaaggagttggagatgtttctagtgagagtgaagtgagattaagggagtcaagacaacctcgagagaggcaaccacctacatggatgggtgattatgttagttgtgagggtttatctgatgatgaggttcatatggcattaatggtgtcaactgacccattatgttttgaagaagtcgtgaagagtgcaaattggagattagccatggacaatgaaatcaaatccatagagaagaaccaaacatggacactcactgagctacctgctggggccaaaagaattggagtcaagtgggtctataaaactaaatacaatgagcatggaaagattgctaaatacaaagctcgtttggttgctaaagggtactctcaaaagcatgcagtggattacatagaagtttttgcattggtggcaaggatggacacaccaagaggatatgaaaaagaaggtagtgagcatttggtttacaagttacacaaagctttgtatggactaaaacaaactccacgagcttggttcaatcaaattgaagcacactttattagtgaaggatttcaaagatgcgacagcgagcagacattgttcactaagagaaacagagaaggaaaaatcatcattttagtaggcagtttaatgtacatcactaccacaagacctgacatgatgtttgtcaccggtctccctattgtaactttatccaccacagaagctgagtttgtggctgcagtagtctgtgtttgtcaaggagtttggatgaagagcattttagaggagctgggacaatctcatgaaggctgcataactataatgtgtgataacagctcaaccatcaagctgtctaaaaatcctgatatgcatggtcgcagaaagcatattgacgtgaggtttcattttttaaggaatcttagcaaggagagtacaattgagttagttcactgtggaagtcaagatcaagtggttgacataatgaccaaaccattaaagcttgaagtttttcaaatgtttcggaagttgctaggagtatgtgaaattcctaatataaactaa

SEQ ID NO: 6302 - DNA, 186 bp, Glycine max
  Peptide Sequence Number=SeqID_123080
atgggttatggtgatgtcgaggttgttgacggaggcagagggagatatgcgaggatgaggcatgttggcaacgatggtgagcaaggttctaaaggtgtcaagcacgacaacaaagcacgcggtgacgatgctatggagcggagccactattcatgcttaagcaaggagagtcaaaagatgccttga

SEQ ID NO: 6303 - DNA, 796 bp, Glycine max
  Peptide Sequence Number=SeqID_123081
atgactacaaaagggagttttgtacaaccagccattccacgctttgatggtcactatgaccattggagcatgttaatggaaaatttcctacagtctaaggaatattgggaactaatcgaacctggctatgtcgagccagcaagtggagcaacacagacagaagcacaacagaaaaagaatgatgagttgaagctgaaggatcttaaaaagaatactgctaaagaaatatgggatgccatgaagaagaagttcaaaggaaatgcaagggtcaagagagctcatcttcaagctctccgtagagaatttgaaattcttgagatgaagactagtgaaggagtgacagagtacttctccagggtcatgacagtggccaacaaaatgagaatctatggggaagatatgccagatgttaaagtggtggaaaaaattctacgctttttaactgagagctttaactatgttctatgttctatagaggagtcgaaggacatcgatgaagggaataggaagaggaagaggtcgaacaacttcaacaaagcaattgtagagtgttaccaatgccatcaactgaggcattttttatacgaatgccctcagaaaaaagaagcaaattatgcagagcataatgaagcagaagaaatgcttttgatgtcctatgttaagctgcatgaagctaatagagaagatggaagcgtgaagttactgttgaatggagttaactttgtttttcctgaggtatactatgttccagagttaaacaataatctcttatgcataggacagttgcaggaaagag

SEQ ID NO: 6304 - DNA, 279 bp, Glycine max
  Peptide Sequence Number=SeqID_123082
atgacgtctaagagacttgcattgcttcctgtgcctgaggttggtccttctactgctcgtgttatcaccaagaaaagttgtgttgatcccttaagagtttatgaccggtcgaccaccatccacaacatccctttgggcaatgatcaagtcaaggtcgatgttgaggaagttcgagatgttgatgctcgcgtttctgtacccactcaagaggttcagttagtggggcagacacttaacaccttccttgcttggttgacacatcttgtaaagcatttttga

SEQ ID NO: 6305 - DNA, 114 bp, Glycine max
  Peptide Sequence Number=SeqID_123083
atggcaggggatggccttaggcctatgttgcatcctaaagcaatggggcatgccacattgcccccattctcttgctattcatgcctaaacatgtgcccaccaggtgctcggtga

SEQ ID NO: 6306 - DNA, 525 bp, Glycine max
  Peptide Sequence Number=SeqID_123084
atgaggggagcaccaacggaagagagcctctctcctttccttgtgagagatttcggtgcgcaaagtttcaagattatacaaagagtccataaggcgtgggaaagcccgttaaggaaagataaagaacttaggggcattcgtaatggcatcatcggtggttatcatgaatggctgaaagtttgtacacgagggttagattgtctctccaagctaaagattatcgacgaagaaagcttcgaagctccggaagaggatgaagaagtccgagctctaaaaacaaaactaggaaaagcaagacttgccaaagaaaaattcaagttggtcgctacagacgtccggaaaaagtgtgtcgggttacgagaagaaaatgcagctaccgcaagagcccttgaacaagaaaccaagagggcttgcaaggaagagcatggccgtgacaaatttcgtggagctttatggggcagcaacagtgagctcaagcttcgaagggaagagagagaccaatcacgagcacatagcatggtctga

SEQ ID NO: 6307 - DNA, 177 bp, Glycine max
  Peptide Sequence Number=SeqID_123085
atggcggctcggcggctcctcaccagaatcttactccctacactctgccactgtcattctgctcccacgaacaagggaactgtgctgagtttgtcgagaccacccggttgtgcatgtaacagcccccctcccataggtgatcagcctgggagcccaaaggtgttccctaccaggtga

SEQ ID NO: 6308 - DNA, 204 bp, Glycine max
  Peptide Sequence Number=SeqID_123086
atgtctgggccatctgatgaggacaaggcaaggaataagggcaaggaacctttagaaggacttggaggacctatggcaagggctagaacaaagaaggccaaggaagctcttcaacaagtgttaaccatgctatttgaatttaggcccaagttacaagtggagaagcttcaaattgttaattacaccatgttccaagaagagtag

SEQ ID NO: 6309 - DNA, 270 bp, Glycine max
  Peptide Sequence Number=SeqID_123087
atggaccaattaaagcgcctaagcatcccctcagaaatgcttagattctctaaccacgcttgtcacccacgtctgggccatccgacaaggtcagtgcacttcgcccctcacaaacatacacaacatccaatgtatgaacgtggcccaaagcaagagccaaagaccgtggaaggtcagtacacttcgcccccacaaacatacacaacatgcacatgccaatgcatttccaacatcaatcaacattccattttcacatcattctcagcatag

SEQ ID NO: 6310 - DNA, 873 bp, Glycine max
  Peptide Sequence Number=SeqID_123088
atgggtgaggggtcagtggaaggtcaggagtgcgagtttagtcagagaaggaacagggccgatgggtttgacgaggaggccattgcccaactattatgtataccgggtcaggattttgcccggaccgctgtcggaaggcgggtgcggatcatgcgcaccagcatgactacattgacccagatgtggatgacattgctactcagcaatgtcctgcccagtgatcataactccgaccttcctctaccaaagtgtcagctggtgtatgccatcctgacacggatgagcgtccatgtggctcagttgattgctgatgccatctatttgtttgcaggtatgccacccaccaggcaccctctagacccggataagtctaatagggccctgtggtttccagcattgatcacaggcctctgccaatcatttggggttcctatcacacctagtaaggtgatccggccgccgatcacccgggccttcattgagaagtattgcacgcctaggcaggcgcagggtgatgcaccacaggtcgcacatgcaccgccaccacctcatcaggctgatcctgctgggtcattaggcatggagcggtatctaaaacacttggttctccaacaggcagccaaccaccaggggcaggtgcagatacatgagtgtctctaccagctcagcctcagtcagcagggccagggtttcgctccttttgcgtgccctactccagatcagtttagggctgaggtcgcatggcccagagattggcccaaggcccaggtaggggaggcgcctgcagaggctcccggcgatgcggaggaggcccgcatggatgaggagatgatggatttgctcggtttcttgggagggagcggagccatatga

SEQ ID NO: 6311 - DNA, 222 bp, Glycine max
  Peptide Sequence Number=SeqID_123089
atggtgtggcgtctcctctcaactcttcttcttctccatttcgctgccattaaaattcaagaagcaaaggactccattgatgaagaagatccaaggcctacaagttccaatggagttacatcgcacctatatctgctccctcgaacacaaggtttgagatcatcacaggatccaaacacaaatagcacactgggagtgagttatcacattcctaactactag

SEQ ID NO: 6312 - DNA, 113 bp, Glycine max
  Peptide Sequence Number=SeqID_123090
atgtgggacatcccctttatccctgaaccaaaccaaaccctgacatatgtcatgtccagccgttctacaagccttgagctgaaatcccaacttaccataaaccttgacccagg

SEQ ID NO: 6313 - DNA, 315 bp, Glycine max
  Peptide Sequence Number=SeqID_123091
atgacggagaaggagatgataacaatgatagtaggcatgttaccggtattgtactacgagaagatggtgggttacacgccttcaagcttttccgatttagtttttgtcgacgaaaggatcgaagtgggtctgaaaagaggcaaatttgatcatcctactttcatgaataagaagcatggggcaaatagagagagtaagaatgagggaggaacccatgttgtgactgtcattcgtacatggccaaatttcccaccagctcaacaatgtaaatactcagccaatatcaaccattctcattacccaccaccttattag

SEQ ID NO: 6314 - DNA, 332 bp, Glycine max
  Peptide Sequence Number=SeqID_123092
aactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccg

SEQ ID NO: 6315 - DNA, 1185 bp, Glycine max
  Peptide Sequence Number=SeqID_123093
atgtggtcatctgcgccctttccagaaatgtcagcatcttccggtggagactttttcaagtctcacaagataagtaggagcaagagcattgcttttgtcggccgccccacaagatctgtcatattgaccctgaggtcatgtgacatgcggagacaaaatttggtcattccgcatccctttgccattcagacacagtcgtgtccgatggcgcgcagagacaaaatttggtcattctgcacccttgtgtcatccagaggcggcgggcccgatgacacgcggagataccttacagttatccgcacccttgtgtcatccagaggcggcaggcccgatgacacgcggagataccttacggttatctgcacccttttgtcatccagaggcggcgggcccgatgacacgcagagacaaaatttggacattctgaaaccatgtgtggtcaggctgcaggcccatgacacgcggagataccttatggttattcgcacccttttgtcatccagaggcggcgggcccgatgacaaagcagagaccaagtttggtcattctgcacccatgatacgcggagataccttatggttattcgcacccttttgtcatccagaggcggcgggcccgatgacacgcagagaccaagtttggtcattctgcacccatgatacgcggagataccttatggttattcgcacccttttgtcatccagaggcggcgggcccgatgacaaagcagagaccaagtttggtcattctgcacccatgatacgcggagataccttatggttattcgcacccttttgtcatccagaggcggcgggcccgatgacaagcagagaccaagtttggtcattctgcacccatgatacgcggagataccttatggttattcgcacccttttgtcatccagaggcggcgggcccgatgacaaagcagagaccaagttgggtcattctgcacccatgatacacggagataccttatggttattcgcacccttttgtcatccagaggcggcgggcccgatgacaagcagagaccaagttaggtcattctgcacccatgatacgcggagataccttatggttattcgcacccttttgtcatccagaggcggcgggcccgatgacaaagcagagaccaagttgggccattctgcacccatgatacgcggagataccttatggtaa

SEQ ID NO: 6316 - DNA, 471 bp, Glycine max
  Peptide Sequence Number=SeqID_123094
atgaaaggcaccatcgacaccttccgccagcagaccgcgcagtctgcgctggataaggagagactggcggcgctcactaagcgcttcggctctgcgctggacgcaagcctgtcggactggcaggccgcgcacggcggcgtcatcctggtgaagggcgcggtagtggccggcgtcaccgacattacgccggggaaagagctcggcaccctcggccacctgtttcccattgccgagcccgacctgctggcctttatcggccagcgcctgcagggcatgaaagacagcggcgagctggaccggctgcagcgcgaggcggaggcgcgggtgaaggctcacgccgtcaggcccgcgccggtggccggcctgacgccggcgaaagcggacagaacgttcctgtatgacccgaccttcacggtgcgggaaaccatccgggacatgcgcgacaacgtcatcgcccgggcgggagacagg

SEQ ID NO: 6317 - DNA, 402 bp, Glycine max
  Peptide Sequence Number=SeqID_123095
atgacagacgaacaagcatcaatttataaccatattgttgaagttgttgataaagatgaaggtggtatgttttttctctatggatatggaggtacaggaaaaacatacatttggaaaacactcacaagttcactaagagatgataataaaattgtaattatggttgtttctagcgtcatagcttctctattattgcctggagcacccatggctcacaaattctgttttgaggcacttgatcacagccttagagatatcatcaaacacaactcaagggacaataaaatctttggaggtaaagtaatggtctttggtggagatttccgacagattctgccagtcattccaagaggtagtcactctgatattgttaatgcaacaattaattcctgttatctatga

SEQ ID NO: 6318 - DNA, 327 bp, Glycine max
  Peptide Sequence Number=SeqID_123096
atggagaggagtatgattgatgcttccagtggtggagcccttggtgatatgactcctactgaggctagaaatttgattgagaagatggcttctaattcccaacaattcagtgcaagaaatgatgctattgtccttagaggagtccttgagatcaccatacagatctttgcctttcttagcagcaatctggagtcaatgagcaacctgaagcttatgctgcaaacatttataatagacctcttcagcagcaaaaccaacagcagcagaataattatgacctttcaagcaacacatacaatccagattggaggaatcatccaaatctga

SEQ ID NO: 6319 - DNA, 660 bp, Glycine max
  Peptide Sequence Number=SeqID_123097
atgtcctccacttcagaggactacatgtcctccacatcaaaggactacacgttctcccctttggaggactacatgtccttgccttacgagggctacacggcttcaccttttgaggactacacgccctcaccatcagaggattacacgtcctcggcttcagaggactacacgtcctcaccttcagaggactgcacaggactacacgtcctcaccttcaaagggctacacgtcctcgccttcagtgggctacaagctctcgccttcgtagggctacacgcccccaccttaaaaggactactcatcctcaccttcagaggactacacgtcctcaccttcagtggactgcacgccctcgccttaacaggactgcatgttctcacctacagaggactacacaacctcgcctttcgagggctagacgccctcgccttcagaggagtacacatcctccccttgagagggctacacgccctcaccttcgtagggttacatacccttaccttcaaaggagtacacatactcaacttcagaggactatacatcgtcgccatcagagggctacacatcctcgcctttagagggctacacgtcctccccttcagaggacaacatgacctcccctttagaggaatgcaagccctcgccttaacaggactgcat

SEQ ID NO: 6320 - DNA, 333 bp, Glycine max
  Peptide Sequence Number=SeqID_123098
atgccgaccgcaaaggtttggtgcaccaccagcacgcgaaagaatggtgctttcgccgacgtcgcgcgcaatgccgctcagcatctcgggcgtcaccacgaacccccagccattaatcacctgcgacgcattttccaccgtggtgccaatcagcgcggcaggggagttcatggcaaagtagacgcccggatcaagcaccgatgcgcaaatcagcgccatgatcgccacaaaggattccatcagcatcgcgccgtagccgataaagcggatatgactttcgcgctccaccagtttcggcgtggtgccgctcgaaaccagcgcatggaaacctga

SEQ ID NO: 6321 - DNA, 365 bp, Glycine max
  Peptide Sequence Number=SeqID_123099
atgaaggaattctatgcaaatctatatgtccctgaggacaagtatcccaagaaagttagggttcgagggcacccgataaaatttgatgttgattccctcaacaactttttggagactccagtggtcgtggagcaaggggagagcttgccctcttactccaggtttgctatactgaggcctgatcctcaggagcttgcagcccggctatgtatccctgggaggggatttgtacttattgccgaaggtttgccatggaatctcttgaggaaagatcttaccactctggcccaaacttggagtgttctatcttattctaacttggccccgacatcccatacttctgatcttaatctggatagggccag

SEQ ID NO: 6322 - DNA, 231 bp, Glycine max
  Peptide Sequence Number=SeqID_123100
atgtcaatccttaccctcagaagaaaaaatgggagaaagcaaaaaaagaaaagaaggaaagttcccaatcaaaaagtgggagaaagcaaaaaagaaaagaaggaaaattcccaaatcaaagagtgggagaaagaaaaggaaggaaagaaaattcccgatcaaggatcgaaggaaaacaaaggaaatgtgcagaaaggtcgttggaccagacgatatctgaacaatacataa

SEQ ID NO: 6323 - DNA, 326 bp, Glycine max
  Peptide Sequence Number=SeqID_123101
tgttggttggaagacgctgacatctccagggaagtctcggccggaagatgctgacatctccgggaaaggtgcagcaaatgagactttttcgcagtctcggccggaagacgctgacatctttgggaaaggtgcaggtgacgatatagcaaatgagactttttcgcagtcccggccgaaagacgctgacatctccgagaatggtgcagggcatctccgcgtgccaaaggactcacaggtcacgatagcaaaaggtggggcgatcgagaaaagcgaggcttttgctcctacatatcctcaatttgtgatgaggaactcagacctacgta

SEQ ID NO: 6324 - DNA, 423 bp, Glycine max
  Peptide Sequence Number=SeqID_123102
atgcccccgactgtccctgttaatcattactccgatcccgaaggccaacacaataggatcagaatcctgtggtgttatcccatgctaatgtatacagagcgtaggcttgctttgagcactctaatttcttcaaagagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcaggctccctctccggaatcgaaccctaa

SEQ ID NO: 6325 - DNA, 378 bp, Glycine max
  Peptide Sequence Number=SeqID_123103
atggtttatggttttcaagaagagatgcggcttggtttccactttttagaaaaaagaacagagggtggacctgggatgatcacaattgttatccaggagaggatgaatggtatagggttttccccggcggcatataagatttggcctttgttttcaccaatggttcttcctcacttcaaacattctagattcaaagatgaccaacattgcagtcaccgtatagctgaagtgctagatccagatggtaaaatttcaccagctcaaatttccaatatgttaaaaaggttaggactagcagttgcacctaggagaaagatgtgtgatgctgatgctgaaggacctttggcaagaaagccaaaagatctgttcatccaatag

SEQ ID NO: 6326 - DNA, 267 bp, Glycine max
  Peptide Sequence Number=SeqID_123104
atgaagaaaatatgcagtaatctccaaggcaaggacaatgcacctccacctccacctcaatggattgaggctaagagccatgtacaacaaggagcatatgagtgtggatattatgtgatgcattggatgtggtgcatcgttagtgccggtttgaaaaatgaactccacaactatttttcagatggaacagcattagacactgacaccatgacgacaatacacaagaaatgggcagcctatttgctagaagttggaaaatggatgtaa

SEQ ID NO: 6327 - DNA, 559 bp, Glycine max
  Peptide Sequence Number=SeqID_123105
atgaaggttacagccctcaagcaaattagccatgacatgattgctcatgtgggtaaggctcgggttgtcgtggaagagctgagaaagttccttgtggctgactcattggaaaaagtgaacagaaaattggacaagttctacatggtcctcatcttgagaagcttacattcagactttgatcatgtgcgtgatcaagtacttgctggggaccaggttccatcaatggattccctcatcactagacttctccgcgtgcctcatgtatcgaaggatgaaaatcctactgatggtgtggaaacgtcagccatggttgcatctcgtggtagaggaggcggccgcaacattagaagaggtcgcagtggaagggatggacgtcctcattgcacctattgcaagaggatggagaaagcagagtctagattctttgatgaggagtatcaggagtatttgaagcttaaatctgataaatctaacagccaagctcaatcctcatctgtaccatatattcctcacattgttactgtagctaatggctccaaggttgcgtctcaaggaagtg

SEQ ID NO: 6328 - DNA, 354 bp, Glycine max
  Peptide Sequence Number=SeqID_123106
atgtcgatctctgcagctccagcttggtttttttctttcttctctctcttcctcgcactatctcctcaccttcttctttggttgttttcctactttcatgcttctaaattgagttgttcgacgactattaccacgcaagacgaaagatcattcaatgttttggtcaaggatgtggaaaatacccaaggggaggggcaaaaggcttacctaggcgagcaaggttactttagggtgaagcaacaactcgcctgggcaagctccagccttcctaggcgagctaccaaagtcccaagcgcgaggggggctgaaggaagggttcaacattcagtattgagagtgttcagtgaacattga

SEQ ID NO: 6329 - DNA, 162 bp, Glycine max
  Peptide Sequence Number=SeqID_123107
atgaagtcaggtgacatgcggggttaccttatggttacccgcaccttttgccatccagggacagcgagtcagattttactctcgtcgtccagaaacattcaagcccgacgacgtgcgagattcttctctgctgggcagggacgatcaagtgcaatggcgtag

SEQ ID NO: 6330 - DNA, 225 bp, Glycine max
  Peptide Sequence Number=SeqID_123108
atgaggatgtctcctccacctctagaacctcataaccactcacaaactcatctcaagctctcaggacaacttcctcttcaagctccattctctgcagatgaagttaggaataagatagatatcaaggaaagcagcttaaagcacaatctcacggcttctgtttcactcaagcacaagtgtttaagctattcattaataacaactagcaagaggtccaatctttga

SEQ ID NO: 6331 - DNA, 385 bp, Glycine max
  Peptide Sequence Number=SeqID_123109
atgagacttcttcgctgtctcgatcagaagacgttgacatcctcgggaaaggtgaaggtgacgatgtttgtcatcgcatgctatcagtctcggccgaaagaggcttacatctctgggaaaggtgcagcaaatgagactttatcgaagtctcagccggaagacgcaaacatctccgggagaggtgcagcaaatgagactatttcacagtctcgacttgaagactctgacatcttcggggaagcgaaagtgactttttctcagtctcggccagaaaatgctgactttttcgggaaaggtgcagaagatgctgacatctacggggaagaagacgttgacatcctgaggaaaggtgaaggtgacgatgtttatcatcccatgctatcag

SEQ ID NO: 6332 - DNA, 345 bp, Glycine max
  Peptide Sequence Number=SeqID_123110
atggttctcgacgtgcttcagatcgtcgagaatagtggcttaagcgatgaaggtgcaaaggaagatttggagaacaaaaatgatgagttaactaaagagcctattgacactcaggataaggaagaggaacaaccagtggagcggccacgaaagacatcaaaatatatgactaagtatgagcatgctaggattttgggtacctgtgctcttcaaatcaggtttgttcaagacatttatgatgtacctgtcatggttgagttggagggggaaactgacccacttgagttagttgaagcacttagaaggacaagaaatgcagttaagagtaaaaaccacatactgtaa

SEQ ID NO: 6333 - DNA, 252 bp, Glycine max
  Peptide Sequence Number=SeqID_123111
atggaggggcgtcaagatgtcaaccatgaccgtgcagaggagcttgtgcaacatcgagggctagaagaacaagcagatcatgccaacgatggtgtcgaatgtcgcgatctggacgtcgggctagatgacgacgacgcgaggcagcacataaatgatgcaaaacaacattcgtttgggaggttcgggaagacaagcatcgcgacttcatcggaggcaatagaggagagtaaaaaatcgagtacctcagactag

SEQ ID NO: 6334 - DNA, 532 bp, Glycine max
  Peptide Sequence Number=SeqID_123112
atggtaaccttttccccagcttacattagtcttgctaatatcaatgctgaggaaactctcaagtatgcaaaccgtgctcgcaatattcaaaataagtgtagtaagcttccacaattctttgttaatcgagatttaatctccaatgagatgcaacaattgcgccaacagttgaagtatttgcaggctaaactttgttctcggggaggagctcctgttgatgaagtgtggttctcaaggaaaggattgcttggcttgagtctactaatgaggacctttgtagagaacttcacgaatatcacagtagatgtgacggtagcttttacgactgtttatcctctcaattcgtttttcctctcctcctcctccaaactctctttttcccgcagtccattaaacctgtctcagaaaaacgacaatctcggactcattcaccgttggatcgtcattaaatttaagcacaagtcggagaaaaactggaggaatctcagggatgccgctatcgctatcggaagacatgtgagcccgcttagag

SEQ ID NO: 6335 - DNA, 570 bp, Glycine max
  Peptide Sequence Number=SeqID_123113
atgagcaagattctagcgaggcccaacgtgaagcgcttcaacgcggtggtggcgaaggacttgatcatgaaggaagggagggttgtgaccaacttggctctggtttcgatgaaccatgacacgcagtcttgcatggaccccaacgtgatggaggctaaggttgttgtgagctcttgtgggcacgatggacctttaagcgccactggggttaagaggttgaagagtattggcatgattgataacgttcctggaatgaaggctttggataccaagagtattggcatggttgttgtgaggctcactagggagattgtgctcggcatgattgtcactggcatggaggttgcagaaattggtggctccccaaggatgggtccctacttaagtatgatgtttaaacttactttcaaattgatggaacgtgtggagttgaaggcgttggggaggaacaatgcaattgatggaacatgtggagttggaacggaagaaccccatcttattttcgcttctacagttgagttccatgatggacttgagagcatgatgttggatcaagtggcctcggaataa

SEQ ID NO: 6336 - DNA, 426 bp, Glycine max
  Peptide Sequence Number=SeqID_123114
atgtctctttatggagttgtttttggcaaggcatgtctttttcctgtagagatagagcacaaagcctattgggctgtaaagacttgcaatttctttattgatcaggcgggagaggaaaagaagttgcaattaagtgagctagatgagatccgtttagaagcttatgagattcccaatttttacaaggagaagaccaagaagtttcatgacagcttgatagttaagaaggatttcatggtcggacagaaagttttattgtacaactttaggttgggactcatgagtgttgaaatcaaaagggaatccacagataagagcttcaaggtcaagggccactggctgaaaccattcctcacaaatccccccttaggggatgtagggggggaggagccccccttacttccccctactttttttcccccatga

SEQ ID NO: 6337 - DNA, 315 bp, Glycine max
  Peptide Sequence Number=SeqID_123115
atgactgttacagatgaccctggttactatgaggatggagagtttgggataagattggagaatgtgcttattgtcaaggaggccgatacaaatttcaattttggtgatagaggttacttatcttttgaacacattacctgggctattgctgatataattcgtacaaccttgggacccaggttcatgttaaaaatgctatttgatgcttcaggaggcattatggtgacaaatgatggaaatgctatcttgcatgaaatagatcttgctcgtcctactgcaaaggcatggcttatcactcttgctccacttctttga

SEQ ID NO: 6338 - DNA, 411 bp, Glycine max
  Peptide Sequence Number=SeqID_123116
gcctaactcgcaaaaatgtccccagtggagtcgccaactgtcgcaacgtgcccttttgcgggcgagcgaagcgaggctcacgggagcactttccaaaggaggaaacatgcgcggagtcgccaccaacgaaggtattagcacctctcacgtcgaaaaaagcggggctcttgctcctacgtaccctccatcgaagaggaaatcatacctacgtagttctttctttaaaggggaggagcttgccacccagctcgcccaggcgagcaaggttgcttcctccagaagcaacaaccttctagccttctggaggaagaatgtggaaggcccaactttcgaagaagttacgaaaactcacggattgcgaaaaacacctcctttcgatttccgtcacattacggaattttcatggatcac

SEQ ID NO: 6339 - DNA, 261 bp, Glycine max
  Peptide Sequence Number=SeqID_123117
atgaggagaggcaagagtgaggcaaacattgaaaagaagaaggatactactccaaatgaaggcaaggaagtacattattctttggtaccttctcggaaagagaaagaaagacatttggcaagatttcttgatattttcaagaaactggaaattactttaccctttggagaagcacttcaacaaatgcccctttgtgccaaatttttaaaagatatgctgacaaagaagaaccggaaaagctctcgtagacttgggagctag

SEQ ID NO: 6340 - DNA, 221 bp, Glycine max
  Peptide Sequence Number=SeqID_123118
agaaaaatcccaaggaggagtgtaaagctgtgatgactagaagcagaagggcaacccatttggataagagtgaagttgagaagaagatagaggaacataaacaacagttggcacctaagccagcacttgagcccgtttctaattctgtagaacttgaagagattaatgaggagcctaaagatgataaggaggaagagacaccaataaaagagaaagaataa

SEQ ID NO: 6341 - DNA, 255 bp, Glycine max
  Peptide Sequence Number=SeqID_123119
atggatgacatggggttgaatcaatatagatttttcaacatggttcatgacatcttggtcaaggtgaaactagaagtaacaaggacatcaacaatcctaaacgtgtttggaagtaaacgaagcagtgatatgaaaatgcaaggctcacgcatgagcaaacatgaaaacaaaaggtatgcagtttgtagaacaaaaagtatgttgaacgcatatgatgatgcaatgactcatgcaaaatgtgatgctggaatatga

SEQ ID NO: 6342 - DNA, 216 bp, Glycine max
  Peptide Sequence Number=SeqID_123120
atggaggtttggaagtacgttagctatcctcgtggccaaacaagaggtaggaatagaagaataggaggacgtgggaggatgagtattttgcacgcagtgccgatgaaagcaacaatggccttcacgcctgggtccacattcatccctttctctttgtgcttggggcttgtcgtcaatcacacgccacacacctctctctcctcctccattccctaa

SEQ ID NO: 6343 - DNA, 207 bp, Glycine max
  Peptide Sequence Number=SeqID_123121
atgagaggaaggaaggaaaaattagctagtgagcggagcggcgacgtaaagcaagtctgtgggaggaaggatagggtttgttatagtaagcgtgaaggaggagggtcaatacaggcacaacaaattggggagacacgggaagaagcaattaatccacagtggcagctaaactggacaagcttgagtgataagcgtaggatattttga

SEQ ID NO: 6344 - DNA, 255 bp, Glycine max
  Peptide Sequence Number=SeqID_123122
atgtcagataaacctgcaaagacgaaggcatttagatcatattatagcattcctaagagcaacatctcacctaatttcaaggagaaactaggtttatgtgagaaccagattataaacttcctaaataaaaatagacaaaggaaaaaactatgcctccgctgcggtcaaggtttcccctacctcataaagattggcgagaagtgtatcgaaagttgtcagattaaattcatgaaagaaagttacgagtttgaatga

SEQ ID NO: 6345 - DNA, 444 bp, Glycine max
  Peptide Sequence Number=SeqID_123123
atggaacagaatcagcaaaagcttcgaaaggctgtctcggacgtgtcgaaggaaattggaagatactataatgacttggagttggagagacaacttggtgctattgaagaggtggaacaagctgaatgccaatgttgtgggataaaggaggactgcaccacggtttatatcacagaggttcaagaatgttattgtgggaagtgggtttgtgggctttgttctgaagctgttaaggaaagagtagggcgaagtcctaaggttgccatgcaagatgctttgaactctcacagggatttctgccaggaatataacgccaccactaggcttaacccccaactctcgataactctttctatgagggaaatagccaaaagaagtttggagaataggaaatctaaggggttaagcataaaaaagcttagtcggacctctagttatccatga

SEQ ID NO: 6346 - DNA, 153 bp, Glycine max
  Peptide Sequence Number=SeqID_123124
atggcattaggggtcatggcagcttgcccaggcgagctgttgcttcaacctgaagtaaccttgctcgcccaggtaaaagctagggttccaaaagaactcaagataagcgtgataagcaagaagaaagtattgtgcaataacaacataagctag

SEQ ID NO: 6347 - DNA, 411 bp, Glycine max
  Peptide Sequence Number=SeqID_123125
cactacggtatctgatataaccttaattgaacgcaacaaagaagtggccatagaagaaacacatgatgagtacatattaccaaccgtgtccgaggtagagaatgcgaaatgcgagtgttgtggaatgttcgaggagtgcacccgcgagtacataaggcgcgtgcgtgaaatgttcttggggaggttaatatgcgggttgtgtggtgaagctgtgaatgtggagatggagaagaatggtggaaagcgagagaaagctctcaaagagcacatgagcgattgtgtgaggttcaataggcttggtaggtcatatcctgctctgtaccaagctgaagatgtcaaagagatcctgaagaagactcagaaaaaggccatgtccaacactcctgatgattctaagggtagtccaagcaa

SEQ ID NO: 6348 - DNA, 408 bp, Glycine max
  Peptide Sequence Number=SeqID_123126
atggatgataatctttttaatggctcaatccctatctccatgatgaagttgtctagcttgtcatggctaaacttagcaagcaataaactttctggctacattcctaaggagattggacaactgcggagcttgaagtatttattacttggattcaataacctttctggcaccattcctccaacaattggaatgttggccaacctcgttgaacttaatctgtcaagtaactccatctctggtcaaattccttcagttagaaacttgacaaatttagaaagccttaagctctcagacaatagtctttctggccccattccaccctacataggagacttggtcaatttgattgtctttgaaatcgatcaaaataatatttcaggattaattccttccagtattggaaactga

SEQ ID NO: 6349 - DNA, 273 bp, Glycine max
  Peptide Sequence Number=SeqID_123127
atgtgtggtaacaagttcaagggagcgagctttgaaacactggaactgcataacctgtatattgagggagaaaggaacatattttgtccagaaaattccaactcctttgagacaaaagcgtccctcaagcaagcaatgcttccattgaagtggtgttacaaaaaggccttccccttgcttcgctctctaaaaatccccatttcccagaaaaaccctagcacccgcaacaccgcgatgaagaagttgaggcgacaagaaggaatgcgagaatga

SEQ ID NO: 6350 - DNA, 219 bp, Glycine max
  Peptide Sequence Number=SeqID_123128
atgacaaacctgtggctaagtgagtgttgtctcgctaagcccagtgttgctcgcgctaagcgctgccctcgcgggctaagcgctattcgttgcggcatgcataaggctaagccggcgctgatcgctaagccattgtgtgaaataaaaatggaatccaggaagaggaagagcactgcttccagacctcaagctcagtatgatactaggcgattcctgtaa

SEQ ID NO: 6351 - DNA, 887 bp, Glycine max
  Peptide Sequence Number=SeqID_123129
attcttctccaggcatcatcaaggacctttcagaccttgagaaactagcagttcttggccatggcaatggcggcatagtctacaaagtttatcacacgaagaaccgttccttttatgcattgaaggtcttacgcttgaatgagaatggcattggcatcctcgaggccgagattctaaaacgagtgaattcgccgtatatagtaaggtgtcatgcagtttttgacaatgacaactgcagtgagggtgacattggctttgtcatggaatacatggaaggaggatcgttgcacgatgtgttgcaagaacaccacaggctgccagaggaggtgatctcggtgttggctaagcgtgttttggaaggacttaactatctgcatggcatgcacatcgtccatagagatattaaaccctcaaacttacttgtgaatgacaagggtgaggtgaagattgctgattttggagtaagtcatgtagtggaaggaaagtttgaggtaagcgactccaatgcaggaacatgtgcctatatgagcccggaaaggattgatccggatagatggggtggtgaaaatgcagacgagtttgcaggagatgtgtgggcaacgggagtggtgatgttggaatgctttttgggttattttccgttgatcggtccagggcagagaccagattgggcaactttgatgtgtgcaatttgctttggtgagaagctggagatgccagaaaaagcatcgccagagtttcaaaattttgtgaggaggtgtcttgagaagaattggagaaagagagcaacagttttagagcttcttcaccacccttttgtgggtagaaactgttgctgttccagtacagggcttggagattatgttcttcggggtcaagttcactag

SEQ ID NO: 6352 - DNA, 513 bp, Glycine max
  Peptide Sequence Number=SeqID_123130
atgaatagttcatcgccggcccactcttcactatcgacgacggcggttgtaggcggcggtggtggtggcggcggcagcagcaacgccactgtttccattgacgattttcatctcccgtgtgatcccatctcgtcgcaagagcgtaaagacgaggccatgctagttttaaaatcagatctcatggctgcactcaacaaggaggttaaatcattggttgaagataactggaagtttgaagggccacgttcgcggatccacctcgtatcacatcgaggtgttgatggcttgatgctcagatccttgatttcatcatggtgtgaaatatcagtatttggaagctcactcaaggttccccaccctgttagattagggaggatacatgtgcacagccttaattcaaggtggagaggctgtttccatgaacctgtgacttctgactcacaaggtagcaaccttactgttgtgcctaggcttgcccttggccttgatattaaaaaaatgtatactctctga

SEQ ID NO: 6353 - DNA, 2046 bp, Glycine max
  Peptide Sequence Number=SeqID_123131
atggccaaagaactcccccaacagcaacatctccaactgggtctgtctctttcccttcactattaccttaaacccactactactttacttttatctttcctttcacattctgttctgttttactatattacttgttttttctcactccctatggaccgtactactgacaagcaacagcaccagcagcagcagttatccttggccaagggtacaaggcaaagaaacaatgaatggatttttcgtgatgtaccaagtgatgtaactatagaagtaaatcgaggaacattttcattgcacaagaagttcctctatgattgttctaattcttatttcttttgcatgaagtttcctcttgtctccagaagtggaagaataaggaggttagttgcagaacacagggattctgatatctcaagagttgagcttctaaatctaccaggaggtgctgaatgctttgagttggcagccaaattttgttatggcattaactttgagatcagatccacaaatgttgctcagctatgttgtgtctctgattaccttgaaatgactgaagacttttcaaaagacaaccttggctcgcgtgccgaggaatatcttgatagtatagtttgcaagaatcttgaaatgtgtgttgaagtcttgcaacaatgtgagagcctgcttcctcttgctgatgagctaaaagtagttagccgctgcattgatgcaatagcttcaaaagcatgtgcagagcaaatagcttctagtttttcaagattagagtatagcagctcaggaaggttacacatgagtaggcaagccaaatgtgatggtgactggtggatagaagatctttctgttctaagaattgatatgtatcaaagaatcataacagccatgaaatgtcgtggggttcgaccggagagcattggtgcttcccttgtgaactatgcacaaaaagaattgacaaagaaatccagcttgtggaatccatctagccagactaaggttgattcaaattccactttgcatgaaaaacttgtggttgagaccgttgttagccttttgcctgttgagaaactagctgttccaatcaatttcctttttggacttctgcgaagtgcagtgatgcttgattgtacaatcgcttctaggctagacttggaaagaagaattggatcccagctagatgttgccactcttgatgacattttgataccatctttcaggcatgcaggtgataccttatttgatgttgagacagttcatagaattttggtaaacttctgtcagcaggatgatagtgaagaagaaccagaagatacttctgtttttgaatctgacagccctccttcaccatctcaaactgcactaattaaagtgtcaaaactagtggataactaccttgctgaaattgcccctgatgcaaacctaaaactttccaagtttatggtcatcgctgaaaccttacctgcacatgcacgcacagttcatgatgggttatatcgagcaattgatatttacttaaaagctcatcaaggttcgacagatttggacaagaagaaactatgcaaattgattgattttcaaaagctttctcaagaagctggagcacatgctgcacaaaatgagcgccttcctctccaatcaatagtgcaagttctatactttgaacaactaagacttagaaattcattgtcctgctcctacgcagaagatgataccaagccaatacaccagtcatggcgcataagtagtggagcactaagtgcagcaatgtctccacgagacaactatgcatcactgagacgcgaaaactgcgagcttaaacttgaattggctcggctaagaatgagactaaatgatctagagagggagcatgtttgcatgaaaagggatatgactaagtccggatcgcgtaaatttatgagttctttctccaaaaaaattggtaaacttagtctttttggacatagttcttcaagaggatcaagttctccatccaggaactctcaaagaacagattcaaaggtgattgagagaacctgtgctagcacagagtag

SEQ ID NO: 6354 - DNA, 341 bp, Glycine max
  Peptide Sequence Number=SeqID_123132
atgggagatcgcttaaaggatatgattcgtgaccttggacaagagtcttttcagcaagcacatgctcctatgtatgatacattgcaaactgattcaaagaagcctttgtatccagggtgcaagaattccttgaccttgttgtcggcagtgttaagtctggttaatgtgaaggccagatatggatggagtgacaaaagctttagttcactacttcaagtagtgcatgatatgcttcctgaggaaaacgcgttgcctaaaagttactatcaggccaagaagatattgtgtctaatgggtatggagtatcaaaagattcatgcttgcctcaatgattgcatact

SEQ ID NO: 6355 - DNA, 309 bp, Glycine max
  Peptide Sequence Number=SeqID_123133
atgggtattcaagtaataattatattattctattggaaagcaagcttcatctctcacattgggagatcatctttcagcatgcatcaccatgaccttgggaccagaatacttgatgataccggagataatacagcaggaaagaagatgataaacactagacaaaaagctggagatttccattctctacttaaagatgtcattgggctaattgggtctcattttcctgtttgcattgacttcatcccaaggacaagaatgtcggagctatttctctggaagatcaaaagcaaagggacaccaaaagattaa

SEQ ID NO: 6356 - DNA, 201 bp, Glycine max
  Peptide Sequence Number=SeqID_123134
atgggtgactgcatgcgacacacagcgagagtattgatcattggtgaggtctctgcaacactaaaagaggtcatagatgatatcgaaggaggcaatgttagcaaagttattgtggttgacaaaggcgatggagttgacggggagatgaagagtgagttgatggtgttttcacaggggaaatccgatgttaactcgagctag

SEQ ID NO: 6357 - DNA, 2299 bp, Glycine max
  Peptide Sequence Number=SeqID_123135
atggttctcatgtctgccactttaccagtctctgagtttatctggttaccatgtaagctttttttttgcctcaaatgcttgcagacctttgcccagatacatgtaaaggaaggcactgttagtaatcttcaatgtcctgaagcaaaatgtgcatgtatgattcctactggccttttaaaaccctttctggatgacacagattatgagcgctgggaatccatgatattggaaaaaacacttgcatcaatgtctgatgctggaatgatgccatgttggcatagcatgcatgagtctagatatgaagcttcagattttgcagtgtttcttcatgtcgttaatatgctttcttgggtgtggtttgatccgccgccaagtgcacttccaacgccaatgcttgttcaggttctattcctctgcttcttctgcattgatgttagaagaccactgtctagggtgttcaaatcactgagttggagtgtggcaagaaaaaaaaagtttgggaattgggttgagtgtcatgggttttctcattcaatcagttgctttaggataatcgttcatgcgtttgctttggcggggatgcgtttggaagtgtgggctttgcttagagatattgttggcttctgtaatgaggccaagtatgatacctttgaattgttttcagcttttctggattcaccccagcacgtggaaagatccggtgttgtgtttgatgtgctcataagcgtgtttgcatccaactctatgctggaaaatgctcttgatgtgttttcgaatgctaagcatgttgggcttgagcctgatattaggacttgcaatttcttgctgaaatgcttggttgaggcgaatagagtggagtttgttagacgggtttttgaggaattgaaggaccgtggtccatcgccaaatatctacacttatacaatcatgatgaatttttattgtagtgatgttgggtgtgatgcaggtatgagacaggctgctgtgattctgggaaaaatatatcggagtggggaaaagccaactgttgtcacatatagtacttatattcatggactttgtaaagttggtaatgttgaggctgctctgatgttaattcgcaacttgcactatacaaaccagcccctcaatagccattcttttaatgatgtaatttatggattttgtaaaagaggtgaagtgtttgaggctttgcaagttttggaagaaatgaagagctctgggatattaccagatgtttatagctacagcatcttaattaatgccttctgcgggaaaggtgatgtaatgaaatgtcttgacttgatggaggaaatggaacactcccagataaaaccatccattgttagctacacctccctcatccatggtctgtgcaagaagaatatgttacaaaatgcagtggatatattccatagtattggtgcttctagttgcaaatatgattcgactgtttatgaaactttaattgatggattttgcatgcaaggtgatatggattcagccatcaagcttttggaggagatgatctgcaacgaattggttcctactgcttttagttgccgcagtctaattaggggatactacaaactgggactattcgatcaggcattggaagtttttaatgccatgctacgagatggtatttggccagataccatcgcttgcaattatattcttgatggatcttgcagggcagggtacttcaaagaagccttgacactgttggaggacttccaagaacatggatttaacctcaacccacattcatataatgcaatcatctacaaactttgtaaagaaggttatccagaaagagcattggagctcctgccaagaatgcttaaaaggaatgtacttccctcagttgttaattatagtactcttatatctggctttgccaaacagtcaaattttaaaagggccgtgaacttattcacgagaatggtaaaagtggggatcactttcaacattgccacagaaatgaaaaaggcctgggcattatttgaagaaatgtcgagggaaggctgttcgccaaatgtaattacttatacttgtataattgatggattttgcaagtcaaaccggatagatttggccacttgggtgtttgataaaatgaacagagattcagttattcctgatgttgtgacttacaccgtcctcattgattggtatcacaagcatgggtatttcgatcaggcacataagctatatgatgtaatgaaggataagggtgttttgccagatgatataactcataatgttctaggtctgaaagctggcacagttcaagaag

SEQ ID NO: 6358 - DNA, 228 bp, Glycine max
  Peptide Sequence Number=SeqID_123136
atggttcaatggagcctcagtgccactgttggagtcatagattatgcataccaacttcctatgtggatttcaaatggcttggttgcccatttttgtgaagatgtacgtgtagctctgactgatatcttgaagctacctctgatggataaaagcaatggctgcagcttctctagcatatcttcaattgctgtcttttcaagtgctgtttccgtagtctccttgattccg

SEQ ID NO: 6359 - DNA, 410 bp, Glycine max
  Peptide Sequence Number=SeqID_123137
gtggtcatactgctgagatgcttaatctactggcagtgttacagaaaggtaggtttaatccaagattctacattgctgctgctactgataatatgagtcttcaaaaagctcagttgttggagaattccctggctgctgagaatgcaacaagggtcactgatactgcacagttcatgaagatatatcggagtagagaagttggtcaatcatatataacctccgtttggactacttttgttgcaatggtgcatgcgctatggctaatgattaaaattagacctgaagtgatactttgcaatggacctggaacttgcattcccctctgtgctattgcatttatatttaagtatcgcaagagtgagaaggctctccttgagaggcctgctcctgtacaagttgcggatggctga

SEQ ID NO: 6360 - DNA, 2784 bp, Glycine max
  Peptide Sequence Number=SeqID_123138
atgtcagaccggggtaccctctccggtgactcggccgtggatgatgctaagagcaacaaaaaggaacacaaagtttctctgctgaaactcttctcttttgctgacttctatgactatgttttaatgggtgttgggtctgttggggcaattgtacatggtgcttctgttcccgttttctttatcttctttggaaagttgatcaatgtcataggcttggcctatcttttccccaaggaagcctctcacaaagttgccaagtactcgttggattttgtgtatctaagtatagcaatattgttttcatcttggacagaggtggcttgttggatgcatactggggaacgtcaagctgcaaagatgagaatggcttatttgaaatcaatgttgaatcaagatattagtctatttgataccgaggcttcaacaggagaggttatttcttccattactagtgacattatcattgttcaagatgcactatccgagaaggtggggaacttcatgcactacataagccgatttgtagcgggctttgttattgggtttgttagagtgtggcagatcagtttagtgacactttcaattgtacccttgattgctcttgctggaggtctttatgcatacgtcacaattgggctcattgcaaaagttcgaaaagcctacgtgagggctggtgaaatcgctgaagaggtgattggcaatgttagaacggttcaagcatttgcgggagaagaaagggcagtaagatcatataaagctgcactcatgaaaacttatgtaaacggtagaaaagcaggtttggcaaagggcctgggcttgggctcaatgcactgtgtcctttttctatcatggtctttgcttgtttggttcactagcattgttgttcacaagaatattgccaatggaggcgagtctttcactaccatgctcaacgttgtgatcgctggcctgtcactggggcaggcagcaccagatatatctgcattcattcgagcaaaggcagcagcttatccaatttttgagatgatagagagggacacagtgagcaaaagtagctcaaaaaccggtcgcaagttaggcaaattggagggtcatatccagttcaagaacatctgtttcagttacccgtctcgtccagatgtagcaatattcaacaacctgtgtcttgacattccttcagggaaaattgtagcccttgtgggaggaagtggttctggaaagagcactgtcatatcattgattgagcgcttttatgaaccactttctggtcagatactattagacaggaatgatatcagggaacttgatctcaaatggcttaggcagcaaattgggctggttaatcaagaacctgcgctttttgctacaagcatcaaggagaacatactttatggaaaagatgatgccactcttgaagaactaaaacgtgctgtgaagctttcagatgctcagtctttcatcaacaatcttcctgatagactagaaactcaggttggtgagagaggtatacaactttcaggagggcagaagcaaaggattgcaatatctcgtgcaatcgtgaagaatccatcaatccttttgttggacgaagcgactagtgctctggatgctgagtctgagaagagtgtgcaggaggctcttgatcgtgtgatggttgggagaacaactgttgtagtggcacacagactctctaccattaggaatgcagatatgattgctgttgtgcagggagggaagattgtggaaactggtaaccatgaagagctcatggccaacccaactagtgtttatgcatctcttgttcaactccaggaggctgcttctctacatcgcctcccatcaattggtcctagcatgggacgccaaccaagcataacctactcaagagaattatcccgtacaacaacaagccttggtggtagttttcgatcagataaagaatctattggccgggtttgtgctgaagaaacagaaaatgcaggcaagaaaaggcatgtttcagcagcaaggctgtactctatggttggtcctgactggttttatggggttgctgggaccttatgtgcatttattgctggagcacagatgccactttttgcacttggaatttctcacgcacttgtatcatactatatggactgggagacaacatgtcacgaagttaaaaaaattgcattcctcttctgtggagcagcagttataactgtcactgtccatgccattgaacatctttcttttggaatcatgggagagcgactaacccttcgtgtgagagaaatgatgttttctgctatcttgaagaatgaaattggctggtttgacgatacaaacaacacaagttccatgctttcatcgcagttagagactgatgcaacattattacgaactatagttgttgatcgttcaacaattctgttacagaatattggtttggttgttgcttcatttattgttgccttcatcttgaactggagaataacactggttgtcatagccacatatcctttgatcattagtggtcatatcagtgagaaactttttatgaaaggctatggtggcaacttgagcaaagcatatctaaaagccaacatgctggctggggaggctgtgagcaatatacgcactgttgccgcattttgttctgaagaaaaggtccttgacctttatgctaatgagctcgttgatccctccaaacgctcacttcaacgaggccaaattgctggcatattctatggcatttcccagttctttattttctcatcttatggccttgccttgtggtag

SEQ ID NO: 6361 - DNA, 345 bp, Glycine max
  Peptide Sequence Number=SeqID_123139
atgaatacctcaaagccttacactggggcaatgagggtcaccgtgcatgagcctcaaccttacactggggcaatgaggggcatcgtgtatgagcctcaagtgaacataggggcagatcaaaagttctcacccgtcgatggttttaaacaaaaaaagggacaaaccctggaatttacactccaaacggctccatggccgtcactccaaaatggtcaagtgactaaatcaaatggaacatacactcggagggagttcccggagagatttgcaaaagataggataaggttgcatgaattatcacctctttcaaaaggacagtcaatctgtgttttccaaaaaaattaa

SEQ ID NO: 6362 - DNA, 579 bp, Glycine max
  Peptide Sequence Number=SeqID_123140
atgacaaacctatggctgagcgagtgttgtctcgctaagcccagtgttgctcgcgctaagcgccgcccccgtgggctaagcgctattcgttacggcatgcataaggctaagccagtgttgctcgctaagccattgtttgaaataaaaatggcatccaggaagaggaagaacactgcttctagatctcaagctcagtatgataccaaacaatttcattctttggatgcttggaatagatacaccgataacattctcggccgaaatatccttccggagagaaatgtgcagatttatcatactgagtttgacgagtttaaagtggaattggagaggcataatctacacaaatgcctcgcgaatctccaagatggaagcatagatgtagctgtggtgaaggagttttatgctaatttatacaccacaaaggatcaatcacccaagcaagccagagtacgaggacacctaatcaaaatagatacagatagcctaaatgagttccttcagactccagtggtattagaggagggggaatctttacccacctactctagattttgcaggttgaggactaatccttag

SEQ ID NO: 6363 - DNA, 183 bp, Glycine max
  Peptide Sequence Number=SeqID_123141
atggttttctaccctaaggttcaacaacaaaacaagaatgaagggagtaaggaacttacttgtatcgttgctgctttgatgcaaaagaaggcgaaaatgaaggaaaatgagtgcgagagagaagatgcagatagtacagcagtttccaacaaatcacataggcttggcttagcgtgccgatag

SEQ ID NO: 6364 - DNA, 483 bp, Glycine max
  Peptide Sequence Number=SeqID_123142
atgtataaacagaatcagaaggactttcctaggcttgtagtgaggcttggctacaaaaattcattggtttttctaagattaaaaggcttagattctaagagagcacaaatcctagacttatcccaatgggttcaaaattttgacaatatcattcagctcaaaaagggtgcaaaggatataattatcattcaagtgagagtaacaacttctccagatgacaaatcagaaagatcggcaattcctctaactggggaagtaggaaggtcagctgtttctctggctggtgaattaggaggggcagccgcttcatctgatgatgcatcgaagatgataatcagaggtggagatgggggaactacttcacgctcaagagaagacagtggattcaccactggagattatgggtcagcaggctctggatcaacctgcacaagtgtgggctcaggcggagcagcctcgttgggtctcaccaatggaagttga

SEQ ID NO: 6365 - DNA, 598 bp, Glycine max
  Peptide Sequence Number=SeqID_123143
atgtgtcccggtcggatgtggaacggtgagagccggtccgccgatcgactcgggacattgaccgacgcggattgcgatggtggccaagcccgggctgttgatatgctcgtggagacgtcatcatcgcgattgtggatggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaaggcgcaaggaagctgattggtgggatccccctcatacctgtcgggacccgaaagatggtgaactatgcctgagcggggcgaagccagaggaaactctggtggaggcccgcagcgatactgacgtgcaaatcgttcgtctgacttgggtaggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtg

SEQ ID NO: 6366 - DNA, 722 bp, Glycine max
  Peptide Sequence Number=SeqID_123144
aggattacacgtcctcgcctttagaggactacacgtccctccccttcagaggacaacatgacctcccctttagagggctacatgccctcaccttaacaggactacatgttctcaccttcagaggactacacgtcctcgccttccgagggctacacgtcctcgccttcagaggactacaagttctccccttcggagggctacacgtcctttccttaagagggctacacgtcttcaccttcagaggactacacgccctcaccttcagaggattgcacgccctcgccttaacaggactgcatgttctcaccttcagaggattacacaacctcgccttccgagggctagacgccctcgccttcagaggagtacacatcctccccttgagagggctacacgccctcgccttcgtagggttacacacccttaccttcaaaggagtacacgtactcaacatcagaggactatacatcgtcgccatcagagggctacacgtcctcgccttcagagggttacacgtcctccacttcagaggactacatgcccataccttcaaaggactcgcacaggctaccttcataggactacacgcccttggcttcgtaaggcttcacgccctcaccttcagaggactacacatgctcgcctacagaggactacacgcctttgccttcgtagggctacacgccctcaccttcagaggactacacatcctcgttttctga

SEQ ID NO: 6367 - DNA, 192 bp, Glycine max
  Peptide Sequence Number=SeqID_123145
atggacatctatctccatattacaaagccctcatctatgaccagcttcgtcttcacaaagaccatgacaaagtttaagtatttttttcattcatgccatgaaaaaatagataaatacacagagaagaaaaatcaaaggccagaaaggagggagagggaggatatagaaggattatataatggggccttgtaa

SEQ ID NO: 6368 - DNA, 267 bp, Glycine max
  Peptide Sequence Number=SeqID_123146
atggcccatgggctggttaagccttcatcatggtgcttgatcacattggatgattggaaggagaactctaatggaaaggctggtggtgctgatggtggttcaccaacaaacttgccaaccatcacgaacggagagaggcagaaaagaaaggccaaaggaagtgaaatcttatttctctcctctttcaaggaaatcaaagtgcactggagagaagttcctatggagaaaggtataagtcttcctatggagaaagagcatgtattatga

SEQ ID NO: 6369 - DNA, 348 bp, Glycine max
  Peptide Sequence Number=SeqID_123147
atgccgggcaaagacggcggtggatttattgtcaccgtgatcctcggtattatcggtgcggtagtcggtggctggatcagtacgttattcggctttggcaaggttgacggttttaacttcggcagctttgttgtggcggtgattggcgcaatcgttgtgctgtttatctaccgtaaagatggtaaggcgcagcctgactgcttcccggctggagaagcagcgagaaaagctaaacctgcgccaccggttgcatgctgcactaccagtaactcgccacttttcgtcaggtataagtacttcgtgtccgaacccgatggcggcgtcgcggattcggctaacaagatgaac

SEQ ID NO: 6370 - DNA, 543 bp, Glycine max
  Peptide Sequence Number=SeqID_123148
atgaagacccttgacgaagcaatggacttaattgaaagcatggctgctagtgacatagccattttgagagaccgagcctatattcctaccaagaagagtttattggagctaacctcacaagacgctctgttggcacaaaacaagttgttgtccaagcaactagagacactaacagaaacactcagatgtacaatttatggtggagctcatgaatctcgatgttgtatccctaatgaagagcaaattgcacatgaagtcaattatatggggaatcagcccagaggtaatttcaatacaagtggatttccaggatttcagaataacaaacagtatcaacaacagagacaatggaaaaatcaccctggtaaccaattcaatagagaccagggtggttcatctacaaggccacagcaacagatgccaagtctctatgaccgaaccatgaagctggaagagactctagctcaattaatgcaagtgtcaatgtctaaccaaaagagcactaagtctgcaatcaagaatctggaagtccaagtgggctag

SEQ ID NO: 6371 - DNA, 384 bp, Glycine max
  Peptide Sequence Number=SeqID_123149
atggacttcgccatggaaggctggatccgcaatcaattcaaggttccgacgttacggagatcaattgatttcctaagtcaactattaacggcgcttgaattcacagaaattaggaagtgtgattgtcatttcaattttcgtgaatgcatgttagacgattgtctagatgaatgttccgaaattcgagagcaagaagaggaaggggtagcggacgccctcaacggtgttggcatcgatggggtgaggaatgcagagaagaagaataagatggtgagagtggaggagaagaacaagaacaatagcattggagagaggagtctcgtgggcccatctcttttccaagcatttgccatggaaaggaattgtgttcattatcgaagctaa

SEQ ID NO: 6372 - DNA, 1098 bp, Glycine max
  Peptide Sequence Number=SeqID_123150
atggcggcaatcagcaacatcagtttgcaatttccagggaatttaaccgatgcaaagaaggataataatgttttgaggcttagcttttgttctccacgcaacactaccaacatgtctagtgaaaaacgaagatttttatcggtaagtgcaagttacagtgatagtcctcgaaaaatagacacggcaaatagagtgaatgtgaatggaatacatgtggcagaggctcctctacaagcagggaaattggcaaatgatccaagtgcagcagatgaagctattgttaccagcttgcgtggaaggtttgtggaggataaaactgccacaatggagacactcatgaattttcttcaggaaactgctttaaatcatgtcaccagctctgggattggtggagaaggatttggagcaacccgcgagatgagccttagaaaactcatttgggtggttactcgtattcaagttcaagtgcaaagatataacaaatggggagacgaaattgaagttgatacttgggtcgatgcagcaggaaagaatggaatgcgaagagattggataatcagggatcattacaccaaagagatcataacaagagcaacaagcacatgggtaatcatgaatagacaaacaagaagactatccaagatccctgaagaggttaagcaagagctgcttcctttttatcttaacaggcttgccgttcctaccgaagaaacagattgtgaaaagatagacaaactcactgatgagactgctcagatcagaatcctatctggactggctccaaggtggaatgacatggatgctaaccagcatgtcaacaatgtgaaatacattggatggattttagagagtgtgccaattgaagtgctagaacattataacatgacaagcatgactttggagtttcggcgtgaatgtacacaatcaaatttgttggaatccatgacatgtccaacagcaagagttatggaatccaataataattccaagaatagaaaacccgacatgcaatacacacacttgcttcgtctgcaacaagataaagcagatgttgtccgagccagaactgaatggaattttaagcaaaagcatcagtga

SEQ ID NO: 6373 - DNA, 234 bp, Glycine max
  Peptide Sequence Number=SeqID_123151
atgcctttaaaatgctctatcaaggggaaacccgacatctccgttacggttcaggaggttctagagaaggccaggagtgaggttaaggatgagttttttttgtcggtgctaatgtcggcatggcatccttcgtcgcttccgctatggggttttgggttctggttttggagcatgtgttcaagaattcgcaaaagatctgtgaaggggtttacttcaatagagttgcagatttga

SEQ ID NO: 6374 - DNA, 750 bp, Glycine max
  Peptide Sequence Number=SeqID_123152
atgtctccagctgtgggggaagtcagaacggttttggagctactcaggaaatggaccttcgcaatctcatttgggttgttactcgttttcaagttcaagtacagagatatagcaaatgacaatcataaatatgacaggagggatgaaattgaggttgaaacttggtttgatgttgccggaaagaatggaacgcgaagagattggatagtcagggaccattacaccaaagagattatagctaaagcaaccagcatatgggcaatcgtgaatcaagaaacaagaagattatgcaagatacctgaagaagttagacaagaacttgttactttctactttaataggtttgccatcgccagggaagaaatagatcatcagaagatacaaaagctcactgatgacactgctgagagttttcgatttggtgtgactccagggaggaacgacatggatgttaaccagcatgttaacaatgtaaaatacatcacatggatcttagagagcgtgccaagagaagtattagaagattacaaaatgacaagcattactttggagtttcggcgtgaatgtactcaatcagatttgttggagtcattgataggtccatcctccagcgtgattggtgcctctgataataactctatcaacagaaaacccggcctgcaatatatacacctgcttcgtctacaagacaataaagccgagttggtccgagccagaacagattggcatcttaagcaaaaccacgagtga

SEQ ID NO: 6375 - DNA, 480 bp, Glycine max
  Peptide Sequence Number=SeqID_123153
atgggcaagttgtggaccttgatcatccagcttcattctattgctgggccggttgtgacgttattgtaccctttgtatgcatcggtggtagcaatagagagccagtccaagttggatgacgagcaatggctagcttattggatcatctattcgttcctcacccttgcggaaatggttcttcaacctatcttagagtggataccaatttggtacgatgtgaaactattgacggtggcatggctggtgttgccacagttcgcaggagctgcgtacttatatgaaaggttcgtgagagagcatataaggaaatatataacggagagacagtatctctatggcaaccaccagcaacaaagcaaaaagtctcccaataacggtggcaaggccaagaaattcgtcgaattcgtcacgcccaagaaaggtaggggaaaaatggagaaagggatttgggtcgcggctcaagaatcgaatactttatag

SEQ ID NO: 6376 - DNA, 1295 bp, Glycine max
  Peptide Sequence Number=SeqID_123154
tatcccaatgcttcaggcgaaccctctgccgaaccatgggacagctgttaacatgatacaagattgtgatgaaaacggtgtcatcctgtacgtccagcacattcgaactcccctggtcccaatacatatcaagatgtgcgaggcagctctgtttgaccatgatcatgcagcgtgtgaaatatgtccagtgaatgtaaaaggatgcccgaaggtacaaggggacatacaagggctgatagacagcagagaactaaccatcacgaggaaggacagagaagtgtgcgtcattacccccgagtttcagcggttggaaataagctataacagtggggaatcaactactactccactagtgattagtttgccaggacctatgccgtatgcttctctaaaagcggtcccttacaagtatagtgccacgatgttggaaggtgggcaggaggtgcctttgccctctccaactcttgcgatttctgtggacaacattgctagtgacggtaaagttctaaggaatggacgtgttatccccacattgtttgcaaagaaagtgaatgatccggcagttaaacaggcgacagtgaatggccccggtacaaggaaggaagtaggccaatccaatgggactagcaagaattctgatcatgacgaaattctgaaactgatccagaagaaagcacaccgtgaggctctaatgaaggtgttagaccaagcttttgtggagagggacgtgactgttaatcaattggacagtatagtaggaaacattactgcttgcaataatttgagttttagtgatgaagagcttcctgaggaggggaggaaccacaatctggcgttacatatatcggtgaactgcaagtctgatgctctgtcgaatgtacttgtggacactggttcctcattaaatgtaatggccaaatctacattagatcaactcttctaccaggggcctcccatgagaagaagcggggtggttgtcaaagcgtttgatggatcaagaaagtctgttatcggggaggttgatttgcccattacaattgggccgtttgttttccaaattacattccaggtgatggatatccaagccgcatacagttgccttttgggtaggccgtggatccatgaagctggggccgtgacatccaccttgcatcaaaagctgaagtttgtcagaaatgggagattgatcactgtgagtggagaggaagccttgttggttagtcatttgtcagctttttcctttattggggctgatgaaacagaaggaacctctttccaaggcctgactgtagagg

SEQ ID NO: 6377 - DNA, 471 bp, Glycine max
  Peptide Sequence Number=SeqID_123155
atggtgtgtatggaggagcagaaggttattttgggtacacacagtctggtagaagaagctgagtattggttggagaacactcgccaatgcttggaggctgaaggccaagctgtgacctgggaaaccttcaagagggtatttatggagaaatactttcctaaagatgttaggaataaggagatgaagttcctagagctcaagcaggggaacatgactgtggttgaatatgcatccaagtttgaggaactagtgaggtactttcctcattacctaggaagagatggtgaaagttcaaaatgcgtaaagtttttgaacggcatgcggcctaagatttgggatgaggactcccaatactgggcggcctattatagaagtagggacccaatgaagaataaaaagaatggatctcaaaattggggaataccatacccaacccctcctaagcaacatggtaatcgccccaacaattaa

SEQ ID NO: 6378 - DNA, 294 bp, Glycine max
  Peptide Sequence Number=SeqID_123156
atggttcaaggaaaatttgtcccaaatcttggggaagttattatcaagaaaaagggcaagtatggggaaggaatgaatgaaaaagtgaaggttattctatggatgaatgctctcctagaacctaagcttttgaatcctagaaaaaccatgaattgttggcagcctaaccccattacaagcctagaaagtccttcggattcatttttgtgtgttcattactgtatgataggagatgaaatgcaaaggttggaacttgtgttggttgtttatgatggaataagcctaaacacttga

SEQ ID NO: 6379 - DNA, 795 bp, Glycine max
  Peptide Sequence Number=SeqID_123157
atggctgagataaaggaggtgcaagagaaaatgaaggccgatatggaggccttgaaggatcaaatggcctccatgatagaggccatattaagcatgaagcgaatgatggaaagcaatgaggtgctagtcagcacaagcattcaacacatagggcataataggaatgcttacccccccccccccaactatacaccacccaatgccatacacattcccaacgagaacgctaaccgtgccgttcccgttccccttgaaggccaacaaccccagcttgtaggggacacccgtgaagagcctcgggatcatgctcaaggtgaattcgacctataccccacattcaccaccgagggaccagcatttaatgctatgcctcagcctattaccatgggagctcctcaacaccgcccactacaacctctgcacttctcagtggggagactgccttcgaccatggaggaaagggagaagctggatctcatcgaggagagattaagggtcttcgaagtttttggtgatttcccattcgctgacatagtagatttgtgtttggtacctgacgttatcatcccctcaaagttcaaggtatcggatttcgttaagtataaggggactacttgtcccaagaattacctgaagatgtactgtcgaaagatgggggcatactccagagacgagaagttgttaatgcatttcttccaagagagtttggccaaagtaccggtcagctggtacaccaatttggaggcttctcggatccattcatggaaggacttgattactgcctttatcaggtag

SEQ ID NO: 6380 - DNA, 339 bp, Glycine max
  Peptide Sequence Number=SeqID_123158
atgtttagcaacacttatgggcaaatttccccatctggggtagttttacaaactatttccccagatggggctctttttaaagattttccagcatggggcacttttggacgtgttttgcatgcatgcagcacccaaaccgccagaaccactggcgagtttggtgtctgtgagaaaatcgccattcacactggcgatacacctagatacgcagcagttcaggccgtggcagtgcaggtgcagtcgcgtcagcagggtgcagagcaaatcaccatccccattggcgatttgcgtttcacaggaatcgccagcatggctggcggactgtgctttgttctttaa

SEQ ID NO: 6381 - DNA, 731 bp, Glycine max
  Peptide Sequence Number=SeqID_123159
atgccgcgcttcctggcgcgcctgccgtatggcattcgcaccaatccggtggatagctttgattttgaagagcagaccgacggctcaaatcacaacggctacacctggagcaacgccgcctacgccatggcagccaacatcaaccgttcgttcaaagagtacggctggtgcaccgccatccgcggcgtcgagtctggcggtgcggttgaaaacctgccgtgccacaccttcccgagtgatgacggcggcgtagacatgaaatgcccgacggagattgccatcagcgatcgtcgtgaagccgagctggcgaaaaacggctttatgccgctggtacaccgcaaaaactccgactttgctgcctttattggtgcgcagtcgctgcaaaagcctgcggaataccatgatgccgatgcgaccgccaacgcacgtctggctgcacgcctgccgtatctgtttgcctgctgccgcttcgcgcactacctcaagtgcatcgtgcgcgacaagatcggttcattccgcgagcgtgatgaaatggagcgctggctgaacgattgggtgatgagctatgtcgacggtgacccggcgaactcgtcacaggaaaccaaatcgcgtaagccgctggctgccgccgaggtgagcgtggaagagcaggaagataacccgggctactacgccgcgaaattctttcctgcgtccgcactaccagctggaaggcctgacggtgtcactgc

SEQ ID NO: 6382 - DNA, 253 bp, Glycine max
  Peptide Sequence Number=SeqID_123160
atggccctggctcagcacaacggacttgagcgtgttgaattgaatctgcagcaatcattcaccatcaaacgcgacggtaaaagcataggaatactgatacagggacggggttgggtgaaggaggttcatccagtctgttttattggctggagcagagatggcgagcatgttgaccaatttttgttaactatcggtcaggatgaatgggaagcgacaggttgccacaagatttctgcagtaggagttatatcag

SEQ ID NO: 6383 - DNA, 441 bp, Glycine max
  Peptide Sequence Number=SeqID_123161
atggctattgatatgtttctgaaagttgatggtgtaacaggtgagtctaaagattcaaaccatacaggctggacagatattacctcctttggttggggggcaacgcaaccaggtaatatggccgtaggcggtggcggcggagcaggtaaggccgcatttaataatctggctgtagatgctctcatcgacaaatccactacagcaatcctgaaacattgtgcaagcggtggtcaacaagttgagtatgcaagaattactttagaagatgttttggttgtttccgtaaactataatggttctaataacggtgacgttttaggcgtcagctacgcattccaggctgctaaagtcaaacaacaatactgggagcaaacgtcttcgggcggaaaaggtgctgaaagtagtgctggctggaatatcaaagaaaataaagaagcataa

SEQ ID NO: 6384 - DNA, 207 bp, Glycine max
  Peptide Sequence Number=SeqID_123162
atggccggtgtcggtcgttatatgaccccgactgatatctttcagccgacattgcgcaatttcttttacaaacgctggccgataatgacggctaggtttttccgtgcgagctcaaccgagggttctgatgtgaacctgactaggaacggatcacttgatacaggctacgaagatttggatgacgccacttccagtgaaggaagataa

SEQ ID NO: 6385 - DNA, 330 bp, Glycine max
  Peptide Sequence Number=SeqID_123163
atggaagaggattataaacctctagctcagccacaaagacgcatcaatccaaccatgaaaaaagtggtacgaaaggaggtagtcaagctattaaaggctgaaatgatatatcctatttctgatagccagtgggtaactccagtacaagtagttcccaaaaaaggtggtatgattgttataaaaaatggaaaaaccaatgagctaataccaactcatactgttatgggttggagaatgtgtattgattacaagaagctcaacaaagccaccagaaaagatcatttttcattgtcatttatggatcaaatgttggagaaactagcatggtaa

SEQ ID NO: 6386 - DNA, 551 bp, Glycine max
  Peptide Sequence Number=SeqID_123164
ggaagctttctgcagggaagctaagtgtgaagtatgcaatcctgcataggattggcgctgcaaactgggtacccaccaatcacacttccactgttgccacagaatcctttgctgtcaaattacccattgccttcccaactgtattgtgtggcattatgttgagtcaacatcccaatattttaaacaacattgactctgtgatgaagagagaatcggctctgtccctgcattacaaactgtttgaggggacacatgtcccagacattgtctcgacatcagggaaagctgctgcttcaggtgctgtgtccaaggatgctttgattgctgaactcaaggacacatgcaaggtgctggaagcaaccatcaaagccaccacagagaagaaaatggagctggaacgcctgatcaaaagactctcagacagtggcattgatgatggtgaagcagctgaggaagaagaagaagcagctgaggaagaagaagaagccgctgaggaagatgcagcagaggatacagaatccgatgatgatgattctgaagccaccccatga

SEQ ID NO: 6387 - DNA, 276 bp, Glycine max
  Peptide Sequence Number=SeqID_123165
atgcctcctaaggcagcagggacctccctgagaggaggtcgaagttcagggaaaggattcaagctagctctaccagagccaactaccaagaaatcatcttcaaaatcttctgggtcaccaacccaggctgggtcatccacccagaaaaccaaagttgaatggtcatcaacccaaatcatctcagttaaacctgagtcatacactcaggaatcccccaaatcgacaaccgccaaacaaacatcggccgactatgcttggtcaatccaaatacaatag

SEQ ID NO: 6388 - DNA, 2481 bp, Glycine max
  Peptide Sequence Number=SeqID_123166
atggagaagttgcaggaaattgcagcatccttggctgttgattatttgcttccacccttgaagaaagctgtgaactcagtcatggaggttccaagagatgttgcagagatgaaagacaaacttgatgggattcaagccatcattcatgatgtagataagatggcagcagctgaagaaggcaactcacatgatggtctcaaagcaaaggtgaagcagctggtggaaacatctttttgcatggaagatatcgttgatgaatacatgatccatgaggaaaagcaacttggtgatgatcctggatgtgcagctttaccttgtaaggctattgatttcgtcaaaactacggcctctcgttttcaatttgcatacatgaacgaggacgtgaaatccgaatttggtggaatcaaggagaggaatggaagtgaagatagctcccaaatccaatcttctggaggaaaccaaaacatcccgttcgataaccttcgaatggctcctctgtatctgaaggaggctgaggttgtgggctttgacggccctagagatacattggaaaagtggttgaaagaggggcgaaaaaagcgcactgtaatctctgtggtaggaatgggaggactcggaaaaactactcttgccaagaaagtttttgacaaagtccggacacacttcactctccatgcatggatcacagtgtctcaatcctacaccatagaaggactgttgagggatatgttgctcaagtttgtagaagaagaaaaaagagtggatcattcttcaatggataaaaaatcattgatagatcaagtgagaaagcacttgcaccacaagaggtatgttgttgtgtttgatgacgtgtggaatactcttttttggcaagaaatggagtttgctttaattgatgatgaaaatggaagtagaatattaatcacaaccagaaatcaggatgttgttaattcctgtaagagatctgctgttattaaagtgcatgagctacaacctttaacacttgaaaaatcattggaattgttttacacaaaggcatttggatctgaatttggtggacattgtccaagcaatcttaaggacatatccactgaaattgttaaaaagtgtcatggtttaccactagcaattgtggtcattggtggtcttttattcgatgaaaaaaaagaaatacttaaatggcagaggttttatgagaatctaagttctgaactagggaaaaatcccagtttatctcctgtcaaaaagattttgaatttcagttatcatgatttgccttacaatctcaaaccatgcttcttgtatttcggaatatatccagaagattacaaagttgaacgcgggacattgattctacaatggatagctgaggggtttgttaaatctgaagcaacagaaactttagaggaagtggcagaaaaatatttaaatgagttgatccaaagaagtttggttcaagtatcttcatttactaagggtggcaaaattaaaagctgtggtgttcatgacctagtacatgaaattatccgtgagaaaaatgaagatttaagcttttgccattctgcgagtgggcgtgagaacttgccaagaagtggaatgattcgtcgcctaacaatagcatccggttccgacaatttgatggaaagtgttgtaaactcaaacattcgatcacttcatgtgtttagtgatgaagaattatcagaatcctcggtcgagagaatgcctacaaactacaggttattaagggtacttcattttgaaggcgattcactgtataattatgttccgctcacagaaaattttggggatttatcccttttgacgtacttaagcttgaagaatacaaagatagaaaaccttccaaaatcaataggcgcattgcacaacctagaaacgttggatctaagatattctggtgtgcgtatgatgccaagagagttctacaagcttaaaaagttaaggcatcttctagctcatgataggttttttgggttaatgggtcgggttcaaatggagggtggcattggagttctaacgtccctacaaacactacgtgacatggaagcagactatgatgcagaagaagtaatgaaagagttggaaagacttacacaattaagggtgttgggcttgaccgatgttcgtgaagaattcacaagttctctgtgctccttgataaacaagttgcaacacctggagaagctatacattaaagcacaatataaacttggggtcaatgatttgcaatttgatgtatgtgcacctgtacttcagaaggttcgcattgtagcgaggttaaaggagttcccaaactgggttgccaagctccaaaatcttgttaggttgtccttgggtaagtcctgtttgactgatgatccattgccactacttaaagatcggcaaatttactgtatagggttttttttaaaaacaatttacgaaactgggtctgtttcgaaactaattgcaacgggggtctaa

SEQ ID NO: 6389 - DNA, 597 bp, Glycine max
  Peptide Sequence Number=SeqID_123167
atggggaagaacaagggtcgtcaatcgcactcagctgcaaagcaaattatggtgaagggtactacctcaggttcaggtaaatcccaaacatctactacttctagtctggctagttgcttggatgttgtccaagcaaatcagaatgcttatactgcttcacaagataatcttgtaggcaaggtgctcgtaaaaaaggtagggacaagttctgcaaaaattgatgatgtcgcacaccaaatgtttgataatttgtcggaatgcagtgccgaatctgaatcttccctagaggtttcttgcaccttaggagacaatgattcaaccactgatgatgattcatctcactcttgtggctataagtcatcaccgcagctagacgacaataagactcccactccttgggtcaatctgttcaaagataacagaaacccttccaaaggttttggaatgaagttctcccctccaccctctaatgatgaagtgctattggaagaaattgatttgcaacccctggaagaggcttggggacataaccttattggctatgtggttggccgcttcccaggaaagaaagctctgttggattgttgccaaaaatag

SEQ ID NO: 6390 - DNA, 1200 bp, Glycine max
  Peptide Sequence Number=SeqID_123168
atggacgaaattgaaatccctgcccatttcctctgccccatttcccttcaactcatgagggaccctgtcacggtttgcacaggaatcacttatgatagagaaaacatagagagatggttattttcatgcaagaacaacacatgccccgttactaagcagtgcctattagaccatggtctcactccaaaccacactctacgcaggctgatccaatcctggtgcaccctcaatgcctcacttggagttgaacgcattcctactccaaagtcaccaatagacaaaactcagattgtgaaactcctcacagaagcaaaaaggttcccagagaagcaactcaagtgcctcacaaggcttcgatccgttgcctttgaaggccaaaggaacaaaacatgtttagagtctgctggagtaatagaattcttggccacaacaatgaagaacaacaacacacaagaagactcaactgttctcagtgaagcagctattgaagtcttgttccacctcaatctctccgaggctcgacttaaaactctgattaacaacgaggaatttcattttatcgagtcattgtttcatgtgctgaggcttggaaactaccaatctagagtctatgctacaatgctgcttagatcagcatttgaggtagctgatccaatccaattgatcagtgtcaaaaccgcgctgtttgtggaaatcatgcgcgtgctttgcgatcagatctcgcatcaggcttcaaaggctgcattgaagctcattgtggagctctttccgtggggaagaaacaggatcaaaggggtcgaggatggtacagtttcggtcctcatcgagctacttctcggcacctcggaaagaagaacatgtgaactcattttgatagctttggatcagctttgtgggtgtgcagaagggcgtgcagagttgttgaaccatggggcaggagtggccattgtgtccaagaaaattctaagggtctctcatgtggctagtgaaagaggggttggggctgtgtccaagttgtgtttggtgcttcaagtgaattgcggttttaagactaaggagagagccaaagagaattataagtgtagtaaagagttcaaattggctgatttcacagaaatgggagttagatttgagggtgtaattgctcacctcaccccacaaatcctaatgtctgctgcaattgcaaccaactacagatga

SEQ ID NO: 6391 - DNA, 1260 bp, Glycine max
  Peptide Sequence Number=SeqID_123169
atgacagaaattgaaattcctcagttttttctttgtcctatttcacttcagatcatgaaggaccctgtgacaaccgttacggggataacatacgacagagaaagcatcgagaaatggttgctaaaagcgaaagattgcacttgtccaatcacaaagcaaccattgccacgaagcccagagttcttaaccccaaaccacacacttcggaggctaatccaagcgtggtgttctgcaaatgaagccaatggcgtagaccaaattccaaccccgaaatcccctcttagcaattccaacgctgagaagctcgtcaaggatctcgaagtttcttctcgttttcaaaaggcgttggagaaattacacgctcttgcaatggagaacgaaaggaacagaaggtgcatggcttctgcgggtgtagcagaagctatggtgcacgtgatcacaaagattttcaagcaaggtaacaaaacgacgccgtgcgttgaagaagctcttagaattcttcgtttgctttggagcagtgccaatatggtcgacagcaacaacaacaacaacaacaaaattaagcgcatggtgggtgagaactttgactttctcaactctttgacttgggctttgcagcttcaaaccaagaacaacgtcaaattaacaaacgaagcaatgccaatattgaaactggtaattgaagccaaagactcaacccctttagggaacttgaagcttgaattcttcaaagttgttgtgagtgtgatgaaaaatagagaactctctcagcaagctgttaaatccgcgttgcatgttcttatagaaacgtgtcctttggggagaaacagaatgaagatagttgaagcaggtgcagtgattgaactcattgagcttgcacttgaaaaaccagaaaagaatatgacagaactcgtatttattctcttggcgaatctttgttcttgtgctgacgggagagaacagtttctgcagcatgctgcaggcattgctgtggtttctaagaggatccttagggtttcaccaaccaccaatgatcgagctcttcatatattttccttggtttccaagttctcggcgtcgaatgaggttgtgcaagagatgctgagggttggtgctgtgtcaaagctttgcatggtgttgcaagcagattgtgcttcctatttgaaagaaaaggcaagaggtgtacttaggttacactccaaaacatggaacaattctccctgtattcaagtgtatttgttaaccagattccataggtga

SEQ ID NO: 6392 - DNA, 204 bp, Glycine max
  Peptide Sequence Number=SeqID_123170
atggtacgacaactcagccctgtactatcaaggactttagagtcagaccagtttccactgttgaatgaccctaacaaagcatgcatctacctgatcaaggtaaaggcatatagtggccaaggagggatattctggagtattggagacttcaggcttttcctattcattggtcaattgatgatggatggagatcatctagattaa

SEQ ID NO: 6393 - DNA, 378 bp, Glycine max
  Peptide Sequence Number=SeqID_123171
atggagctttttgcttgtaacttgggtcgtagttcagttcttcaagctggattatgggccatttttcatggcattcaactagccagggagcgtgttctcttcaaactggagtttcaatcagactctagagaagcaatagatttggtgaacgaaggctgggatgattctaatgaagcctttccaatggttagggctatcaaggaggctattcaaccgtatctgcaggtgatctttaagcacattctaagagaaggaaatttaaccgctggtgctatggccaaattcgggctttcaatggggcagagtctcttttttgttgatcctccagattttgttctgccaatgctttgtgcagataagacagcttttagtgttcct

SEQ ID NO: 6394 - DNA, 813 bp, Glycine max
  Peptide Sequence Number=SeqID_123172
atgttgacctggttgctcctctgcatgggggccttgctggatctctgcgctgttactgctggctgcccatttggtgagggctgccacttcttacattatgttccaggtggttacaatgttgttgcccatatgatgaatttaaaacccgcggctcctccaccaagaaccgttgctgcaccaccacccatcccgaatggttctgctccatctgctgttaaaacccgcatatgtaacaaattcaatactgccgaaggatgcaaatttggtgacaagtgccattttgcccatggtgaatgggaacttggcaaacctattgctccatcaattgatgatcatcatcatcatcgtcctttgggacctccagcaggtggtcgtatggctggtcgaattgagcctcctcccgctatggctggtagctttggtgccatttctaccgccaagatcagtgtagaagcttccctggctggagctatcattgggaagggtggtgtgaactcgaagcagatctgtcgccaaacaggagccaaactttcaattcgagagcacgaatccgatccaaatcttagaaacattgaactcgagggaacttttgaacagattaaggaagcaagtaacatggtaaaagatttacttttgaccgtgtcaatgtctgccccaccaaaatccaccccaggtgttcctggtgcccctgccccccctggaagcaacttcaagaccaagctgtgtgagaattttgcaaaaggatcttgcacctttggagagagatgtcactttgcacatggagctgctgaattgcgcaagtcgggagtatga

SEQ ID NO: 6395 - DNA, 252 bp, Glycine max
  Peptide Sequence Number=SeqID_123173
atgtgcctccaatttatgattcttttgtggaaattgctaaagaagagaaggtgtaaaaagctgctggtgaactcgcttagcaaggcagattggctaagcgagtctcatccgcttagcgaggcagacaactcacttagcggatgcaaaaccctagaagaggataagtcagagatcagtgtgcttagcgcccagccagcccgcccaacaaggatgttgtctcttcttgcgcttagcacacccaagctcgcttag

SEQ ID NO: 6396 - DNA, 339 bp, Glycine max
  Peptide Sequence Number=SeqID_123174
atgacaagaaagtctgaaataaactcactctctcttctcacactcacgaaagaactagggttccttatctctcctctcacactcagcctgttttcttctcctcattgtctcctactatcgttgttgtcgccgttgaaggctgttagaagcacaattccttctctcactctcagattctcacacgaaaactctatctcagttcaagcttccctaaccgtgacgtcacccttgacagttgttgcccttgctgcctccgttgacatcagaggctttgggagacagtcgcatcaagcatgcaagacaacaacttttattttgtatcaatgcttaacactttga

SEQ ID NO: 6397 - DNA, 363 bp, Glycine max
  Peptide Sequence Number=SeqID_123175
atgcacgaacagaaaaaacgcaaaagggtatgtttcaaagccggagaagaagcattttccggcgagtttggattccgagtcctaactaccacggcacgatcctctccccgcctgtttcgttctgaaccccccacttctctttctccgcggatccaagttcccggcgaccactttccggcatgccatcctcctccagcagaggaagttgtaaagagagagagaaagaaaaagggaaagaaagaaaacttttgggttatatttacggggagagccactgggggtgagagtgagaagggaggaggcagagaggttgctttgcttttgtcgggttctgaaacagtgtcgggagtcagatacagatag

SEQ ID NO: 6398 - DNA, 540 bp, Glycine max
  Peptide Sequence Number=SeqID_123176
atggtgtctgcaaataataattcaaaaggtggcagcttcgcagtcgcatactcgaggggaaaagggaagggagatgagaggcgattcctaggaattcaggggtgggaggttcccgggggaatcgagagtctcatatttatggggcattttccaaaggggaaggaaaaggtagaatgcaggaggaaaaataaaaggaaattgttgcctaacgtaaatcaactcatcaaagtggcaccagatgccaagagcacaactcttggcacaaccccagcacgtaccgggagtggttgggttgggatattgaaagacatgtccaagtttaataagttagaacaagaaggttttctagaggggaacatgaaggcctctaggtcgtttggagtgacattgcttgtgtggtacacgttggcactacaagtaccagcaatagatgatgggttttgtcgggcgagccctggtgcagcggtaaagttgtgccttggtgacttgttggtcatgggttcgaatccggaaacagcctctttgcatatgcaaggataa

SEQ ID NO: 6399 - DNA, 1497 bp, Glycine max
  Peptide Sequence Number=SeqID_123177
atggcatccgtaaatggaaacaatgaaggaggaggtgctgcaggtgccagagtcaccaagtttttgcaatggttgatggccttgcctagcgagtttagtgctaaggtagtggatgtgatgtcacaaataaagaaagtgggaaaagaagatccaagaagggtgattcatgcgttgaaagtagcactctccatcaccttagtttcagcattttactatgtcaaccctctttatgatggttttggctcatctgcaatgtatgcagttttcactgtcattgttgtctcagagttctccgtaggcaactacagagaccacgaggtactagacattgcattgaaaagggtaatctcaattatctcaggaggtttaatttctgtatcagtcagcattttcgtgtgtcccatatgggccggtggtgatcttcacaatctagaatctaaaaatattgaaaaactaggcaactttctagaaggttttggagaggaatatttcgggagatcagagggtggagaatcaaacaaattatttatgcaaggatataaaagtgttcttacttcaaaacaagttgaagaaactttggccaattttgcaaggtgggaaccgtgccatggacgtttcagatttcgtcatccatggcaacaatacttgaagattggaaacttgtcaaggcagtgtgcctatcgtattgatgcccttaatggcttccttaattctgccaagacaccattagaaatgagaggcaaaataccagatccatgcatcaagatgagcacagaagcaggaaaggctttaaaggaattagcaatggcaatccataaaatgattccaccatctgctgcaaaccctcacattgccaaatctaagattgctgccaccaaccttaggtccatcatgaaaacaggattgtgggaagacacaaatctctttgaggttattcctgttctgactgtggcttccctattgcttcatgtggtttcttgcactgagaaactagcagagtcaatacaagaattatccaccctagcaaaatttaagaaccaagacagtgaatttgtcccaaagagtcctcaacagaaggaaactccacaaccatgttgtcacaacagtggaccacatcatcggggtgattcatggaaagccataagaaacaacttagcgccaccgacgacgtgtccatgtcggcgagaaggaagttcaacgcgatctgtcgcagcgcttagtgatttttcgacactgtcatgcttctttatgaaggagaggatgatggcgttggaggaaaatgaggttcacagagctgaagttgttgatggtgcggccagtggtttgaaggagcgtggtgatgagcttgccggaggaagggagggcacggaggtcagactaggagaggaattggaggaggacctggtagcgaaggatgtcaacgagggcggcgagggagaggtggtcatcggcagcgaggtaggcgttggggacggtgagaatgggaagggaggagaa

SEQ ID NO: 6400 - DNA, 1272 bp, Glycine max
  Peptide Sequence Number=SeqID_123178
atggagggcgagggaggaggagaggggttgaaccaggcagtgcagcagcaactgaatctgaagcaagtgaagacccgtgctatcagcctcttcaaagccatctcccgtattttggaagatttcgaggcctatggtcgcaccaactccacgcccaaatggcaagacattctgggtcaatattcgatggtcaaccttgagcttttcaacattgtcgatgacattaagaaggtgtccaaggcctttgtggtccatcccaagaatgttaatgctgagaatgctaccatactgcctgtcatgctttcctccaaactactccctgaaatggagactgacgacactgctaagagggatcaattgcttctggggatgcaaaacctcccaattggaatgcaaatggaaaagttgaaggcccgtcttgatctgatttctgcagcctgtgaaggtgctgaaaaagtgttggctgacactcgcaaagcctattgcttcggaactcgtcaaggcccagccattgcccccactttggacaagggtcaggctgccaaaattcaagaacaagagaatctactccgttctgctgtcaatgcaggtgatggattacggataccaggagaccagaggcacatcactcctgcacaacctccattgcatttggcagatgcacttcctgtcattgtcaatgaccctactgcacaaccacaactctcatcaaacaccatgcctgcccagaattccttgttacagacctcctccgcatcacaacttttgggaagatcggcagcatctccttctggtgcaaccagcaccacttcttttgacaatacaacagcttcaccaatcccatatgccaattcacctaggtcttctacaaacatgatgaatactccatcccctcagccacaaacaacccaacaacagccacaagtgcagcagcagcaacggcagaaactcatgcagttacctaaacaacagcagcagcaccaccaaattcttgctcagcagcaacagttcaggcagtctgcaatgcaaggactgggacagcttgcttgctttcatcatcagttgcatggacaacatcagatgcaattttctcaaccacttgggcatcaacaatttcagggtaggcagttgccttcaggacatgttcagcatggcattggtcaaagccaactcaatcaaggaaatcaaatgactcgattaagccagttttctggtcctgctaacagtgcactattcagtgctgctcaaacaacacctaatactcaaatggtatga

SEQ ID NO: 6401 - DNA, 288 bp, Glycine max
  Peptide Sequence Number=SeqID_123179
atgggaagcaggaatgtttcaggttatgaagctgaaatggtatccatattctctcagattgagtcccctgacagatcacttcatgaccatataattgaagctcttggcaagctcattgttgaacaaggaattccttatgttaccaaaaaagtattgagcaacattgtggaaccggcactgctatctcaagatggctctgatttggataagcctgtttctcaagagacatttttggaggaatttaagatagtcacaatgagtgtggctaatcgtgttaatgtaaattaa

SEQ ID NO: 6402 - DNA, 348 bp, Glycine max
  Peptide Sequence Number=SeqID_123180
atgtaccaatgcccttgtatcatctctgaagtcattgagttggatgatgaaaatgatgatatttggctgccaacaattccagatatgatggtgaagagaaggatagtggtagttcttggatcagtcaattcagacttcaaattaagtggaataacttctcaagagtgccagcaggagtggatgtgcattccgatgctatgggttgataatttgagaaaggtgcagaaatgcctgtcatcttatgctgcagaaatttcctcttcatttgggtggaaggttccaactggatctgattctgatgatggtggagatggaagcattaatcaaaaaactcaattgaagtcttga

SEQ ID NO: 6403 - DNA, 1350 bp, Glycine max
  Peptide Sequence Number=SeqID_123181
atggccatgctagcaggtgcggaacacaccacaggctacactcatacatgtaaaaccctactcgagaaatcacaggctaagttagttaacttcacaaacatggtaataagcctcggaaaagatgaccccagacgagttattcactcctttaaggtgggattggcactaatattgatttctattttgcaatattttcgtccttcattctatgcttttggtgacaacataatgtgggcggttctcaccgtggttcttgtcttagaattttctgtgggtgcaacacttggaaaaggtttaaacagggtgttggcaacgggtttagctggtgctttcggtgtttcaatccgtagaatagctagtttttctggggacaaaggaaaggctgtattgacttcaatgtttgtctttttcatagctggaacagtgacatttatgagattttcaccgagactgaaggcgagttacgattatgggttgattatatttatattgaccttctgcttagtgtctctttcggataatactgaaaatgaattattagaagttgcccaagagaggttattaacgataatcattggaagttgtatagctattgtggtatctatttgcatatgccccgtttggattggccaggatctccataatcaaattgctggcaatattcaaaagctcgctgattttttggaaggatttggagatgaatacttcaataatttagggaatacagaagaagctgcgggtgataataagccatttttccacagatatgaaagtgtcctatcttcaaaaggcagtgaagaaacaatggctgttctcgcaagatgggaaccttgtcatggcgggttcagatttcaccacccatggaagcaatacttaaaggttggaaaccaaatacggttgtgtgcttacaaaattaaagctcttagtgtcttcctcctccgctctgaacagaccccatatgagctacgaaacaggattcaagagccatgcacaaacattagcatggaatctgggatggcccttaaagaatcactattgatacttaaacacatgactaagtcatcaatgccaaatccccatgtggcgaatgctaaaaatgctgctgaatctctcaaatccgttctaagaacaaacccgtgggaaggagctgatcatttggagataataccagcagctacggtggcatcacttctaattgatattgtgatttgtgttgagaatatttgtgaagctgttgacgaactagcaaccctagcaaattttgtgccgtctgagttactccatcgaggaacagtgcaacctatttctaatagtgatggtttggttcatgtcatttccgttgctgagtga

SEQ ID NO: 6404 - DNA, 2358 bp, Glycine max
  Peptide Sequence Number=SeqID_123182
atgggcttccttactggaacaatctccatttcggctagaactaaccctctattttcttattgggagtgttgcaatacgcttcttatgtcttggttgattcattttgtttctccctctattgcccagagcatcattttcttcgaaaatgctgctgccatttggactgatcttcgcgaaaggttctctcaaggcgacttgttgcgttttgccgagttacaagaagagatttactctctcaagcaaggttctacttctgtcaccgactactacactactctcaaatctttgtgggaggaattagacaatttccgtcctttgactccttgcacttgctcagccaaagattttcatcatcaggatttcattatccgatttctcaaaggactcaatgagcgcttcgccatggtccgatcacagattctgcttcttgatcccctaccttctgccaacaaggttttctccatgattattcagcatgaacaacatcattccaccaatatctcaccatcgctcgatgttaacctgtttgccaacgtcgtctctagtcgaagccgtggcatcccacagtcagggggaggcaaatcgaactcttccaaccgcaaatgtgaccactgtggtcgccttggccacaccagcgatgcttgctatcagaaacaaggaaacaccattcctaaatgtgaacattgtacgcgatacggtcacaccatggatatatgctacgccagatttggatatccacctggccacccaaaatactcgagccgacctcaccttcccaacaagactggaactttcagaggtggcgccgctggtggtgccgctgtcaacaacactataagagaaggaaatcaaacactacatggagaagcacataaggatgggtcagctacaataccccgtcccaacatcacacaggcccaattccaacaactgatggctctactccagaagactcaagttggtggtgcgaatacaaatgacatacccattagagcaaacattagtcactccagcccaaactctgtttctgatctgtgtggctggatctttgagcttcaatggggtcctttaatggtgattttccaccatggagatgcagcggaagacaaaggaaaggagctctcaaatatgttcaatcaacttcaacgtgctcttatcccattcaatcctccatcacatatgacaggatatctccctctcatcatcgatacatcatgtctctgtcctctgagtctgagcccgccagctttcaagaagccgttcaacatcaatacccctcctcgtgttcgtcccattggctgcaaatgggtctacaaaatcaagagattgcctgatggcagcattgaacgacacaaagcctgtctcgttgcaaaggggttttcacaaattgaaggtgtggattacttcgaaaccttttctcctgtggtcaaaatgtccaccattcgtgtggtgcttgctctagcttcaattaaccactggaccattcaacaattagatgtgagtaacgcatttctacatggagatctgtctgaagacgtttacatgatgataccgtctggattacctgtggcccattcaagccaagggatttcactatgtcaaagaaaatattgtcttgaccttctcaaggattatgggatgcttggttgcaagccctcttctacacctatggatagcactcttcgactccatgctgattcctctagcctccttcctaatccgctgccatatagaagactagttggtcgcttgatttaccttactagcactaggcctgacatagcctttgctatgcaacaattgagccaatttatgtccaaacccactaaagctcatcaccatgcagctatcaaagttcttcgctaccttaaaagcgatccatcactggctattgctttttttattggtaattcactggtttcatggaagacaaagaaacagaacacagtctcacgttcctcttccaaagctgaatatcgcgctctagcttctgcaacctgtgaactgcagtggctcacttttcttcttagagatttgcaagttccttgctcacctcaacctagcctctactgtgacaaccaaagcgctcttcacatagctgccaaccttgtttttcatgaacggacgaagcacttggatattgattgtcatctagttagagagaaatcccagattggtcttatgcggctgcttcctgtttcctcttcaaatcaattggctgacattttcaccaaagccctctcacctcgcctcttcaccatgaatctatccaagctgcagctagctgatatctacctacctccaacttgtggggggctaaaagaagaagaccataatcctaacctaatcacaacataa

SEQ ID NO: 6405 - DNA, 1110 bp, Glycine max
  Peptide Sequence Number=SeqID_123183
atggtggacactgcactgattgacatgtacgctaaatgcggtcgtgtggagtccgctaggttggcattcgaccaaatgggtgtcagaaatttggtgtcttggaacatgatgattgatgggtacatgaggaatgggagattcgaagatgctctccaagtgtttgatggaatgcccgtgaagaatgctatttcttggactgcgctaattggtgggtttgtgaagaaagattatcacgaggaagctctagagtgctttcgagaaatgcagctttctggtgtggcacctgattatgtgactgttattgccgtcattgcggcgtgtgccaacttgggcacactcggtcttggcttgtgggtgcaccgacttgtgatgacgcaagatttcaggaacaatgttaaagtttccaactcgttgagagacatgtattctcgttgtggatgcatagagcttgctcgtcaagtgtttgatagaatgccccagagaaccttagtttcatggaactcgatcattgtggattttgctgctaatgggcttgcggatgaggctctgaataacttcaattcaatgcaggaggaagggttcaaactagatggggtcagctacacaggtgctctaatggcatgtagtcatgctggacttattgatgagggacttggaatctttgaaaacatgaagaggaggttagaggaggcattgaatgtgttgaagaatatgcccatgaagccaaatgaagtgattttgggttcattgctcgcagcttgtaggactcaagggaacattagtttggctgaaaacgtgatgaattatcttattgaattggaccctgggggagattccaattatgtgcttctttctaacatgtatgcagccgttggaaagtgggatggtgcaaacaaggttaggaggagaatgaagaagcgtggtatacaaaagaaaccaggctttagttccattgagattgactccagcattcacaaatttgtttctggtgataaatcacatgaggaaaaagaccatatttacgcagcattggagcttatgtcctttgagctgcaaatatgtggctatattccagatttctccggaaaagaatcttatgaggatgattaa

SEQ ID NO: 6406 - DNA, 495 bp, Glycine max
  Peptide Sequence Number=SeqID_123184
atggtgcttgctcataaaccctttgatcgtcacaccttacccgtggtgctcaaatcttgtgctggcttatcggctctgcggctcgggcaacaagtccatggagcagttttggttaatgggtttggcttagatttggcaaattcgaatgctttgatgaacatgtatggtaagggcggacatttggtatgtgcacgcaaggtgtttgatagaatgtggaaaaggaatgagattgcgttttcaactatgatggcgggttatggaatgcatggaaagtgtggggagtcatgggggtttatagataaagggagggaatattttgagatgatggaggtgaggtttggggtgaaacctgggttgcaacattacacgtgcatggtggatatgttggggagggtcgaacagggagcatgtaaaactcatgggaagcttgaggtgactgagagagtagtagagagggtttatggaagggaattgcgttttgcatcgtcggtttga

SEQ ID NO: 6407 - DNA, 375 bp, Glycine max
  Peptide Sequence Number=SeqID_123185
atggacaaaggaagtggaagaaaatggaggaagatggagaagaatggagatgaaattctccaaatgaatgtgccatttgatagcaatatgaataggctggtcagtgctagtcaagacgatgaaagcacgggagcattggcgcgaggctatgaggcaccttcaaagaaaaccggagtaccacctgttgaagaagttggtgaagctggtggccaaatagggcaggtggtcctaaccgtcaaggatgctagggagagttggtgtagccttgcacgcaggaaggaacattcttctcgcaaatcaaaatcccctctctgggattacgcttctatatatctttgttgggataaattaggaaaacagaaccagcaattctga

SEQ ID NO: 6408 - DNA, 231 bp, Glycine max
  Peptide Sequence Number=SeqID_123186
atggcagaatgctttccaccgtctgatggagttggtagaggagcaacaggaggaagagatctagcatcaaactcacagataataacatcaatgttggttccaacaactacgagatgtggctgcaaatgcgagaagagcaacgaaaatacaccgattgtcggttgtcggtgtggtgcgtgcgagaagagcaaacacacctgtcatcgttgcgctgcgagaagagcaaattga

SEQ ID NO: 6409 - DNA, 318 bp, Glycine max
  Peptide Sequence Number=SeqID_123187
atggcgtcaaagtttatctttaccactgtggttttacttatgcttttgtgcttgcttctgatgagggagccttctggttgcggttctgcgtatgaatgctttggtgctaatgcagctgatctaagggacattccaaacaggaaggtgctgtctgttttgaaggataagaaaactagtgctctgaaggctagtctgcaaggatcatcaagcaacaagtatggtgaaaagccactgaattgggagttaaggaaggttccttctggtccagatccgctgcatcataatggtgtcaaccccaaaaagcctcaaaccccttaa

SEQ ID NO: 6410 - DNA, 463 bp, Glycine max
  misc_feature (3)..(3): n is a, c, g, or t
  Peptide Sequence Number=SeqID_123188
gtnactctagaggatcccctagctctagatcctgagtgttccccaataaagcaaaatctaaggaggatgaagccagagatgtccctgaaaataaaagaagaggggaaaaaaaaatttgacgctggcttcttggccattgctagatacccagaatgggtcgccaacatcgtaccagtccctaagaagaatgggaagctcaagaacactggggcaacttaccagtgggccatggtagcattattccacaacatgatgcacaaagagattgaggtctacatggatgatatgattgccaagctgcgtaagtaccgattaaggttgaatctcgcaaagtgcattttcgaggtcaagtcagagaagttgctcgattttatcatgagccagaaagggatagaggtagacccagacaaagtgaaggccatcctcgaaatgcccgaaccacgcaccgagaagcaagttcgag

SEQ ID NO: 6411 - DNA, 643 bp, Glycine max
  Peptide Sequence Number=SeqID_123189
atggcagaaccatcgaaaaagcgaaaaggaacctcgagtcggagtcagcaacattctgggtcacaggaagccccaattcctccctccattccctctggatcattattttcatcagaggaacagcgtacacggtacacaaacctcttttcctctcgttccattgtagacccaaaattcatagatatggagttcttctctaatgagaattttgaatgcttccaagcatttgaaaacttcaatcttattccatttatgtctctgaaattacctgtctactctgaattagtcaaagccttttattctaatttagaaatccatgaaggtactctaaactctgaagtttatgggatcaagatggtcattgaccaatccctattttatgatttaaccaaattgcctagtgaaggtgtgccttttgagggtgcactgatttatgaatggaaattcgatttctctgtgcatgatgcccgccggttggtttgcatcaaccaagcggatatgaccggaagacttcttgccggttcattggcttttgaaagccgcatcctccattaccttatagttcgcattttgcttcctagatcttcaaaccttgcccaggtttttgaagacgatctcattgtcatgtgggcctttcataaag

SEQ ID NO: 6412 - DNA, 414 bp, Glycine max
  Peptide Sequence Number=SeqID_123190
tctgttggagattgtttagatgcaatcttcagcagatctatgaagtaccctttcttcgctcagttcgagaaggtgtacccaggacagcgctttactaggtatgccattcttggagacgatgtttgtatcgccgacgagaatgtggcctctctttatcgccagacagtagcttgcttccaagccggcccggccgcgaggaagagatctttgccggtgctgacttggatctcgggtgacggaataaggcgcccagaagctacgagcagtcgcggtcgaagcttggctctaggcgataggctagcagctttctctgataggggctcgttagccgttgtttgggtcgagctcaaaccttcgccacttgagccgtatgcgggggaactcgcacgtgcggttcttaggggggagagctag

SEQ ID NO: 6413 - DNA, 195 bp, Glycine max
  Peptide Sequence Number=SeqID_123191
atggcagcagaatggagaaaggggaaaggtgattggagatgtgacttgttcgaaggtcgacaagtgcaccggatcacacaagtgagcagtggtgggtgcgaaggtagatggtcaacgtgttggtcttcctactgggcaactgatgctactaattctctacctaactgttggatcgagtggcctcagaataattaa

SEQ ID NO: 6414 - DNA, 108 bp, Glycine max
  Peptide Sequence Number=SeqID_123192
atggcgtcaaagtttatctttaccactgtggttttacttatgcttttgtgcttgcttctgatgagggagccttctggaactacccgtaataacgaacttgcaaaatga

SEQ ID NO: 6415 - DNA, 510 bp, Glycine max
  Peptide Sequence Number=SeqID_123193
atggagtcgcggatggatcactacgagatcatggagcagatcggtcgtggcgcgtttggcgctgcgattctcgtaaaccacaaagcggagaagaagaagtacgtgttgaagaaaatcaggctcgcgcggcagactgaacgatgcagaagatctgctcatcaagagatggctcttattgctcgaattcagcatccctacattgtgcaatttaaagaggcttgggttgagaagggttgctatgtttgcattgttactggatactgtgaaggtggagacatggctgcattgatgaaaaaatcaatcggggtttactttcctgaggagaaactctgcaagtggtttactcaaatacttttggcagtagaatacctgcattcaaattttgttttacatcgtgatctgaagtgttccaacatctttctaaccaaggatcaagatgttcgcctaggggattttgggcttgctaagacactaaaagcggatgatttggcttcttcggattcatgctaa

SEQ ID NO: 6416 - DNA, 216 bp, Glycine max
  Peptide Sequence Number=SeqID_123194
atggtgattgaaggcattgtgttgggccacaaaatctctgtgcatggcattgaggttgacaaagccaaagcggaagtcactgaaaaattgtctccaccaacaaatgtcaaaggcattagaagctttctaggacatgaatttgatttggaaatcaaggataagaaggggagtgaaaatcatctggctgatcatgtttctaagctaactattgatgag

SEQ ID NO: 6417 - DNA, 2253 bp, Glycine max
  Peptide Sequence Number=SeqID_123195
atgacattggtggtaggaactcccaactatatgtgtcctgaacttcttgcagatattccttatggattcaaatctgatatttggtcactaggttgttgtatatatgagatggctgctcatcgcccagcttttaaagcttttgatatggcagggttgataagcaagataaaccgttcctctattggccctttgcctccctgttattccccatctttgaaaacgctgataaagggcatgctgagaaaaaatcctgagcatcgtccaacagcatctgaaatcttaaaacacccttatttgctgccttatgttgatcaatatcgttcatctttctgtaccccaacagctggttctcctgaaaggccaatttctgctgtccatcatcctcgaaaaaataagccagaaagtcaaaacagtagtagtagtttgagtcctgagaaagatagtttcatgtcgagtgagaaaaacactgcaaatgaagtaaagaagtgtgatagaaaaatcaccgaaatagacctgacatcaattgaggatgacagctctgagcaactcctgcccgaggaagagggaaatggctccagtagagtcaatgccaaaacagatgagaaagagctgacgaagcaatctaataatgtacaccattctaatgctgtatctaagcaaccaaaaccaattaagaatgttgtgacagctttaaaagatggaaaacttagagagacaagttctccaataagaggcaatcgcataaaggttggtggtgtattgacccataaaataaattcagagacagtgtccaaattgcccaaacccaattttggtgcttatgatttgaagcctaatttggaggtgccaactactgcaccttctaaaacaactcctgattctgcaaaaagaatgcaaggattgcatacttcaaagcatcagttaccaatgatagaatccactccaaaaactaaacctcgacataatgcgattccaccatctggtccagtcaaacaagtagaaggacgggaagttccttccaagccaaggcaaaagactcgtccaagcttacttaaaccaccttcttttccaggacatgtgaggcaggctgggtttgatgttccaaatgcaacaaataatactggaaagtcaagtccaaagaaaatggtttgggagcctaagatgagccatcatcagctgaccaacactcatctaccacatgtttctagagagactactagagagcctttgaagacttttgaaaccagttccaaaggaatgcaaacagacagcagcaattctgtctcatcttcactctctattcaaggattcgaactttctgattttgcaaccacttttattgacttaagtgaaccaacacttcctgatcatgagagtttaaaccacactgaaaacgtggaatcatgtccatatagcatttcatgtgcttcctatttgcatcttgagatgtctgaacaattatctggggaaacccctgtggttacaccatgttttcaggatataactagtaatgagaaagtaagtcccagtttaactcttgatcactcaggccaagatgctgaggtaatgtttgcttctgatgatagtttttccataaatcaaaggactgcatctgctggctccaggtgtgataatttatctgtagatccctctgctgaaatcacacaagaaatcaaagaccctcaagattcaaaggaaatgtcttcagccaaatctctccaacagtcgctcctcatttctggagaaaagtctgtttgtgaagaatttggtccttcaagtaaaggaagtaataggcttgataaagttagccggccaaaacttatgtgcatctccactggtgatgacaaattcatggtgagggaaagactgtcatcagtggatgaaactgctccttcgattatctctactaaaatttcaagccagaaagttttgcaagaagagaaaggaatggttttacagaatccagcaccagaaaggccagctgttggccatcttcctccagcttttgatgatgtcattcatgtcatacgccatagcagttaccgcgtggggagtgagcagccagggaaggaatctgtggagatgggagttcaaaatgtagatgtcgatttgctgcagcaaaatagattggaggaacttgcagttgttctgaagccctttggaaaagataaagtctccccaagggagacagccatttggttagccaagagtctaaaaggattgatgatcgaggaaagtgggggacgcagttaa

SEQ ID NO: 6418 - DNA, 690 bp, Glycine max
  Peptide Sequence Number=SeqID_123196
atgacatacaaggacctcttgccatctctcattgccaaccaattggacatggtgattccgggaatgatcttccagtcttcgctcccgaagtgcaaggtccaaagtttgatagaagctggatggttgacatttcaagaggacgggcccaacataaagacaaacccactttccaatcatggagggggagctgttaatgccatcgaggctggcgtgattccccgcggtgggcacaaagaggattcgtgtttaatgcatctgagggtactgcataacatggaaacgtgttcagttgtaagagacctattacaacaaatgatagaccaaggccggcatgagtgttgggcgttagacctattccttttccttaaaagaacagccgcgcagttccgtggaggtacgccccccggggcgcggtcgtgcgttcgcacccccctcctgccaacacatcccatgaacgttaaagggaaagcaaaggtgaccgaaggagaagacgtcaaggcgatccccacaccagatgaggttgttttgacggaggaatttgccgagggaagagagagccgcggcaagaaaaaggttttgaatgaagctcgcgtagcccaagacatctccatagatggctttgtggggatcgtcaataacatcatagccaacaattacctcaccttcgctgaagaggaaatccccgcctag

SEQ ID NO: 6419 - DNA, 198 bp, Glycine max
  Peptide Sequence Number=SeqID_123197
gcccgtgaccgacaagtcatcacgcgtccggctcaagacgttaaagaagcgctactaggaggcaacctagaagtggctatgaagaagctccctgcgaagcggtctaggaagggcaccatcgaagaggattccaatgtggccccacaagccgacacaggctttaaaaaataccaattccagagcgtggaacatcaatag

SEQ ID NO: 6420 - DNA, 492 bp, Glycine max
  Peptide Sequence Number=SeqID_123198
atgcttctcataagggtgaagccttgggtactagtaccgtcaccttcggaggactacatgtcctcccctccagaggactacatgtcctcgcctttagaggactatgcgtcctcgccttcagaggactacacgtcctccctttcagaggactgcacgtcctcaccttcaaagggctgcacgccctcgccttcaaagggcgacacgtcctcaactttagagggctgcacgccctcgcctttagagggctacgcatcctcattttcagtgtgcttcatatccgcaccttcagagaactcaagggccagtagtttccttttatcagttcctgggccaccccctaatattgaaaggcgaccaactatgcaagcacaaccagagagggaggctatcacgcagctactatgcataccagggcaagatttcacccgtgccgctgcaaagagacgagtgtgggttatgcgcaccaacatgaccactcttacacagatataa

SEQ ID NO: 6421 - DNA, 276 bp, Glycine max
  Peptide Sequence Number=SeqID_123199
atgggtgagaaggaagagaaaaaaagaagaaattcaagtcctatatgcttccgattgcttctggaggaagtaacccagcttgcctgggcgagttgggcggcaacctcatccccctggctatgcatttcagctgtttttggtgaaaaaaattatttccgtgaagaaaattcaagccaaggtgcttccgtaacgctttcgagacgtttgcgtgagggaatcggtgaaggttttccgtcgttcttcaccgttcttcatccgttcttcgttcttcaacgg

SEQ ID NO: 6422 - DNA, 480 bp, Glycine max
  Peptide Sequence Number=SeqID_123200
atgatcctagattttaagagaggtgaggactatattgaggttctttgtggcgctacaaacaaaaaatatggagattatgttgggaggctaaaaattaataacgaaggtcaatatttcatcacttgtgagtgttgccctgagtgtcccttggtgaatgtcactctagaagcctttgagaaacatgctttaagggatgggagtggaaggtggaagagaaacatctgggttcattgtgaagacgaagacaaaattccactctggaagacacctctgataaaggatgagttcctgcgttgcacgagatgcgggaaggagcacaggttccatctcaagagtagaccagacattaagaagtaccatgatgctttaaacaacaaatgttggacttgttctctttggccttatcaaaattggtacttagtcttgcaaaacacattatatgctggaaaaagatactggggactcacgatgtgtcaataa

SEQ ID NO: 6423 - DNA, 252 bp, Glycine max
  Peptide Sequence Number=SeqID_123201
atggtagccacaacctaccaaacatcccatgagtgttcagaagaaacaattattgatatcctagtggcaggattttccggacaattaaaaggttggtgggataattatctcactaatgatgaaaaaactttagcagattttagatggtatagagataccttcctaactagagtctaccccagagaagatagtcaacaacctttctggaaagaaaaatgtctagccagacttccaagatcattaggagataag

SEQ ID NO: 6424 - DNA, 153 bp, Glycine max
  Peptide Sequence Number=SeqID_123202
atgaagttaattaggcaagctttgaaaagtgctatttttcaccttctcgctaagccagcagattggcttagcgagcttccgctaagcgcaaggaagactctggaagaagatgagttctacaagttcgctaagcgcacggcttcatctaactaa

SEQ ID NO: 6425 - DNA, 507 bp, Glycine max
  Peptide Sequence Number=SeqID_123203
atgaaaaagtcaagggtccttaattactgcaaatgcaatccttttatcagaaaacttggtgggaaccgtaaaagaagtaattttcaaaacaaaaattggattcagcacaagcaactcagccccaaattttcaaataaaatcaagacaccacacacaaaaaggatttgcaggagctttcggcctgacccatcactagattatggccatcttccatcattgttcgcatcaacgagcggagttcgtggcgactggcgagagattgtcttacagcggcacagatcgaccttgtttggaagccaaatcctctctctctcgctcgctcaaatcttctctctctcgcacatacatcaaatgggtagaggggagaaagggaattggttgacgagtcacttccctccacggcggtggcaacctcaagcgcacaccctggcgttcctcgaccgcgccgacatctccattctaggtttgggtatgaatcttgcgacgacgctggcggccgagtgttag

SEQ ID NO: 6426 - DNA, 162 bp, Glycine max
  Peptide Sequence Number=SeqID_123204
atggtggacagaggtgttacatcgagtgaggctctactaaggcatgacaaatggcttcagaagaagggaataaagaattccaactttgctgtggttacatggtccaactggaataaagaattctacctaaagtgcttcttcttggaacatactgaacaataa

SEQ ID NO: 6427 - DNA, 210 bp, Glycine max
  Peptide Sequence Number=SeqID_123205
atgggtaatcctagcatgggaggctcaaagagaaggctttcaagcagagggcttggaggagcccttaggcagcaaagggcaaggctttacataattagaaggattgatttgcaattaataagttttgtttatctattgtcaaaactctctgactcgtctttcaactacaacaaccaaagcctttctcaccaggcagggatacttgcatga

SEQ ID NO: 6428 - DNA, 1188 bp, Glycine max
  Peptide Sequence Number=SeqID_123206
atgccacaaaatattgctcctcctaatgtgtactccacttcaagatccatggggaacaataaggacgtcaacatgggtttcaatctcacgtggatcttccaagttgatccgggttccatgtaccttacaaggttgcatttttgtgactatttctattccaaagtgaatgaaattgttttcaaaatcttcatcaacaatcaaacggcggaggctgaagctgatgtgattgggtggacaggaggtaaaggcgtgccaacttatacagattatgtgatatatgtgaaagatgaggcaggtgatgatcaactctggcttgctttgcaccctgcacttgaaacaaagccagaattttatgattcattgctcaatggggtggaggtgttcaagctcaacgacacagacttatctggtcccaatcctcgaccttctgagatgaattcacacaccgcaggcaccaaaacctctgggtcagggaagagtgttggtagtgccaacatatcagccatggctcaaggattgtgccgttatttctccttacaagagatgaaacaagcgaccaagaattttgatgagtcaaatgtgataggggtaggagggtttggaaaggtttacaagggtgttattgataatgggttcaaagtggctatcaaaagatcgaatccgcaatcagaacaaggagtaaacgagttccagactgagattgagatgctgtacaagttgagacacaagcatttggtgtccttgattggtttttgcgaggagggtaatgagatgtgtctggtttatgactacatggcacatgacaccttgagggagcacctttacaaaggaaacaagccattggacacactatcttggaagcaaaggttggagatctgcataggagctgcaagaggccttcactaccttcacacgggtgcaaagtacaccatcattcatagagatgtcaaaacaaccaacattctccttgatgaaaattgggttgccaaggtttcagattttggactttccaaaacgggcccaaacatgaaccaaggtcatgttagtacacccttgaaaggtagctttggatacttggatcctgaatatttcaggaggcatcaattgaccgagaaatcaaatgtgtactcatttggggttgttttatttgaggcactttatttgaggaaggtagctttggatacttga

SEQ ID NO: 6429 - DNA, 678 bp, Glycine max
  Peptide Sequence Number=SeqID_123207
atgtcacttgaagtgaaaatgccaacagtaaataaccatttgccatctttattggaacttaatgagaatgaggaagaaaaggttccttacacacccacttctttagagagtctacatcagctacacaagaaactacttctccttgagaggaaagaatcaggaacagaagagtcattggatggaagtgtgataagtgatatagaaggtggtgaggtaacaattgataagttaaaatcagcattgaaatctgaaaggaaagccttaagtactctatatgcagaacttgaagaagagagaagtgcatctgctatagcagccaatcaaacaatggcaatgataaataggcttcaagaagagaaagcagcaatgcagatggaagccttgcagtatcaaagaatgatggaagaacaatctaagtatgatcatgaggctttgcaactcttgaatgagctcatgatgaagagggagaaagagaagctagagctagaaaaggagcttgaagtatatagaaagaaggttcatgaaaagatgatgatgtcaagaagagatggtagcatgagaagcagaacttcatctccctcttgtagcaatgctgaagatagtgatggattgtccattgacttgaatcacgaagcaaaggaggaaaacaggttttatagtcatcaagatcaagaatga

SEQ ID NO: 6430 - DNA, 276 bp, Glycine max
  Peptide Sequence Number=SeqID_123208
atgtctaacacagacgcgctaagcatatgggtctttaaaactcaaacgtcatatggactcgctaagcgcggcttgcctgcatctgcttccttttcacaactagtttcaacaatccaattaactgttgaactcgctaagtgcaactgtgcgctaagcgagtgctgtctatcagacacttcaaatttcttggagttgggcttagcgagtctgctcgctaagcctgtgttgtccagtagagtagtcgcgctaaacgcgccttgcaacgctaagagctaa

SEQ ID NO: 6431 - DNA, 387 bp, Glycine max
  Peptide Sequence Number=SeqID_123209
atgcgggggtaccttatggttatccgcatcttttgtcaaccagaggcaagcgagcccgttgacacgcagagactaacgtcgtcatctgcacctttgtcatccagagatagcgagtccgatgacatgcagggagatgacgagtctgatgacatgcgggggtaccttatggttatccgcatcttttgtcaaccagaggcaagcgagcccattgacacgcagagactaacatcgtcatctacacctttgtcatccagagacggcgagtccgatgacatgcgggggtaccttaaggttatctgcaccttttgtcaaccagaggcaagcgagcccgttgacacgcggagactaacatcgtcttctgcaccctttgtcaatcgtggccaatga

SEQ ID NO: 6432 - DNA, 386 bp, Glycine max
  Peptide Sequence Number=SeqID_123210
atgggtgtcaagtacctcgaagtggtcaagcgaaggtcgtatcccaccaaacagatgggaagtaaagataagacactaatttcgttcgagtggaacatcattcggccagtcaatatccccaccagcggaacctggattgcacccataagacacccagtggacccggaggagcccaacagggccctggggtttccagctctggttacaggcctctgtcagtcctacagggtgcccgtccccccagcaaggtcatgccatcgtgacatagaattccaacaaggtcctggggtttccagctctgattacgagccttttcagttctacgaagtgcccgttgccaccagtaaggtcatcaggccccctactaaccgagctttcatcaagaa

SEQ ID NO: 6433 - DNA, 372 bp, Glycine max
  Peptide Sequence Number=SeqID_123211
atgggtggtggtgcatggccgttcttagttggtggagcgatttgtctgatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttcgtgcgccaaggaactcaaatctgttaa

SEQ ID NO: 6434 - DNA, 189 bp, Glycine max
  Peptide Sequence Number=SeqID_123212
atggctatggtgttctgcttgttgaaggagatggtgtctagggaagaagaaaggtggagatggtgtctagggaagaagaaagggaagcaatctaatatcaaaatctcacatttgaaaatcaggggactcaattttatgattgaaaagcaagaaatgaaaattgccgattttgtacctaaggaggattaa

SEQ ID NO: 6435 - DNA, 770 bp, Glycine max
  Peptide Sequence Number=SeqID_123213
agtgctacacgccctcacctttagaggactacacgtcctcacctttatacggatacacgctctaaccttcagaggactacacgtccttgccttcagagtgttgcacgctctcaccttcagaggactacaggtcctcaccttcagagggctacgcaccctcaccttcagagaactaaacatcctcaccttcagagggctacacgctctttccttcagagcactacacgtcctcacctttagagggttgcacgccctaaccttcaggggactgcacgtcctcacctttagagggctacgcgccctcaccttcagaggactacacgtcctcaccatcagagaactacacgtcctcaccttcagagggcaacacgctcttaccatcagaggactacacgtcctcgccttaagaggaggactacacatcctcaccttcaaagggctacacgttgtaaccatcagagaactacaagttcacgccttcagagggttgcacgccctcaccttcagaggactgcacgtccacacctttagaggtctacgcgccctcaccttcagagggctacacgctcttagcttaagaggactacaagtcctcgcctttagagggttacacaccctcaccttcagaggactgcaggtcctcacctttagagggctacgcaccctcaccttcagaggactacacgtccacaccttcagaggtctacgcgccctcaccttcagagggctacacgcactcacctttagaggacgacacgtcctcaccttga

SEQ ID NO: 6436 - DNA, 1525 bp, Glycine max
  Peptide Sequence Number=SeqID_123214
atggtagaagaatttgaagagatcctagggtgtcctctaggggggaggaaaccatacctcttcacaaggttctatccctcattagctagaatttccaagatagtccaaatcttggtgcaggaattagaccacaggaagcaagtcgaaaatggggtggttggaataccgagaaaatatttggaggcaaaagcaagaatcttggcaggtaaaggcgagtgggccccgttcatagatattctcgcactgttgattttcggaggagtcctctttccgaatgtggatgggttggtggacctggcagcgatcgacgtttttctcacctatcataaccacaaggaaagcccggttgtcgctatgctagccgacctatatgacaccttcgaccgaagatgtgaagagagcaatgcaaggattgtttgttgtactccagctctttatgtatggttagtttcacacctttttcgccaagaggtgaggcatgcttgcccgctagaaagtcatcgttcatgcacagagaaaggaggggcaaattgggaccaactcttagcaagcaaagaagaagcatctgtcaactggttccctcgatggaaggaaggaagaaccggagttcttatttcatgcggaggatttccaaatgttcccttgatggtgatgaggggttgcatcagctacaatcccattcttgcaataagacaacttggctaccctatgagaggggcgccactagaggatgggctcgcgcctaaggtccgcaaggcatggggggtggtacaaaagaaagacaaagagctcataggtagtgggcccattggtggctaccgtgagtggttgaaagcccacgtgcaatgtttggattggctcccaagtttgagaaccgctaaaagggaggaagttgaggcaccggaggaagacgaagaggtgcaggctcttaggacaaaactcgagcaagctcaaacagtcaaagaaaggttcaaatcagtggctcttaggatccggaaggagaatgccgaactaagggatgtaaatatagctaccaccaaggcattggaacaaaagaccaagagggctcgtagggaagagcacggccagaacaagttccgaggggctctatggggtagtaataacgagcttaaactctggagggaggaaagggaccaatcgcgagtagacagtttgatcttgaaagatgaattgaaggcttgctcgaggtccaaaagaagtttgtctcagcggttatgcgagacagagaccaacatgttagctatcatcaccaagtaccaagaggaactaagtctagccacggcccacgagcatagagtggcggacgagtatgcccaagtgtacgcggaaaaggaggctagaggaagggtgatcgactcgttacatcaagaggcaacaatgtggatggaccgatttgctcttactttgaacggaagccaagaactttcccgattgctagccaaggccaaagcagtggcgaacacctactctacccccgaagagatccacgaacttctcagctatt

SEQ ID NO: 6437 - DNA, 757 bp, Glycine max
  Peptide Sequence Number=SeqID_123215
atggatatccaagccgcatacagttgccttttgggtaggccatggatccatgaagctggggccgtgacatccaccttgcatcaaaagctgaagtttgtcagaaatgggaaattgatcactgtgagtggagaggaagccttgttggttagtcatttgtcagctttttcctttattggtgctgatgaaacagaaggaacctctttccaaggcctgactttagagggtaaaaagccggagaaaaatgaagtatcttttgctacttggaagagcgcacagaaagtggtgcaggaaggaacaggtgtaggatggggaaaagttgtgcagttgttagagagtaaaaaccgcgaaggactgggatttgcttcttctgcaggatccgcaacgaacagtgttggatcaagctccattactagcacctttttactaggcatttatgagcccgttgaacataataaccctgcactctctcccaactacgaatctcctgtctacgaggctgaagaggaggaggatgatgaaatcccgaaggaacttgctcggttattggaatatgaaaagaaaaccattcggcctcatgaggaggtagtagaggtgattaacttgggaaccgaggaagataagaaggaagtcaagattggggcatcgcttgaggcaactgtcaaacgaagggtgattgaattactcaaagaatacgtcgatgtgttcgcatggtcgtaccaagatatgcccggcttggatccccgtattgtggagcacc

SEQ ID NO: 6438 - DNA, 189 bp, Glycine max
  Peptide Sequence Number=SeqID_123216
atggagaattggcgaacagtgctaggcaatgacattcgcggggctccagactcgaagcgcttggcaatgtcattcatggggctccgaaaaaaagtggagaatggagaattggcgaatagagctaggcaatcacattcgcggggctccagactcgaaggtggaggacacatgaacagcgctaggcaatga

SEQ ID NO: 6439 - DNA, 393 bp, Glycine max
  Peptide Sequence Number=SeqID_123217
atgtttaaacatatctgtactgcagctgtggatgattgtacggtttccttgagccccagtctatacgctgcacaaaggacacgcgtgaagaatgatgttcacattaagtttgcagtgaacaatgcaatgaagaaaatatgcagtaatctccaaggcaaggacaatgcacctccacctccacctcaatggattgaggctaagagccatgtacaacaaggagcatatgagtgtggatattatgtgatgcattggatgtggtgcatcgttagtggcggtttgaaaaatgaactccacaactatttttctgatggaacagcattagacactgacaccatgacgacactacgcaagaaatgggcagcctattttctagaagttggaaaatggatgtaa

SEQ ID NO: 6440 - DNA, 237 bp, Glycine max
  Peptide Sequence Number=SeqID_123218
atgtcgcagaacttcacggattgcctaacgatgggtgttaagtacctcgaagcggtcaagcgagggtcgcatgctatcaaacaatggtccccagatgaaattgggaacgtcattcggccggtcaatatccctaccagcggaacctcggccattgcactcgatcatccctggatgacaaaaggtgcaggagacgatgttagtctcctcgtgctatcatgcgttgagtcttacagatag

SEQ ID NO: 6441 - DNA, 1626 bp, Glycine max
  Peptide Sequence Number=SeqID_123219
atgggattgggagcagcagccttccctagacctctccctttttccctcaagaaattgactttagagaggctgccaaaactggagaatatctggaatgaagatcctcatggaattctaagcgtgcaacatctacaacttgttattgttgagaaatgtaaatgccttacaagtgtgtttccggcatcagtagccaaagatcttgaaaaactagttgtcaaagactgtgagggattgatggaaattgttgcagaggataatgcagatccaagaggagcaaatctagaccttatgttcccgtgtccctgtgtgaggtcattgaaactacaaggtttgcccaagttcaagtatttttactactgctcactgcagtgtgacatgttccagacacctaccgaggatggaaagcttacatccaacttgcaatgcctgtcactgggtgaaaaaggactggagatgatcaagcgtggagaatttcagagaaacttcttgcacaagctacaagttcttactgtgggctttcatatagggtccgatgaatttccatatgaaattctacaactggcgcccaatatagagaagcttgtggtgtgtgatggttccttcaaggagattttctgctttgatagtcttaatgtggatgaggctggactcctattacagctcaaagtcttatgcttggactcccttccagagcttgtttccattgggttagagaactcttggattcagcccttactgggaaatctagaaaccttggaagtaataggttgttctagtctaaaagacttggtaccatctacagtgtctttctccaatctgacatatttgcaagtagaaagatgcaacaacctgcgtcatttgttcgcatcctcaacagcaagaagtttgggtcaactcaaaagaatggagataaaaaggtgtgattcaattgaagagatagtctctaaggagggggatgaatcacatgagaatgaaataatatttccgcaactcaattgtttgaaacttgaagaattacgaaagctgagaagcttctataaaggaagtttattaagtttcccatcattggaggaattgtcagtaatggagtgcgcgtggatggaaacattatgtcctggtaccctaaaagcagacaagttggttcaacttcaacttgacaggtacttatatgaacgtgaggagtcatcagatgctatcaaattggaaaatgacctgaactctaccatgcgggaggcatttagggaaaagttggccatcatttgggcaatttcctttggaacggaaccaccttattcttcgcagagcgcttcacggagtcccgaactggcactgacaacggattcgtgtcacttctctaaccccacgcaacaaccacctcttttccgccgagacttcggcgaggaaggtcaaagccgccgaagttccgaggaaatgcaaggtggaagggcgacacgaaacgacaaacctccagttgtggtcgagagtgaccaagaaggaggagcacacgacggtgagacggcaatggtgacggcatggggatggcggagcgaactgggggggaaggtgttgacagagaaccccacgatcttgttccttagcctcttcgatggtcatgggcacttctag

SEQ ID NO: 6442 - DNA, 4434 bp, Glycine max
  Peptide Sequence Number=SeqID_123220
atgacagaggatgtcaagaacttaatagatgagtgctccaagtttaaagaagttgcctacagggagaacataacatctaatgatgtcactttgtctaatgctggctatgtagaatttggttctagaaaatctatattggaaggcgtaatggcgcaacttgaagattccactgtcagaatgattggactgcatgggcctggtggtgtgggtaagagcactttaatcaaagacattgcgaagaaatctctagacaagaagctgtttgatgtggtagttaaactagaaataacagccaatcccaatctacaaaaaatccaggaagaaattgcttacgtgttaggattgagattggaaggggaaggtgagaatgtgagagctgattgtctacgaaggaggttaaagcaagagaaggagagcatccttgtaatcttggatgacctttgggacagattagacttgaataagttgggggttccacttgatggtgatgttgatcataatgatttaagcaagaagacacttgatggtgatgttgatcataatgatttaagcaagaagacaagcaaggctaaaatgggtcccaaagaggcgaataaagaaaaatctcttggtgattgtaagggctgcaaaattttgctaacttcaagggataaaaacgtattaaccgataaaatggaagttaagtcaactttctgtgtagaggaattagatgacgatgatgctctgagattgtttcagaaggaggctagaatacagggtgaaatgtccaagtggaaacaagaaattgttaagaagtactgtgcagggttacctatggcaatagttacagttggaagggcattaagagacaagagcgactcagagtgggaaaaacttaaaaatcaagacctggtgggagttcagaattctatggagatttctgtaaaaatgagttatgaccgtctagaaaatgaggagctcaagtccattttctttctttgtgctcaaatgggtcatcaacccctaattatggacttggtgaagtattgctttggtttgggaatacttgagggggtctactcacttggggaagctcggagcagaatatctacattaatccaaaagctgaaaaactcaggtttggtgttggatggaagttctagtattcatttcaatatgcatgatctggttcgagatgctgctttatctatagcacagaaggagcaaaatgtatttactttgagaaatgccaaacttgatgattggcctcaactcgagaggtgcacttctatttctatatgcaacagtgatatcattgatgagcttccagaagaaataaattgtcctcaacttaaatttttccaaattgacagcgatgatccatccttaaaaatacctgacagtttttttaaaggaatgaaaaagctcaaagtattaatgttgactggtattcaactatcaagattaccatcttcaattgaaagcctatcagacctcagattgctttgtttggagcgatgcactttagatcacaacttatccatcatagggaagctgaaaaaattaagaattctcagtttttctggatctcgaattgaaaatttgccagctaagttaaaggacttggataaactacaattactagacatcagcaattgttcaatggtcaagatgattccgcctaatcttatatcaaaattgactttgttggaagagctgtatgttagaaagagcttcatcgaagtgttggaggaaggagaaagaaaccatagtcaaatttcatttctttctgaactaaagcatttgcatcaattgcaagtggtggatttaagcattccatgtgctgaagcttttcccgatgaattgttctttgacaacttaactgattacaagattgagattgggaacttcaaaacactttcagttggagatttcaggatgcctaataagtatgaaaagttcaaatctttggcattgaagctgaaggatgacactgacaatattcactctcagaaaggaataaagttgttgtttaaaagagttgaaaatttgttgttgggagagctgaatggtgttcaagatgttattaatgagttgaatttggatggatttccatatctgaaacacttatccatcgtaaacaaccctagcatcaaatgcatcatcaactcaaaggatttgttttatccccaggatgtttttcccaagttggaatctctatgcctccacaaactaagaaagatagagatgatatactttagttcaggtacaaagatgatatttacagattgctcattcaccaacttgaaaaccatcaaggtcgagatgtgtgaccaattgaagaatcttttctcctcttgcatggttaaattgcttgtgagtcttgaaacaattggtgtttcccattgtttttctttagaagagatggttaaaatacctgacaattctgataagattgagtttcttaagttgaagtctttgtcacttcaatcattatcatcattcactagtttttataccacagtagaggggtcttccacaaacaggaatcacatacaaattactgttatagagacggagcatagtgagatggctcctcctctttttggtgaactggttgaaataccaaacttagagaacttgaatttaatctcaatgaacaagatccagaagatatggagtgaccagcccccgtcaaatttctgctttcaagacttaataaaattagttgtgaaagattgtcataatttgagatatttgtgttcattgtccgttgctagcagtttgaggaaactgaaaggcctctttgtaagcaactgtaaaatgatggaaaagatttttagcacagaaggaaatagtgcagacaaggtttgcatctttcctaagttggaggaaatccacctcgaccaaatgattgagttaacagacatatggcaagctgaagtgagtgttgattccttttctagtctcacttctgtgtacatttttcgttgcgataaactaaacaaaatttttccaagtcacatggaaggatggtttgcgagtttgaacagcttgaaggttcattattgtgagtcagtggaagtgatttttgaaatcaaagattctctgcaagtagatgcatctggtgggatagacacaaatttgcaggttgttgatgtatgcaatctcccaaagttggagcatgtgtggagcagggatccaggaggaattcttaacttcaaaaatctgcagagtatagaagtgtcttgttgtaatagactgaggaatgtatttctagcttctgtggccaaagatgttccaaagcttgaatacatgtcggtacaaagttatggaattgtggaaattgttgcctgtgaagatggatccgaaacaaacactgaacaattagtgtttcctgaactaacctacatgaccttatataacctatcaagcatccaacatttctacagggggagacatcctatagagtgtccaaaattgaagaagttggaagtaaacaaatgcaacaaggagctaaaaacattccaaacaagagaatgcagcaatgaagaagatgaagtagttttgtcagctgaaaatatattccccaacttggagtatttggatattgactttgacgaagcacaggagtggttattgagcaacactgtgaagcatcgaatgcacaatttaaaagagcttaggttgtgctatgttaatgatggtgaacgtctctgtcagattctgtacagaatgccaaatctagaaaagttatatttgtttaactctgaacatttgcttaaagagtcatcggagtcacgtttgggaaccgtaatacagctgaaagaattggttttgtggtcttcgaagataaaggatataggatttgaacgagaaccagttctacagagactagagcttttgagcttacattggtgccacaaattgaggaatttggctcctccctcggtatcattggcttacttgacaaatttggaagtaaggaattgtggtagattaaggaatttaatggcatcctcaacggcaaaaagcttggttcaacttaagtccatgaagataagcgaatgcgatgaattagaggaaatagtaagcaatgagggaaatgaagaagaagagcaaatagtgtttggcaaattgattactatagaacttgagtacctactgaatctgaaaagtttttgcagttacaataactgtgaattcaaattcccgtcattggaaatattgattgtgagagaatgccgaatgatgcaaacattcacggagggtggtgcaagagcaccaaagttacaaaatataggtggtggtgttgaaaaaggtaaagaggaagccatgtggcagtgggaaggagacttgaatgccaccatacaaaaaggtttctaccaggagttaggaagaaggatttcaaggaaaaaggatgaaagaggttttgagttagaatactatcactaa

SEQ ID NO: 6443 - DNA, 318 bp, Glycine max
  Peptide Sequence Number=SeqID_123221
atgtgtgtggactaccgacaactcaacaaagtgacgatcaagaacaagtatccgttaccgaggattgatgacctcacggatcaactaagaggcccacttgggccttccagattcttcctccagaaggcgattgcttctagaggaagcaacctggctcgcctaggcgagctgggtggcaagctgggtggcaagctcctcccctattttgctataaatagagggagaagtgaagaaggaaagggttcagccttcttggcactttgtattcacttgaaattgctgagaaaaattgtttccgtgaagaaaattcaagccgag

SEQ ID NO: 6444 - DNA, 468 bp, Glycine max
  Peptide Sequence Number=SeqID_123222
atgccaatctccccttgtagatgtatcagttgggatcgcacccacaagatacccagtggacccaaagacgtccaacagggccctgggatttccagctctggttacgggcctctgttagtcctacagggtgcccgttcctccagcaagggatcgcacccacaagacacccagtggagccgaagacgtccaatagggccctggggtttccagctctggttacgggcctctatcagtcctacagggtgcccgttcccccagcaaggaatcgcacccacaaagacacccagtggacccggagaagtccaacagggccctggggtttccagctctgggatcgtgcccgcaagacacctagtggacccgaagaagtccaacagggtcttggagttgtcaagctctaattacgggtccatgtcagttctacggagtgcctgtcacctccagcaagggcatcaggcctcttactaa

SEQ ID NO: 6445 - DNA, 267 bp, Glycine max
  Peptide Sequence Number=SeqID_123223
atgcaccgcaggccgcaaacgcaccgccaccacctcatcaagctgatccagctgggtcatttggcattgagcggtatttacaacacttggttcgccagcaggcggccaaccacagggggcagggcagaggtcgaatggcccggagattggtctgaggcccaggcaggggaggcacccgcagaggctcccgacgacatggagggggcccgcatggatgaggagatgacagatttactcgatttcttgggagggagaggagccacatga

SEQ ID NO: 6446 - DNA, 282 bp, Glycine max
  Peptide Sequence Number=SeqID_123224
atgaaggcctgggtgatcggcggtcaaatcaccttactaggcgtgacgggaaccccgaatgactggcagagacccgtgataattgctggaaaccccaaggccctgttagacttatccgggtctagagggtgcctgagggaggtcggagttatgatcgctgggcaggacgttcctgagcagcaacgtcatccacatctgggtcaaggtggtcatgctggtgcgcatgatccgtacccgcctcccggcagcggtccgggaaaaatcctgacccggtatgcataa

SEQ ID NO: 6447 - DNA, 690 bp, Glycine max
  Peptide Sequence Number=SeqID_123225
atgccggacgccagaggtcatggcatgtcgagtgcgccacagcatggatacacttaccaggaccacgcaaatgatgtgattgagctgatcagaaccctcgatattaaaaatccgtatttgctgggacactcgatgggcggcatgactgcagccatggtagccagccggttagggtttgcgatcagcggcattatcctggctgacccaaccttcatcagcccggaatggcaggatcaagtttacgaaagcggcatcgtagatcaacatcggcagatgcttaaatctaccagggaagcgttgtttaaagaagctaaggcaaaacatcgtttccgttcatctgagctgcttgaacatattgttgaagcgaggctgcaaaccagtgtgaaagcgtttgatgtcctgattccgcctaacccggaatttgaggagctgattcggaatatttatgtcccaaccctgctggtattagggagtgaaggcatcgtttcgtctgaaacggcgcgtgaattgcacgagattaatccagatctgcagtacaaactcatcccggatgttgggcatggcttgccatatgatgaacctgtgcgtttggccgctgctattgatgctttcctgaaacccagattcaaaactaaacagcgcatgaaaacaccgtcaaagtattctgtttacacgacaaatgctttttaa

SEQ ID NO: 6448 - DNA, 210 bp, Glycine max
  Peptide Sequence Number=SeqID_123226
atggatgagtttaaggcacaggtggcttggccaagagctcagccttctccttctggagggggtggggcctccgcagcccaggagcctacttctaaggagccagcagcagagacccagccatctacaccagtcacggagccagagcaacctatccaggattcatcagcagctccagcattggatcagccacaagatgagcaggacatttaa

SEQ ID NO: 6449 - DNA, 216 bp, Glycine max
  Peptide Sequence Number=SeqID_123227
atggttacgaaggagtgtaaggaggcaagtgtctcctccaagagtgatcaaggggttcccacggaccctaagagaataaaggtcattcctgattggccccctccaccaagtgtcgagggaaggagcccagagtatgaagaacctcgggatttgaggtcaaatcctttccaaggtggaggggatgatgcaatcctaccccccaagggtattggataa

SEQ ID NO: 6450 - DNA, 360 bp, Glycine max
  Peptide Sequence Number=SeqID_123228
atgggtgtcattgaattgtgcgttgaagtagatgttgctagtgcttccacgttgaatgtgaaaaattcactactatcatgtgggaataatatagctgacaatgaatcaaaagttcaaagatttacaataaatttagatgatgattcttacgatgatgattacatgatatctaattcatatgttgaggactcgttggatgaggaggaagatatcgatgatatatctgacacagatgaaaaattaacattaattggagtcatccggatgaagaagacatttgtggtttcgatatgggatcaaccttcaatattggccaagaattatttgttggcatggaatttgaaagcaaaaattcagtaa

SEQ ID NO: 6451 - DNA, 111 bp, Glycine max
  Peptide Sequence Number=SeqID_123229
ctctacgaaggtccatctacagagcaggtggagaaggtcggcgggcttcatccaagtccctatcggaggttccataaggctgtggcaataggaggttggagcgatgcatga

SEQ ID NO: 6452 - DNA, 276 bp, Glycine max
  Peptide Sequence Number=SeqID_123230
acttatcaaggtaatccttgtggcgtctaccctgacttatcttccttcactggaagtggcatcatccaaatccccgtagcctgtatcaaacgatctgctcctagtcaggcaatcaattcatggggctccggacctgatggtggaggatgcatgaacaacgctaggcaatcaattcgtggggcttcggacttgatgatggaggatgcacgaacagcgctaagcaatcaattcatggggctccggactcaatggtggaggatgaatgaacagtgctag

SEQ ID NO: 6453 - DNA, 666 bp, Glycine max
  Peptide Sequence Number=SeqID_123231
atggctgatcatcagaaaaccgctcctggcgagagagacatcgagcaggcaattatatctcttaagaaaggctcatatctgctgaagtacgggcaaagagggaagccaaagttctgtccatttaggctttccaacgatgagtctctactcttatggtactctggcaaggacgagaaacagcttaagctcagtacagtttcaaggatcattcctgggcagcgaactgcaacatttcagcggtatccacggcctgaaaaggaatatcagtcattttctcttatatacaatgataggtccttggatttgatatgcaaggataaagatgacgctgaaatctggtttcctggtcttaaggcaatagttactcgaggtaacaaccgcaagtggagatttgaatcaagaactgacgatagtctgtattctgatagtccaaaatctggcacacgaagatccactccgtccattgcaccattctctgaccctggggatgctggtggaggttttattgacttgcaaaatagatggataaaggctttctctgaaataatttcttactctgcagctagcaagagttccagtcaagctgaatcacttgcaaattcctctttatcctctgggtctgtggataactcaagcaatcgaaattctgcatctgaggcatttcga

SEQ ID NO: 6454 - DNA, 441 bp, Glycine max
  Peptide Sequence Number=SeqID_123232
atggtggaaagactgccagaaggacataatactgactccagtacagagccctttgctgaaaacactagtagcattctacataattccttagatgagagccatataagaaacaccgtcattcccaaaaatgaaggcagcagcattgtaacaaatctgatattagctaatggtaccaaaacacaaagtggaaaggcagagtgggtagtgcaagatgaaccaggtgtgtatgtaagtttgtcctcacagccaggtggtggtaatgagcttaagcgtgtccgcttcagatttcatgcacactttactgaaattctcagttgtttttacagtcgaaggcatttcacagaagagcaagctgaaaaatggtgggctgaaaatggaaccaaaatattggagcggcacaatatagttgctttattgaatgcaagagaatctgttccctga

SEQ ID NO: 6455 - DNA, 264 bp, Glycine max
  Peptide Sequence Number=SeqID_123233
atgataccgacacaggcaggtgaccagccgatagatggaccagccgcagaccctgaggagtacatacagccgtccaacccccaggatgattacgacggatatgaggtgattacacaaaggttggagcgtgtgctcaaccttagaatggttactgtgggcacagagtattatgagattatgcaggactgtctgacgatcgctagagggggagccaatgctgatggaagtgtcagggctcgtcagagacgccgcacggaacattga

SEQ ID NO: 6456 - DNA, 204 bp, Glycine max
  Peptide Sequence Number=SeqID_123234
atgctggatattacaagcaaaggggagttagggagactaacctcgttcgcggagaagaagaagaacaagctttgcgcttggcttgcggagaagaagaagcagttcgcggagaaagagaagaagcttcacggaatagcaggaaggcaaaatggtccattcataaaaattgctgggtgcaccagcaatattgctgggtgcacctag

SEQ ID NO: 6457 - DNA, 579 bp, Glycine max
  Peptide Sequence Number=SeqID_123235
atggcagaaacctgcgactccaacaataaagtgatccgtgaataccatcatgatgcttcctttatgtcaaggtgtgacatctttactgatgttaccgagtaccaaccgtgtctggcatatgccggagaatctggtaaaggaaacttcgaacctaagtgggacacagacaatgtcactccccaccttatcgagcagttcaagctaaattgtgctgcctcgaatctgccagtcaaagtgtttgtcagcatcggaggagatgaccccttcaaagttgctgctggtggtgccgatgattgggttctcaatgccacaaccacactccaccacatgatcaacgagtaccacatcgatggaatcgatgttaactacaccacaatcctgtgcaaccaaaaattgtttgttaactgctttaaggatctcataaggggtctaagggaagctctatgcaccactgggtttgtggcttccttagctccagatgctgccacttatgttgtgtttcagtgcttcgttgattttgaacctcgagatcctaacagaccagttaaaagcttggtgcagcatacttaccaaaactaa

SEQ ID NO: 6458 - DNA, 216 bp, Glycine max
  Peptide Sequence Number=SeqID_123236
gacaatctaacgacggtgctgaaggttacgagactttgcccatggaagagtagggatatgctactaaagaataaagagaaggtagaaaaacacattaaagttgcaatttttatctcaaaaacttcatgggttcagagaaggtggaaaaacacattaaagttgcgatttttatctcaaaaacttcatgggttcaggtttgaaggcacaaaagcttaa

SEQ ID NO: 6459 - DNA, 1080 bp, Glycine max
  Peptide Sequence Number=SeqID_123237
gtgctccagtggcttctgtttctatcagctgtccctcctgttcagctactgacggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggaattcgatactggatgcaatgctttcctatcccgaagtatgttgttcacaaaattgaagctatttgcagatctttcctctggacaggagggcaagagctaaagagaaaaagtccagttgcttgggactctgtgtgtaaaccgaaggattatggagggttaaacatcattgacctttcggtttggaataaggtaactatgctgaaactcctttggaatcttagtggcaaatctgatagtctttgggtgaagtgggtaaatgcctactacttgaataaggacacactgatgaatgtgagtgtaaagattcacaactcttggattatgaaaagtatcctgaagcatcgtagtagcattttggatatccaatctatatgggacagcatgctagagaaaaatcgatttggtatgaaggaggtttataaaagtctttgcaccaacacttcaaaagtgcgctggcgtaatctgtttcgggggaatacagcgaggcctagagctctgatgactctatggcttgcttgtcatgggcggttagccaccaaaaaccgtctgaaaaaatttggtatgattgaagatagtaagtgttgcttttgtcctgctgaagaatctattaatcacttgttttatggctgcccggagcttaaaattatttggactaaagttcttgattgggttcaaattaagagagtaccgcgtgagtggaatgatgagttagagtggttaatttcatccacaaaagggaagggaaagagacatgcaattttgaaactagccgctgctgaaactttatatggaatctggagataccgtaacgataagagtttcggtaatactgttgataatacaaaaatagcggataatattatagatatgatagtttacagag

SEQ ID NO: 6460 - DNA, 756 bp, Glycine max
  Peptide Sequence Number=SeqID_123238
atgctgctaaaactaggcataaccatatcagaagctgtggaggttgctgctaaaaatgcttatagcaagtactgcttacacaatcatattctactccaccatagtgttataggagaagaatggatcaaacaaatggaagctattggggaaaccccagatgtcattaaaggatgtactggtggtggctccaacttcgcagggcttagtttcccgttccttcgagagaagctcaataagaaaatcaatcctgttataagagcagttgaacctgcagcatgtccttcattaacaaaaggggtatatacttatgattatggtgatactgcaggaatgactccattgataaaaatgcacacacttggacacgactttgttccggatccaattcatgctgggggtttgcgttaccacggtatggcaccattgatctcacatgtttttgacttgggtttaatggaagcaattgcaattccacaaacagaatgcttaggggctatacagtttgccaggtctgaagggttgataccagcttctgaaccaactcatgccatagctgcaaccattagagaagctattcgatgtagagaaaccggagaggccaaggttattctgacagcaatgtgtggacatggccattttgatctgccagcttatgaaaagtacttgcaaggtaacatggttgacctctcattctcagaagacaagatgaaagcttcactggccaatattcctcaagtgactgcttacctgagttga

SEQ ID NO: 6461 - DNA, 300 bp, Glycine max
  Peptide Sequence Number=SeqID_123239
atgcagaaacaagaactagatgctcaaacactgcaaatggaacaaaaactagagacaaggaaaaagggcaatagtttatggcgtcatggtatttggattccggatatttcttataaaacttcttcacataaacatcctcttgaaagaactgttaatggagagaccccaaaacaaagacaacaaaccgtcgagattacatctgccaaaaaggcattaaacaaagaggaaggaacaaactcaaagatcttaagatgtccttctagagagtggccaaactggggcagattgtctgcaacttga

SEQ ID NO: 6462 - DNA, 1221 bp, Glycine max
  Peptide Sequence Number=SeqID_123240
atgtatgtaactaggcctttgtcaatgtacagaagatctccaagtactctatcaatgccaccaccagatggtccttattcaggttatcttgtgatcacagatgaggaagcagaagcagaagacacgtgttgttggcgtctatgcaggcgtaagaaggttaagaaactacctttccctcaggacaaaatcttctctgtcactcatgcatcagagtatgaacaaacttcaagcaccaaggtttggtttctccctgtgcctgatcaccctctagcttccaaccgctactacgtcatcagagccaaaggcagacagaaggggaaagcatacaaatgctcaagagaggcggacattgtcacatgctgcttcacagacatcttgaatgaccaaagaccaaagcctttcaatctgaaagacttgtaccaaattttcaagattcatagtcaccaaagtggtggattttttgctaggtccattactcctgatggcattcctccctcattcctaagaaaaaaaggatggagaattagaacatcaggctcatatagatcttgcaagctaagtgaagctcttggtgttgatgcccctcttagggagaagcttccagatttcaactttccaatctctagaaaacgttcacctcctgtgacagtaggaagatggtactgtccattcatatttgtgagggacaatggaacaagagtcaaacaccaaatgaagaagtccatgtactacagcatgacacttgagcaaaggtgggaagaggtttacacttgtggtaatgatcatcatcatgagaagagtgatgaaggggatgataatggtggtggtggtggtggtggtgtggttattgtgaatgtgtgtgtggagagagaggtggttttggtgtctggcatggaagccacaaggaatggaagcactgatgccaatggtttcttttggtatagagcatatgatgcatataataagagaagggcaaatgtggggttgagttcagcaattgttgagcacatgagatgggtgcaagaggctggaggatgggcttatggtcatggaagagagagggtggtgagagtgagggaagaggcaagatgccagagtgaatggctaaggtttgggtgttatgtgttggtggaaagtttctgtttgaggacacttgatgggaagttagtgttgagatatgactttaggcacacacacaaggtcaaatgcaaatgggagtag

SEQ ID NO: 6463 - DNA, 774 bp, Glycine max
  Peptide Sequence Number=SeqID_123241
atgcaaggtagctttgttccccatggtcgtgacgacatattaaatactgctattgggcgaccaaagcatccaggtcgtgttcatgcagtagggactggtgtcacaatcagtcaatattttggacaagtgtcacgtgggtccaacacttcctctgcatcaatcagccaacaaaaattggttgacataatcggaaagctgaaggaagagttgaggagagaagttgaaaaggaaaacaaaaatctgaaggaagagtggaggagacaagtagaagaagaaaacatacaaagtttggagaaaatgaaacaagagttgaaggagacaataaaaattgacttatcccaaatggtgtcgcaccactcacccctgttgagcaccaaggggagttgttttgaagacgttgccaatccatcaggggaaaatgcaggtttaattatgccacctactatggggttgtatgttgaaggaaaagtatatgacagggcgtccaccatatgcaacgtgccttatgcaaatgatgtggtgaaggtgagtgttgtagaagtttacaacggtgacgctcaaaagtctgttgaattgttgtgggatgtgactaaatttgggatttcagatgtcgaagcatccttcttcataacacattctaatttgtggaagatgtttatggatgagtggagtacgacgttgggtcatggttcggtgtatggattccttgagcctcaattcatacacaatgcaaaagatagacatgaagaatgtcaacattacattgaaacatag

SEQ ID NO: 6464 - DNA, 1152 bp, Glycine max
  Peptide Sequence Number=SeqID_123242
atgaagacattaaagacaagttccactgataaatctgatcactctgcaccacactggattgaagtcaagtggtttggtggtggaataccattagacattaaggccataacaacaattcgcaaaaaatgggcatgtcatgtcgtttgttcaaacttgcaattactttcttttgtgaaggatcaacaacaggctgcattattttctccagagcatataaaagagtcgaagttcccttttacaaatgataaaattccaagtccaactccttcgagtgactgtgaggatgagattgttgatacaaacgaggaggtctctagtgcttctactggtgattttttaacaagcactaagccaactcttttggatcagccacctgtttctgctacttccatggataggtccaacttccatggattcattagttctagagttgatgcagtaggtcctgggtctttgccagtgaaaagctctgcaaagaatagagctcctaggcttcatttcactaattctgatgcaagtgctgtggataacccatctacattgatacataatatgcctaaagtggaatatgtcggaacaacaatctcgaggaaacaaaaggctgctgaagaaccttctttggatgtttctgtatcacaaagacaaaaaagttcattggaaaatactgagcataatatgaatgaagtaagaactggaagtggtggttggttggaagagaatactgggcctggagctcagtttacagagaggaatcatttaatggacaaatttggacccgaacccaaaaagactttgaatacagtcagtagttcctgtactagttctgataatttaaatgcaacaagcattagaaatgagcaagcaccaattacaagtggtaatgtgctagcttccttacctgctctattgaatggtgcagttgtaaatccaatcatgttggttaacttacttagaatagcagaagcccagcagaaatctactgattctacttcaaatatgatgctgcatccaacaagctcaaattcggctatgggaacagactcaactgcgagtattggttcatcaatggccactggtcttcttcaaagttttgttggaatggttccagtttcatcacaatcaacttccacggtaaaatgttgtttgtcttaa

SEQ ID NO: 6465 - DNA, 483 bp, Glycine max
  Peptide Sequence Number=SeqID_123243
atgggatttactttagtagaccttcaaaaggtggcttacaaggacaagcatttcatcatggcagaacaagttagacaggtgttttacatccaagatccttgtaactcaagatggtcagtggttctacaaggaagaactggtgaacatgaggttgatgatgcacatgcaaatcataatgatcatgatgaagatgctcattcgaaggctacttctaagagtagacaatctacccggctaagaaggttgactgtcagaaacttggatcagtcaaggctcatggttaacgtcaatcttgtcactagcagaagatcaaggccacctaaagaaaagttccacaattatctgggggaaaaatttgatatccctgaaggttcaaatgccaagaagaaggttatgtcaatggtcgccactagatggaggcaatttaagtcttccctgaccactaaatatgtatatgttgccaataacggtcaagctaaatag

SEQ ID NO: 6466 - DNA, 216 bp, Glycine max
  Peptide Sequence Number=SeqID_123244
atgaagaggcagcaacaacccacacccaatcccaacaaacccttcccataccttcctttctcttttatgcgcaccctttcgtttagacttatgatggcttgcatgaatcaaactttctacaatgctggacacgacccctcctatgaagggaaaaatgttgcagagagacatcgtagagtgattacatcggtacgagtgcactatgatgatgagtga

SEQ ID NO: 6467 - DNA, 861 bp, Glycine max
  Peptide Sequence Number=SeqID_123245
atggccgaggctattcttggagttgtagttgcaaagttgagctctcgttggagaagagctgggactatttctggagatgtagctcatgagctggatgacatcatggacgagtgtgcctatgaaaaaccagggctggagttccaaggaatcaagttcaaaccagattttagtttgaagagaatgacaaaagctatcatcgaagcagcatctggatgtgcttgtgatgatttggatctagagccactacaaaaaaaacttcaagatttgcttcaaagaaaaagatattttcttattttggatgatgtgtggaatgatgagcaagagaattggcagcggttaaaatcagttttggcttgtggggccaagggtgcttccattttagtaactactcatctttcaagtgttgcaacaatcatgggaacaactcctcctcatgaattatcaatgatgcccaaaaaaaattgttgggaattgtttaagcaccgagcctttggaccagatgaggtaatgcaagtagagcttgaagtcatagggaaggagatagtaaagaagtgtgggggagtacctcttgcagcaaaggcactaggaagtcttttatgctttgaaagaaaggaagaagcatggctcaatgctgcacttatcagcttactcactacagtcaagcctaagcttgaagattctgagaaacaattctccaacagagctataaaagatgcagctcacaacctgaatgacatcatggacgagtgtgccactcaagaattggagttgcaataccaaggagtcaaatgtggggaagtgcctcttgcagcagtagcgttaggaatttttcacattttgaaagagaggaaacaagaatga

SEQ ID NO: 6468 - DNA, 699 bp, Glycine max
  Peptide Sequence Number=SeqID_123246
atgggtgatttttgctatgtaggaagtaggtgccgccatcctgggtggctccttgtgctttttgtttgtcttgtagtaggaggcgttatcctggtatgcttcatcctgtcaggggatacagaatctatgaagaaggtgcactgggtggcatggaaggacctctatcagcccaaagagaatgaagatattggaatgcgcttggagaggcatgttaatgattcctttatgataaaggtggcttgggaattgtgtatgaaacctagtcatttgtgggtaaaagttgtgagagccaagtatgcttgtagggatgatcattggcatattattgagaagaagaagagaggatcaaatctttggtctagtatcaaatatgtttgggatgcttttcaggagaattgtgttgtgaatgggatgaacgttgcttggagatcatcctcatatagaaattttaaagtaaagaatgtataccactgtgtagctaatttggaaaactctcctaatactatgttatttaggattatttggaggtgggagggagctaaaagatcaagagttttgttgtggaagatggcaaagggtgctttagctacaaatgaagcaaggagggaaatggggttcacagaatcatggagttgtccaatgtgtgagaatgagaaggagacaacttttcattgcatgagggattttcaacatgcctag

SEQ ID NO: 6469 - DNA, 189 bp, Glycine max
  Peptide Sequence Number=SeqID_123247
atgtcgccctttgtgcaatactattacaaaatctctcctccatatcttttaggattgccattaggccaagcaggttgggtcatgatttcatttagcatcagtggcttattgtggagtagcaatggtgagttcatccagactttttcaagaagaatgagccactgctcaatccttgaggctaagttgtag

SEQ ID NO: 6470 - DNA, 312 bp, Glycine max
  Peptide Sequence Number=SeqID_123248
atggaattggataaaattgggtcttctctgtcattcatgcttgtgagaatgtatggtaatgttggatcccaaccgggggtacagcagtctcaaacaagtttgcctccaaatccttttgggagtgcgtttaatgttgctggttcaggactcattcgaggtggattgggtgcgtatggagggaaaatattaggatcgagctctgagtatgtccaaagcaattcgatctcacttagtggcataacctctcaaaaacaaattcaatccctgtttctaagctgttggtatatcatcttagcaatacttatctattga

SEQ ID NO: 6471 - DNA, 630 bp, Glycine max
  Peptide Sequence Number=SeqID_123249
atgcctttgttggttgatgcagaacacaccacggttcaaccggctatcgattacttcacatactcttctgccattaggcacaacaaggatgacaaccccattgtgtttggaactattcagacttatttgaaagatgctaaggagaggttgttgctggcaacaaaggcagcagagaaaatgggagttccaatgggattcaaattggtgaggggtgcctacatgtccatagagagtaaattggctgagtcgtttgggtatgcatccccagttcacaatactattcaggacacacacaattgcttcaatgactgctcatcatttatgcttgagaagattgctaatggaatcggttcagttgttcttgcaacccacaatattgaatcaggaaaattggctgtggcaaaggcacatgaattgggtgtcggtaaggtgaaccacaagctagaatttgcacaattatatggaatgtcagaggcactttcctttggtttgaacaatgaaggatttcaagtaagcaaatatatgccatttggacccgtagatatggttatgccttacctcctgagaagggctgaagagaatagaggactcttggctgcttcaggttttgataggcaactaatgaggtaa

SEQ ID NO: 6472 - DNA, 678 bp, Glycine max
  Peptide Sequence Number=SeqID_123250
atgaggcttgatcctctttcaagacaagatgctctcttctttttcttggagcttgtgatctatggttggatgaagttggttgttgctgacatcaaaggcaccagagaaaaggggagttctaatggggttcaaattgaccgagtctctgagattgccaatggatcttgtttagttgttcttgcaacccacaatgttgaatcagggaaattggctacatcaaaagcacatgaattgggggttgcaaaggtgaagcataagctagaatttgcacaactatatggaatgtcaggggcactttcctttgatttgagtgatgcaagggttgaaaagaataaagggcccttggctgcttcaggttttgataggcaactgatgagctatgggttgggttgggctttagtgaaagggctcattctctgtttccctcggtcttttgtgagtaaccttttgcccgagagagccattctcagtccttctttaagtcttagcgttgctaactcaaatatcaaacaaccgccagaagaaattagacacctaagcttgctaagaaatctccctttagagaaggctaatcacattcttattgagttacaatctttatctcatcatctgaaggtcgtagagattgcaattttggcaaatgaagatttgcctaaggatttggtcttcaacaatccg

SEQ ID NO: 6473 - DNA, 606 bp, Glycine max
  Peptide Sequence Number=SeqID_123251
atggcaacccgggtgatccctccgagaatgatcctcaagaacatccgttacaacaccgcaacaaagccactcaaaaccactcacccatccctctctcctgtcaccgctaccgcatcactcgtcaagaagccgtcgtctcctgctacggatgcttgggcatcatttgcccaagcatccgtaacaacggagacggcggccctgaatttggaggacgcggagcagctgttcgcgtcggtgtcgacgcgaaaattgctccagtcctctgcagttatgcatgcgacagctgtggggcccgtggtggacctgggaatgagggtgatgaagtctcgggtgttccagagcggggtgctgaggaatctcctcatggctgccacgaaagagacgttctacgcgcaattctgcgccggcgaggacgccgccaccgccggacggagcatcagcgcgctcaacgaggtcggcttacgtggcatgctggtgtacggtgtggaagacgcacatgaaaacgatgggtgtgacagaaacctcaaagggttccttcacactgtggatgttagcaaatcgcttccaccatcctctttcgaaactaccaagagggctagcggttga

SEQ ID NO: 6474 - DNA, 1765 bp, Glycine max
  Peptide Sequence Number=SeqID_123252
ggttgaagctgcaggggcacgtgcggtagggattggagtgtgtggtttttgggtaggatctgatggttgcgggccttggtggaaaggtggacctttgggaagagaaacagtgccagctgcaggcaggcaggcattgggacacatgagtggttggattattggcaagagggagctgatggggtttgggatgtataaagagaacggaaaggtgggtaaggaaaatgaaaagccgcaagtcgttctgagagtccagccatggcagaaacaagagtgtaaatgggagtcgatggacttgaggaggatggcatggtgtgacggtatagaggaggtcttccatgggaggtggactgagcagaatgaaaacaccgatttagagaaaaccagtgctaatgtcattttagctcgatgtcccacactttctgcttttgatggtcgtgccactataaaggtcgaagattatgagattccttcgagttctgttgacaagggtaaagaagcatctattcaattagattttcctatcccaaaggtgaaaaaggagattcctgaaggcattgttgatgatctagatcatattgtattgaaagaacggctaaggatgctgctagctaggaagcttccaggattgtcaaatgcatctttagagggtggtaatgcaggcttgttggaaaccatcacggagcaaactgttaaaaaagtaaatgaagagattaattttgctgatgggaaagcagcagaggccagagaccaggtttatgacaacccagaaggaagtaatatttcactatcactcggggctacatgtggatcatctttattaactgattatgccacatctaaatcaacaggatcagtaatttcatctggccttctagaagacgaccatttattaaaatccagaggaatagtcgagcaatttgattcacatgaagaacataatgttataaataatgatggcccaattagttcaacttctccaacctttatcaaagtcaaggatgaaccttgggatattggtgaaaactacaatgttaccaaggatgctatgggtagcatttctttcaaactctcaaatgtaaaaagtgaaagggaagtccataatgaatatcatgatgaccaagcagaacatatgaacttaattgatcgactaaattttctcatggctggagcggattctagtttaaatatttctacaagttactctttgaagactcagccttcttcctctatgtcaagccctattttttcaaaatctgctgaaccttcaagcatcaaatctaggcgcaaaagaaaaaaaacagccactgattcagttcaagaagcacttgaggaggatgctcctgggctcctgcaggtattgctagacaaaggtgtattagttgatgaaattaaactttatggagagaaagaagatgatgaagctctggatgaatcattttgtgaagatagcttttcgaagcttgaggctttgataaccaaggttggagaagatttgagtgaaggtgaagccaaggtgctaatggaatatggttggacacctaatactggcctgggaactatgcttaactactgtggcagagttgtgcatgacaggaaaagtgaggacaattcttcagaatggcgatctaaaatagggaaattgctgatggatggttataatggtggaaccatagtgatgcctactgtcccaaaaaaagttgcagaatacatgtgttctcaaagccctgacagtgacataagctgtagtagtcccatgtctgattag

SEQ ID NO: 6475 - DNA, 328 bp, Glycine max
  Peptide Sequence Number=SeqID_123253
aagctgtcgtgagcccgtgagagcagcgacggtggtgattgcagggaggaagaagggtagaggtgactgggtcgccacggcagtcttaggagaagggcatccattgaggattcgaggcggtgttgagcgacagcaaggttggccaaggcggcctcaaggcggtcgtcgacagccatggaagcttcgtttggcgagtggcagccatgggcggcaacggcggcaggtcgaaccaattgttatgagcagaggtcacgagggagaggaaggagataactggccttacttcgagggaaggctacctcctaactacactaagcttttactttga

SEQ ID NO: 6476 - DNA, 258 bp, Glycine max
  Peptide Sequence Number=SeqID_123254
atggcaaattacagatacatggaaacattgacggaaaaagaaaaaacaaccggaataggccggggatgcaaatatttcaatcagcgggggggtattgatgaggttttgatatgcaaagtgctaatgaacaaatgcgtaagatcgatgcttaaggttgactctaaccaggctctagatctgtttctttatccagatttggctctcattgaccgaggtctgaattgtatgggtggcaactctttcttccgatgcaaatga

SEQ ID NO: 6477 - DNA, 621 bp, Glycine max
  Peptide Sequence Number=SeqID_123255
atgaacaactattcatttgttaacgtgggtaataacccttacctcttatccaatcccaacctgaaccctttatttctgaacggcacaaacctcttccaaactaataaggagcctcatgtggtgttcagtggtagtgaagaatatgctaaccctggtttatactctcaagcacaaagtgagtgctctcagcaggatgtatcaaaatcatgggcagatttagagggtggatctattccacaagatactgattacaacaaaattagcaacactactacttcacgtgaaaatcaagcagaaaaccctcttcctgcattagttgcattctctacaaagatgggaacgttcaaccaaatggacagtaacatagctcaaacgtccacagagtcaccttccaacactttctttgatgattgggagaagttgcttgatgatgaaacaagcggtcgttcctattggaaagagattctagagttatcaccaaaaagggagattgcagcttcgtcaaaactacttgacatccacttctgcgtcaccaattttgtggtagaagaatcatcggttcatctctttcaggataatcccatcaacttatggatatacatcacgtaccgaagaaaatag

SEQ ID NO: 6478 - DNA, 915 bp, Glycine max
  Peptide Sequence Number=SeqID_123256
atggcggaggaaaaacggttccgaatagggtacgcgctgttgccgaagaagcaaaacagcttcatccgagactcgctcgtgaatctcgcgagatctcgcgggatagacctgatccgggtcgacccgaaccggagcctaacggatcaaggtccattcgattgcgtcctccacaagctctatgacgacgattggaagcgtcaattaacggatttcaccgttaagtaccctaatgtcgttgttctggactcgccggaatcgatcgagaggctccacaaccggattttgatgctgcaggtggtgtcggagctgaacgtcgacgaccagagcgagacgttcgggattctgaagcagattgtgatatacgacaaggatacactcttcgaccggcggaactgggaggcgctgaagtttccggtgatcgcgaagcccttggtcgccgacggaagcgcgaagtcgcacaagatggcgttggttttcaaccatgacgggttgaattcgctaaagccgccagtggtggtgcaggagttcgtgaaccacggcggcgtgatcttcaaggtgtacgtcgccggcgagcgcgtgaggtgcgtgaagtggaagtccctgttggacgtcggagaggatgagttggattctcgatgcgggaatcgttaccttattgttgatatcaattacttccccgggtacgctaaaatgcccggctatgagactgttttgacagactttttctgtgatgtgttttgcatgaaacaacaatggggtgaggattgttctgagaatgctggttttgatagtgtgatgggtaacaaagatgtgaggcagattatgagcaatacttgttgtggtgatggtgatgagggtggtctccaggtttctcctctcagtgtggaagagaaagatagttctgttcaagtgtga

SEQ ID NO: 6479 - DNA, 165 bp, Glycine max
  Peptide Sequence Number=SeqID_123257
atgtgtagagatcaagttgccgcacacaacaatcagaccaatgaatacgaagccagcaaggaaccaaagagtgacaatgctttctctttctctgattttctcagcgggttccggattctcattccagcgctctaccctcttcagctcatagaagctaatgaataa

SEQ ID NO: 6480 - DNA, 588 bp, Glycine max
  Peptide Sequence Number=SeqID_123258
atggatacacaactcaagaagttgcatgccccaaatttcagccaagtaaatagctctattgcttgcacatcccaaatggtgccatctttttggttattgcaagctaggtctaacaaaagtgtaccagaacctgcttttgagaatgtggctggtcctatcaccaatgcaactgattattgtgcaacgactgtagataataaaaattgcttcccaaatggagggttgtcttattcttctgttgttcccagtcaatttttccacctgataaccatccatcaatcgctacatgcactgatttggatgtgcttcctaactcttgtttctagtgggagaagcaatccgaaagctagctccaagtcagttagttcctatttacctcagcgacaggcaaacaattggaagacatttatggtgaagtatgaagattgttctaggactacaatgagaaaatccatccaatctaaatcttcaaatttgatgaaccctcaagattccttgagggaattttcaaaagtttttgatcttcctcctatcccgagaagtcttggagatattaggcaacatcaaccccggaagcaagatttttag

SEQ ID NO: 6481 - DNA, 393 bp, Glycine max
  Peptide Sequence Number=SeqID_123259
atgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggtggtggctcatcttgtggggggggggggggggtggaaagaagatgttgactgtgattgaagtaggatcttcaaggatttattacttgagtggtgaagattgtaaaaagaacatgttacataggaaaacaatgacttatgaacaagtctaa

SEQ ID NO: 6482 - DNA, 1011 bp, Glycine max
  Peptide Sequence Number=SeqID_123260
atggatacacaactcaagaagttgcatgccccaaaattcagccaagtaaatagctttattgcttgcacatcccaaatggtgccatcttcttggttattgcaagctaggtctaatggaaggatgacacttttggtgaagtatgaagattgttctaggactacaatgggaaaatccgtccaatttgaatcttcaaattcgatgactcctcaagataccttgaaggaattttcaaaattttccgatcttcctcctgtcccgagaagccttggagatattaggcaacatcaacaccaaaagcgagattttcagcagaattttaaaccttttgtgcagccatatgggcttcctggtaaaacttatatggcgcgacctaatgcattctccaatcaagatgtagaaggcatacatggcagaacgaggttcaaccaagatgggataaatgctgccattgagccaaaagttgatcaagagatggaaaggatgtcacaaaatccaacaaataatattgtagacatagaggacatgcaaggcagaaccgggttcaaccaggattggataaatgctacagagaagatcattgagccaaaagctaataaagagatggaatggatgtccctaaatccaacagttattgaagatatggaggacatacaatcaaaagctgatccagagaaggaaaggatgttcccaaatccagcagtttatactgcatatatggaggacatacaaggaaaaatcgggttgaaccaagatgaggtaaatgctacaaaagaagtcattgagccaaaagttgatgaagagaaggaaaagaagtccccaaatccaacacttaatattgcaaatatggtggacatagaaggcagaattgggttcaaccaggatgggataaatgctacaaaagaaatcattgagccaaaagctgacaaagagatggaaaggatgtccccaaatccaaccgttactgtagatatggagggcatacaagtagaaccgggttcaaccaggacgtga

SEQ ID NO: 6483 - DNA, 297 bp, Glycine max
  Peptide Sequence Number=SeqID_123261
atggaggagttcaccgttggtagaggaggaggaaatgacatcgtttgggtgtcggatagcacgagggttgtgttggatgagattcaaaggcatgagtgcagagcattgcgagcggttaccattggcgacagaggagaaggatggggagagggggaaaggagtggtgatgatgttgttagtggtagtggagggtggggggagagtggtgatgatgttgttagtggtggtgggcgagagaaagcttggaaaaagaagagtaaaatgaaaatattaaaaattgagaggtgcattaagtaa

SEQ ID NO: 6484 - DNA, 549 bp, Glycine max
  Peptide Sequence Number=SeqID_123262
attcagaggttatcttttgatgatcaaataaacaatttcaagaaaaccaaagaagtaatcacggcaaacataggagaggcagctgccaacaagcattgcaatgaagccacgtatttcattgggattggcagcaatgactatgtcaacaatttcttgcaacccttcttggcagatggccagcaatacactcatgatgaattcatagagctcttaatctcaaccttagatcaacaacttcagagtctttatcagctgggagcacgaaaaatagtcttccatggacttggtccactcggttgcattccatcgcagagggtcaaatccaaacgaagacaatgtctaacgcgagtcaatgaatggatactacaattcaactccaatgtacagaagctaatcatcatactaaaccatcgtcttccaaatgcaaaattcatatttgcagacacttacccgttagttcttgacttgatcaacaatccatctacttacggtaatttggcatctctaccttatatcttaatttatatgctgatggtagttaacaactaa

SEQ ID NO: 6485 - DNA, 345 bp, Glycine max
  Peptide Sequence Number=SeqID_123263
atgtcaatgccgaggctagtttttgctgcatgcatcttctcacttgcagcaattgctttagcaactctgcctgtgacatatatctttggtgactccttgacagatgttggaaacaataattttctacaatattctttagccaaatctaactatccctggtatggtattgactacagtggtggccaggctacaggaagattcaccaatgggaggactattggtgatttcatattgaaattgaataagagtttaacttctgttagtgtcaatgtagaaaattttatactatcaaccaataaaaaaccatgctgcaaagcttggaatctcatcaccaccagcttatct

SEQ ID NO: 6486 - DNA, 1631 bp, Glycine max
  Peptide Sequence Number=SeqID_123264
atgccacgcagaggaggcggttctcagcggaagaagcaacccttagcttcaacctcagaaaatcaaactggggcccagcaaaactcagaaggtggaaacagatttcaatcacctagtgataatggaacactgaccgaaatatctcgagaggctgttggaaatcttatacgccgtgctaataaagttggcatttccaggaaaaagaagacgcctgagtttgagccagaacaaaatggaacccaagtcttggctccaatgctcaaacaaaagacttcagagattggacattgtggtagaaattccatggaaaacgcttctgcagaggagaaatgtggtaattcaggcctgcactgcttcgataacaaggaagaactggatgactcagattgggaagatggtacagttgccagggatgatcatcctgtgacaattgaattgaatatgaccgctcattcaactgtacagaaacaaattcgtcgagcttctgctgaagataaggacttggctgaacttgtacacaagattcatttgctttgtttacttgctcgaggaagattaatagacaatgcttgtgatgatcctcttattcaggcttctttgctttctctacttccagcacagttgctccagctatcaaatgtcacaaaactcacctcaaatgctctatatcctttaatatcatggttccacgataatttccatgttaaaaactgtacaaatagagaaacttctccgcactttggtctggcatcagctttggaatcacatgaaggtagttctgaagaggttttgagtttctcttttaataaggtttccattcaccgatgctctacttctatgattgcagctttatcagtggctctattaagagctttaaatcttacagccaggtttgtgtccattttggatgttgcccctcttaaaccagttcaagttgcaagtgggtctagtaatggcatatttaaaacttctacaccaatgatatctaagcgaaaattggattttaagtcacctcaagaatcaatatcttgtaatgagatagaaaatgtctgtgaaagttctcttgtgcattcacggaaaagtaagaaatgtcatgcgacaaaccacacggatcagtctagtgatcctcctgttgttgatgtaagaaatgatagtgttgctaactcaaaagcttcagagacacgagatagtaactcggaattgtgtctcactgacaaatctcataaatcaaagaggaaaggggatattgaatttgagatgcagttggaaatggctctttctgctacaacagttgaatgtaaggacagtaaaactgaggcaagtgcaaatcctgattcatcgagtttttcttgtccatcaaaaagagtgaaaagggttatcggtgaagactcttcaacctccccccaagtaatttctacagcaattggatcaatgaaagtaggatctcctctgtattgggcagaagtatattgcagtgaagaaaatttgactggaaagtgggtgcatgttgatgctttgaatttgattattgatggagaggacaaggttgaatccatggtagcagcatgcaaaacatctttgagatatgttgttgcttttgctgggcaaggggccaaagatgtgacccgcag

SEQ ID NO: 6487 - DNA, 1185 bp, Glycine max
  Peptide Sequence Number=SeqID_123265
atgaagtggtacaagatagcatcacatcgagttaattcaacatggtgggattcggtgttgaaaccattgagagacttagagtctggggcaactggaggtgtggctcatttaggaacaaaccaaatcatttctacagaatccaacatgaatgattctgttgtccctacaaggagctctattgaggatattgagttggaaaccagggcattaactgaacctcttccaaccaatcagcaggcctacaaaagtcatccactttatgccatagaaaaatggcttacaaagtatcaagtacttcatccaaagggtccagttctgggcttttgttcaggtcacccagtttaccctaggacttgtgtgcaaacagttaagacaaaagagagatggctgcgggaagggctgcaggttaaacccaatgaacatcctgtgaaggatcttcaacgttccatgaagcctcaaaaagtacaagattctgaagctgatgactatggctgcactgattctattgaacaaattaaactttatgggaagtggcaactggaaccattaaatctacctcatgctgtgaatgggatagttcccaagaacgagcgaggtcaagtagacgtttggtctgagaaatgtcttccgccagggactgtacacttaaggtttccaaaggcattttctgttgccaagagacttgaaattgattatgcacctgctatggttggttttgaatttaaaaatggccgttcatatcctgtctttgatggtattgtggtgtgtgctgagttcaaggatgtactgctagaggcatatgcagaggaagaagaaaggcgacaagctgaagaaaagaaacgggatgaaacacaggcccttagtcggtggtaccagcttctttcttctatcgtaactcgtcaaaggttaaataatcgttatattaataacagtttgtcttcagacaaactaactggtgtcctatgtataaataatgatgagtcaagtgcgacagtatgcgataataatgacaagagtccgaaccaaagagaccaacaggtggacaaatgtgatactaatgttgatgtttcattaagcacttcagtaaaagatcatgagcatgtgtttttgaaagagtacgaaagctttgatgagggaacttctctattgacaaagcgatgtcatgtggattttcagtccaagtag

SEQ ID NO: 6488 - DNA, 216 bp, Glycine max
  Peptide Sequence Number=SeqID_123266
atgggtcttttttggaagtatttcttgcatgatgttgtttttgacgtaaaaagcatgcaaatcgcagaagccattggcgacttcgggctggcttctagggttgcaggacgcgttgtaggagaagtcagctttatcaggttggaactgccaggggtattggcaaattgtgctgtagttggagttgccagcagcactggcgagttgtccttggagtag

SEQ ID NO: 6489 - DNA, 1314 bp, Glycine max
  Peptide Sequence Number=SeqID_123267
atgagaggcaagagtttctcacttgacccaatggaggaggagcaagcagctaatactactgctatgaccaacacagagacttggcataagaggctaggtcattttcatcacacaaaaattttgaatatgcaaaagaaagagttagttcatgacttgccccatattgagtccaatctaccaagctgcaaggcatgtcattttggcaaacaagcaaagctttctttccaaaaaggatcttggagagctaacatgaagctgcaactcattcatacagatgttgtcggacctcataaaactccttcacttaataggagtaaatattacattgtttttattgatgattatacaaggatgtgttgtatctattttctcgggttcaagtcaaaggttgcaggctttgctgcaaaaggagatgaagacaatgtgtatctattaaagaatgcattgtacggcttgatgcaggctccaagagcctggtatagcagaactgacgaatacctactgaaactaggctttgttaaaagctttagtgagtctactttatatgttaaaggtgacaatgataatatttttgtggtatccttatatgtggatgatctcttaatcactggcagcaacattgagcttattcaacaattcaaagaagacatgatgcgagtctttgagatgactgatcttagagaaattatgagcactcctacgtgtcaaaaagagaagttgtgcaaggatgatggaaaagctaaagtggatgagtccgaatatagaagcttggttggctgcttgatgtatctaacagcaataaggccaaatattatgtatgatttttgtctaacaccaagcttcgagttgcaaggttattctgatagtgattgggtcgggtctttagatgacatgaaaagaacttttagtttctatttcaactttggatccaaaatatttacttggagttcaaagaagcaagaaattgtggctcaattaacagtcgaagcagagttcatcgctgcaacagcatttgttaatcatgctttatgggtgagaaaatttttaaatgatttgcacttagagcaaaaaacgattaccaaagtcatggttgataatcaaacagctatagctatctcaaacgatccaatttttcatggcaagaccaagcatttcagcatcaaactactcttcattagagatattcagaaagatggtgcagttagactgaagtattacaacactgaagatcaactggcaaacatatttagaaagcctcttgcaaaaagcaggtttaaagatttaagagaaagacttggaattcgcacctactga

SEQ ID NO: 6490 - DNA, 928 bp, Glycine max
  Peptide Sequence Number=SeqID_123268
atgatgaatatactgctctttgtcttgtgtttggtgactagtaatgtcaatcatggagttgatggtattcaaaattttaaagaaaatttggagcatgagagacaactaaagttcattaataaacatcttgttaagagtattcatacaaagtttggagatattattgactgcattgatattaacaagcaaccagcatttgaccaccctttactaaaaaatcataagttgcagagaaagcccaactttaaaacatcaagtgtaaaaaattcatgggctagacttatatttggacttgagaaacatcaatactgtccaaccggaaccgttcctattcagacaataacaaaagatgatctcattcgagataaattattaaatagtcacacctcaactcaaagcactcctggtgatcattttgcagaagtatctcttgtaccaggtttaggtccttattatggagttagtggttcattaagcatttataatccaaaagttgagaaggatcaaagcagcgcttctgttttatgggttcggaatgaagatgcgaatagaatcgtgcttggatggcatgtgaatccaagtttatacggtgatgatgcaactcatatttactcacgttggacgagagataactacgagaaaacaggatgtttcaacatgcaatgtccaggttttgttcaaactaacaaaagaatttaccttggtacacgagtggacattacatccatctatggtggaaggaccattgagactaatgtttctattacccaggatccaattaccaaaaattggtggttaaatatagaaaatacaaatattggatattttcctatagcattgttctccaacatggcttcagcccaacaaggggggtggggtgggaaaacacatgctcctcctggtgctcctagtcctccaatgggatctg

SEQ ID NO: 6491 - DNA, 222 bp, Glycine max
  Peptide Sequence Number=SeqID_123269
atgggattctttttgaaacatattcttgaaatgggtctcttttggaagtattttctgtatggtgctgtttctgacgtaaaaaacatgcaaatcgcagaagttattggcgacttcgggctggctgtgacacgtggcactggtctcgccagtgccactggcgatttcaggatgcatggaactcgcaagtttgactggcaagttgtcctaggggagccaggctag

SEQ ID NO: 6492 - DNA, 1050 bp, Glycine max
  Peptide Sequence Number=SeqID_123270
atgaagacaaagtttggggagattattgattgcattgatattaacaagcaaccagcatttgaccatcctttactaaaaaatcataagttgcagagaaagcccaactttaaaatatcaagtgtaaaagattcaacgactagatttatatttgggctgaaaaaagatcaatactgtccaagtggaaccgttcctattcaaagaataacaaaaggggatttgattggagacaaattattaaatagtcacaccctaactcaaagcactcctggtgatcattttgcagaagtatctcttgtaccaggtttaggtccttattatggagttagtggttcattaagcgtttataatccaaaagttgagaaggatcaaatcagcgcttctactttatgggttcaaaatggagatgcgaatagaatcgagtttggatggcatgtgaatccaagtttatatggcgatgatacaacttatatttactcacgttggacgagagataactacaagcaaacaggatgtttcaacatgcaatgtccaggttttgttcaaactcacaaaggaatctatcttggtacacgagtggacaatacatccatctatggtggaacgattgttgaggctaatgtttctattgcccaggttaagtatgatatattattcacaaagaattatacaccttttcaggacccaattaccaagagttggtggttaagtttggaaagtacaactattggatattttcctatagcattgttctccaacttgacttcggccgagcaaggggggtggggtgggagaacacatgctcctcctggtgctcctagtcctccaatgggatctggttattttcctgatgataacttagttcatgcatgctattttaggcaggtctcattcaagaatggatcaatacaagactatggacctgaggaatatcatgtacacacaaacaccgataaccctagttgttttggtgttgaatattatggagatcaaggaagacaagccgggtattctctccaatttggaggacctgggggcaattgtgataattaa

SEQ ID NO: 6493 - DNA, 246 bp, Glycine max
  Peptide Sequence Number=SeqID_123271
atgactttgtggcttccattgcactcatcgcacactatgaatctgaagcctccgcaagaatcgcaggcattgttctggttggagcgctggaggcgttcgatgagccaatggagctcatcgctctcgtggagctggtggacgtcatcggctccaccaacgcaagagtcaaaggaagcgccagagagtggagggagaaatgaaagggatcggatttcagaggagcctagggtttcaaagtacacgtga

SEQ ID NO: 6494 - DNA, 180 bp, Glycine max
  Peptide Sequence Number=SeqID_123272
atggctcactcaagcaagaaagggaccagggagagcagaaaggtgcaaagctcagtgagcttgatacgaaagaggaaggagattttaggcgacgatgtctcgtcattgctggagaacgatgaggtggcgatggtgaaattagaattacatattgcgacaataacacggaaagaggtttga

SEQ ID NO: 6495 - DNA, 147 bp, Glycine max
  Peptide Sequence Number=SeqID_123273
atgggttttccctttgccgacggtcatttacctcgccgaaaatttactcggtccgaagatcttctgttttctttccaggttttagcattcgttattcgctctcccttgaggagattctgttgtcctcttcttcgggggaaaggatga

SEQ ID NO: 6496 - DNA, 885 bp, Glycine max
  Peptide Sequence Number=SeqID_123274
atgccggaatcacccggcggcggagacgccggcgctccaccgcagacgacggagactgagaatcgcaaaaccgaccaaaccgccgcggatcctccggtcctctcaaagaacgcgcggaagaagctggcaaagcaacagaggtttgaggcgaagaaggcggagaagaaagccgcggcgaaggagcagaagcgaagagacgtagagagaaagcgcaaggagtgggaagagagcctcgccggggtctccgaagaggagaaagcgaagctgatagagtctcgaaggaacctccgcaaggagagaatggaaaagaggtcacaggagaaagaggacaaaagagagagactcaccgtagcgagagaaaaaggccagaacgtcgtcgtcgatctccagttctctcacctcatgaaccctaacgaaatccacagcctcgtgcagcagattatgtactgttatgcggtgaatgggaggtgtgcttcccctgcgcatctttggctcaccggctgcgaaggggaaatggatagcgggttgaagcggattccggggtttgataagtggataattgagaaggagaataggtcctacattgaagccttgagtgatcgtaaggaggatttggtttatctcaccgcggattcggagactgtacttgaggagcttgatttgaacaaggtttatgttattggcgggttggtggataggaaccggtggaaggggataacgttgaagaaagcagaggagcaaggtatcccaacggctaaactccccataggaaatttcatgaagatgtctagttctcagcatagaaggggcatttctaaaattagaatcattgcacatctttggcattgccctttgttttacctttactttccttctgttagttga

SEQ ID NO: 6497 - DNA, 828 bp, Glycine max
  Peptide Sequence Number=SeqID_123275
atggaaaatgaggttaagaaggataataaacaaatcactattcttacaaagggtgcatggaggtaccttaagaaagagttaaatatgaaattaggcaaggagtacacacctaacctatttaagaaaaaatccaatcaattgggaggaaaatggaatgatcttacttcactgctgaaaatggagactgaactaggagacaagtcaagtactagacgaattattgccataaatgatcaatggaacaaattatgtgagaaatatacatttgcaaagcaatttaaaaaggaagaatgcttgtattatgataaattatgtgttgttttttgggacaaaactccctctagtgcaaatcaacatccctctaccaaaagtccttcaattaatgatgatgatgataatgaagaagacactaattttgatcaagagggagatgttcatcagccaaaaaggaaaacaattgttcatgttagtgaggataagaagaaactgaaagcaagaaaaagtgatcaaatgacatttgctaatgctttgacaaattttggagaaactcaaaataagcttgaaattttggaaaagatgagtgcggatcatgtcacaacatcaacttttagtgctacaggggaagtaaatggacaaaagtcacaaaacaataagcaagataaggaatccatattggcttgtgtaaggattcttcaaggacttcaaggcattgatggtgcttcttttacaaaagcattaaagttattgaaagaagatgctttatggagatgtgtgtttttggcattatctgatgagcgaaagaaagattgggccctcaatcttccttag

SEQ ID NO: 6498 - DNA, 660 bp, Glycine max
  Peptide Sequence Number=SeqID_123276
atggttcagatatcagtttcggtggtttcactctatcgccacccagttccgatggctctcctcgccgtcacttcgcgcgctcccttcctcttctccccaaaccctaaaccactttctccatcctctttctactcccacctctctctctctcctcgctctcccaggttcccttctctccgcttccgctctgccaccggagacgccagcgacgccggcaagcccgccggtaagatctccgacgagtggggcgaggactacgatcccgaggccgaagcattgacctccaagcttcccgactcggaccctcccaaggacgaggacgagtggcaggaaggaggggcgcccgacgccggcggctacgtcgacggcgggaacggaactccggtcaccggagctgaggatccggcggaggaggaggtggacgataagttggaggcgctgaagcgtgctttggtggatactttgtatgggaccgagttagggattcgggccgggtcggaggttcgagctgaggtatccgaattggtgagtcagttggaagcggcgaatcctacactcgcccccgtggaagaacctgcccttctcaatgggaattgggtgttgctgttagataagtttggaaggtgttctgaaggaactggaacagtgcttcatggttga

SEQ ID NO: 6499 - DNA, 234 bp, Glycine max
  Peptide Sequence Number=SeqID_123277
atgaaaaacgatcctcaaaagctgttgaatagaccaatgatcttcatcaaacattctattgtttctccatttccagacccaccaccagatggctactgtaaaaaggaaaacatggctgctacacagaagtcccaaactgatccacacttccctagcatgagggcagtccccaaggcaatgaagcacatcctcagactggttggaacagtgggggtacgaagcttaagcagctag

SEQ ID NO: 6500 - DNA, 540 bp, Glycine max
  Peptide Sequence Number=SeqID_123278
atgggccgagcgcttggtcaatgtagggaaaggtacactgcatcttctgaactgttgcctcttctagccgcgggaagattgcctttgttgaaggtggacaagattacacaaacaattgatactagtagctccactattataaactccacaacattgtctagcccttttgcatccttgtctttcagtgcatctgcctcatttgaagttcgaacccctacgagaattcaggttacatttaaagaaggttcaatacaacctccagagataaagtctaatgttgaactaccagaaaatgtagacatttttggccaaaagcttagcctacagcctctgcaacaatcccttggcccacttcagggtctggtggaaaacatatcgcgtgtcatttctggtcagccacctcttaagattcccatccctggcgaaaggacaagctcctggcttcttactacatatcttgataaggacttgcgaatatcaaggggggatggtggtcttttcgttcttgccagagaagggagtccacttcttgatcagtag

SEQ ID NO: 6501 - DNA, 564 bp, Glycine max
  Peptide Sequence Number=SeqID_123279
atgttttggcgatccgaagtttgcaacagcttccgaaacctcgccctcaccggaaactcgccgatttttaagctcgcacggagtgagtgtgagtgtgagtgtgagtgcttactcactgtttactgtttccgtgctccggcgcaagatagcatcggttgttggctctgttcgaagcataacggggatttttttccgttaccgttgggtgcttgggaagtccgtgcaaccttagttcaccgtggagggattgggtacacgtgtcactgtttgggggaatggaatggagaaagcacaaacataggaagtactgtagggtgcaaaagtgtcggtgctgcgtttggggcgatgatggcgtgtgtctggtacgtgggacatgcctggggggttttgattggctggtctcaaatcatattcaaagataggatagggatcatcatatatcaaatcgaatcatcaaattatggatatattgctctttcctactttcataatcgtttgtattacgttgacgacgtccattgtgagacacgtatcacgttatgcactcaagggacccggagataa

SEQ ID NO: 6502 - DNA, 624 bp, Glycine max
  Peptide Sequence Number=SeqID_123280
atgggtagtagactctgcgttctgctgtgttaccatatatcagatggcaacaatttgaagaaagagaagcaaggaatgtattgcaagatatcgaaaagaaagaaggagatggagacagaagagaagaaggtggttccaaatctgactctagaagattggatattagcttctcctggtttgaagccagactacattaatataagatcaggagaattctcttcttcatgttcatctaagtctaagaaaaaggtgcacccttgtgtgagtcaagttcctagatcattgatagctgaagctaaagacagtttatgcctggacagacccatgaaccgtaatgaagaaatgttaagttccacatcaattggtagaagcataagtgagaaatcacagaaaaaagtgagctttaaactccctcataatgtcatattttactcacctgatgagcctcgctccccagaggagaaagagccttattattgctattattataatagcagtgaaagtgaagactcattctactcatcaatctgcagagaatattcatttgactcttctgcagaggaaaccttgatcaaactcgcagtggatgttcttcctcatgtttctgtctcttccaaaatttga

SEQ ID NO: 6503 - DNA, 147 bp, Glycine max
  Peptide Sequence Number=SeqID_123281
atggtgtctgtccaatttggtttggaggcaaaaacgatggatgcattatgtggagatggaaaagacaatccagccaagtgtagggtgaggaagccgaatcaaatggtgaagcacttggcgtcttcaatctctatcctatctatctag

SEQ ID NO: 6504 - DNA, 1253 bp, Glycine max
  Peptide Sequence Number=SeqID_123282
atggccacgagttactttctattgctctcattattcctcctttcatcatctgtctctcatgcactttccaatgttgaagcttctttcattgttcgtcgccaattattgcacttacacgagaatgatgaattatctgacaactatgcagacaattatgaaacaaatctaactttccccaaccccagactaaaaagtgcatacattgctcttgaggcattaaaaaaagcaatctactcagacccatcaaatttcacagcaaattgggagggcccaaatgtttgctcttataacggagttttttgtgaaaaggccttagatgatccaaagatcgatgttgtagctgggattgaccttaaccatgcagacatcgcaggttacattccccccgagatcggtttgttaaccgaccttgcgcttttccatataaactcaaacaggttttgtggggttctcccaaaaagtttttccaagcttaagcttctttatgagctagacatcagcaacaaccgctttgttgggcgattccctgagcctgtgcttttaattccagacattaaattccttgacctcaggttcaatgagtttgaaggggaattaccttctgagcttttcaacaaaagccttgacgctatctttttgaacaataaccgtttcacgtccacaattcctcagaacatgggatcttctccagcttcagttatggtttttgcctataacaatctcacaggttgtctgccttcaagtattggcaacatgacaaagacattgaacgagtttgttttaatcaacaacaacctcactggttgcttgcctgcagagattggaaagctcgaacaagtttatgtgtttgacataagccaaaacaactttgttggcatgttaccaaggacatttgatgggcttaagaacgcggagcacttatccattggacacaacaagctcacgggttttgtcccacgtaatgtttgcagcttgcctaatttggtcaacttcacattctcttataactatttcaacggtgaggaagaaggttgtgtgcctcctaagaaagatgttgtgttggatgatgagaacaattgcataccaaataggccaaaacaaaaggttgcagacgtttgcaatgtggtgataagcaagcatgtggattgtaaatgtggaagtggaacccatctcattcttccaatcctccaacaacaccatctagcccatcaccaaaatctccatctgaatcacaaccttccagtcctcctaaa

SEQ ID NO: 6505 - DNA, 1029 bp, Glycine max
  Peptide Sequence Number=SeqID_123283
atgttagcttatgacttatttacttataaatttgacgacattgaggagcgaacagcaaagggtacaccaccccttaatgtgaacgtgactcgtgaagaagaagcaactgtagctgatgagaacgccatgcctcagtctcctcccaccacccctacgactacccattcccccctcttattcgctcctcaggttcccgtggttccgctacaaagacctgatgacattcatgttccaagttgttcctggatggagacaacttcagggtatgaagatatgtacactcaagtaggaatcccaacaatgattacttggagttatgatggaaaggaagtagctgtcgagggatcgtgggataattggaaaacaaggtttagatacattcttatattccttcttcatcagaatgcccctgcagagatcagggaaggactttgccttaatgaggtacttccgtctggtgtttaccagtacagatttattgtggatggacgcaagaagtacactccagattcgccttgggcccaagatgatgctgggaatgcttacaacatcttggacttacagaattttgtttcagatgcacatgatcccaaactcatttcagggacatactttttcaataggctaacagtgtgggaaagccaccttattgcggccactcctagcccccaccttaattgcggtctacttctagcctcttcttgtcctgaagacattggaagcatctctagttttgagcctcctcaatcaccagactcaagttatgataacttacatcttagttctgaagattatgctaaggagccaccattagttcctccactcttgcaaatgacactgctaaatgtgcctgcaacaaatatggaaatccaacctcctatgtcaagacctcgacatggagtgctgaatcatctttacacccagaaaggaaagagcagtccttcagtggctggccttggtacaactcatcggtttctagccaaatatgtcactgtggtactgtacaagtcgttgcaaagtaaaccataa

SEQ ID NO: 6506 - DNA, 562 bp, Glycine max
  Peptide Sequence Number=SeqID_123284
atggattctgttcctgttccatccctgtcagcctcctcgacccttacggaagaagtacaagtgactgcattgcagatgattgaactgctaacatctaccactgatgaacatggtggtgttattgtggaaatggacaagcctatggattctgcaacttttgtgtccatcctcagagcttcaatttcacactggaaacaactcggcaatatgggtgtttggataaaatcgcctattcatctagtcagtctagttgaagctctagttaaggaagagggggttcaacatatcttacgtaaaggcaaagttgataaacaaattaacacaaagatgatgatgagctacttttgcggctggcacgcccttgccatcttggtgctaattgcatctccggcagcaggagagaacaaccaccctttgttggagttattatcaagtagagatgaagtggtgcaaattgctggctatggagaggagaagctatcgacagtcctcattacaggctcagttaattgtgaggcaccacatcagcctcaacctcaacctcatgcatggccagtacaag

SEQ ID NO: 6507 - DNA, 522 bp, Glycine max
  Peptide Sequence Number=SeqID_123285
atgagaactgggcaggagtttttgaaggcgttaataggttttatagatgttgctgggctttattttgccttgacccagttgactcacaggaacatctctcagaatcataaatttcaagcagttggacttggctgggcatttgctgactctgtgctgcatcggttggctccactttgggttggtgccagaggattagaatttacttgggattacattcttcagggccttgaggctaatgcaaatttgaagatttctgcacttgcatctgcacaggtgttgagcatatcccttgctgcacttggatctttgatgtggcttcgaaaaaataaacccaagaccctcatccctattatatatttgagtgcagggattgtagcaaccatgccatctatcacaagctatctgaggcgtggattggggtggcactttcccaaagtggtcggttttgagctcttcacatccctggtgatggcttttataagctggcaactgttttctgtatgtcagagaccttcagtgtga

SEQ ID NO: 6508 - DNA, 5073 bp, Glycine max
  Peptide Sequence Number=SeqID_123286
atggctcagttgcaactgaaggagctgggatccaagctcgagacccttcccacctccaaagacgctctcgtcaagctcttgaagaatggaatggaaggaaagaatttgaaatgggaaggaagaagtgtaaatgagggattgcaacattcatgtttatatgcattggatattgaagggcaagcaaccacatgccttgcagagttggaccagtcaccttcgacatcaacattggagtcaatgaagccattttttaatgcaattgttaagccagaattgctgaagcaccaagatagggatgtcaagcttctagtagcaacttgtgtttgtgagataactcggatcactgcacctgaagctccctacagtgatgaaattctaaaggatatctttcagttgattgttggcacttttcgtggtctaagtgataccaatggtccatcctttggccggagagttgttatattggagactctcgcgaaatatagatcatgtgttgtgatgttggatcttgaatgcaatgatctggtacatgaaatgttcagtattttcttcgtggttgccagagatgatcatcctgaaagtgttctgtcatccatgcaaactataatggtggttctcttagaagagagtgaggatgtccgtgatgatcttttatctattctactatctaaattaggtcgtgaaaaaaaaggtgttaatatggctgcaaggaggctggctatgaatgtcatacaacaatgtgcaggaaaacttgaacccatcattaaacaatttttactatcattaatttctggagatagcaagccagtgaacagtcaagtcgaataccatggaattatctatgatctgtattgctgtgctcctcagatcctgtctagaattctcccttacgtgactggagagctactgaccgaccagctggaaatccgtttgaaagctatgaacttggttggtgacataatttctcttcctggatcttccattcccgaagcatttcagtctatattttcagaatttttgaagagattgactgatagagttgttgacgttcgcatgtcggtccttgagcattctaaagtttctttgttgccttttattgttgtcctttatctgctgattttaattgaatcaaacttagctgccctttgtgaacggttgctggatttcgatgaaaatgttcgaaagcaagttgtagctgttatctgcgatgtggcatgtcatgccctaaatgctgttccacttgaaactgtgaaacttgttgcagaacggcttcgtgataaatctctacttgttaaaaagtatacaatggagagattaactgaagtgtatagagttgcttgtgagaagagcagtgacaatgtcaatcctaatgaatacaactggattcctgggaagatccttagatgtttttatgataaagatttccgatctgatataattgaatctgttctctgtgggtccctgtttcctgtagaattttcaatcagtgatattgttaaacattggattgggattttctctggatttgataaagtggaggtaaaggctcttgaaaagatactggagcaaaaacaaaggttacaacaagagatgcagaagtatctgtctttgaggaagatgagtcaggataaagatattcccgaggtccaaaagaagattgttttctgtttcaaagtaatgtcccgttcgtttgctgaccccataaaagctgaagagagtttccagattctggatcaattaaaagatgctaatatctggaagattttgacaaatcttgttgatccaaatacgagcctccatcaatctcgggcctaccgggatgaattgcttaaaatacttggagaaaaacattgtctctatgagtttctgaataccttctctgtgaagtgctcttgtttgctttttaacaaggagcatataattgctcgtttcagtccattgctccttcgtggcagtgaagaggagctggtgaatttactgaaagataataatgatacaattcaggaaggtgttctgaatgttttagcaaaggctggtggtactattcgtgaacaacttgccgtcacatcaagttctgtagaccttatattggagagactatgtttagaaggcagtcggaggcaggcaaagtatgctgtccatgcactggctgcaataacaaaggatgatggcctcaagtctctctctgttctatacaaggtctcgggttcaaattctggagacagcctctctgctttcagtgataaggctgcctatgtctactctctccaaaacccactagatgggagtcttagacttgtagatatgctggaagataaaacacatctgcctgcagtacttcagtctctggggtgtattgcgcagacagcaatgcctgtctatgaaaccagagagaatgaaattgaagaatttatactaaacaagattctaaaaagtgatagtaaagaagataacatgaaaacatcttgggatgataaaagtggtctttgtatgttgaagatatatggcattaaaacatttgtaaagagctacttgccagtcaaagatgctcatgttcgtccagacattgataggcttctggatatccttaggaatattttattgtatggtgaaatatcaaaggatttaaaatcaagttcagttgataaggcccatttgaagcttgcttctgcgaaggcagttcttcgtttgtctagactttgggatcacaagatacctgttgatctttttcacttaactttaagggtgtctgagattagttttcctcaagctaagaagattttcttgagtaaaattcaccaatatatcaaagaccgccttttggatgccaaatacgggtgtgctttcttattcaacatatttggatccaagcctgacgagtttgcagagggtaaacagaacctctttgacattattcaaatgcaccaccagttgaaggcacggcaactttctgtgcaatcagatgcaaattccttgaccacttaccctgaatacattcttccatacctagttcatgcacttgctcacaattcatgtcccaatgttgattattgcaaggatgttggagcatatgatgatatataccggcagttgcacctaatattgtcaatgctactgcaaagagatgaagatgccaagtcagaagtaactactgacaaagagaaggaagttatatctaccatcacttctatctttctgaggatcaagcattctgaagatgtggttgacacatcaaagtcaaagaattctcatgcattatgtgagcttggtttagcaataaccaaacgcttagttcagaaggatgttgattttcaaggattgtcccatttggtttctctacctccattgctatacaaagcatctgagaaggaaggagatgacactttggtaactgaagttaaaagctggttggctgatgaaagtgccttgactcactttgaatctcttgaactagaaacggttcaatcccaatcagcagaggatgaagcttcaaaggatgatgaaaaagacggcaatgaaatacctttgcgaaagatgttaaagaacataaaatctcagggaaccagtgggaaaaaggtgaaaaggaataagtctgtgccagctgaaacaaaaaagactggaaatgattttgacatcttaaatatggtcagagaaattaatgtggataacttggggacccccactaattttgaaccaagtaacggtcatgaccattctctgattaaaaaggaactgaaggatccagaatatgcaacaggtaaaaagagaaaagctagcaaaacaacacctgttccggtgcctaaacgtaggcggtcttcctctgctcatggaaaattgagattatcaactagtatatcaaaggcatctcgaagagtttcaggagtagactcccctcaacccaaattaccgcttgatgaagaagttaaccctgatgcagatagcaaaaccatgcagagaaaaatggtcaaaggaagtgagaaagatttgttattgtcctcattaaaacgaaaagttaagggttctgacagttaccataatgatgagttgaacaaacctgatgagcatgacatgatgagtcctgatagtacacaacaaagtgataagactgtaggaaaaaataacaagtcttccacaggatctactaaaaaggggaaaagaaaaagtatttcaggattggctaagtgcacgacaaaggaaggtgaaattgataccgaagatctaattggctgcagaattaaagtttggtggcctacggataagaattctaatgttggtattttgatgctctgtagattttatggaggcaccatcaagtcctatgaccctttgaaagggaagcatgtgatattatatgatgatggagacgtagaaatacttcgtttggaaaaggagcgctgggagcttattgacaagggccgtaaatctatcaaggtctctgaggatgccaaagagccttcaaagatatcaaatcctgaagagactacaacctctaaagcggatgaaatgtactccggtggatcagatgaggagttgactggaggattcaatgaaattatgacaaaggagaagaaatctaacaaaaatacaaaatcaatttccagaggaaagaggctaaacaaagagaaaaacttccattatacagaagaatcagatgaagagaagcaggattgtagtgggaggctttctgaagatagggaaagtgtcccacaaggtagttctgaagagagagaagtggatgaatcaagtggagctttgagggaaaatattaacggacaagaatttgattctgaagggcatcatgataacagcaaagctgaccgtagtcctagagaaatggagaaatcacatatagagccatcaaaaagtcctgatgatgatgacgacgacacaattgctgagatttctgatgatgtgcctctggtaaacaactcagccgttgcagcactcatagcaaatggaaacataggacggggaagaaaagctcagggaaagaacaatgagcagtttagctattgttatttgtctgtcaagaatgcagcggagttgatgctgtggtacaagtacagttgttag

SEQ ID NO: 6509 - DNA, 336 bp, Glycine max
  Peptide Sequence Number=SeqID_123287
atggcggagataggcttttggatcttaacagcacaagggactcgccggcgagaaaacgacggaagctgttcggcgaggtcgttatggtcaatgttcaagtcgcaaaagggtagtagacacagcgacgaatgcggcacgccgaagcagtgggaggcaaagaagatattggcggaggaacgaggcggcgatggtggcataaatccgatgatggtgcggtcaaggtcggtggcggtgacagtggtgacgacggtaacagtggtttcaagcgacggaggattgagaccgtggacaaaagggagagggtggttctttccgagtccgatgaagactttctga

SEQ ID NO: 6510 - DNA, 391 bp, Glycine max
  Peptide Sequence Number=SeqID_123288
atggcaacctttgcacccttgccagagccagacctatccttaaacataagcccacccttcatttcagattctgatgccaaacaagtgggaataagctgcaacggattaacattaactaccaaaatgctttacaacgatatgtgctcaacctcggattctggtagcagtgaaagcgatttaagccacgaaaatggttttttcctcatggacactgcctacaaccttggccatcatgaaccgactttgagcttaggcatcgaaacagaaaatttgaatccttatcctgtccaacaaggagcactctcgagaaacaacttcagtcatcacctccacaactaccaacctcacaccaatacccttgatttcaagagaaatgctagagtcattcatg

SEQ ID NO: 6511 - DNA, 144 bp, Glycine max
  Peptide Sequence Number=SeqID_123289
atgatgaaagctaacagcgatattctaaccccaaaatgcaacatggatagacgctggtcgcagagcagggagaatgaaatcagagcatacgtagacctaaattcactcgtcaatttattattcatggtccaacaaggaccgtag

SEQ ID NO: 6512 - DNA, 1647 bp, Glycine max
  Peptide Sequence Number=SeqID_123290
atggcgttcttaatcaaacgggctacagcaggttctgctcgcaagccaccggcagcatccggtggctggcctttgatcggtcatcttcacctcttgggtggctccggtcagcctctttacgaaaccctaggaacgttagcagacatgtatggcccaatattcagcatccgaattggtgttcaccctgccgttgtggtgagctcttgggagttagcaaaagagtgtttcaccactcttgacgtcactgtctcctctcgtcccaaattcaccgccgcaaaaatcttgacatacaactatgctagtttcgcgttcgccccatacggagatttctggcgcgatatgcacaagattacggtttcagagctactctccactcgccaggctgaaatgcttcgaggtattagagattccgaggtaaagagctcgttgagagaactacagagagcgtgggcggagaaaagaggcgtgtcctctggtgatttgttggtggagatgaagcagtggtttggagaaatgaatctgaacgtgattctgaggatggttgctggaaagcgatactgtgtggggagtgtagatcaggaacaggcaaggcgagttcggggggtgctgagagacttctttcatttgatggggtcgcttgtgattggggacgcgattccctttcttgggtggcttgatttgggaggtgaagtgaaggagatgaaaaagacggctgtagaaatagataacatcgtttctgaatggttagaagaacataagcagctgagaagagattcaagtgaggccaaaacagagcaagacttcatgggtgcgttgctgtctgcacttgacggtgtcgaccttgctggttatgatgctgacactgtcataaaagccacatgctcaacgctaattgctgcggcaacggatactacaactgttaccatgatttggacactatcgttattgttgaataatcgtcacgccttaaacaaagttcaagatgaattggatgagcatgtgggcaagggaagactagtgaatgaatctgatattaacaaattaatataccttcaagccgtagttaaagaaacgatgaggttgtatgcagctgcaccacttccaggtccacgtgaattcacaagtgagtgtaccttaggtggctaccgtatccaagcaggtaccagatttattttgaacatttggaagatgcagagagacccacgtgtatggtcagacccattagaatttcaaccagaaaggttcctcacgaaccacaagggtgtggatgtaaaaggtcaacattttgagctacttccctttggtggtggaagaaggagaaacgagaaggcatcggaaaatgttgaaaatcctcccttgctttccatccatttagctcgtgaaaatattatgcagtggcagaaagtttgcgaaccacatttgaatccagcagctaattttccccacctgattctcaatggacaaaccgaatggagggatttatcaaatgcaatgttggtgctgccatattcagggagtcctatacctattctggtgcttgctcgagaaataatgagggtcattatatcaaatagaaaatgtggtggaattatggtttttcatctgttcaagaggctgaggctgcagcattacttttgcatgctttaa

SEQ ID NO: 6513 - DNA, 651 bp, Glycine max
  Peptide Sequence Number=SeqID_123291
atgaagaagactgccaaggacttggattacatacttgaagggtggctgaaggagtaccgtgaccaaggagtggatggtggagttaaggcagaggccgtagacctggcaaccgggtggaacaggggcgggacgcatattacctctcaagtttccatcttgacttccgaacatatttcatatccatctcccaaagataacaattatcaaggaaaccttgcggctatacccagagctggtcccctcctaggaccaagggaggcccaagaagattgcaatgttgccggctatcatgtccctgctgggacccgcttggtggttaacctgtggaagcttcatagggatccaagggtgtgggaagaaccttctgcttttagacctgagagatttctcacaagtgatgctgttgatgtgagaggccaaaactttgaactcattccctttggctctggtagaaggtcatgccctggcatgtcctttgcactccaagttcttcacttgacactggctcgtctgcttcatgcttttgaatttgctaccccatcagatcaaccagttgatatgactgagagccctggtttaacaatgcctaaggcaactcttttggaggttcttcttacttcacgccttccagccaaattatatgcctactaa

SEQ ID NO: 6514 - DNA, 528 bp, Glycine max
  Peptide Sequence Number=SeqID_123292
atggtcgatgcagttgtggttgcaagtgtagacttcaaaaaccatggggcaactccgaagtcagtgttagagttaatgaatgttaaggatctaactctatctcacgtgaagagtcacttgcagatgtatagaacagtgaagagctctgacaaaggcagcgcaggttatgggcagacaggtataggattgagccaaaagccagggattgtcgatctgcatggagtcttagcttgcgagagacccgatttaccacagccactgctaaaattccaaagggcgtcatggcaatcatcaaaagagacaaattcaataaattatacacagaaccccataatcaattcgatgtattctcatctcaaaggaaaccaaaccatggtgggtggacagcattatggaggcctgtcaaattgcatgaaggagaaattggattcttgctctttgtcacgttccgatatgacgcttgacctagaatttacccttggaaggcccactagttgcaaacagaccacgcggaatcaagagaattaa

SEQ ID NO: 6515 - DNA, 2106 bp, Glycine max
  Peptide Sequence Number=SeqID_123293
atgaaacgctcaaacgacgacgtcgccgcccccgtctcaaccgccaagccagtgttcttaaccaaagcccaacgcgagcaattggctctccagcgccgccacgaagacgtcgccgaccagaagcgccgccaggaacagctcctctcccgcaaccactcctccgaccgcgacagagacagagaaagggacagagaccaccgagaccgggaccgtgatcgtgaccgagaccgggacagggacagagaacgcgagcgcgagagggcacgcgatcgggaccgcgaagccgaacgccgcaacagagagagggagcgcgaagaggagacccggtcccgtgaacgtgcccggttggagaaactcgtggagcgtgagcgcgagaaggagctggaatccatcaaggagcagtacctgggttccaagaagcccaagaagcgcgtcatcaagcccagcgagaagttccgtttctccttcgactgggagaacaccgaggacacctcgcgcgacatgaactccctttaccagaacccccacgaggctcagctcctcttcggccgcggcttccgcgccggtatggaccgccgcgagcagaagaagctcgccgccaagaacgagaaggatatgcgcgatcaaatccgcaagaaagacggcatcgaggagaagcccgaggaggccgacgcccagcgccgcaaggaggccgccgccgatctatacgacaccttcgacatgcgcgtcgaccggcattggagcgagaagaagctcgaggagatgacggaaagggattggcgtatcttcagagaagactacaacatctcctacaagggttcgaagattcctcgccctatgaggagctggaatgagagcaaattgaccagcgagctcctgaaggcggttgagaaggctggctataaaaccccttctcctattcagatggctgccattccgcttggtttgcagcagcgtgatgtcattggcattgccgagaccggttccgggaagaccgcggcttttgtgcttcctatgctgagttacatcacccgccttcctcccattagtgaagacaacgaggctgagggtccctatgctgttgtcatggcccccactcgcgagctcgcccagcagattgaggatgagaccgttaagtttgctcagtatttgggcatcaaggtcgtctccattgttggtggacagtccattgaggagcaagggtttaagattaggcagggctgtgagattgtcatcgccactcccggacgtttgattgattgtttggagcgccgctatgctgttctcaaccagtgcaactatgtggttcttgatgaggccgatcgtatgattgacatgggttttgagccccaggtgatgggtgtcctcgatgccatgccttccagcaatctcaaaccggagaatgaggatgaggagcttgacgagaagaagatttaccgtaccacctatatgttcagcgccaccatgccgcctgctgtggagaggcttgctaggaaatatttgaggaaccctgttgtggtcaccattggcactgctggaaaggcaactgatttgatcagccagcatgtgatcatgatgaaggaggctgagaagttttacaagcttcagaggttgcttgatgagcttaacgacaagactgccattgtgtttgttaacaccaagaggaatgcggatcatgttgccaagagtttggataaggaagggtatcgcgtgactactttgcatggagggaagtcgcaggagcagagggagattagtcttgaagggtttaggaccaagagatataatgttcttgttgctactgatgttgctggacgtgggattgacatacctgatgtggctcatgtcatcaactatgatatgcctgggaatattgaaatgtacacgcaccggattgggcgtactggtcgtgcaggaaagacgggtgtggctaccacgttcttgactcttcaggactctgatgtcttctatgacctcaagcagatgcttattcaaagtaacagtcctgttccacctgaactggcaaggcatgaagcttcaaaattcaagccaggaactattccagacagaccacctagacgaaatgacactgtttttgcgcattag

SEQ ID NO: 6516 - DNA, 1608 bp, Glycine max
  Peptide Sequence Number=SeqID_123294
atggacctgcaatatcccttcttactatcaacaccatcatttaccatcttcttcgggctgctcttatttctctttgttctttcatccatatggagaaggagcagaacccgcacggctacaaccagaaaatcaccaccagaagcaagtggtgcgtggcctttgattggtcacctccacctctttggtgcctcaaaaccacctcacgttacgttgggcaacatggctgacaaatatggccccattttcaccttgcgtctcggtgttcacaaaacgctggttgtgagcaattgggaaatggccaaacagtgctttaccgtcaacgacaaagcgtttgctagccgtcctaaatcagtggcctttgaagtgttggggtacaacttttccatgattgggttcagcccctacggttcttattggcgtcacgtgcgcaaaattgcgacgctggagctcctctcttctcaccgcatagacatgatcaagcacgtgatggagtcggaggtgaaggcagcagtgaaagaaatttacgatatttggatagacaagaacaagagtggttcagaaaaggtaacaactgagatgaagagatggtttggggacataatgctaaaggttatgttcagaacggtggttggaaaacgttttgttttggagactgaagagaacgaacggatccgaaaggcaatgagggacttgtttgatcttagcggttcattctctgtgtctgatgctctgccatatttgagatggtttgatttggatggtgcagagaagaaaatgaagacaacagcgaaagagttagatgggtttgttgaagtttggctccaagaacacaaacgcaacagaaataatagtggttcgggtcaagagaaaggtaaccacgacttcatggacttgcttcttaaccttgttgaggagggtcaagagtttgacggtcgtgacggcgataccacgatcaaagctacatgcctggcattaattttagcgggcatggatactacagcagggacaatgacttgggctctctcattacttctcaataatcatgggatcttaaataaggttgtccatgaattagacacgcatattggaacggaaaagatggtaaaggtatcggatttgaagaagctagagtatcttcaatctatcattaaggaaacattgcgcttgtacccagttggaccacttagtttgccacacgagtccatgcaagactgcactgtgggtggatatcatgtgcctagtggcactcgcctcttgactaacatttcaaaacttcaacgagatcccttattatattccaatcctttagagttttgcccagagagattcctgacaacccacaaggacatagacgttaaaggtcaacattttgagttgattccatttggtgcaggtagaagaatgtgtccaggactctctttcggtcttcaaattatgcaactaacactagctactctattgcatggatttgatattgtaatccatgatgcaaaacctacggatatgcttgaacaaattgggctaaccaacatcaaggcctctccacttcaagtcattcttacaccacgtctctctacttatatttatgatgaaatttatatagtctaa

SEQ ID NO: 6517 - DNA, 1329 bp, Glycine max
  Peptide Sequence Number=SeqID_123295
atggcactgaatatttttttaattaaagctttatgtgtagaaaagaacttcattataagagttaattgtaagaaaaataggagtggagacttgtttgacatttggactaaagaaaagaacttgtccgtccaaatcccgaaagatagattaaaaggccgtctttcctcatttctgacgtacgctccccatccatccatgtctacttctgcaaaatcccgagatgtttgtattgttggtgttgcgcggacgccaataggtggtttacttggcaccctatcatctctttctgccacagagttaggctcaattgctattaagagtgctctcgagagagcaaatgttgatccatcgcttgtgcaagaggtgttttttgggaatgttcttagtgccaatttagggcaggctcctgccagacaggctgcattaggtgcaggaattcctacatctgtaatctgcactactattaacaaggtctgtgcatcagggatgaaagctaccatgcttgcagcactcaccatacaatttggtctcaatgatgttgttgtggctggtggtatggaaagcatgtctaatgcacctaagtaccttgcagaggccaggaaaggatctcgatatggacacgataccatcattgatggtatggtcaaagatggcctttgggatgtctataataactttggcatgggtgcttgtgccgaactatgtgcagatcagcatgtcataacaagagatgagcaggattcttatgccattcgaagctttgagagaggaatatctgctcaaaatgctggtcattttgcttgggagatagttccggttgaagtttccactggaagagggagggcttccacaattgttgataaagatgaaggtctggggaagtttgatgctgcaaagttaaggaagcttagaccaagctttaaagaggttgggggttctgtgactgctggcaatgcttctagcataagtgatggtgctgctgcattagtgctagtgagtgaagagaaggcacgtgagcttggattgcatgtaattgcaaagataaaaggatatggggatgcagctaaggttgtagctcttgcaaatcagaagcttcttgctcttaatcctgaaaaagttaacgtgtatggtggagctgtgtcattggggcatcccttgggttgcagtggagctcgcatcttagtcacattattagggatttttgtgatctgtggatatctcagccaagttgtattacaggtattgagacagaagagagggaagtatggtgttgctgccatctgcaacgggggaggaggagcatctgctcttgttcttgagctcatgtaa

SEQ ID NO: 6518 - DNA, 897 bp, Glycine max
  Peptide Sequence Number=SeqID_123296
atgggggttggttcccaggatgccatcaagcagttccaggcattcattgaccaagttgaggagcctttgcgaacaacgtttcagcttctccttttccctcctttggaacttcgtaactttaattgccagaatgttcatcaagggtttgtcaccgaaactttaatgcggtttctaaaagcaagggactgggatccttgcaaggcacataaaatgttggttgactgtttaaattggagggtgcaaaatgagattgacaatatattatctaaaccaattgttcctgctgatttatacagagcggtgcgtgattcacaactcataggattatcaggttactcaagagagggtctgcctgtctttgcaattggtgttgggcttagcacatttgacaaagcatctgttcattattatgtgcagtcacacattcaaattaatgaatatcgtgagcgtataatcttgccttctgcatcaaagaagcaggggcgacctattaccacttgtataaaggttttagacatgactggtctgaagttatcagccctgaatcagattaagttgctaactattatatcatccattgatgatctgaactaccctgagaagacaaatacttattacattgtaaatgctccatacatattttctgcttgttggaaggttgtgaagccacttttacaagagaggacaagaagaaaaatacaggtgttaccaggttgtggacgagatgagctattgactataagagcatgtggtgccataaacttatctttaaaattctgtcatttctttcaaccacatgcttgcactttacattgcaataaagccccttaccctccttacacagttgcacttcacggtgcctttgaaactagttggaaaatgtttcaaacttcctag

SEQ ID NO: 6519 - DNA, 1765 bp, Glycine max
  Peptide Sequence Number=SeqID_123297
atggcgcagaagcctcactttcagctcgaggagctgggatccaagctccaatctataccctccgatgacaacgttctctccgagcttcttaagcaagcagcagcatgcctaactgacttggatcaatcacaatcggcttcaacattagagtcaatgaaacccttttttggtgcaattgttaagccagaattgctgaagcaccaggatagtgatatcaagcttctagttgcaacatgtctctgtgagataactcgaatcactgcacctgaagctccttacagtgatgatgttctaaaggacatttttcagttgattgtgggcacttttagtggtctgagtgatacaagtggtatatcctttgaccagagagttgctatactggaaactcttgcaaaatatagatcatgtgttgtaatgttggatcttgaatgtgatgatttggtgaatgaaatgttcggtactttctttgtagttgtcagagatgatcttccgaaaagtgttctgtcatccatgcaaactataatggctgttcttttagaagagagtgaagatgtccatcaggatcttttatctattctactgtctatgttaggtcgtggcaaaactaatgttactggggctgcaaggaagctttccatgaatgtcatacagcaatccatggaaaaacttgaaccgtgcattaaacaatttttgctatcattaatgtctggagacagcaagacaatgaacagtcaagttcaataccatgaagttatatatgatctctattgctgtgctcctcagaccctatctggagttcttccttatgtcacagaagagttaatggctgatcggctggagacacgtttgaaagcagtgaacttggttggtgatataattgctcttcctggatcctccacttctgaagcatttcagcctacattttcagagtttttaaagagattgactgatagagattttggggttcgcatgtctgtccttgagcatgtaaagaatagtctgctgtcaaatccttcaagggccgaagctcctcaaataatctctgccctttgtgaccggctactggattttgatgaaaactttcgaaagcaagttgtggatgttatctgtgatgtggcatgtcataccctaaatgcagtccctcttgaaactgtgaagcttgttgctgagcggctttgtgacaaatctctacttgttagaaaacataccttggagagattggccgagatttatcgagttttttgtgagaatagttccattgcagttaatcccagtgaatatgactggattccaaggaagatcattagatgtttctatgacaaagatttcagatcagatataattgaatctattctatgtgggtccctgtttccatcagagttttcaatcaatgatatagttaaacgttgggttgagattttctctgggtttgataaagtggaggtcaaggctcttgaaaagatacttgaaaaaaaacaaaggttacaggaagagatgcaaaagtatctagctctgaggcagattagtcaggaaaaagatattcctgaggcccaaaaaaagatcgggttctgtttccgtgcaatgtcccgttcatttgctgatccaataaaggctgaagagagtttccagattcttgatcaattgcaagatgctaatatctggaaaattttgacagatcttgttgatccaaatactagcttccatcaaactcgtgtatacggggtaatatcatctgaaactgatagatatggttttggagatactg

SEQ ID NO: 6520 - DNA, 1389 bp, Glycine max
  Peptide Sequence Number=SeqID_123298
atgcagataattgctcgtttctgtccagatctttttagtggcactgaggtggagctggtgaatttactgaaggataataatgatatgattaaagagggtgttttaaatgttttggctagggctggtggtaccattcgtgaacagcttgcagttacatcaagttctgtagaccttatgttggagagactatgtttagaaggcagtcggagacaggccaagtatgctgtgcatgctctggctgcaacaacaaaggatgatggcctcaagtccctttctgttctgtacaagagacttgtagatatgctggaggagaaaacacatctacctgcagtattgcagtctctggggtgtatagcacagacggcaatgcctatatttgaaactagagagagtgaaattgaagaatttataataaacaagattctgaaaagtgatagtaaagaagaccactcaagaatatcttgggatgataaaagcgatctttgtgttttgaagatatatggcatcaaaaccatagtgaaaagctacttgccaatcaaagatgctcatgttcgtcctggtatagatggtcttttggatatcctgagaaacatgctgtcttatggtgaaatatcaaaggacttacagtcaagctcagttgataaggcccatttgaggcttgcttctgcaaaggcagttcttcgtttatcaaggctttgggatcacaagatacctgtcgatattttccacttaactttaagagcaacagagattagcttccctcaagctaggaaggttttcttaagaaaagttcataaatatataaaagacaacctgttagatgccaaatatgcatgtgcctttatattcaacatatttggaaccaaggattccaagtcagaggagtttgcagaggacaagcagaacctggatgacattattcacatgcattaccaagcaagggcttggcagctttctggacaatcagatgcaaattccttgaccacttaccctgaatacatccttccatacctggttcatgcccttgctaacatatcctgccccaaaattgacgagtgcaaggatgttggagcatatgaaaaaatatacaggcaattacacttgatactatcaatgctaatgcaaagagatgaagatgataagtcagaagtagctcttaacaaagagaaggaaattatatctaccattgcttctatcttttggagtattaagcagtctgatgatgtggttgatgcatcaaaatcgaagaattcgcatgccatatgtgaccttggtttagcaatcactaagcgactagtacagaaagatgttgatttgcaaggattgtctccttcagtttctctacctccaatgctatacaaagcttgtgagaaggaaattgaccccatg

SEQ ID NO: 6521 - DNA, 1650 bp, Glycine max
  Peptide Sequence Number=SeqID_123299
atggttccatctcaattagctgaggatgatgctttaaagggcagtgaaagagacaaaaatgaaatgcccctgggaaaaataataaaggacataaaatctcagggaactaagggcaaaaaagtgaaaaggaaaaaggctgtgccagctgaaacaaaaaaggccgaaaatgatattgatatcttaaatatggtcagagaaattaatatagataacttgggattatccactaattatgaatcaagtaacggtcatgaaaattccctgagtaagaagttgcaaaacgatccagagtgtgcaacaattaaaaaacgaaaagcagaagtaaccctggttccagtgcctaaacggaagcggtcttcctttgcccatggaaaatcaaggtcaagtagtactccaccaaaggctcctccaagagtttcaggggaagactcttctggagtgaagttgccgtcaggtgcaaaattcaaccctgatacacatagctcagcaatgcaaaggaaaaaggttaaagacaatgaggcctcaataaaagcaaaagttaaggcctccaagagcaatcatgacgatgactctgacaaatctgaagagcatgacatgaagagtcctgataatacaaagccaactgacaagtccaaaagtaacaatctcaagccatccataggatctactaaaaagctgaaaagaaaaagtattggaggattggctaagtgtacaacaaaggaaggtgaaagtgatgctgaagatctaattggctgcagaattaaagtttggtggcctttggataagaaattttatgaaggcactgttaagtcttatgactctttaaagaggaaacatgtgatattatataatgatggggatgtagaagttctcaatttggaaaaggagcgatgggagcttagtgacagcaaacctactaagaagctaaagctctcaaaaactgtctcttcccctgaagtgtctactgggaagaagcagagaagttctagtggttcagcaagtaaaaagacaaaaaaaatagttaatggtaagaaatctccaagcaaccatgtaaaacatggacaaaaaggtgcctcaaaaactaattcccataatgaggatgccaaagagagttctgagttatcaaaccctgaagatatatctaaagctgagattaactcaggtggttctgaagcagaacaggctgaagggtctgatgtaattgtaactaagcagaagaaatctaacaagaaaccaaaatcagtttcacgaggaaagaaacttaaaaaagagaagagcttgaggtataagaaagagtcagatgaagagaagcgggaatcagaccaagagaagcaggatcatggtgagaggcttgctgaagagaatatcccacaaggagatcaaaatgatgatgcagaaagtagttcaaaagagacagatggcaatgaatcaagaggagctttgagagaaaatggtaatgaagaagaatcaggttctggagggaatgaaaatgacagtgatggggaaaaaagtagtcctagagaagtggaaaaatcacctatagagtcagcaagtcctgatggtgccaaaattgctgaagtttctgatgacgagctgctggtaaattgctcatcctttgcggaattgtggcacctacttttatttacttga

SEQ ID NO: 6522 - DNA, 549 bp, Glycine max
  Peptide Sequence Number=SeqID_123300
atgcccaacagcctcaagaccaatgactttacgggaacgccaagaggtgcccagtcaaagtgggaaatccacctgaggaacgtggagctcgttagagctccagcggaggcagtggcatcgggagttctattccaacatctacgagccagaggacagggctccaaaatactgcaaggtgtggggcatatcaccaggttcaatgcgaagaccattaatgatttcctggacaccccggtcgctcttgctgatggaaaagactatctggtggactccaaatacctgcacacgtacccgaatcaccaagccattgtgccaaagttatgcatacctggaggaggatttgtcctgaatgccaacagggccccttggaagctattacggaaggatctcactaggctcgctcagacatggagcatactttcttattttaaccttgcccttacttctcatacttctgatctcaatgtcgacagggcaaggcttatatacgggttagtgatgaagatggacatggacctgggcagcttcattttaggacaaatcatgtag

SEQ ID NO: 6523 - DNA, 312 bp, Glycine max
  Peptide Sequence Number=SeqID_123301
atgccaacaaagaggagccttgtggaactcacatctcaagatgcaacgcttgcccaaaacaagctattggctcgacagatagaggccttgatgaagaccctcaacaaactccctcaacaacgacaagcggacagtgaactacttgggagctcagaattgccatgggttccaaggctacaaccaatgaagaccgccgggattcaaccaagggaggaatttcacacaaggctcaagctcgaggaatcatttggggaaccagttcaacaaggagcaaagaagtcaacttggccagaattccaaccaagggattga

SEQ ID NO: 6524 - DNA, 1191 bp, Glycine max
  Peptide Sequence Number=SeqID_123302
atggatgtgttgaagctgaaggcggtatcggaagagaaccctagcgagactgtgaaaagggaaacggaagcgacgtcgtttacattcagaggattgactgagttgacttacagtggatatcagcctcatgcatattcttgggatgattatccacgacttaaaaacatgttggatgctgtctataaagctctccctgggagtagttttaatagcttactcttaaataggtacaattgtggtaatgactatgttggttggcattctgatgatgagaagctttatggacggacgcctgaaattgcatctctaacttttgttttgaagaagaagccatgtaaaaaatctcgtgatggaagtggtgaacctgccagcaagagattaaagaagggtagccatgatgctgatcagcatacatttagacttaggcatggatcccttatggtgatgagaggatatacccaaagagattggattcactctgtgcctaagcgtgcaaaagctgaagctacactcattaaccttacctttagaacaaaggttgtctttggtgaagttaatgatgataaagttaaactcttcagcttagagggcttagagaaggccactgacaacttcaataagaatagggtacttggaaaaggaggtcaaggaaaaggaatgttaatagatggaaaaattattgcaactgaaatttctttgcttgtttatgaattcatccctaatggtaacctttttgagtatttgcatggtcaaaatgaggatttaccaatgacatgggagatgcgtttgagaattgccaccaaagtagcaggagctttattttacttacacttagctgcttctcgacctatttatcacagagacatcaagacaacaaatatactattggatgaaaagtatagggcaaaagtagcagactttgaaaagagtgtctacagctttggagtagttcttgttgaactcttaacagggcaaaaaccaatatccctcctaagaccagaggaagccaagagtttagtcatatttcattctttgtatggaggaaaatcgtctttgaatgggaagaaaccaccaactatgaaggaagtcacaatggaattagaaggaattcgaaaattggaagggaagtctaatacactagaaagacatgatgatcttgagcatgtcccaactgaagactatcaaatataa

SEQ ID NO: 6525 - DNA, 1569 bp, Glycine max
  Peptide Sequence Number=SeqID_123303
atgaatgtgctggaaaaggagactcagcttctcttggcccaaagagaattaaacaaaataaagaaacagctagaaagtgctgagaacacaaaatccaaagccctctccgagcttgataaggccaatgtgacccttcaggaattgacaaagaagctcaacagtgtgagggaatctaaacaatcagcaatagaagctgctgaagctgtgaagaatcaggccaaagaacttgaacaggcactatcccaaaaagctataggatatgaagcatggaaacaagaactagagcatgcaagaaaggagtacacaacaacagtgaaggaactagatgcttccaagcaagaactcaacaaaataaggcaggattttgacacagctttggaggcaaaactggctgcattccaaacagcaggagaggctcaacgttccgcaaaattgaacacagaaaagctccatgaactcaaaaaccaagttgcaaccatgaaagaacaaattgaacatttgaagcttgcctcatcacaagcccaagaagatcaggcaaaggccatggaagaaagagaagcacggctaagtttctacgaaaatgccaaggaagaagcacagaataaattaattgcattgaagaatgagtatgaacccgaactaacacaaagccttgaggccaaacttgctgaaacaagtgaagagattcaggttctccaaaagcagatacaagaggcacatgcttctgagatggattcagtgagactaataactttggagatcaaagaagcaacaaaaacacttcaagaagttgctgaagaagaatcttccctgagagacctagtggattcccttaggaaagaattggaacaagtgaagaaagagcaagaggaactcaaggagaaggaaaaggcagcagaagctctagctgttgacctaactgatcaactacagagtaaaccagaagagacaatggacaaagaatctgataacattgatgagatagaattgaagatcaaacacctttcatttgagacagaaactgcaagaagggaagaggaagaaatgagatctaaaacacaagagctgaagcaagaggctgaaaaatccaaagcagtggcagaagaactagagaaaaaactagagctttacctgaaacaagctgaggaagcaaaagcagcagaacaaagagccattgaggagatgaagatgatgtcagacagtgacaacacccaagacacagtctcagttgcagattccaatgggaagattgtgttgacagttgatgagtttgcagcactgagtgggaagatcaaggaatctgaagacttgattgacagaacagaaacagcagtaatggctcaggtggaagcaatcaacacaagaaagaatgaagtggacagaaaggtggaggcaaacctgaaagcaattgaggaaataaaggctgcaacagatatggctctgaggaatgcagagatggcggattctgcaaaggttgcagttgagggtgaactaaaaaagtggcgtcaagaagaacaaaacttggattactcagacaattcctcaagaccaatctctctgcgtatttag

SEQ ID NO: 6526 - DNA, 930 bp, Glycine max
  Peptide Sequence Number=SeqID_123304
atgggccttgtttcccaggatgccctcaaccaactccaagctctcatggatcaagtgctacttgaggaggagccactgcagagaacgtttcagaatgttcatcaaggatgtgtcgccgaaaccttaacgcggtttctaaaagcaagggagtggaatgctaccaaggcccataaaatgatagtcgattgtttaaagtggagagtacaaaatgagattgacaacatattatctaaaccaataatccctactgatttatacagaggcattcgtgattcacaacttataggattgtccgggtactccagagagggtctgccagtctttgcaattggtgttgggcttagcacatttgacaaagcgtctccttcagcatcaaagaagcatgagcggcctattaccacatgtgtaaaggttttggatatgactggtctgaagttgtcagccctgaatcagataaagttgttaacaataatatcatccattgatgatctgaactaccccgagaaaacaaatacttattacattgtaaatgccccatacatattttcagcttgttggaaggttgtgaagccacttttacaagagaggacaagaagaaaagtacaagtcttacaaggttgtgggcgagatgagctattaaagatcatggattacacgtctctgccacatttctgtagaagagaaggctctggatcatcaagacattcagagaatggaaatgaaaattgctattccgtggatcatcctttccataagcagctctacaactacatcaaggagcaatccagaatccatgaagctgttgaacccatcaagcagggatcgttccatgtagattttcccgaacctcctgccgagaaagcagagattgtcaagactttagagtctgagctacacaagtttaagatcagcaatgagaatggtgattga

SEQ ID NO: 6527 - DNA, 375 bp, Glycine max
  Peptide Sequence Number=SeqID_123305
atgcaagaggaaaatgaagatgaagaatcggaagatgaagaagacttctcactttttgtgaagaagtttcacaaatttgtcaagaatagaagaagcgagaggcgtcaaaatttcaaccatggaaaaagatatcatgaaggctctccaactcttagatgctacaagtgcaatcaacttggtcacatcaaagcaaattgcccctcaaacgagcaatggcctaagaagagtgataagaaaagtcatgaagaaagaaagaccaagaaggctgacatcgcttgggatgacaacaattcatccgaagaatctaaaaaggaggaaatcaaccttctaacaaaagactatgagagtgaagaggacatcactcaaaggggctaa

SEQ ID NO: 6528 - DNA, 255 bp, Glycine max
  Peptide Sequence Number=SeqID_123306
atgtttgagcacaatttgtcattcactgttgagcttccaaactccactttcaccttcattcatcatgtgcaacccatcactaaagagggaggcacactgaagttcttcagaatagctcatgctgaaagagaaaccaaaatatgcaaaatccttggagagaacctttataggaagtatgatgacgctttcttggataattcatctaataatgaatctggagatgagttctttcgcaagcttgaagaggaagaataa

SEQ ID NO: 6529 - DNA, 678 bp, Glycine max
  Peptide Sequence Number=SeqID_123307
atgtcttctacaacgaagtttttaacatttgaggaaagacccgttaagggtgaccaattaagctcccaagtggagaataatcatttacaaaactcaaacttcgtttcatccattgatggcatatttccaaagggttgtaatccatctttcatcactttgatccctaagctaggtggacaatccataagacctagaattaagaaggtactcccaaaggtcattgacaagagacaaagtgttttcttagaaaataggaatctcctacatagtgtagtggtggcgaatgaggttgttgatgaggcagggaggaagaataaaagtagctcaactagaaaattcaatttacaaaggaagcttcaacaaggtcatccactggcactgtttcttttcatggtagtggcagaggatttgaacggaattatgaggatgaccacttccaaatgtctattctcgggatataaggtagtgaagaggttcgagagtattatgagggagttttgtgggagtaagaagggtgagcaaaatgaaatagcttgggtgagatggaaagatgtgtgttgtcctagaagtcatggaggtttgggtataaaggacttaaaactgtttaatgaaactctattagctaagtggaggtggcatttgtttcaccaaagaaacactttgtgggtgatgtcttag

SEQ ID NO: 6530 - DNA, 249 bp, Glycine max
  Peptide Sequence Number=SeqID_123308
atgctagggtacaagggcgatgacgagtacgattacctcttcaagctggttctgatcagcgattctggtgtggggaagtccaacctactttcgcacttcaccaggaacgagttcaatttggagtccaagtccaccataggggttgagttcgccaccatcggatttttgttcaagaatgaaatcttattggaactgtccagttcaccctttggaaccatatcacatcccggatatgatgaaataggatga

SEQ ID NO: 6531 - DNA, 552 bp, Glycine max
  Peptide Sequence Number=SeqID_123309
atggttccaaagggtgaactggacagttccaataagatttcattcttgaacaaaaatccgatggtggcgaactcaacccctatggtggacttggactccaaattgaactcgttcctggtgaagtgcgaaatcagagaatgttcaatcgagattgatgagaggttgattcgagggacggaaaaggtagaggaaggtccaagaggcaaaaaggccaacaaggaggatgagagagaaaggattagtgaggaaagagactgcgaggatgaggtggctttggagaaggactcgagttttgagaacgtagagcgggaggtggataggttgttgatgaagtcgcggaaggctaggttgttcgccgaagccttgatggcatcgctgcctgcattggtggttcccgtggaggtttgggggttggagatggggaggacgggaggcacggtggaggacatgatgggaagagcttattcaaagatgatcaaaatgaaaagaccgtctttgtattaccaatacaactacaacggtcaacgcggaacccgtcgttgtactctttaa

SEQ ID NO: 6532 - DNA, 1002 bp, Glycine max
  Peptide Sequence Number=SeqID_123310
atgggagaagatccacagaagctgaagcgactagcggcggattcctacgactacgacaacgactctcgatggcctggttactggaacaatgttctcattcctccccacatggcttctcgcgacgacgtcgtttcacacttcaagcgcaagttctaccagcgctacgttgatcctgaccttgtggtggagccaatgtctgttggtggcagttcatcccaaccgacacgttcatcaactacgtcatcgtcatcatcgcccccaacaaataatcaacctcgtgcaagaagttctggatcaactaatagaacttcagggacatccacaactgctggtccaggtcctagtccaacacctttgcgttgggatcggcagacagttctattttctgtctatgcttgggtgtttgttgtggctttccttgcagccattccgctggtaccaaagcatctttctcatagggcttatcgcctttgtttcctgggcactctttgctcttctttgtactcattgtactcgcaatatgggaagccaagagcatggaatttgcaggccttgcaagtttactttcagtcaatagttgcttcaaaggattttatatacttcatctactgccttacatttgttacatctcatctttgccttaaatttgctttgatccccatcttgtgttggtcttttgaacatgttgccaagttccttagacgtaatttcagtcgctctaccttattttcagtaacatacaaagaaaatagtgttcctagaagaaacaacattgctctcattaaacatggactagtcctgtcctctatctcagaagtacttggaagagccttgtgtttgggtggagtcaaacaattctaccctcaatatactgacatcgcatgccgagattggacttggattcttgctgatcatctcattgttctcgtggcagcggaacataatacaaacattcatgtactggcaggtttgtttccttgtcatagaactggttcagaataa

SEQ ID NO: 6533 - DNA, 324 bp, Glycine max
  Peptide Sequence Number=SeqID_123311
atggtcatcgatttggagcggtggcgggagggggattacacgacaaaaattgaagagtggatggagctgcagaagaggatgaggatctatgacttgggttccttgccgccgtttttgcttgtctttgctgggaacattgcttccgttgatcataggtggaaccagcacggcctcggtggggacaactttcgtgggctttgcagagatctgcaccctggtcctgttagtctcttgcattggagtgggaaagattcgtacagatttgaagtgaacacaaggcaacgcagattcaaacggggaggaaaagagattcgtgaattttga

SEQ ID NO: 6534 - DNA, 1782 bp, Glycine max
  Peptide Sequence Number=SeqID_123312
atgaagttcatgaaacttggaacaaaggcagatactttctacactgaacaagctaccaggactctgatatcagagatagttgtagaccttgtgatacaaatcaatgatattacttatttgttacacaagctgcagtttccgcttcttccaaaatgtggcctcctacaaaggttttgctgtgatacaagtgattctgagagtgtctctctagagcttcatgatatacctggaggagaagacgcttttgaactctgtgccaagttttgttacggaattgcaatcaacataagtgcccataactttgtatccgctctctgtgctgccaagttccttagaatgaatgattccattgagaagggaaactttgtaggcaaacttgagtctttcttcaactcatgcattcttgaaggttggaaggattccattgccacgcttcaaactactgctacgttgccagagtggtctgagaatcttggtattgttagaaagtgcattgattcaattattgagaaaattctcacgcccccaccacagcttataaacgatgattctgttcaggtcaaatggtcctacacctacaccaggccaggttacacaaaaaaacagcaccactctgtgccaaaggattggtggacggaggatgtttctgatcttgacatagatcttttcaggtgcataatcatggctattagatcaacctatgtgctccctccgcagcttattggagaagctttgcatgtctatgcctgccggtggctaccgggcctcacgaagataaaaagttctggcagttcagcatctcaaacagaagaatctaaggagaaaaaccggaaaattcttgaaacaattgtgagcatgattcctgccgatagagggtctgtttcggttggcttcttgtttaggcttctcagcatttcaattcaccttggtgtctcatcggtcacaaaaacagaactaataagaagagccagcctacagtttgaagaggcaacagtgagtgacctactttacccttcaacatcctcttctgaccagaattattatgatacagagttggttctagcagtgttggaaactttcttgaagctttggaaaagaatgtcgcctggggctgtggataacagctactttttgagatcaatcagaaatgttggcaagctcatcgattcctatcttcaagtggtcgcaagggatgacaacatgcagttggcctgtgatctagacaaagatctctccaaggcaacatatgagcagaaagagagtcacttgaggggagagacggttagaatgcaagtacatcctgacctgagcaaggcagacaagaagcgcctgtgtgggattctagactgccaaagattgtccccagaagtgcgtgcccatgcagtaaaaaacgagcttctgccattaagaaccgttgtgcaacttctctattttgaacaagacaaaggctctaaggcaaccacaagtcacaaactgccaaagccacatgagatactgctgggagcaaaacatagaccagctacagctacaactaaagaagaattcaatagagaagaaattagagaaagggaccaccacaaaactaaaagatctgatggtaagttgttggccttggacttggaaaaaaagatggctataagaggagaagacattgaggagacccagtctgagaaggccaggggagtcaaagatgcaagtagttcaagcggcaaggtggacttggaccccaaaaaaatcattagaagggcaagaagtaaatcagaacatggcgtcaaaaagtaa

SEQ ID NO: 6535 - DNA, 222 bp, Glycine max
  Peptide Sequence Number=SeqID_123313
atggtgcatgcactgtggctaatgattaaaattagacctgaagtgatactgggaattagatggtcatcaattttctatgttgagagtattgcaagagtcagaaggctctccttgagtggcctgctcctatacaagttgcggatggttgatcaactatttgttcagtggccacagttgcaacgacaatatccccgtgctacctatgttggtcgactcatgtaa

SEQ ID NO: 6536 - DNA, 534 bp, Glycine max
  Peptide Sequence Number=SeqID_123314
atgaagatgtgcggagttgggaaaagacttgaaaatgtggaggatggagtatgtgaaggaggcattacagagtgttgctacgactacgaggatagaggggtctatggagttttgttgggttcatattctttggcttcaattccctcatctcctctacctctccgctcccaccccaagttatcatcctccgcgcagcatggtcttggcaaaaagacattgagggaaaagaagttacagattgagaacggaggtgattgcagcgacacccttattattctgcaacacccttctgtttacacattgggtaccgccagtacccaccacaacctcaactttgacatcgaaaatccaccctttcctatttatcgcactgaacgcggtggagaagttacgttccacggccctggccagctagttatgtaccccattatcaacctccgaagacacaagatggatcttcattggtacctcaggactcttgaggaggtcgttattcgtgctcttcaacgttttcaattcaggcttctcgggtag

SEQ ID NO: 6537 - DNA, 2256 bp, Glycine max
  Peptide Sequence Number=SeqID_123315
atgaagctcgtggttcgtgtgattgaggcaaaaaacttggcaacgacagattccaatgggctaagtgatttgtacgtgcgggtacagttgggaaaacaaaagttcaaaaccaaagtggtgaaaagtttgaatccaacgtgggatgaaaaatttgctttttgggttgacgaccttaaagattcgcttgttatctctgtgatggatgaagataagttctttaattatgaatatgtgggaaggcttaaggtgcctatctcacttgtttttgaagaggaaattaaatcccttggcactgcttggtattctttgaaatccaaaaacaagaagtacaagaacaagcaatgtggtgagattcatttgagtatattcatttcccaaaataatgcctctgaggagttaaatgacattggtgatcagttattacctccaagaaaatgtcctgatgcaattaccacttctctttcaatgtcttccactggcttttcaagctcgtcttctcctgtaagggaagaaactacatcttgcagttctaaggaggagaaatcttgtatgcaacaaagatcatttgctggtcgaattgctcaaatttttaataaaggtcctgatgtgtcttcagtgtcacccagcagaagtattgacttggaccaatctgaaacaaacaaagctgtagttggtgagatcaagattgaggaagatcagtcctctaatgagactttcgaagaaactatgaaaaaaatacagtctgctgatcaaggaagtgaaattcctaacaatttatcgggaggagtgcttattgatcaattatatattgttgcaccagaagacttgaatgtattactattttcacctgattctaattttcccaagtcattatcagaagaacagggtacttcagaactgcaaatttgtccttggaagttagagaatggtggggaaaccttgaaaagatcacttacttacatcaaggctgccactaaattaattaaggctgtcaaaggctatgaggaccagacatatttaaaagctgatgggaagaactttgctgttttgggcagtgtcagcaccccagatgttatgtatggcaccacctttagagtagaagtactttatgtgatcacacctggaccagagttgccatcaggggaacagtgttcacgtctcgtgatatcttggcgaatgaattttttacagagcaccatgatgaaaggaatgatagaaagtggagctcggcaaggtatgaaggacagctttgatcagtatgctactttgttatgtcagactgtaaagcctgttgtctcaaaggaccttggttctagtaaggagcaagctttggcaacattacggcctgagccccagtcaatcttgaagctggcaatgcagtatttagcgaacttcacagtcttcacaacattcttaatggtatcatacgtgcttgtccatatttatctggcagctcctcgcacaattcaagggcttgagtttgttgggtttgacttaccagattctattggtgaatttgttgtgtgcattgtcttggttcttcaaggtgaaagggtgttgggtttaatctcacgcttcatgcaggccagagccagagcacgcaagggtagtgatcatggaattaaggcacaaggagaaggatggatgctaactgtggccttaattgaaggaagcaatctagctactgttgattctggtgcattctgtgatccatatgtggtgtttacttgcaatgggaaaacaagaaccagctcaattaagttcaagaaatctgatcctttatggaatgaaatttttgaatttgatgcaatggatgaccctccttctgtgctggatgtggaagtttatgattttgatggaccctgtgataaagctgcatctctgggacgtgttgaaatcaatttccttaaaacaaatatctcagatcttgctgatatatgggtttctctagaaggaaagttggctttggcatgtcattctaagttgcacttgaaagtttttttgaacaacactagaggtggggatgttgtaaaacactacataagtaaaatggagaaagaggtggggaagaaggacattgaagacatccaaatcattcctcctacattttcatcgatgggcagtccgataattgtcataactctttggccaggaagaggtgtggatgcaaggcatggtgcaaaaactcaagatgaagaaggcagactgaaattccggttccagtcctttgtgtctttcaatgttgcaaacaggtag

SEQ ID NO: 6538 - DNA, 597 bp, Glycine max
  Peptide Sequence Number=SeqID_123316
atggctctctggaaggccagatccttgagtcccgagcaaaaggtccagttagttgaagaagactctgaaactaaaagccttagaagtgaggagagtgggtcattcattggtcttggtgatgtcagcatgtccgaggccagtttttttatggagctatttagtgggggtgagttggatcgtatgttcatggaaaaatctggttgtgttaattattcttataccccttgggtgtctgagaacagtgatgtatatgagagggcaatatattacaaatttgagaagcgtatttcacgttatagagttgaagtaacaagcactcagcaaagatctcttttggaaggaaagggttggctgttgcaagaggttatgaacttccatggagttccccttggtgactttttcaatctgcaccttcactatcaaattgaggatttgtccccaaaggcaaatagttgtaaagtacaggtattgtttggaactgaatggctcaaaagtacgaaacatcagaaaagaattacaaagaacatcctaaaaaatctgcaagaacgtttgaagctgacattcagtctggttgagaaggagtttttgtctaaataa

SEQ ID NO: 6539 - DNA, 402 bp, Glycine max
  Peptide Sequence Number=SeqID_123317
atgtcgctgatctctgccgccatattcaccggcatgttctccgcccaagccgaagcccgggacacgcggtggctgtggcggcgatccagaacaacctcgttcgagtggctgctatgtcttccactccgcactcgcccctccggtcgtgtcttcttctggtcctacgttttctacctctcacgctttctccaccttcttcgtcgttttgcgtcaccgaaggttgtcgtttttcaggctgttcaacaactccgtccttttgatcatgtcgtttttatggcacgagttttcacggtcgcttcaggtgctggcgattctgttttacacggcggtttattccgtcgtttatgcgttccggtcaaatgtaatgactctgtctatggatacagaacttgtaatttgtaa

SEQ ID NO: 6540 - DNA, 174 bp, Glycine max
  Peptide Sequence Number=SeqID_123318
atgatgatgatgaagccgaagaggggagagaatattgaaatgaatgagttggtgttggtggcttataattggagtatgtatgagggttcaaacacgtttcggagggtagtaaagctaataaaaaggaaggttaaacgcagcggagttggagagagggcaaagtcaagaatataa

SEQ ID NO: 6541 - DNA, 234 bp, Glycine max
  Peptide Sequence Number=SeqID_123319
atgaatgttattgctagacatagattagttgcccaaacaaaacagattcccagggttggttcaacttcaacccaatatgcgagtatcagattcaggatacacagcggatatctctctcctcgtctctcagtttacaaatacaccgttcaaacctgggcatcgcctttcaccactatcatcttgttctcttctctaccttcccccaaaaaccttcattcccatgaacccaattaa

SEQ ID NO: 6542 - DNA, 459 bp, Glycine max
  Peptide Sequence Number=SeqID_123320
atgcaggttcttacaaatggtattgaagtgaagctacaaaggaatgctcttagcgtgattgaagcacccaccggtaacgaggaagatgatgaccttgagtttgaaaatatgccgtggaatggatcagatttggcatcggacgatacacagaagttccacaagccgaggcatagaatgcatagaacattgggatcatctcacaagaccatgagtaggtcattctctggcgattcacagtcaaagggctccgtttctatgcctcatgggtccacgaaggtagacttgagcaaacttgaaatggctgcattgtggagatattggcgacattttaatctagtggatgcggtcccaaacccatcaaaagagcagctagtagatgttgttcagaggcatttcatgtcgcaggtgattgtgggattcgtccaagctgcaaagaggcttaagactgtgtgcaaatga

SEQ ID NO: 6543 - DNA, 633 bp, Glycine max
  Peptide Sequence Number=SeqID_123321
atgagtagctttcaagtgtggagtgggtttctcttggctttgtcactcttgaattcacgtgctcttgtctattcccaccccaccccaaattctccttcacaccctcctcagcatggtgatagtgcacacaagcccgggtgctaccagcctactcctcctacacataggcctcctaagatcccaccaccaccatcactaccgtcgttgtcgccgctaccacctggggcattttatttcttctctccaccccctcctagtcctccccattatccaaaaactcaaaggcccgtgggcctaggcccaccccctccaaggttccggatcaatctgattcctggaattggtgttagaggagatagccttttcaatgggagatctggaagcattgttgttggtcgaggtcattggctagatatatctgttgttattccaaatgatttgcaagccttgtacaatctgtttgggtctttggttttggggaaaaagggtcacacatttgatggtggtaaacttcttgatggaattaagatcaactcatgggaatggtttccgtatgagaaacagaatactgataggatcttcttctcttcatggatgcttaacacgctactctgtttgaactcatatgagtag

SEQ ID NO: 6544 - DNA, 216 bp, Glycine max
  Peptide Sequence Number=SeqID_123322
atgggaattttagctggacatgcaacaaccaagggaaaaacaaagcaacaatgtgacacagggcatgaccatgaatttgcagaacccaaaaagagaaagagggaaagcgaaggagagttggagtcaatattctcggacatgtttgtctttgaaaattgtaattgtaatataggaacaagcaacgcaagcatgcatcaaggtgaggtgcaaaattga

SEQ ID NO: 6545 - DNA, 1686 bp, Glycine max
  Peptide Sequence Number=SeqID_123323
atggtgtctgtgaacaataaaaacttcgtaccccattgcccagaggctcttcgcaatgcgaagctaaaaaaatcaagctctcgttcatgttcaggtgctttactgttagcagttaacacagttacttcacgagctggtgctagttctgcgttccgtgtctattattcccctcaaactgctgcaaaatctttgttgtttaatgaacggttaaagtgtgtttgtttgagtggcagaatgttagaggcaacaaggtggttgttgggtgcaggtattttgatgtggatgttggcatggctgggagaatcagcaataggggtgaactggggcacggtttcttttcacaagttgaagccttccacggtggttggtctcttgaaagacaacaagattccaaaagtgaaggtgtttgaggcagaggctgatgtgcttaaggctctcatgggaagtgggattcaggtgatgcttggaatacccaatgagatgttgcccctcttgagcacttcccctgctgctgctgattcgtggcttcgccagaatgtttctgcttacctcggtaaaggcggtgctgatatcaggtacattgctgttggaaatgaaccattcctcactagttataatggtcaatatcagaacttggtgatgccagcaatactcaatcttcagcagtctttagtgaaagcaaatcttgctggttacattaaactagttgtcccctgcaatgcagatgcgtatgagtcatcacttccttcacaaggtgcattccggcctgaactgacccaaatcatgactcagctggttcagttcctcaactcaaacggtaccccgtttattgttaacatctacccattccttagcctctatgacaacaatgatttcccgcaagactacgcattctttgagggaactactcatcctgtcacagatggtaacaatgtctacaccaatgcatttgatggaaactatgacactttagttgcagccctgagtaaacttggatatgatcagatgcctatagttattggggaaattggttggccctcagatggagccattggtgcaaatatcactgcagcaaaggttttcaatcaaggtctcataagtcatgttttaagtaacaaagggacccctttgaggccagatgctcctcctatggacatctatctcttcagtcttcttgatgaaggagcaaagagcatactaccaggagggtttgaaagacactgggggatattctcttttgatggacaagctaagtatcctctaaaccttggccttggaaacaaggaattgaagaatgcaaagaatgttcagtatcttccatctagatggtgtgtggcaagcccctctactgatgctcaaaatgtagcaaaccatatgagaattgcatgcagtgttgcggattgcaccacacttgattatgggggttcatgtaatggaattggagagaagggtaacatctcatatgcttttaacagttactatcagttgcaaatgcaagactcacgaagctgcaactttgatgggcttggtgtgatcactttccgagacccttcagttggtgactgccgttttcttgtgggtgtcacagataaaggctccgattcctctgcttctcagatcagatgtcagtggtggattctactagcatttctagttatacagacgatctcttctttctcattgtga

SEQ ID NO: 6546 - DNA, 354 bp, Glycine max
  Peptide Sequence Number=SeqID_123324
atggcgtggcgtggcgacgtgaaaaaggaggagggttgttcttcagaggcacttggggtatttgatttcccttggctgaaagatggtgtcacgactaaaccagaggactacttgatggatttggaagacaatttatcgtcattgctagaacaagaagactcttcgtttaaagctgcaactgcatgtattgatttctcgtcagaagcaaagttggaggatcttgcatggcagccatttgaaagtgatgtgttggagcttgaagcagatgatgtggattacatttggagctctctgctcaaacagcctctccgaccacatccagcagcaacaatattcagtataaatattgtttga

SEQ ID NO: 6547 - DNA, 225 bp, Glycine max
  Peptide Sequence Number=SeqID_123325
atggaaagttcggtcaatggtgggtttacccatttgcagagctgtggagatagcagcgaagaagagttatcggtgcttcctcgtcacaccaaagtggtcgtaacaggaaataaccgcaccaaatcggtgctcgttggtcttcaaggtgttgttaagaaagccgttggactaggtggatggcattggctgattttcacatgcgggtttcttcgtggtgtgggttga

SEQ ID NO: 6548 - DNA, 1518 bp, Glycine max
  Peptide Sequence Number=SeqID_123326
atggcatcagaagaagcagagtgtatatcgaacttgttcaaacccatatacctgaaggaggtggctgagctgaggcagtatgtccccaacctccaaagccgccccaacccactggatcacaacccctactttgacacccgccaactacaacaacaacagggcttctaccttacagaatccgacgtcctactccgccagatcggcaacgatctctctccctctccccgcttcgcctaccaccgcgctggtccacgcaaaaacatctactttgacccttccattgttcgcgttgccattgtcacctgcgggggtctctgtcccggccttaacaccgtcatccgagagcttgtcgtgggcctgtggcaactctatggcgtccgtcatattttcggcatcaccgccggctacagggggttttactcctctgtcccactccccctcaatcccaaactcgttcatcattggcacaacgtcggtggcaccctccttcagacatccaggggcggtttcgaccttcataacatcgtcgatgccatccaaactcacgccttcaatcaggtgtacattataggtggagatgggactatgcgaggagcagtgaagatatttgacgaaataaagcatcggaaactggaagttgcagttgttggaattcctaaaactgtggacaatgacgtgggaataatcgacaggtcttttggattccaaacagcagttgaaatggctcaggaagcaatcagtgctgcacacgtggaggcggagagtgcagtgaacggcataggcctcgtgaagttgatgggtcgaagcacaggccacattgctcttcatgcaacgctcagcagccgcgacgtcgattgctgccttatccccgaaatagatttcttcttggaagggaaagggggcctcttggagtttctcggccagcgactcaaggaaaatggacatgccgtgcttgttgttgctgagggtgctggccaggacataatacccagaaccgattcacagaaggacgaaagggatgaatctgggaacccagtcttcttagatgttggtgtgtggttgaagtcagagctgaacaagtggtggaaaagggaacaccccaatgagttgtttacagtcaagtacattgatcctacttacatgattcgtgcagttcatgcaaatgccactgataacttgtactgtacactcctcgcacattctgcaattcatggtgttatggcagggtacactggctttgttgctggtcctattaatggaaactatgcatacattcctttggaagatgtggcacgtgcaaataacccggttgatacccaagatcataaatggtcgtgggtgagatctgtcaccaatcagcctgattttgtaaggagtctttttcttctgtccaaattcgctttagtttatcgatgggcttacaaaggagtgtttggcgtgacggaaaatgtggaatcccttgaatttatctcctcaaatgttttcgttcgggaaaaaatgtgggcaacacatttttga

SEQ ID NO: 6549 - DNA, 816 bp, Glycine max
  Peptide Sequence Number=SeqID_123327
atggtagtggccactctagccgaatctggcatgaatctttcagatgatgtgatcgaaagtattattgacaagacatttgaggaagctgataccaaacatgatgggaagattgacaaggaagaatggcgaaaccttgtcttacagcatccatcccttctgaaaaatatgactcttcagtatctcaacgcagaatcagcaaacggccacagcttgtttcccctacttcctcattcttcttctgattctggttctgctttgctcagtcaacctctattgcaagaccaaaacctgtttacagaaatagaacaagaagtccaagttcttcactgggaaaagccttccgctctagagaaggaaattcgcggattgaagtccagtttttctagactcgaaacagtggtgcaaaccagcgtttcaaaactgcaatcagggcccacctcagaggccaatgaagcagcaatcaccagccttaaagaaaaggttgacaacttgaagacaagtcttaatggtgaaattattggacgtgaagctgacaaacggatttacagtgctaaagaaattaatgagctgaaaaccatagttgatgagatgatgtctaccatgcttgatttggctgctgctattgctgacttaaagcatgaatctcttcaaccaaaggagtcaaatgaatcagctcaagttagaataacagacttggcgatgataacagtttcaaaggaagaacattacatcgttatcatatttttaatcgcagttctcatcggtctcaatcttcaaccaaattgtgtcttgacatctggtaccatgttgctgtga

SEQ ID NO: 6550 - DNA, 2220 bp, Glycine max
  Peptide Sequence Number=SeqID_123328
atgggatcgcatgagcatggtgaaggagtcacagatgctgattttgatctagttacacaaattcatcatgagttcgttaaatcctatgtgggaagttctgagaaagcgaaagaagcaataatatactcttacactaggcacatcaatggctttgctgccatgctggaagagaaagaagctgctgatattgcaaaacatccagacgttgtgtcagttttcttaaacaaaggaagaaaactacacactactcattcgtgggaattcatggacctggaagggaatgatggggtaattccctctgattcactgtttagaaaggccaaatatggtgaagatactattattgcgaattttgacactggtgtatggccagaatctccgagctttagagatgaggggatgggacctataccatcaaggtggaaaggaacttgtcaacatgatcacaccggcttccgttgtaacaggaagctgataggagcaaggtacttcaacaaaggttatatggcccatgctggagctgatgcaaaatttaaccgttcactgaacacagcacgagactatgagggtcatggatctcacacactatcaacaataggaggaacctttgttcctggggcaaatgtattcggcttgggaaatggaactgccgaaggtggttctcctagggcccgtgttgctacttacaaggtgtgctggccaccaattgatggcaatgagtgctttgatgctgatatcatggcagcctttgacatggccatacatgatggtgttgatgttctttccctctctcttggagggaatgctacggattactttgatgatggcctttcgatcggggcctttcatgctaacatgaaaggcatccctgtcatatgctctgcagggaattacggaccaacacctgcaactgtttttaatgttgcaccttggatactaacagttggtgcaagcaccttggacagacagtttgatagcgttgttgaactccacaatggacagcgcttcatgggagcaagcctttctaaagctatgccggaagacaagctttacccactcatcaatgctgcagatgcaaaagcggctaataaaccagttgaaaacgctactctctgtatgcgaggaacaattgaccctgagaaggcgaggggcaaaatattagtttgccttagaggtgtcactgcaagagtggaaaagagcctggttgctttggaggccggtgcagcagggatgattctttgtaatgatgagcttagtggcaatgagcttattgctgatcctcatctcctgcctgcatcacaaattaattataaagatggtcttgctgtctatgccttcatgaattcaaccaagaatccgttaggatatatttatccacccaagaccaagttgcagataaagcctgctccagccatggcagctttctcttctagagggcccaacacagtcacaccggagatcctcaagcctgatgtcattgctcctggtgtgaacattattgctgcctactcagaaggggttagcccaacaaatctgggatttgataagcgcagggttccttttatcaccatgtctggaacatccatgtcttgtcctcatgtggctggagttgttggccttctcaagactctccaccctgactggagtccagcagttattaaatctgcattaatgacaactgctaggacaagggacaacactggcaagccaatgcttgatggggggaatgatgctaaggcaacgccatttgcctatggatctggtcacatcagaccaaaccgtgccatggatcccgggttggtgtatgacttaaccaacaatgattacctaaactttctttgtttctctatctataatcagagtcaaatagagatgttcaatggtgctcgttatcgttgtcccgatataataaacattctggatttcaactaccctacaataacaataccaaaactctacggctcagttagtgtgacacggagggtgaaaaatgttgggccaccaggcacttatactgcaagactcaaagtaccagcacgtctttccatatctgtggagcctaatgtgttgaaatttgacaacattggtgaagagaagagctttaagttgacagtggaagttacaagaccaggtgagactactgcatttggaggtataacttggtcagatggcaaacgtcaagtgaggagtccaattgtagttgggggggttagagggtag

SEQ ID NO: 6551 - DNA, 1447 bp, Glycine max
  Peptide Sequence Number=SeqID_123329
atcctctgagtcacaaaagcaaaggcagcaaagctatattcactgctcagtgctctcatgcattccactttgcttgtatctcctccaatgttcgccatggtaatgtcacttgcccgatttgccgtgcccaatggacccagctccctcgcaacctgaacagtggttcaactatttctactaaccgaagtgatcccatcctgcaaattcttgatgattctatagctaccttccgagtacatcgccgcactcttttgcgctccacccgctatgatgatgatgaccctgttgagtctgatgatgcacctgagatacacaagctgtgtttctctcttgcacctattccaccaaaggcacctactagccatctatcccctcatcccttatcctgcggctcctcatcactgttacagtctcctcctcaacctatgcatatcatgttcccttcctccaatagatcttatctttcattaaaactagcccaagaacgagcaactgatttggtcttagttgctagctccaatggacaacacctgaggcttctcaaacaagcaatggctctggtggtttactccctcagacacactgatcgcttggccattgttacacactcctctgctgcagcccgtgtgttccctctaagacgcatgtcatcatatgggaagcgtactgcccttcaagtcattgaacgtttattttatatggggcaagccgacccagttgaagggttaaagaaaggaattaagatactgcaagatcgcacccacaagaactccaaatcatgtatcctgcatctatctgataaccctacaagaccataccatgctgtaaacatggaactgccatctacacccattcacagatttcatgtgggatttagctttggtacttctaatggatttttcatacaagaatttgagaggttcttgaacaagattttgggaggcattgttcgagatatacagctgagaatatgtgggactggagaggaagttggcggttgcagagtcgtaagaattggagacatgagaggtggagaagagaggagagtagtgttagacttgggtgactgtacagatgtatatgtagaatatagctacactgaaggagatattgatgaatgtgttagaagaacaggggaaactgttgtaggtattggagaccataaaggtagggtgacagaagttgctgaggaaacaatgaatataattggcaggagttgcagcgttgaaagctgggattttcatgacccttacatggccagaagatgggccaagcacttgcaggaactagagattagaggaggtactgaatatgaaggagtcaaggtcatatttaagcatcggccagcctacatagatgattgcatcataggaggacaatgtaccaattcggggcttaaacttcatgcagcaattcagggtcttgctatttgtgcacaatggctaac

SEQ ID NO: 6552 - DNA, 711 bp, Glycine max
  Peptide Sequence Number=SeqID_123330
atgggttttgatgacgacaaaggcaaagacgttcctgaaacgcagcacgcggccgggaaaacggttcatgctcatgatgatgaaagtggcgatgaacgaggcacgagtctcagtagacacatgagtgaaggctccattgctgtcaccgaggatgaagatgaggacgtggagaggaggattgacttgggtccccagtgcaccttgaaagaacagcttgaaaaggataaggatgatgagagcttgaggaggtggaaggaacaacttcttggcagtgttgacatgacttctgttggtgaatctctggagccagaagtgaagatactgagccttgcaatcaaggcggctggtagagaagacattgttcttccaataccagaatcaggaaatcccagtggcttatggtttactttgaaagaaggtagccgttacagtctgatgttcactttccaggtcagccataatattgtttcaggtctcaaatacaccaatactgtatggaaaactggtctcaaggttgacagcactaaagagatgattggaacattcagccctcaggcagagccttacacgcatgagatgcccgaagagacaacaccatctgggttatttgctagagggcaatattcggctagatccaagtttgttgacgatgacaacaagttgtatttggagataaactacacttttgatattcggaaggactggctttag

SEQ ID NO: 6553 - DNA, 426 bp, Glycine max
  Peptide Sequence Number=SeqID_123331
ccagactacgttataagaccaggcgaattctcatcttcatgttcatctaagtctcagaaaaaggtgcacccttgtgtgagtaaagttcaagtccccggatcattgatagctgaagccaaagacagtttatgcttggacagacccatgaacatgaaccgtaatgaagaagctgaagaattgttaagttccacatcgattgggaaatcacagaagaaagtgagctttaaactctctcataatgtcatattttactcacctgatgagccttgttcgccagagccttattattataatagcagtgaaagtgaaggctcattctactcatcaatctgcagagaatattcatttgacccttctgcagacgaaacattgatcaaactcgcagtggatgttcttcctcatgtctctgtctcttccaaaatttga

SEQ ID NO: 6554 - DNA, 198 bp, Glycine max
  Peptide Sequence Number=SeqID_123332
atggtttcggtcttggttcaaaccatactagggattcatcctatatgccttacttcgatcagccataatcacgcgcttcttcctccttcacggcttctgcgtgctcacaccttgaggataaaaaagcttttgcagagatccttaagagaatctccaagatacacaagacaagtggtggagccagttatgttatattga

SEQ ID NO: 6555 - DNA, 378 bp, Glycine max
  Peptide Sequence Number=SeqID_123333
atggaacgttcaattccagaggctgcagaatgtgatctctccattccaattccaaggggtggacccatttacgttcctaacatggtcggcccctccactagggttcctcactttcagacttgtcttctttctgaacttcggaatctcgaggctgaattgtctgaagatttttctcaccttgatatctcggtggatgaccttaaaatatttacagaggatgacttaatggatatggctctcaaagaagtatttcaaggtagggagaacgatgaaaatcatcctccgcttctggaccaacccaatgcgaggtcagtcttttttctttttatcattgttgttgttgctgctgttgttgcaagggtggccaagtttgattga

SEQ ID NO: 6556 - DNA, 501 bp, Glycine max
  Peptide Sequence Number=SeqID_123334
atgattaagagcctattatatgagattctctctagtctgaggtctgcatcaaccgaagctgcaagttcatcttctgtgcttccaacaatttccagcacaaaatcagttagtgaacttctttcagaagttgcaccggagtccttttttggagaagatactgatggcaatgatgggcatacagatgtgcaggataagaagctaaatggcgagggtgaagattgttgctcatatacgagctcaaacagagaaagttggggcagatgttcttctttaggaggcagtgatgaagatttaagggctgatgataccctcactcaggtgtttgcaacacccatgcgaagcacgaaagagaaagaaaaagaagatgacaaaaagcacaagaagaagaagaagaagaagaagccaaagagcgagaggtttgagaagctggaggctctaagcagacgcctgaggctttgccttctaaagggatcaacccatcgaaggcacaagtccacttag

SEQ ID NO: 6557 - DNA, 582 bp, Glycine max
  Peptide Sequence Number=SeqID_123335
atggcactattaaggcagagtataaccctgatcagtacctgtgggaaaaggaattcacccttgcaggtcgaacataccaaaggcaggatttggaggcaactcaagaacaccagaggctataccttaaaatgtagtcattatcttccttctccttttcctgaagatacttctcttccttgtgttatatattgccatggaaacagtggatgtagggcagatgccaatgaagctgctgtaattcttcttccttcaaatattactgtttttacccttgacttctcggggtcaggcttatctgatggagactatgttagtcttggttggcatgaaaaagatgatctcaagatggtggtgtcatatttgaggagcaacaaacaaatatcttgtataggtctttggggacgatcaatgggtgctgttactagtcttctttatggagctgaagacccttctattgctggaatggtgttggatagtgccttttcgaacttatatgatctcatgatggagcttgtggatgtttataaaattcggcttcctaaattcactgtaatctctctctcactcactttttctctctga

SEQ ID NO: 6558 - DNA, 312 bp, Glycine max
  Peptide Sequence Number=SeqID_123336
atggtaaaagttcgtaaagggaaaatgtggggtaagttaagaggcacgaattccaagtcagacgagatcccacatccaaattgcgacattaaagcctatggatgcagttcccctcttactttgtttctcaacgaagctgcaaagaatgggggaaaagtaaacaactttaccggatggaaaagtgggtacgagttattaccacccaaaagcaaatgcttgtctgaagaagaagaagaagaagaagaagaaggagacaatgacgggaatgaattgaaaagaagttggttcttatttgtggttttgagaaagtga

SEQ ID NO: 6559 - DNA, 990 bp, Glycine max
  Peptide Sequence Number=SeqID_123337
atgactgtgacaggttcatcttctgggcagcctcaattcattgccagcaccggtggtagccggagcttctcaaatgcgcccttgattgaaaactcagatactgatcaaattgttgtgcctgatgtggaaattattgtgtgggacttagacgaaaattgctttatgtttgagattaaggtttacaatttcagagtgggatgctttattctcagtttatatgctaatgctaaaagaacaagctggaaaaacttatttgcatacattgggcctggatttcttgtttccattgcatatatcgacccaggaaactttgagacagatcttcaatcaggggcacaatataaatatgagttactttggatcatattggtggcgtcatgtgctgcacttctaattcaaacaatggcagctaatcttggggttgtcactggaatgcacctagcagagcattgtagagctgaatattctcgggtgcctaactttatcctttgggtgattgctgaaattgccgtagtggcctgtgacattcctgaagtaattgggacagcctttgcattgaacatgctcttcaacataccagtttggattggtgttcttctgacaggatccagtacattgatcctcttagcattacagcaatatggggtagttttctatattctctacagtcctcttcctcatggttacctgacatctttctatgatttgaacctgaacaaatcaatgattaggaaacttgaattcttcattgcatttctagtattcacaattgctggttgctttatggctgagcttggatatgcaaagccggtggccaaagaagttgtgacgggtctttttgttccaaaacttcaggggcatggtgccactggtcttgcaatttcactccttggggcaatggttatgccccacaatctcttcctccactcagcgctggtgctttccaggaaaataccgcgatcagttcgtggaatcaaagtaaacacttaa

SEQ ID NO: 6560 - DNA, 1101 bp, Glycine max
  Peptide Sequence Number=SeqID_123338
atggaggaggatgggaccagcaaagagcagcagcaggcggcgggagtgggaattcttcttcagataatgatgttagttttgtcattcgtcttaggtcacgtccttcgtcgcaagaagatttacgttcttcccgaagccagcgcttctcttctcattggcttactcgttggtactctcgctaacatttctcacactcaaaccagcatcagccctgctttttcacttgcctctttttggtctttccagaagcctttcttcgctaatttcggagccattgttacatttgctatattcggcacctttctggcttccattgtcaccggtgtcttggtttatcttggtgggttgatgtacctcatgtacagactgccttttgtcgagtgcctaatgtttggtgcacttatatccgccacggaccctgttactgttttgtccatttttcaggagcttggcacagatgtcaatctatatgccttggtttttggagaatctgttttgaatgatgcagtaagtttctattgctacaaaaataataataataatcccggtgagatggctatttctctgtacaggacaatgtcagtagttaaaagtcatccatctggacaaaatttcttcatggtgattgttagatttttggagacttttgttggctcaatgtcttctggacttcgaggggcaatggcctttgcccttgctctgcaatcaattcatgatctgccagaaggacatggacagaccatcttaactgcaactacagcaatagttgttttgacggtattactgattggcggttcaacgggcaccatgctggaagctttagaagttgtaggtagtgacagtcctgtcgagagtcctttggcttcgaattttgagggaaacaatgtgtatatttctcctgatgatgaagaaccgtcatcagggaacaaaatcaagatgaagctacaagaattccaaaggagtgctgcatcttttacagcaatagataaaaactacctcaccccattcttcactagtcaaaatggagatgaagaagatgaagctgtgcctttgactttgaagaacgtgggattggatgaccacgaccactattcgtcatga

SEQ ID NO: 6561 - DNA, 315 bp, Glycine max
  Peptide Sequence Number=SeqID_123339
atggtggctaaggtagaagctgggctaaaatgtttcaatatgaacaccaatcttgttattcttctccttttacctcctccatccactttggcgttcccacaaatcctttcattgttcatagcattgtgcggcgattcaaatgctctgccaccattgcttcggtgtcaaatccttcacgatgtcaatttgggactcaaagtcactcgattggcactacgacatgaaattcgaagacaaagcctccaggttgttggcgaggtagaaccacatgatggaggagacatagtgttgcatctgtctcgatacattctttaa

SEQ ID NO: 6562 - DNA, 426 bp, Glycine max
  Peptide Sequence Number=SeqID_123340
atgatacttagctcttctatattgcatgttgctttctctccttccacttgggaagttgcatattactatttcttcacaagcaaagtaaagcgaagcattgtttatggagatcagcctagaaacaggttggatctgtatctacccgccaatattggtgaacctaagccagttttgatatttgtaactgggggagcatggattattgggtataaagcatggggctcccttttaggactacagttggcagaaagaggcattatagtggcatgcattgattacaggatttatctaatggggcaatctgctgatgctcatatttcttcttgtgctttactggagcaagcagccagagaatcggaaaaagtagagagtgttccttggagcatttcccagttaaaagcttatcttggtttatctggagggtaa

SEQ ID NO: 6563 - DNA, 270 bp, Glycine max
  Peptide Sequence Number=SeqID_123341
atgcaattccgttatggcgaggagagcacatcggtggatgtgcatgacaacacaatgatggtgatgaggagttgcatgtgtggagcctcaaaggttgaggtcgcacacaggatgtttcgcataagggctctgtgcaacactgatgatgggggatgtggcggtgcggggcatggaggagatgggatgaggttgtggcgcagtgtgaaggtggtcgatggtgataatggttgcttgactgtggtgaagggaagggaggagttgtggttctag

SEQ ID NO: 6564 - DNA, 702 bp, Glycine max
  Peptide Sequence Number=SeqID_123342
atgcaggagcttgatccacctacgtggcttaacagaatgcgagaactaggatacccacctggatatcttgatgtggacaatgaggatcagccttctggcattacaatattcactgatagtgagattgctgaccaagaggatggggaaattatggaagctgatgcttccaaaccaaagcgtaaaaagactgtcaaatttcctggaataaatgctcctattccagaaaaagctgatgaaagattgtggggcactagggctggaccctcgagttcagacatatcaagaaacttgtcattgccacagcacaggtcgaattatagtactgattatggcagccaaggatatcatcgcgaacatagattaggggatcttagggatgatggtccaccaggggacccaggacatagttcatctatgttcagttttcatcctaggtttggtggccatgattctgcactaagaagtccttcaatggcaaggtctcaatctgacaggggtagaagtcctatgcatgacgaagaatcctcaatgcctttttctttccattttcttcattattcatcttcagagaggtatttttggcccttggatcaagattctggtagactagggagctggacctccgaaagtcaaacgatggtcactaccgcagttggaggtgaggatggcacaaacaggatcaatcatattggtaggttctga

SEQ ID NO: 6565 - DNA, 153 bp, Glycine max
  Peptide Sequence Number=SeqID_123343
atgggatgcgactcattttcggttaaatttgcttatgatggcattttgaattcacaactggaagggacaatggaggagttgtttactcaactatggaaggtggatgcccctccgaagacacttcatatagtgcggaggttgttccttccttaa

SEQ ID NO: 6566 - DNA, 299 bp, Glycine max
  Peptide Sequence Number=SeqID_123344
accccaatcctgtatcccaagctaaatgtcgacattgtggtgctttggtcaaatatagtaatggaacaactgtcatgcgcactcatttagacagatgcaagaagagatcagacatcatgagcaagaggcaaaaatcagattcttcttcaacaaccattactccttcttcatcttccatgattgaccaagaagcatggcgagcgagactcaaggatgcgtcttccaagaaaggaaaatacataggagttgccaccaatgtttattcaaggaaaacgttagaaaaaaccaaaaagacaaag

SEQ ID NO: 6567 - DNA, 2283 bp, Glycine max
  Peptide Sequence Number=SeqID_123345
atgtttcggataagcaagatgcacgccaaaggttctaatctcgggaatagttgcaaacaaacaccaggaagttcttcatcatttgtcccaaaccatcctttgcagagagattttgatttaagacatcaagattatataatgaatcaagcaaggttcttctttgactggcgaaaagatcctgaaattagccaatgccgtaacttgataaaaaatgatatttctacaattttgcattcccgacatcctaatgatcaaggacaggcctctgttttggcaaactttctggaaaatcggctatttgttgaggctgcttcaaaggatgagtatatcaaccgacagacaattatgcaacgattggatacacaactcaagaagttgtatgccccaaaatgcagccaagtaaatagctctattgcttgcacatcccagatggtgccctcttttgggttattgcaagctaggtctaatggaagtgtaccagaacctgcttttcataacgtggctggtcctatcaccaatgcaaccaattattgtgcagtgcctgtagataataaaaatagcttcccaaatggagggttgtcttattcttcttttgttccccaaccggtttttttaccagataaccatccatccatcgctacatgcactgatttggatgtgcttcctaactcttttgtttctggtgggagaagcaatttgaaagcttgctccaagtcaattagttcctattttcctcagcgacaggcagacgattggaagacgcttctggtgaagtatggagattgttctaggactacaacgggaaaatccgtccaatctgaatcttcaaatttgatgacccctcaagatgccttgagggaattttcaaaagtttttgatcttcctcctgtcccgagaagcctaggagatattaggcaacatcaacaccggaagcgagattttcaacggaatttaaaaccttttatgcagccatatgggcttcctggtaaaactaatatggcccagcctaatgcattctccaatcaaggtgaacgttgcagtcaaatgttggggcataaaacattgaaacaaccacaacttttcaaaagaagtctcaatggggatcaacagttcacttcagggagctcagtagatctttttggtttagatgattctgataatatgaattcatgtggtagttccaaagtttcggttgaacagaggatcatgcttgaatatctttatttgaagaattttaacaatatttcacggggtaatgttatgaaatatctgcattcaacagtttgtcttaaagggacatgtaattgtggatggtatatcaagctattattgcattttgatgactgtaaagatgatggttgtcgtacgtgttactcttggaaattgcatggcactgatattcttgggggtcatttgaaatttcctgatattatgggttctgttgaaagaaaaaatgacgctccttctggaaatactgaagccatgctaccacctgaaaaaagaagaaaaatggagcccgcttttggtgtccctttaattaataatgcaagtttggatcagtcgactcagaaaatggttcaccctcgttcttctgaagctctttcagaattgccattgagccaaaaagctgatcaagagatggagatgtcaccaaatccaacagctaatagtgtacatatggaggacaatcaaggaaaaatcaggttgaaccaagatgagataaatgctacaaaagaagccattaagccaaaagttgatgaagagaaggaaaggaagtccccaaatccaacacttaatactgcatatatggaagacataaaaggcagaattgaattggaccaggatgagataaatgctacaaaagaaatcattgagccaaaagttgatcaagagatggaaaggatgtcccaaaatccaacagttactgtagatatggagggcatacaagccataaccgggttcaaccaggatgggataaatgccacaaaagaagtcattgagccaaaatttgatgaagagaaggaaaggaagtccccaaattcaatagttaatactgcagataaagaggacacacaaggcagaactaagttcatccaacatggaataaatgttgatctagagatggaaaggaagtcctcaaaaacaacagttaatactgtttccttaattgattttttcacaagtaatcaaataaaggaacacattacaagcctgagaaagcaatttaatcaggtcagcataccatcttccactgttttccattaccttgacatgtttcagtag

SEQ ID NO: 6568 - DNA, 654 bp, Glycine max
  Peptide Sequence Number=SeqID_123346
atggttgaagaatcaggaagtgatgtttacacatgccaattatgtggaatgggaacactttcttttgcccccgtgccaatctattgcttttgttgtggcatccgcatcaagcgaaacgcatgctattactatagaagagaagaagatgatacacagcattgcttttgcagtgtttgctttaggacttctcgaggtgggaacatcaaattcaatggaacatctgtttccaagacagatcttgataaaaagacaaataatagagaatttgaagaatcgcatcaaatatgtgcactctacaacgataaaagagatttggactacagagctgagtatacatgtcctatatgccgcttaaaggaaattggaaatggaatgcatgcacccttaccgaagacagcggctatgtttagtgctaatgacttgcccagaaccatgcttagcgaccacatagagagcagactttttaagcgtctctggcaagaggatgaagattgggcaaaagcagggtataagaatcttgatgaggttttcgaagcagaaagtctttctgttagagttgtgttatccgttgacaaacaattgaaagtgaagaaacagtttctggacatatttggggaggagaattacccttctgaatttccttatacattaaaa

SEQ ID NO: 6569 - DNA, 1210 bp, Glycine max
  Peptide Sequence Number=SeqID_123347
gtatcattcaatgctaagaaaggccgctgaagaaaatatcgttgttggtttaactaacttacatgatcatttctttgttactactggaagttgtgactccaaggtaacagctgctcgtttgccttactttgatggggacttctggtctggtgctgctatggataaagccaggcacattgaacaagagtgtggaggagattataaaatgatcttcgataaagtagtatcgaaaagatgtttaaagtccatgggacatgtaaatcctccttctgaaggaactgccaaagacattctagtgatgcataaattgggacaaaccatattacctttcaaggaagattttctcgtagttcaatttcagtatgtttgcatgcactgccatgaagtaatagcaaatgggaagcgatggttttgcaccgaatgcaagaaatttcaggagtgtgaaagatgccatactgttcactcacacatttcagccaaaggcgagaggcatagacttcatcaggtcctcatggatgacgtccttggtgatactaaggagaatgatatcatccttgataatgggttatttgattcccgacacaactttctgagcttttgccaaaggaacaggtttcagtttgactcactccgcagagccaagtattcctcaatgatgatcctctaccttgtgaagaatcctactcttctgattgttggaacaacatgccgcgtttgctctaaaaacaatgtgtcccagcgctactggaaatgtgagaattgcccggaattcactgtctgttctgcatgctacaacgagagaggtgctagttgccatgcacacacgttgagtgaagcttattcaccagcgcaatctccttcagggaatcaagaattgcagcagaactcagcaatgttgcagcaacttctggatgttattgaacatgcatctctgtgtcactcaatcaaaactcaaccatgcacttacccacattgcagtcaaattaaaaagctgttcgctcatgccagtaggtgtgaagttcgactttctggggggtgccaattttgtaagaaggtttggcagggactgactttacactcaaggaattgcaaagactcagcatgtcgcataccccgttgcatggatctgaagaaacaaatagaatggatagcaacacaagctgaatcgcggcttagggctgcagttttgcaatcggaagatagcagataa

SEQ ID NO: 6570 - DNA, 237 bp, Glycine max
  Peptide Sequence Number=SeqID_123348
atggcaatgagactatggtgccggagcaaagtggatgggagcgtaatggatagtggtgaaagagctgacattagtggtgttatcgggataagagaaatcactgatggaagagtgcttgatccatactgtagctctctaacaccaaaaatggtggaagcttttatttggactcaatattggttaaaaggagacccttgtcagtatttacaaatgaggaatttgaggaaggtaaaatga

SEQ ID NO: 6571 - DNA, 555 bp, Glycine max
  Peptide Sequence Number=SeqID_123349
atgaaaaaggttcttgcaagccgtactaagatttatattatattgaagttcacgggtggtgaattgtttgatataattatactccatggccgccttagtgaagctgactctagaagatatttccaacagcttattgacggtgtagattattgccacagaaatataaagatttccgattatggtttgagtgcatttcctgagcagggggcgagtatccttcggacaacttgtgggacaacttgtgggagtccgaactatgtggctcctaaggtactcagtcataagggttacaacggtgctgtggcagatgtttggtcctgtggagttatcctctttgtcctactgactggatatcttccttttgatgaactgtatggtattttccctttaaaagttgagacattcacaaaagttggacaattggaaaaggccagtgatgctgaacagagtattcaagttgacggttcaaatagaggcaccggtctgagttctcctattcctcttccagcacgtcctcaaagaatttctactggaagagaattattctaccagtaa

SEQ ID NO: 6572 - DNA, 2076 bp, Glycine max
  Peptide Sequence Number=SeqID_123350
atggagcttaattatattccaaagtgctttagagatagcttacctgttccaaattactggttcaacaagtgtactgcatcaggctggttctctggcagagcctcctggaatgcagggatctcattatatgtctcatgcaatcttgctagaatagggaactcactctgcttggacaacaatgaggaaagattggaagaatcctttgagtgtgggaaaatgagtatgtacggtagggatccgtggggaggcccgctggagattcacgccaccgactccgccacggacgacgagcgcagccggaatctccaggagctggaccgaggcgctttagacgagacccaacagagctggctcttgggcgccggagaacagaaaaagaacaagaaaacctacgtagaccttggctgcatcatcgtcagccgcaagctcttcatctggaccctcggcaccctcgccgtcttcgccttcctctccgccttcatcactctcatcgtcaaaaccgtcccccgccaccaccacaagcccccccctcccgacaactacaccatcgccctccacaaggccctcctcttcttcaacgcccagaaatccggaaagctccctcgccacaacaatgtttcctggagaggcaactcctgtctgcatgacggcaaggatgacggcgtgcctcccgtcattaaggatctggtgggcggttactacgacgccggcgacgccataaaattcaacttccccatgtccttctccttgaccatgctgagctggagcgtgatcgagtacagcggcaagtaccaggctgcgggtgaattgggtcacgttaaggacatcataaaatgggggaccgattaccttctcaagaacttcaacagcaccgccgacaccatcacccagctgggcatgcaggttggatccggggacacctcccaagggagcgccactcccaacgaccactactgctggatgcgtcccgaggacatcgactacgaccgccccacccagacctgcaccacatgctccgatttggccgccgagatggcggcggcgttggcggcggcctccattgttttcaaggacaacagggcgtattcgcagaagctggttcacggggcgactacgctttttaagttctctagggatcagagagggaggtacagtccaaatgggaaggaggcttctgtattctacaattccaccagctattgggatgagttcgtttggggaggggcatggatgtactttgccactgggaattcctcttacctcaagctcgctaccactcctcgcctcgccaaacacgctggcgccttctggggaggccctgactacggtgtcctcagctgggataacaagcttactggtgctcaggttcttctcagtcgtttgaggttgttcctgagtcctggttttccctatgaagatattctaaccacatttcacaatcagacaggcatagtcatgtgctcctacctcccaatgttcaccagctttaatagaacaaggggtggcttgattcaattaaaccatggtaggcctcagcctctccaatatgttgtcaatgccgcctttttggctgccctttacagtgattatctcgatgctgctgatacacctggatggtattgtggacccaatttcttctcaactgatgttcttcgagactttgcaaagacccagattgattacatccttgggaagaaccctcggaaaatgagctatgttgtaggttttggtaatcattatccaaaacatgttcaccatagaggtgcgtctataccaaagaacaaggttaagtacaactgtaaaggaggatggaaatggagggactcatccaagccaaacccacatacaattgttggtgctatggttgctggtcctgacaagcacgatcatttccatgatgtccgaaccaactacaactacactgagccaactctagcaggaaatgcaggtttagtggctgcacttgtggcattgtccggtgataaaaccacaggaattgacaaaaacaccctcttctctgctgttcccccaatgtttcccacaccaccaccacctccagcaccatggaaaccatga

SEQ ID NO: 6573 - DNA, 663 bp, Glycine max
  Peptide Sequence Number=SeqID_123351
gttctttacccaatcatggaatgggaagctactgcctttggccgtccagttcttgctttagtactagttgcctctctggctttattcccggtgttcttaatcccttctggcccctccatgtggctggctgggatgatttttggttatggccttggcttcgttataataatggttggaacaaccattgggatgcaatggttaaagagatggccccagaatgctgcactgattaggcttgctggggaagggaactggtctcgtcaatttcaagtggttgcactgtttagggtttctccttttccctatactatattcaattatgccgtggtagtcacaaatatgaggttttggccctacttatgtggatcagtagctggaatggtaccagaagctttcatctatatctacagtggtcggttaataaagacattggcagacgcacagtatgggaagcaccacttgactactgtggaaatcgtatacaacattatttctttcattattgcaatagttaccactattgccttcactgtctacgcaaaaaggactctaaatgaactcaaaatggcagagttgaatgatgaagttacctctgtttctgtagagatggagaagcttccccttgaaaggcctaaacagcttagtttgccaaaaatttcgtga

SEQ ID NO: 6574 - DNA, 2052 bp, Glycine max
  Peptide Sequence Number=SeqID_123352
atgcagaaagggatgtttggcagaaactcctgtgacatagcacaaacatctgatgacaaacacttcgtgtggacaatggatctatcttacaacaaggacttgactggaccacttccagaatccattggggaattgaagaagctggcaaccttaattcttgttggttgtagcttcaagggtcctattccagacagcataggaaatatgcaggagctcctcttcttatcattaaattccaatagctttagtggaccaattcctcattctattggtaatctatcaaagctttattggttagatttagctgacaatcaacttcaagggaacatcccggtatctagtggcgacatatctggtcttgataagttacaccatgccaagcattttcatcttgggaagaataatctctcaggcagtattcctcctcaactttttagctcggaaatggctctgattcatgtgcttttggaaagcaatcaactcactgacaagattccacctacccttggactagttcagagtctggaggtggtgcgcttagatggtaattcattaaatggacctgtgcctccaaacatcaacaatcttactcatgttcaagatctgtacttgtccaacaataaactgtcaggctccctgccaaaccttactggaatgaatgccctcagctatctggacatgagcaacaatagttttaagccattggattttccaggatggttttcaactcttaagtccttaacaacattaaagatggagagaacacaacttcaaggacaggttcctacttctttgtttacacttatcaatttacagattgtcaatcagctgcgacttgttgattttgagactaattcaattgacagctttgagcaaaaagacgaagttccaaatgtgaaaatcaagataatacttaaagataacccaatttgtcaagaaaatggagaactagaaagctactgctcctcttctcaacccaatgtctcatattcaacaccactaaataactgtcaacctggtacctgcagttcagaacagattcttagtcccaactgtatatgcgcatatccatattcaggaaccttaactttcaggtcacctccctttttggactttgataacaaaacttactactcaatgcttgaggagggtcttatgaactcttttaagtctcattttctacctgtggattcggttttgttgagccatccaagtaaggattcaactcagtatctcgaattgagcttacaagtcttcccatcaggacagaatcatttcaatcgaacaggggcttttagcattggttttctgcttagcaaccagacttttaagcctcctaaagtttttggaccattttattttgttggagataaatatgaacactttgaaaactctgaaggattgactgaatcgagtaaatcttcaaacattggaatcataattggggcagcagtgggtggacgctgggatacagcttcgagcaagagtgaggtccctcagttgacagaagcaaggatgttttcttttgaagagcttaaaaaatacaccaaaaatttttctcaagtcaatggcattggatctgggggttttgggaaggtttataagggaaaccttcccaatggacaagtgatagcaataaaacgagctcaaaaagaatctatgcagggaaagcttgagtttaaagcggaaattgagctcctatcaagggtccaccataagaatcttgtcagccttgtgggattctgctttgagcacgaagaacaaatgctggtttatgagtatgttcaaaatggaagtttaaaggacgctctctcagggaagtcaggaattagattagattggattagaaggctaaaaattgcccttggtactgcccgtggtttggcttatcttcacgaacttgttaatcctcccatcatacatagggacatcaaatcaaacaatattttgctggatgaccgcctgaatgccaaagtttctgattttggtctctccaagtctatggttgattctgagaaagatcatgttaccactcaagttaaaggaacaatg

SEQ ID NO: 6575 - DNA, 228 bp, Glycine max
  Peptide Sequence Number=SeqID_123353
atgccaactgacacatcatcagtttccggcggcgaaatcgtgtgtgtgaccggtgccggcgatgatccgaagaatggtcatttgaaagagttggaaggaggcaaggagaggctaactctgcataaagttgatctcttcgatattgactccattaaagaagctcttaacggttgccacggtgtcttccacaccgcttctccagtcaccgacaacccttttcgagtttga

SEQ ID NO: 6576 - DNA, 411 bp, Glycine max
  Peptide Sequence Number=SeqID_123354
atgctctcctttaacgattggggcagaaacggtggccaaaggttgaagctttgcttgaagcttcaatggagaatgaagaagaagaaagctacaaatttccaggatgttacaggtttcggctgttatcgtacaccgaccaaagaggattgtgcggcagtttggtgtgcagtaaactacatcgacgggctctacgtgagactgtcacagcccggggatccacttaggcatccacctgttgtgcacgatgacacatatgttgaaccagatattcctcagtacccaatggcgatgacagctatagaggaagcacctgcagatgcgccttctcatgtagagcagcctcgacatgcagtggttgacacggttgttgaacctaaggatagtaacagaaggtacaaaagcgtacaatga

SEQ ID NO: 6577 - DNA, 1890 bp, Glycine max
  Peptide Sequence Number=SeqID_123355
atggactacagctccgaagaagattctgatatcagtgaatctgagattgaagagtacgcagagaaaccatatgaacagttaagggctgggaaatacaaggttaaaaatttgaatggaactcttaggtgtccttactgtgctgggaagaaaaaacaagaattcaaatataaggatttattgcaacatgcatcaggagttggtaagggttctgctaacagaagtgcacaacaaaaggcaaaccaccttgctctagcaaagtatttggagactgacctagctagtgaagcagagtcaatccagcgcccagctccaccccaagctgtcaatcaacctttgttgcaagaagatctttatgtttggccttggacaggtataattgttaacataaaggggaaatcaattgattctggatattggttgaaggaatttgctaaattcagaccaatagatttccgtatattcttaaaagatgatgacctgattgctgaggctgtggtagacttcaataacgactggaatggtttcatgaatgcaagtgagtttgagaagtcatttgaagctgcacgccacggtaagaaggattggaattcaaggaagttagaagctggctcaaacatttatggatgggttgcccgggaagatgattataattgtggagggccaatcggggaatacctccgcaacaaaggaaggttgaggacagtttcagatattgttcaagaggcatctgtaagcaggaataatattgtgacaaacttgactaatgaaattgagataacaaacgaaaaccttgacaaaatgcaatataagtttaatgaaaagactatgtccttgagtaggatgcttgaggagaaagataagcttcacaatgcctttgaagaagaatcaaggaatatgcagcgtagagctcgtaacgaggtacgaaggatcttggatgaacaagaaaagctgagtagtgaattggaggaaaaaaagcggaaacttgattcctggagtagagatctaaacaaacgtgaggccctaactgatcaagagaagaagaaactagatgaggacaagaagaagaaagatttgaggaatgaatcactccaattggcttcaaaggaacaaaagatagctgatgagaatgtcttgaggcttgttgaagagcaaaagcgagagaaagaggaggcctataacaagatacttcagttggaaaaacagttagatgccaaacaaaagttggaaatggaaattgaagagttaaaagggaaattgcaagttatgaagcatcttggagatgaagatgatgcagctgttcagaataaaataaaggagatgaatgatgaattgcaagaaaaagtagacaatttggaaaatatggaggccatgaatcaaaccctcatcgtgaaggagcgccaaagtaatgatgaactgcaggaagctcgtaaagaattaataaacgggttagacgatatgctgaatggtcctagaactaatattgggctcaagagaatgggagagcttgatcagaagatttttgtgaataactgcaagaaaagatttcctcttgaagaagctgggaccaaaggtgtcgagctttgctctttgtggcaggagaacgtgaagaattcagcttggcatccatttaaagtggtcacagttgatgataaaccagagaatattataaatgaggaagatgagaagttaagaagcctcaagcaggaatggggggatgagatatattcagctgttgttacagccctaaaagaaataaatgaatacaatgcaagtggtgggtatactgttaaagagctatggaacttcaaggaaaaaagaaaggctacattgaaagaagttatcaattatattatggatcatatcaagccacttaagcgcaagagagcttag

SEQ ID NO: 6578 - DNA, 885 bp, Glycine max
  Peptide Sequence Number=SeqID_123356
atgaaattgaaagcggttccatggtggcataattggttagtggtaaaagcaggatcaagtcacagcagcctcatggtacgcaagaagcagactcaggattctgaatccactcctccaagaatcacatccaacgtcaaacaaaacctccgcttcctaaagctatggaagagcttccagaatagaaattctagcactcctaggccttctaccagttaccgcaagaagaaggtcgagaaggaagatgatgttgttgacacagacctctatcgtgatcccaccacctccctctactacacaaaccagcagggtatattagacaatgccgtccctgtacttcttgtggatggctataatgtgtgtggctattggatgaagctcaagaaacatttcgtcaaaggaagacttgatattgctcgccaaaagctgattgatgagcttctaacctttagcatgcttagagaggtcaaaatcgttgttgtctttgatgcaatgatgtctggactccccactcacaaggaagatttcgctggtcttgatatcattttctcaggtgaaacatgtgctgacacatggattgaaaaagaggttgcagctttaaaggaggatggttgccccaaagtctgggtagtcacttctgatcactgccatcagcaagcagcacatggagctttttatactgctgctgactttcagggagcctttatttggagttgcaaggcattggttactgagatcaaggcatcacaaaaggaggttgaaaggatgcttcaagagcaaagatccacttcttttcaaggtagattattgaagcacaatcttgatgcagaagtagtggatgctctgaaggacctgaggcaaaaactatctgaaaatgagttgaagtaa

SEQ ID NO: 6579 - DNA, 510 bp, Glycine max
  Peptide Sequence Number=SeqID_123357
atggctcagccaatacagagtatgagagttatgcgagttactcttggaccttactctaaggttcatgccgccaacaagctcgagttgcgccacccgcgtgtcgcattctgtgaggtgtgcgagcaggcgtcggcgcatgtgacctgcaaggctgacgctgccgctctctgcctcgcttgcgaccgcgatatccattctgccaaccccctcgccagttgccacgagcgcatccccgtcacgtcgttcttcgagtccgtacactcagtcaaggcctcctcgccaatcaatttccaccaccccttcttctccgacgtcgacgctgacgtcagcaccgaggaggccgaggccgcatcctggctgctagctaatccgaagacatatctaaattcgtctcagtacttattctccaaaaccgaatcagttccttacgtagatctggattacacagccatggattcgaagacggagcagaaaagttctgccaccgctgacggcgtcattccggtgtag

SEQ ID NO: 6580 - DNA, 210 bp, Glycine max
  Peptide Sequence Number=SeqID_123358
atggtttgggttgaggttgatttgagaaaacctgtggtggtaaaggtcattgttcatatgcattggtaccattttgaatatgaaagcttgcatctcccttgcacctcatgtggccattatggccatcgaagtaaggattgtccaaagaaaccaccgcagatgtcaacgaaggtgaaccctagcataaacttaaaggtgacaatagattaa

SEQ ID NO: 6581 - DNA, 1303 bp, Glycine max
  Peptide Sequence Number=SeqID_123359
atggctagtactttcccaataggaaaggtgacaaagatgctaatagcgggacaatctacgaggacgaatgggggagagaggactaacggcgatgctagctcgaaggatggagccaagacgcaaaaccctaatagtaatgagcgagatatcaatcaacagagaataaaggaagggaagatctttacggggattggattgatggaaaagggggaaagacagaaatggacaagaccaaaagtcaacgggaatgcaagcaaggtccctgaggtccctaagatgacgatgacgtgtaacctaccaacacatggtcttgccacatatgggaaagacacaaaacttttgtatccaaatagccatgccaatgaagtttgtggtcacccaaggagaagcaaactcatgaaatttgagtcaagagatggaaggggtggtgagcatggtagaggaaatccaatcggggggtttgcaaataagaaaagttttcagcatatgaggaagttgatatcgaaataccatctagatatcagactcataaaagttgtcactctaacaagacattatgaaagcttctccttaaaagaaaagggatttatggatgacatgtttgggagactacaagtgctcctaactggtcttaaggctttgggttacacctacaccaaagctcagataaatctaaaggtgttgaatagtttttccaaggtgtgggaaccaaagacaataaccattctaaaggctaaagacttaaaagactcgtctaggatgaacttctggatagacaaatccacaaaggaagagaagaagaactccttcaaatctcttaaagtacagatgattgagtttaacgtgtcaaacaacaactctggaggatccacagacaatgaagtgatgccttatgatgttcttctccaaaattgtcatatgatttctcttcaatgcaaaaagtataaagaaagaaataaaacatctatttttgaaaacactaagctaaagaaatcagatgaggatttggaaaagaagatcaatgctctggaagagagtttgagtcaagctagtctgtctggcttaggcttagaagaagagacatcttcctctgagtcacaatctgatccagacaaatatgacttttgtggtaagtctggacattccaagttcatatgcatccataagaagaaacaaatgtctaaggacaatggttgctcacgacacatgacagaggaaaggtctatgttcctcaacctaaagccagttgaaggaggagtgggttcctttggaggcatgggtaaagggaagatcactgatatag

SEQ ID NO: 6582 - DNA, 330 bp, Glycine max
  Peptide Sequence Number=SeqID_123360
atggaatgcacagaaggctggagcttctgctgttctactaagcaaggtgacttatctgcctgtatgaagcaacacactttaccaaagaagttcataaaagggttaacaactacgagtttgcaaggaagggctcagattgttcctgatcagttcatcaatgatgaaataccaaatgaacttgtcttctttttagatggggctcatagtcctgaaagcatggaagcatgcactaagtggttttctcttgctattaaagatgaagaccagattttgtttcatcaaaaacctgataattctaacttctcaagtagtgaagatgcacaattgtga

SEQ ID NO: 6583 - DNA, 2025 bp, Glycine max
  Peptide Sequence Number=SeqID_123361
atggagcagctttctgggaagttcaaccttgacggaaatattgagttgcagattgctgttagttcttcagaaccaggagctgcaagacaagtagattttaaggtttcatataatagtgagtctctgcttttacattggggagttgtgcgtgatcagccagggaagtgggttcttccttctcgtcacccagatggaactaaaaattataagagcagagctcttagaactccttttgtgaaatccgactcaggatctttccttaaaatagaaattgacgatcctgctgcacaagccattgagttcctcatacttgatgaggctaagaataagtggtttaagaataatggtgagaactttcacatcaagttaccagtaaaaagcaagctatctcaagaagtttcagttcctgaagaccttgtacagattcaagcatatcttaggtgggaacgaaagggtaagcagatgtacactccagagcaagagaaggaggaatatgaagcagctcggaatgaactattggaggaagtagccaggggtacttctgtgcaagatctccatgcaaggttaactaagaaaactaaagctgccgaagtaaaggagccttctgtttctgaaacaaagaccatccctgatgaacttgtacagattcaagcttttatacgatgggaaaaagctgggaagcctaactactctcgggaacaacaacttatggaatttgaggaagcaagaaaagaattgttagaagagcttgagaagggggcttctctggatgcgatacggaagaagattgtcaaaggagagatacaaactaaagttgccaagcaattgaaaaccaaaaaatactttcgtgctgaaagaatacagaggaaaaagagagatttgatgcagcttatcaaccgaaatgttgcacaaaatatagttgaacaagttatagatgctccaaaagccttgacagtaattgaacattatgccaatgcaagggaagaatatgaaagtggtcctgttttgaataagacaatatacaagcttggtgataattatcttctggtccttgttaccaaggatgctggcaagattaaggttcacctagctacagactcgaaaaaaccttttacacttcactgggccttatctagaacatctgaagagtggttggtaccacctgaaactgctctgccccctggatctgttactatgaatgaggccgctgaaacacctttcaaagctggttcttcgtctcatccttcttatgaggtccagtccttggatatagaggttgatgatgatacttttaaaggaataccttttgtcattctgtcggatggagaatggataaagaacaatggatcaaatttttatattgaatttggagggaagaagcagaaacagaaggattttggcaatggcaaaggtacagccaagttcttgttgaataaaatagcagaaatggaaagtgaggcacaaaagtccttcatgcatcgggtctgcacagatagttatagtcttaaaaggcaaactgagcttcctgtgccaccagctaccaatgccttattctatgtctgtgttacgtgcatatttaacattgcatcagatttgatagatgaagccaaaaatgctggtcaactgggtcttgcggggattttggtgtggatgagattcatggctacaaggcagctcatatggaacaaaaattacaatgtgaagccacgtgagataagtaaagcacaggataggcttacagacttgctccaagatgtttatgcaaattatccacagtatagggaaattgtgaggatgatcttgtccactgttggtcgtggaggtgaaggagatgtcggacagaggattcgggatgaaatccttgttatccagagaaataatgattgcaaaggtggaatgatggaggaatggcaccagaaattacacaataatactagtcctgatgatgttgtaatctgtcaggctagtttttcttctataactgatttgtgtctcaagttagttattgagtctagtcagtgctga

SEQ ID NO: 6584 - DNA, 1011 bp, Glycine max
  Peptide Sequence Number=SeqID_123362
atgcaatttctctcagtttctgatctagatgcaggaattgaaaatcctctttatcgcacttgggagcttcagtatcagcttcgcaactccaaaaaaggagataagtcagtttttgaatttttacttctcattaaggttattgttgatgcgctttactccataagacatcctgtttcagagcatgaacaactagatgttatccttgaaggtcttccttctgagtatgaattgctggtactgcttatgactaccaagcctgatctattttctttttctaaaattggttcactgttagttgcgcaagaagcacgcattgaaaggaacaagcaaacagagattgtgtctctcaatcttactcaggccactgcttcgaagcagcctgatgcttcctcctcgtctgttgttcagtatactcagtcgaagttgaactcagcaaattcttgtcacaatcagtcttacaataactatcagtgtggtgactatggcttttgtggctgtggtggaggtcagcgtggtggctgtcgccatcgcggtgctcatggtggtaacagtaatgtccagtgtcaagtctgcagtaaatttggacacattgcagcatactgtcactacaggtttgactcatcctgcatgcctcagcaaaacatttatcaaccaaatcagtttgccactggacatcaacagtttcctaattctccagctacttacactgcaccaccaggatttcatttacaacgaaactacactcagtttggtcctccacagtcacaggcacatcaaattacttatatagcacctaccctctctactgtagcagctccatccatgactcagtattcagtagcatcaatgacctatcaaacttctttcccactagagtacttagctcatgaccgtcccaaaactgggttgtggactcgaatgcttctcaccatgtcaccactgatggtgaaaatctcacgaattctgctgcagtccaagggaatgaaaatattttccttgcaaatggtcaag

SEQ ID NO: 6585 - DNA, 1743 bp, Glycine max
  Peptide Sequence Number=SeqID_123363
atgttactcctcaatctgtttcgtctcaacagatttccccttctcagtctgtcttctgagtctaatcagtcaaactcagcttctgagttgtcaagtcctgttcctaagtcttgtcatgtcactgttcctgaacagactcaatcagtttctgaacagctttcctcttctgttcatcctatgcagactagttccaagtctggcattgtcaaacctaaacttcatcctactttgctttttactactgctgaaccttctactgtgaagcaggccttaatttctcctccatggagacaagccatgcaagctgactttgatgctctaatggaaaacaaaaccttgacattgacttctcttccatcagggaaggcagccattgactccctcactaatcattggccacttcaacaagtagatattaataatgcttttctacatggacttctaactgaggaggtgtacatggttcagctaccagggtttgaaaccattgattctactcttgtttgcaagctgcagaaggccatttatggccttaaacaggcaactagggcctgtgactttgatattggtgtttactggaaagcattgaatgacaatggaataacaaaagagcggcttctgagctatgaccgtgccatccattctgaaccaaattttaggagagatcagaaggaaggtcttctgcgagatctgggaaactacatgaggactttaaaggcagttcattccggtgcagatcttgaatctgctatttcaaattgtatgggctacaaatctgagggtcagggcttcatggtaggggtgaagataaatccagtgccgggtttgcctactggttttccagaattacttgagtttgtcatggaacacgttgaagagaagaatgttgaaccacttcttgaggggttgcttgaggctcgtcaggaactccaaccatcactcagtaaatcccaaagtcgtctgaaagatcttatatttttggatgttgcccttgattctacagttagaacagcagtggaaaggagttatgaggaattaaacaatgctggacctgagaaaataatgtacttcattagcttggttcttgaaaatctcgcactttcatcggatgacaatgaagatcttatctactgtttgaagggatgggatgttgccttaagcatgtgcaagattaaagatactcattgggcattgtacgcaaaatcagtccttgacagaacccgtcttgcactaacaaacaaggctcatttataccaggaaattctgcaaccatcggcagaatatcttggatcactgcttggcgtggacaaatgggccgtggaaatatttactgaagaaattatccgtgctggatctgctgcttctttgtctactcttctaaatcgactggatcctgtgctccgaaagacagctcatcttggaagctggcaggttattagtccagttgaaactgttggatatgttgaggttgtagatgagttgcttactgttcaaaacaaatcatatgagcgacctacaattttgatagccaatagtgtgaaaggagaggaagaaattccagatggtacagttgctgtcctgacacctgatatgcctgatgtcctatcccatgtttctgtacgagcaagaaatagcaagctgattcaaaattttattatcatcgaagtcagcatccaatctgtgaaattctgtgaatttgttagagttgataatgtaaacaaaagggtttttggggaaatttaa

SEQ ID NO: 6586 - DNA, 1173 bp, Glycine max
  Peptide Sequence Number=SeqID_123364
atgtcactaggtgaaggaagtaaggcatctggaactgtggctacaatgaatgcaaaaccagctaaagctgtaaagcctgcacagaaagttgataatgcagcagttgcagcgtctgaaaagaagggaggtgagattccaccagaaaaggatagaaagaaagatgctcctcaaccacgcatgcagtatgacgacaagagtcgagtggagaaagctaaacgtcgtgcagtggtgaaacaaactgaagctaggaatagagttgagttgttcaggcatttgccacaatatgagcatgggagtcagcttccagatctcgaggcaaagtttttccatctttctccagtgcacccttctgtttataaggtgggtttgcaatatctaactggagatatagctggtggcaatgctcgttgtattgcaatgcttcaagcattccaagaggccatcaaagactacaaggttccacatgagaagactcttgtgagagacttgacagcaaaaattagtagttatgtatcatttcttattgaatgtcggcctctgtcaatcagcatgggaaatgcaattcggtttcttaaaagtcatatagccaagctacctttgaccttgtctgaatcagaagcaaaagcttctctccagtcagatattgagcgttttataagtgaaaagattatacttgccaacaaggtgatagtgaagcatgctgtcaccaaaataagagatggtgatgttcttctaacatatgggtcctcatcagctgttgaaatgatactattacatgcacatgagttggggaagcagtttcgtgttgtcgtagttgactctcgtccaaagcttagagggcaactcttacttcgcaggcttgtggagaaaggtcttagctgtacatatactcatataaatgctgtttcctacataatgcatgaagttactcgggtttttctgggtgcttcagcagttttgtctaatggaacagtatattcaagagtagggactgcatgtgttgcaatggttgctcatgcattccgtgtacctgtcatattgtataagatgaggattctatttacactccccggtagattcttgcattgtgtttctaagaaggttgatgtttctatgatgttcttacaggcaatccagatgtcatttcaaatgtactgggtagagaggatgtaa

SEQ ID NO: 6587 - DNA, 291 bp, Glycine max
  Peptide Sequence Number=SeqID_123365
atggtacatctcttgtggatcagttcaagtggagggtacatccacttggttgttcaaagagaacaaggcagggtacatcccttgtggatctttgcttgtaaaggtttttacaaggttgaaaagaaatctcaaggaccgcaagtctcttggggactggatacaaccacacgccatccgagattgcctaataccgggatgctattggtgaagagatacttgagggagagatgcattcatctaatgaggaaggcgattcctcgggagacgagagtgacccttctgaatatatga

SEQ ID NO: 6588 - DNA, 549 bp, Glycine max
  Peptide Sequence Number=SeqID_123366
atggatccctcacgccgtgccccacgcgccgtgatcgaccctataccgaagatccgccaagtggggttctttgccccgcccgagcgctctcagtcgggtcctcccgacccgacccactcctctcccccgatctccagctccctctccccggtcatgatcccgcccccgcgccacctctccgacaacctccttctccacgccccccgccccgcctcctcccccctctccgccgccgctgccgccggaggaagcggaaactcctttgactacggcgcggtcttcttccccgccccgctctctcccgcgataccgtcgtcttcgtactccagcagaatcatcgccaccaccggcgagggagggttcttcaaggggaacggcgccggcggcggaaaggtggcggcgtcatcgttccctcgcggaggattcgacttgacggcgatgaagaaggcggcggcggcgagtgttgtggtgccggcgagcgagttgactacggtttccgtggtaaatgattcgctcgggattcctggtgaggttcttatcaatggctag

SEQ ID NO: 6589 - DNA, 240 bp, Glycine max
  Peptide Sequence Number=SeqID_123367
atggagcttgaaatctaccctaagcctcatgagaaccctagggtcttctcttgcatctttggcctaatcttcttggagtcttcaatccaatgcacttggggattcttaccaaaaacttatgaaacaaaatgttggaaaaaaggaaacgaaacaaatggtttgaagctatggatggttcctagacagtgcgaaattatggatgatttggttcaagaagagaggttaagggaaagaggttag

SEQ ID NO: 6590 - DNA, 264 bp, Glycine max
  Peptide Sequence Number=SeqID_123368
atggcacaacctccaccccgtgagaggactctaagggaaatggctgcacctgatttcacctacgaaagcttgtgcatccaataccctgatgaggatgtcccatatgttcgtaaaactagactgatccatttgcttccaaagtttcatggccttgcagagggagtggcaaaggactggctatattaccttgctccaaggtccatcacgagctgggatgacctcaagagagaccacgaccatcagaaaggatatttcaggcattag

SEQ ID NO: 6591 - DNA, 1203 bp, Glycine max
  Peptide Sequence Number=SeqID_123369
atggcaattgcagcggcaaactcatcacccaccatgagcctcagccatagccagagccaagaggatgccaccaccaacgacaacaagcccgtcgtcgtcgacgatgatcacgagcacgacatggtcatgcccggctttcgcttccacccaactgaagaagagctcgtggagttctaccttcgccgtaaggtggagggaaagcgtttcaacgttgagcttattactttcctcgatctttatcgctatgacccttgggagcttcccgccttggcagctattggtgagaaggagtggtacttctatgtgcccagagataggaagtatcgcaacggtgatcgtcccaatcgcgttactacctctgggtattggaaggcaacaggagctgataggatgatccgaaccgagaattttcgctctatcggcctcaagaaaaccctagttttctattctgggaaagctcctaaaggcattcgaaccagttggattatgaacgagtatcgcttgccgcaacatgaaactgaacgatatcaaaaggctgagatatcgctttgccgtgtgtacaagagagctggagtcgaagaccatccttccctccctcgctgcctcccaacgaggccatcctcatcatcaagggcttcttctgatcacatcaataataataagtcgacgaagcacaatgaaatggttcaacaccacaacatcaacatgggattcatgggacaatcaaagccgccaacaactgaacacatagttgacaaaattaatgaatcggaagcaagcagtgatgtcaacacaactcttggactttctaaatacaatgcttaccgtgctgccaccatggcgcttccagttgttccaatggatgaggaagccttgatgatgatgcagcaatctaagcaagctgctgctgcagcagcacatgttccaacaatcttctctgctgggccttctagttccaacaacagtggagtagtgaatatggatgatctgaataggctaatgagttatcaacatcagtactacaatgttcaaagccaaagccatcccaatcagttctctactttgctgatgcaaccttcaccaatagtgtctctcagctcgctaccaaatccacttccacccaccttctctgaccgactctgggactggaatccaatccctgagtcaccaagtcaagagtacagcaacatatccttcaagtaa

SEQ ID NO: 6592 - DNA, 975 bp, Glycine max
  Peptide Sequence Number=SeqID_123370
atgtctcttaagcctctcctcgaggactatatgcttcgtgtcttcactgaagaaggtgctcgcgaaaatagccacaacgaggtcgaggacagcagcgaccttgatgttgacaaaagtaagctgccattgcagttagccattgtaggacgccctaatgttggtaaatcaactttattgaatgcattgttgcaagaagaccgtgttcttgtgggtcctgaagctggtctgacaagagattcaatcagaacccagtttgaatttcaaggaagaacaatttatctggttgatactgctggttggttgcagaggacgaagcaggagaaaggagcagcatccttgagcattatgcaatcaaggaagagtctactccgggctcatataattgctttagtactagatgcagaagagattataaatgcaagacgaagtatgaaacatgctgaagtagttatagccagacgggcagtggaagaaggacgtgggctggttgtgattgtgaacaagatggaccttctaagaggcaaacacaaatcgtcatcctatgagaaggttatggaagttgttccacaagaaattcagacaattatacctcaggtaacagggatcccagttgtattcatttcagcattggagggaaggggccggaccactgtcttgaatcaggttatgagcaggcattcttggaaagaccaagcagcacagcctaaggttaagtatttcactcaggtcaaggcccggccacctacatttgttgcgtttgtgcgtgggaagactcagctttctgatacagacattaggttcttaaccaagtccttgaaggaggacttcgatttgggtggaattcctatacggatcatgcaacgttctgtcactaagaaagatgccagtggaagtggaaatagcaagaatagccattcggtatgcagagtggttgaaaggactgtctctgacaagagaagtatcgtagatgaataa

SEQ ID NO: 6593 - DNA, 348 bp, Glycine max
  Peptide Sequence Number=SeqID_123371
atgccactcaaaggagttgggcataatgttccaacaaatcttggtcgagttaaaggtgatcctggtgcctcatctctaacacaatcaaatcctaagattgggtccaataatggaaatgaaatgacaaaggaaaaatataagccatatttgaaacacattgtgaatgggtctagttttaccaatggtatagttgttgttaacgtaggcccacctaagataaggtcaaataaagtctttgttaagactaattacatggagattgaaaaggtgtttgtcccaacctctaatagggaacttcttgcccatatgatcgcctctaaggagattgattcgggtcccaagatatga

SEQ ID NO: 6594 - DNA, 633 bp, Glycine max
  Peptide Sequence Number=SeqID_123372
atggcaccaattcgtccaagaccatatgttcaacctccaccaactgcacctattaatctaaatgtcaatgttagactcttccctggattcagagggcacatagtcttagagtggcagacttgtaataaggtctggaaggagaaaggcgaagttgggtctcacatacttcatcctaaaatgtcacaattttcttacgtggtcacctccaacactcaattcgcaatagcagtagataagcttgtcttgtatcaaaaggccaagtgcgacaagtgcaaggagttgttgattgaagaggatgaagatgctccatcaaccagatatgtgaatgctcgacctagaaggctttttaagcatgagtttgaggctctcaagatgaagacaaagcatacaagtctggtttggtttaccatgagaagattctatagacttaaagcttattgccctgttgtggaacctaatgggaagccctctacatacggagttcatcatcaaatagggagttgttatcagactctgaaccatttgtgtttcactaaagatactcccttcaatatgatctattcttggactagggagttcaatattgtgtttgattacaacttcacttttggactagggagttatgtaatgtaa

SEQ ID NO: 6595 - DNA, 1050 bp, Glycine max
  Peptide Sequence Number=SeqID_123373
atggaaggagtaccgcacccaatacccagaactgtcgaagaggttttcaccgattttaagggcagacgcgctggtttgattaaggccctcactactgacgttgaaaagttttaccagcagtgcgatcccgagaaggagaatttgtgtctatatgggtttccaaatgaaacatgggaagtgaatttgcctgttgaggaagtgcctcctgaacttcctgagccagcattaggtataaactttgccagggacggcatgcaagagaaggactggctatcactggttgcagttcacagtgactcatggctgcttgctgttgctttctattttggtgcccgctttggatttggtaagaatgaaagaaagggaatttgggaaaggctagaagagaacatagatttgagtcttgagatttgggaattcatgctgatctctacaatggcagagcatcggttggcagtgggggcatgggcttgttggtggtatacttggacggtggaaacaattatgtgcaaagtgggtttgcagttgagtcaaattggttttctggtggtgacggagaaggaagaggtagaagattttaataaaagtgctatggtcagggtgcaaagtggctttggattttggctatggagatctgactactgccatgatgagtctgggaggaaaaggctttttcagatgataaatgatctgccgacaatcttcgaacttgtgacaggaagtgctaagcaattaaaggatcaaccagctgctcacaacaatggtagcaaatgcaaatcaagtggaaaggtgtcccatcagtctgagtctcaggccaaggggatgaagatgtctgcaccacccaaagaagaggatgagagtggagaagaagaagaagatgatgaacagggtgcaacatgtggtgcttgcggtgataattatggcactgatgaattctggatctgttgtgatatgtgtgaaagatggttccatggtaaatgtgttaaaattactcctgctaaggctgagcacatcaagcaatacaagtgccctagctgcagtaacaagagg

SEQ ID NO: 6596 - DNA, 489 bp, Glycine max
  Peptide Sequence Number=SeqID_123374
atgttggtgctaactataacccttattccaacacctaaaaccaaggttggagagaccacccaaatttgtcttggaaggagcaaaaagatcaaaggcaaggttagagttaaagccaaaatgtgtaccagcctcctcacctgtaagaggcctaggaaagaggagaaaagacacaccatgcaggacatgatgatggagcacatgactaagagtgatgagagagaactcaaggtgctctgccctcccaaactaagcccaaccctaaggaggattagaaggtggtttattgtttatcctaaaggcatagaggatgtgttggttaaggtgaacaagttcatctttctagacgattttgtggtgtttgatatcgaggtagatgaagatgtccccatcatactggggcatccattcctaaacacttatgacatagtgatagaggttaagcaaggtaggctcacccttaggatggtggatgagcaagttgttcactga

SEQ ID NO: 6597 - DNA, 237 bp, Glycine max
  Peptide Sequence Number=SeqID_123375
atggggcgtcttggagaagaacgagagaaactagttgctgtaaatgcgtgcgacagtgggtggcaacgacccactggttcttcttcttcgtcccaagccactgggatcacaaaccagatcggcaacgttccctgtttgctggtggcgatgctgttgagctttggagggttggggaccaggacaatgacatacatagtaactatgcctaaaaagaaattcatcaataattttgagtag

SEQ ID NO: 6598 - DNA, 195 bp, Glycine max
  Peptide Sequence Number=SeqID_123376
atgtatattaacaattccaacacagtaaacaaaacccacaagacttcgtcttcaacctccagcagtgcatatttagatcaaacagcggaaattaaaaggaattacaagcgtacctccagccattgcaaatcgaacgggaagcggctcacacacctgaaagacagttttgttcttccagacccttactcactctga

SEQ ID NO: 6599 - DNA, 3705 bp, Glycine max
  Peptide Sequence Number=SeqID_123377
atgtcagaaatgcgggtatctgagcttcacttgaagaaggaactcacccaaatccgcaaggctgctcgagtactcagagatcctggcaccacttcttcttggaagtcaccactcagttcatcaagatctgtggctgcatggaacaaagacactgccagtagaaggttcactacccccaatgacaaagacaaggacaaggacaagagggtgttcttgtacaactggaagaactacaaatcttccagtgagaaatacaacgatgaggaagaagaagaagatgatgatgacgatggatcttcttcgcttctcggggacagagacagagatagtttgagtgatgctcgcaatggttgtgactcaaagagtgatacttacttggctgctgccgatggtggcggcggcgctcgttcttccattttccgatgtggggatgccaatcttgtttccagaagagcggttccagttaagaaaaagagtaagaaaaataacccacattttgattttttagcaaagtatcaacaccatagaccaggaaaaaaatttgtgagttcttccaaggcattgctagaagggcatccttcgcctttttttaacagggatgactcggttgaacactctgatgatgataccgaggattacactaattccgagggtgtgagaccaatttcggggacttcccctttgcttctcaaactcaggcaaaagaactggtctcgctcttcctctaagtttttgagaagaagcaggaaagaggactcttcttattcttatagcacccctgcattgtcaactagttcttacaataggtacggtcaccgctatcccagcactcttggatcctgggatggaaccaccacatcggtcaatgatggcgacggcgatgatgagattgatgatcatttggatttgccaggccgtcaaggatgtggaattccttgctactggtccaagaggactcctaaacatagaggcatgtgtgggagttgttattctccttcactgtcggatactttgaggaggaaagggagtagcatgctctgtggaagtcaaactatttatccaaggcaccggagatcagcttcggcttctcacaagcgaagactctctttgaggagtgctagaggtgttattccattgctcactaatagtggtgatgttagagaagggtcatctgttggaaccggtaggagtgatgacgagctttccacaaactttggggagcttgatcttgagggattgagccggttggatggaagaaggtggtcatcgagttgtaggagtcaagagggattggagattgtagctctcaatggggaaggggaatatgatggcacgccagaaaataatcggagcttcagccagaagtataggcccatgttctttggtgaactgatcgggcagaatgttgtggttcagtcacttatcagtgctgtttcaaggggacgaattgctcccgtctatctgtttcaaggtccccgtgggactggcaaaacatcaacagctaggatatttgctgctgctttgaattgtgcgagtcctaatgagagcaaaccttgtggctactgcagagaatgtgttgatttcatttctggtaagagcagtgatctattggaagttgatggaaccaataagagaggaattgataaggctagatatctactaaaacgattgtcaactggatcatcatcagcctccccacaatatacaatttttgttattgatgagtgtcacctgttgccctccaagacatggctgggatttcttaagtttctggaagaaccaccgcagcgagttgtattcatttttataacatctgatcttgacaatgtgccacgaacaatacaatctcgatgccagaagtacctttttaataaaattaaagatggggatattgtgaccaggttgaggaaaatatctactcaggagaaccttgatgttgaagcagatgcactggacctcattgctatgaatgcagatggttcacttcgagatgcagaaacaatgttagaacaacttagtttgctggggaagagaattactacttctcttgtcaatgaactggtgggagttgtttcagatgaaaaattattggaacttttggagctagcaatgtcatcagatactgtagagacagtgaaaagagccagagaattgatggactctggagttgatccaatggttttgatgtctcaactagccggtcttatcatggacatcattgctggatcatatgcagtcattgacaccaaacctgatgattcattttttggtggacggagtttgaatcaatcagagttggagaggttaaagaatgctttgaagcttctctcagaggcagagaaacagttaaggacatccagtgaacgctctacatggttcacagcaactctattgcagcttggttctacaccttctcctgatcttactcagtcaagcagcagtaggagacagagctgcaagacaactgaagatgatccatcaagtgtttcaagagacgttacatcttgcatgcataagtcagaccctcaatatgtgcctcgaaagtcagcatacactgcatcccagcaaaaagccgtgaatgagagttcccaccatcaaaaggatatatcctcaaagattgaaggcttgaaatcaaagccatcaaacggcccagtcatagatgatggctccacagtggtctcatctgatgaccttatggttgagaatagaatgtttaggtgcatagattcagggaagttatgtgacatctgggtgcattgtattgagaggtgtcactcgaagacattgaggcagctgctacacaatcatggaaagcttgtgtctgtatgtgaagtagaaggtgttttggtagcatatgttgcttttggagatgccgatattaaagttagggttgagaggtttttgagaagcattacaaactctatggaaatggttcttaggcgcaatgtggaggtaagaataatccatttgccagatggtgaaggtgaaaatcaagttaatctattgggcctaaagcaggcagagtcaacagtggctggtgagaaggaagaaagaaagggtcatatgaacagaacggagtcttattctagttttcctcctttactggatggaaaccttcaatctaccaatgcttcatcagatattttggctgaaggaaatggtgtgaaggagaggagacaggataatccaatgcaaagaattgaatccatcattcgtgaacagaggctggaaactgcctggttacaggcagtagaaaagggttcccctggatcattgagtcggttgagacctgaggagaatcaagtactgctacagaatgctgtggacccaatggagtccatggattctacaagatttccctctcaccagcattgggaagatgaactgaataatgaagtcaaagttttaagccttaaaaatggaagggtcccacagaaggatcagattggtcgaaaggcagatcgttatcccatgtcaccaagtttattgcatgacaacagtttagcaacaatttctggaaaagacaatctgggatatgaatcagggtcaggagctgggggttgtggatttttatgttggaataagtccaagcctagaagggtagtaaaggtcaaaggtggcaccccagttagagcgcgtagagctgcaacttttacgttgtttggtgactgcactaagccaaagaaaagggagaggagaagataa

SEQ ID NO: 6600 - DNA, 1686 bp, Glycine max
  Peptide Sequence Number=SeqID_123378
atgacagttatattagggtacagtaacaattctgtgaaactttttgttaaaggggcagatacatccatgtttagtgtgatagacaaatcattgaactcagatatactacaagcaactgaaacccatcttcactcttattcctctgtgggtttgaggacacttgttattggcatgcgtgacttgaatgcttcagaatttgagcaatggcactctgcctttgaggcagcaagtactgctttgattggtagggcctctatgcttcgcaaggttgctatcaatgtagagaacaatctctgcatattgggtgcaactgctattgaagataaactgcagcaaggcgtaccagaatccattgagtctctaaggactgcaggtattaaagtatgggtcttgactggggacaaacagcaaactgccatatcaattggatgctcctcgaagctcctaacgagcaacatgactcaaattataattaataccaacaatagagagtcatgtagaagatgtttgcaagacgcccttgtcatgtctagaaaacacatgactgtgcctggggttactcacaattctgaaggaagatcagatgctgtttcaactccattagccttgattattgatggtaccagccttgtttatattcttgacagcgagcttgaagaagagctctttcaactagcaaatagatgttctgttgttctctgttgtcgagtggctccgctgcagaaggctgggattgtagcccttgtgaagaataggaccgatgacatgacactagccattggagatggtgctaatgacgtatcaatgatccaaatggctcatgttggagttggaatcagtggacaggagggtcggcaagctgtaatggcttcagattttgcaattgggcagtttaggcttttagttcctctcttattaatacatgggcattggaattaccaacgactgggttacatgataatatacaacttctacagaaatgctatctttgttcttgtcctattttggtatgtgctctttactgctttctctttgacaactgctataaatgaatggagcagcgtgttatattcaataatttactctgcagttccaactattgttgttggtgttcttgacaaggatcttagtaaaaggactctcctaaagcatcctcagctttatggggctgggctgagacaggaggcctacaacaaaaagttgttttggttgtcaatggccgatactttgtggcaaagcattgctgttttctttactcccctaatcgcatattggggaaccactgaagatgtagcaagcataggagatctttggactctttcagtggttattttggttaatttgcacttggccatggatgtcatcaggtggaattggattacgcatgcagcaatttggggctctatagttgcaactttcatttgtatcattattattgatgctataccagcctttcctggtttctgggctatctttcatgctgcaggcactggattgttctggctatgtttgctcggaactgtgatagccgcattacttcctcgattggttgtaaaatatatgaatcagtattattttcccagcgacattcagatttcgagagaagctgagaagtttgggaatccaagagacaatggagttggacagatagaaatgcttcctgtttcagatggttcaccaagataa

SEQ ID NO: 6601 - DNA, 722 bp, Glycine max
  Peptide Sequence Number=SeqID_123379
tcttactacttctcacaggtcttcctaagtcaggatgtcagatgtctagttcattcacatcaagtggaaaacatataatctcagttggagaggactcccatgtatatatttggaactttgatgacatgggaaatgcttcttcaaaacagacgaaatccgaacgctcctgtgagtactttttctctaaaggtgttactgttgcaattcctaggtcaggcatgaaagcagataaaagggactctagtggtaattattcccaccattcttcagaaatgccaacccaacagctagaggttgcctctgaggctagagatcacaaacgtttttctcttggtaattggttcgccattgatggcacgtgtcgaggttctatgacttggcccgaggagaaacttcctagctgggatttacctataacagaagatgaatatggtcaccagcagttatgttacaaagataattgccatggcagaaatgtatcagaaacatggggactatcaattgtggcagctggttgtgatggaactatcaagacattccacaactttggattgcccgctttgcctggtaaaggtggaaatttacaacggtgtgttatggccttagaatccaatgtaagtggctcaaaatgtgggaagacggaatttgaagcctttgcctctgcttatatgatgatcattgctaaatccatgttgagtctcaaggctctcgaaatgttctag

SEQ ID NO: 6602 - DNA, 852 bp, Glycine max
  Peptide Sequence Number=SeqID_123380
atggaactttcgagtcaagaaggcgaaatcccaatcccaataaacagcagtactacatatggacatggtaatggtcatggtcacggactcatgattcaccatgaccataaccacattatatcctccacggcaccttcaaatggcatacctaccatgcagcaggaggaggatcatggacttggaagctacaagaaagtagttcggtacagagaatgcctgaagaaccatgcagcagccatgggagggaatgccactgatgggtgtggtgagttcatgccaagtggagaagaagggaccatagaggcactgaactgctctgcctgtcattgccacagaaacttccacagaaaggaagtggagggtgagccttcatgtgactaccaccacctcaacatcaacagaagaagacacattctaggccctcacaagaacctcctcccacctgaggctctgggataccctacagctgctagaagtgtcccaccacaccagatgataatgccctacaacattggaggaattgggcaccacctcccttcagaatctgatgaacaagaagatggtggtggtggtggtggaatggtgcagcttagtagtagacccatcagctcccagcagcagctagtgaagaaaaggttcaggacaaagttcagccaggagcagaaggacaaaatgctcaactttgctgagaaggtgggttggaaaatccagaagcaagaggagtctgttgtgcaacagttctgccaagagattggggtcaagagaagagtgctcaaggtttggatgcataacaataagcacaatctcgccaaaaagaatcccccaacaactgctgcaccaccaccaccttaa

SEQ ID NO: 6603 - DNA, 144 bp, Glycine max
  Peptide Sequence Number=SeqID_123381
atggattatggtatgtttgaaccaaaaaggattgtgtcacaagctatctcaacaaccatcaggcaaaagtttcttcatccatggcctacatgggtagtgatgaaagaccatgaaaggatgccttcttccaatgctttaaggtag

SEQ ID NO: 6604 - DNA, 581 bp, Glycine max
  Peptide Sequence Number=SeqID_123382
gtctgaattcctcattggaggatacgtaggagcaagagcctcgcttttgtcgaccataccggcttttgttgccatgactcaagagctggtagcccgcggagacaccttacggttatccgcacctcgtcattcagtgaccccaagtgtgattgacgagaagagaccaaagaccaagtttggtcattctgcacccatgatacgcggagataccttatggttattcgcacccttttgtcatccagaggcggcgggcccgatgacaagcagagaccaagtttggtcattctgcacccatgatacgcggagattccttatggttattcgcacccttttgtcatccagaggcggcgggcccgatgacaagcagagaccaaagaccaagtttggtcattctgcacccatgatacgcggagataccttatggttattcgcacccttttgtcatccagaggcggcgggcccgatgacaagcagagaccaagtttggtcattctgcacccatgatacgcggagataccttatggttattcgcacccttttgtcatccagaggcggcgggcccgatgacaagcagagaccaa

SEQ ID NO: 6605 - DNA, 273 bp, Glycine max
  Peptide Sequence Number=SeqID_123383
atggttgtccaactaggcaacccacttgctccttttctttataccattgtggcagaatgtctaagtgtgctcacgacggaagcggtgaacttctacaagagtaaaattggggtgtttggtatggaggaaagtgtgatgaaaagatatgtagaacttttgaattgtagaatgatgaatgaggcctttctatacttgggattcctattggagcaaatccaagatgccaatatacttaggagggattcatatcaaagtttcaaaaaagatggctaa

SEQ ID NO: 6606 - DNA, 372 bp, Glycine max
  Peptide Sequence Number=SeqID_123384
atgttggtgcgcatgatccgcactcgtctctttgcagcggcacaggtgaaatcttgccccggtatgcatagtagctgtgtgatagcctccctctctggttgtgctcgcacagttggccctcctccaatatcagggggtggcccaagaaccgtgtggatatggagcccactgaatgtgaggacgcgtagtcctctaaaggcgagggcgtgtagccctctgaagttcaggacgtgtcgcctttcaaaggcgagggagtgtagtcctatgatggcaaggacgtgcaatcctctgaaggtgagggcatgtagccctacaaaggtgaaggcacatgaccctttgacggcgaggacgtgtagtcctctgaagttgaag

SEQ ID NO: 6607 - DNA, 273 bp, Glycine max
  Peptide Sequence Number=SeqID_123385
atggggatcgcacccacaagacacccagtggacccggaaaagtccaacagggcctggggtttccagctctggttacggcctctatcagtctacagggtgcccgtaccccccccggcaaggtcacgtcatcatagttctacggagtacctgtcacctccagcaagggcatcaggccccctactaatcgagctttcatcaagaagtactgcgcccccaggcaggcgcagggcgaaacaccacagcagcattgggatggccggtagcgggcaatag

SEQ ID NO: 6608 - DNA, 405 bp, Glycine max
  Peptide Sequence Number=SeqID_123386
atgactgccaccaccgttggcggtggtggtggcgacaacgatggcaatgatgggcatgacgacaaaggtggtgttgataatagtgatcatggtggtacctacagcggtgggatgattttttgtggtgatgccgtgaaggataagtatggaatgtttcgatttggctttgcttgcttcttaggaaattgctccatcctccaagctgagcttgcaactatttttagagggcttcaagtagcaatcattagaggttatgataagattattgtggaatctaattctaaggatgcttttaaaatgctccagaaatgggtgtcagtcagatcacctcttggcccacctaattggttttatttggagtttggcttcctcttcaatgcaattccaatggcagcaaatctttag

SEQ ID NO: 6609 - DNA, 393 bp, Glycine max
  Peptide Sequence Number=SeqID_123387
atgtgtggagggagagatcaattttacagttggcaagatttagctctaaccaccacccaattctcctttcttttggcacaaaaaggaagcgacataggagaatggaaaagctatataggttctgacatttgtaaagaggtggtgaggcattctttgtgcccaggacgtgatattcaatccaatgtggtcaggactagttcaaatctgatggattgggaaagtgcaacatttggttctcttaaacagaaagtaaaggaggagtatttctcatctttattcacttcatcaaatcccagtggtgttcaggaggtggccaatgtggttggtaggagggtttcagacgagatgttggggttgttctcaatgaagcttttatggaagatgaagtggtga

SEQ ID NO: 6610 - DNA, 195 bp, Glycine max
  Peptide Sequence Number=SeqID_123388
atgaaacaagctcaagaggttgctcttgtgtgtataaagaacaagctcaagaggttgctcaaaaggttggcattaacagatccacttaaactgttacaagaacacaataagggtaagggaaacttcactaaggagaagaagcacagagttgtcacgatgctcgagttaaatatgagataccctagccatgtttag

SEQ ID NO: 6611 - DNA, 186 bp, Glycine max
  Peptide Sequence Number=SeqID_123389
atggcgtcgtggaacatgggtctcgcttcatgccagaagacgatgtcgtttgaggtttcgtgcagtaggaagagagacagagacagagaacgaggtagcatccttccctacaaagtggtcgagattactcctccacccaagtctcttggcgttcgttgcttaccccccgtaagtgccattcgttga

SEQ ID NO: 6612 - DNA, 676 bp, Glycine max
  Peptide Sequence Number=SeqID_123390
atgtatgagtgtcaccaagtccaaaagcacatagttcagcagctagagtacctcaacaccataccatcaaaaaaccctacatctgagattcacaaacaatcaactcttcagctggagcttgaagtacagcagtggcaccaatccttctgcaacctcttcaaggcccaccacgactacatccaatccctcacaggttggctaaggctcacccttttccagttcagcaaaacccctataaaccgaacccccgaggagtctaagatatacaccctttgtgaagaatggcacctcgccgtcgaccgcattccggacaaggtagcatccgaaggaataaaaatcttgttgacagttattcatgccattgcactgcaacaggcaaaggagcagaaacagaaaaagaagtcagattccacattcaaagagctcgagaagaaggtggttcagctgcgatccttggagtgcaagtatggtccatactccatgccagaatcatctggcagcttgagaaccagggacccgatcaccgagaagcgcactaaggtggatgccttgaaagcaaaggcagacgaagagaagagcaaatacaacaagtcagtgagtgtaacgagggcaatgacactgaacaacttgcaaatgggttgccctcatgtgtttcaagggattgtggggttttcaa

SEQ ID NO: 6613 - DNA, 977 bp, Glycine max
  Peptide Sequence Number=SeqID_123391
atggagttgcatgatataccattagttggaaaatctatcccttggttcaagaccaatggacacacaaaaagcaaatttgtgaattttgtggaacaagcttgggaaactattgagatcaatggaagagtcgattttgtccttaaagagaagttaaaagctcttaaaggagaattgagaagatggaacaaaggaatgttttggaaacttacaagaatgtgggtggaagatccaaaggaagttaaagctgaggtgagacgattttttaatgaaagattcttggaaacaaatgaagatagaccaaagttagatggtgtatctttcaagcgattgaaggaaagggataatgacatacttggggaaacctttgatgatgcgggaggagggttttctacttatgatggaggaattccacacaaatgggaagctaccaaaaggaacaattgcctcattcattcctctcgttccaaagatggaaaaccctcaagagctagaaatatgttgggtggagtattgattgcaaatgaaatggtggaaaaagcaaagagatgcaaaaaatcttgtgtcattttcaaggggtcaatggattggattggatggattaagggttgtcttcaaccgactttagtatccattttggtgaatggtagtccaactaccaaatttaacacacaaaaggggttgaggcaagacaatcctcttgccccatttcttttcttgatggtggtggaaagtctcataggacttataaggcaagctatggtagctaataaattctatggtgttaaagtgggcaaggacctaatggtttccatgttacaatttgaggatgatacactcatgtttggggatgttactttggagaatatgttatgtgtgaagagtgctctaaggtgttttgagcttgtgtccagactcaaagtcaaattccagaaaagcaaattgggaggtatttgtgttgatgaattaattgtcaaaag

SEQ ID NO: 6614 - DNA, 300 bp, Glycine max
  Peptide Sequence Number=SeqID_123392
atggggatgggttttgggaagcagggatgcggacagggaaccacatacccatcctcatctcgtcctgctaccatgtctagtcctgaagattcaaaagttcaaatacaacttatgcaagctctctggttgataggacttaggagatcaacatccatgcatcgtactttcctaggaggagaaacttggtcacatgaaagaattattctagatgacttgaaggttgaactggaaggtcccatgaagctccattgtgacaagaagtcaacaatcaatattgctcatgatcctatacaacattaa

SEQ ID NO: 6615 - DNA, 340 bp, Glycine max
  Peptide Sequence Number=SeqID_123393
gaggcttaggcttgtggctaaggaattgatttggtggaaggactttttgaaggtgagagaatggattaatgggaggtggatttggaaacttgattggaagaggcaatggttcaattgggagcaacctatctttgatggttttctcaagatgttgaattcaaagaggttgtatccacaagaaaaggacaagttagtgtggaaaggttgtgtttcaagttctttcttgataagcaacatgtataggcttttgaggagttatcaaggagaagaggatactcagtctatttttaaggacctttggagtattgcaataccttccaatgttactttttttggctag

SEQ ID NO: 6616 - DNA, 120 bp, Glycine max
  Peptide Sequence Number=SeqID_123394
atgcaggagaaaattgctaagattaagagtcaaggaaatgctactgtggaaatctcacttaatgactctcttggtcaagagtacaaagtagtgctcaagaacttaaagttcatgagttga

SEQ ID NO: 6617 - DNA, 285 bp, Glycine max
  Peptide Sequence Number=SeqID_123395
atgggtggaggggctggaactcgactttttcctcttactagcacaagacctaagcaagcggttccaattgcagggtgttataggctaatagatattcctatgagcaattgcatcaacagtggcataagaaaagtgtacgttttaacacagttcaactctttctacctcaatggccacttgtctcgcacttacaattttggaaatggcgtgaattttggaggtggttttgcggaggtcttggctgctactaaaactcctggagaggctgggaacaaatggttctaa

SEQ ID NO: 6618 - DNA, 919 bp, Glycine max
  Peptide Sequence Number=SeqID_123396
tggtgtgttggatgttaatgtggttgtccactcccccaagatggtgcatgtatcgattcagaacaagagtggtggctgtaggtggttcatgacgacggtggatggtgatcccgttagaactagcttcaatcaacaattctggtttgatttaactaacattggtttgtctatgcaagatccttggatgttggtgggtgactttaatgcttacctccacccgaatgaaaagaagggaatgagtgatcctaatatcagttctatcaaccagtttgagaagttcttggatgactactgcctgatggacctaaattttcaagggccttgttacacttgggaggctagaggtgaggctatggtgtatcatttacccttcttcaaatctaaccttagggagattctgatccggcttaatcatatagtgcaccctcatcatggtcagagggagttttgttttttgaccaattggcttgttgaccggtcgtttgaggaggttgtcaaaggtgcaagtgaaaatggccaagaaatttttgaggtgggtgacattaagtggattgtggaaggtttcttcattgacctgttgaaggatgagaccccttatcaagaatggcccctcataggagctttcctgcagttggctaatgatgagattgatgccatccaagttccacctgtggattttgaagttaaggcaacagttcatagtatgggcccccttaaggctccaccctttattctttcaaggtcattgggaggtggtgaaggagttatggtcaatggagataaaactcaagagtttaggccagaaaagggtcttagtcaatgggatcccctctccccctacatttttgtgctgtgtgtggaaagactgttgcacctcattcaagagggtgctggaagcctatcaggtggggtaggatga

SEQ ID NO: 6619 - DNA, 905 bp, Glycine max
  Peptide Sequence Number=SeqID_123397
acgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggtctcgttgggagcgtgcgtgcacgcaaagggtcgtcgatgggtccagaactgaccggctcgcacgtgattggtctcgagcgtggctcatccaccattttatcacggcgaagtcggcctgaacccagattcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggtagatga

SEQ ID NO: 6620 - DNA, 600 bp, Glycine max
  Peptide Sequence Number=SeqID_123398
atgggtgataatgattcgctctccgaattcctcgcatctgcagtcgacgctgcttgcaaggctggtgagattattcggaaaggtttctatcagaccaagaacgtgcagcacaaaggactggttgatttggtcactgaaactgatcaagcatgtgaagatctcatatttactcatctcaagcaactttactccactcataagttcattggggaggaaaccacagctgctggtggcaatgcagaacttacagatgaacccacgtggatagttgatcctctcgatggaactactaattttgtgcatgggttcccctttgtttgtgtctccatcggtcttacaattgggaaagttcctacagttggcgttgtttacaatccaataattaatgagcttttcactggaattcgtgggaaaggtgcttttctaaatgggaaccctataaaagtatcatcacaaactgaactaatgagcgctcttcttgtgactgaggtatgtcccctcctcttattgtgcattagtgaagcattaagttgcgagaataagttgctccagagtatcaatgacaaatatcaatgtaatggtgaagtagcaaccctctga

SEQ ID NO: 6621 - DNA, 957 bp, Glycine max
  Peptide Sequence Number=SeqID_123399
atgcttgccgtgattgcttgggtctattcttggtgggtcaccgccgccgtgcctcttccggtgacctccatgtgtcccaagttcaacagagcggtggttctgacggtggtgtacgccacccccattggagggatcagcacttcacaatttgctctgatacaatttttagaatcggatgtgacttgggtttttctcaacatggttcttcttcggttttcctgttgccattctcttcctcttctcttttggtgcatcgtctgtttcctctatgttccaaaggactcctctcgggccttgtcttctttatcatttgacattcccggatggggagcttgcttccatggtcttgttggtgatggaagtgttagtgttatggtggctgtgttattgttcataatcccaaacaagaaacaagagggggagaagctaatggattggaatgaacgcaagaagttaccttggaaccttattttgcttcttggagcagggtttgctttagctgatggagtccaatctagtggcctagcagacgtgctttccagagccttggatttcttggaagatacaccatactgggccattgctcctgctgttagtcttatgagtagcattattacagagttcatcacatctaacgatgccactgccactgccacacttctaatcccacttctatataacatagccaagactatgcatgtgcatcctcttcttcttatggtacctggagcagtggcaactgctttcttacttccaacttcaactccatcaaatgtagtgggatttgccactggccatattgaaatcctagacatgctcaaaattggcgtgccacttaaggttgcagggatagctgtgctctcaattttcatgccaactctaggagctattgtttttggaacagatgactatattcaatggatgccaaacataaactctccttggttgagaaattga

SEQ ID NO: 6622 - DNA, 738 bp, Glycine max
  Peptide Sequence Number=SeqID_123400
atggaatgtctcgcgcgtgaggtcaaaggagacgatgagatcgggttcgtggggttggagttttctggtgacgagccagtggagggagccggagacgaagacgcccatggtgcgggcgcagcagagggcgtagggcatgctggggaggttcttccaggagtcggatttgagggtgtagagctggacctgggaatcgaaggtgcgtttctggagatccacgaagtaggtaatgctcaggagcttgtagtcgttggagggggagtggtggccgaagccgtagacgcgggcggcgaagagggaggattgggggcggtggaagcggtcggcggggagaatacggtgcttgcggaggaaagggttccagagggcgatgtcgtcagcaacgttggagatgcagaggaggccgttggaggagccgaggaccttgatgctgttgctgtagcacatcagggggtggctcagttccacgggattctgttccggagatttgaggtccaaggagtagaggtgggagcggtggcggagaatgaggctggagtgggatttgttgaggtggaagaggacgaagtgcctgctgtcgatgatggaccgccaccacttgcagggtttgcttccggagaaatccagattgtgagtattaccaactgcaactcgcctttcgacaaactggtattaaataaagttaaaaattacctgcaatacgctgtgaaagatataacctatgttcatttcaagtaa

SEQ ID NO: 6623 - DNA, 288 bp, Glycine max
  Peptide Sequence Number=SeqID_123401
atgaaattggagtgcattcttctggtctttgttctatttggttttgcgattgatcagggtgaagttaaaatgaatgatccccacgtgatagagatcgcgaattttgctgtgacagagtttaataaggaagccggtgaggggttaaactgttcaagttgcaaaagttttttgatgaatataactctaaactgttggaatcttccaactatattacaaggcgccaagctgtcaagattattggatgatgcaaaaatggagaagtctgggcttctgagattgtcctcttga

SEQ ID NO: 6624 - DNA, 417 bp, Glycine max
  Peptide Sequence Number=SeqID_123402
atgagttacttgggtttgggtgttagtcctggtacagttccagtgtaccatggaacaaaactcaaagtgttggataggagggtgaggataacagagctggtgttaaggtgtgtgagccttggtctaggagctgttgcaattgttcttgtggtgactgattcccaagtcaaggaatttttctcctttcagaagaaagctaaatttacagacatgaaggctttagtgttcctggtagttgccaacggactaactgttgggtactccttaatccaaggattgcgctgtgttgtgagtatgattagaggaaatgtactcttcaacaagccctttgcttggctcattttctctggtgatcaggcaaatccaccaaaggagggagtcatcgactttccattcaaacatttgatcctgtcctaa

SEQ ID NO: 6625 - DNA, 312 bp, Glycine max
  Peptide Sequence Number=SeqID_123403
atgaggaagaagaaagaactgctgaaaatgctcactactagtgaacctaaacctttcaattctaaccccactatgaggcagtttttccaccctgagttgatcatcccatctaggtcatctcctcctcatgtttctctttctctagggcctacttcacagcccatgcaagagtacaccaaaagcactattgatgccccagtcgcaaacaacatgctctccatagattctacacacaaccaggtttcatgcaagaacatctatgattgggattcgggcactgactctattgttgatacttcccttcacctgtaa

SEQ ID NO: 6626 - DNA, 273 bp, Glycine max
  Peptide Sequence Number=SeqID_123404
atggagatgagaaaaagaaatgggatgctggataggtgttgcacgagtttaagaaaggaagatttggaagtgctactgaagagctcgctcagcgacgaggaagccaactcccccagcgagagaagaaccctagagaatgtaaagtcaaagagcagcgcgctaagcgtgcaactaacccgcccagggaagcctttgttgcttcttgcgcttagtgcatccacatctgctaagcgctcagtcactaactctcactcagcgaaacatgctcgctga

SEQ ID NO: 6627 - DNA, 192 bp, Glycine max
  Peptide Sequence Number=SeqID_123405
atgcctgtacaaataggatcaatagcttgcttttcaagggatgtggcaggcggtgctgtcattgttagagaagccggaggtgttatatttgatccgtctggtgcagattttgacatcacatctcagcgggtggcagcttccaaccctttcttgaaggatgcccttgttgatgttctgcaccaaatcgtgtga

SEQ ID NO: 6628 - DNA, 1734 bp, Glycine max
  Peptide Sequence Number=SeqID_123406
atggatgagagagagaggttagttgctggcattggcaagcaatctggtttctctctcctctctgcactgcaccccacaactcaaactgagcagtcacagacacagatgcaaacgtctcagaaacacccaagttcagctggtgtccatttctatcaccagcctgtgcaaggcatttaccaaatgttgcaaagcaatctatgccatgatagcagcagccagggaacaagtgtttcttttgaaacctgcaaggagcaatactttactctagaatcatgcccagcacccactacttgtttcgtggattgtgatgattctccttcctatgccagtgtatcatctaaaaggactccattttctccacagggttctcagtcatgctattcagatcaccagcagtcctctgacaacacctacggttcgccaataagcggcttgtccagtgttgatgacgggcatgaactgaagcacaagcttagagaactggagatttcattgttggggcctgaacaatcagacagttgcggctgctgcgtcgtcaagggtggcctccagggatcatctcagttggctaaacataactgggatcagattgcagagaacgttgcacaatttgacttgaaaggagtcctcagggtatgtgcacaggctgtgtctgatgatgatgttccaacagcaagaggctggatggataatgtattggggaaaatggtatcagtctctggtgatccaatccagaggctgggtgcttacttattggaggggcttagagcaaggttggaatcatcagggaatctcatctacaaatccttgaattgtgaacaaccaacaagcaaagaactaatgagttacatgcacattttgtaccagatttgcccgtactggaagtttgcatacatatctgcaaatgctgtcattgaagaagcaatggcaaatgagtccaggattcacataattgatttccaaattgcgcagggcacgcagtggcatttacttatccaggctcttgcacataggcctgggggacccccctcccttcgtgtgacaggtgttgatgattcgcagtcgattcatgcacgtggtggaggacttcagattgtaggagaaaggctttcagattttgccaggtcttgtggagttccatttgaattccgcagtgctgcaatatctggctgtgaggttgtacgaggaaatattgaagttctacccggagaagctctggctgtaagttttccctatgttttgcaccacatgcctgatgagagtgtgagcactgagaatcacagagatagattgctgaggttggttaagaggttgtctcccaaggttgttaccattgttgagcaagaatccaacaccaacacgtccccattctttcacaggtttgttgagaccctggattattatactgcaatgtttgaatctatagatgtggcttgccccagagatgacaagaagcggattagcgcagagcagcattgcgtggcacgagacatcgtcaacatgatagcttgtgagggggttgagagggtggagaggcatgaacttttgggaaagtggaggtcaagactttccatggctggatttaaacagtgtcaattgagttcttcagtgatggttgctatacaaaatctcctaaaggagttcagtcaaaattataggcttgaacatagagatggtgctctttatcttggttggatgaacagacatatggccacctcttctgcttggaggtga

SEQ ID NO: 6629 - DNA, 1135 bp, Glycine max
  Peptide Sequence Number=SeqID_123407
atgcatttccttcaggtcgttgtagtaggcgcgcgccggcaacagggtttccacctggcggcgcgcggtgaccaccgcctggtgcgcgccatcaagctcggcgaagtcgctgaccaggcgctcggcggcgtcgaaggtcttcggcgtgtcgagcatgaagtcgcgcaggaagacattgaggtcgcccaggttcttcgccgactgcgtcttgtgcagcaggcgcagcgccatctcgttgtcgatgccgagcaggtcgcggaagcgctcggcgtaaccggagaaggtgtcgaagtggtgcaggtcggacagcttctgcttgagcttgcgcaggtccaggtcgaaaccaccaagatccttggcgatgtcgaacgggcgctcggcgatcatgtagtgcttgcgcacatcgccagccgaggtgccgttgccggagatccacagcaggcgcaccaggctgaccacgcggccatcgccggcgcggtactgggtggcgatttcgccggtgccgctgtcctgctggtcggcccacgcgccacgcacgtaggacaccaggttgcggtcgcggccactgcgttcggcttcacgcgcggcggcgttgaagtcgacgatggccggcggcgtcagcagcgcggacatggcatcgagcagggtcgacttgcccgagccggaacggccgacgaacaggaagccgcgctcggcgatcggcacttcggtcaggccgttgaagtgtgcttggagatagccatgcgatggtcgggtctctcaggcctcggcggccggggtttcgcgcagctggcggtagaccgccgagagctgggacacgtcttcggcggagaacagcagcttcagcgccggcgagacttcgtggcggtcttcctggccgctgaggcgggtcaggatgtggttgtccttcatcttctgcaccgccgaagcgacacggcggttgaagccggcgcggtcggtggacaggttcttttcgtagatggccaacgcttcggccatctcggcatcggcgaccaccgcgcggttgccgcgcgcatcggcctcggccagctgctggcgaaggtacagcagcagcaccgagtcgatgaaggtcagcggcgaggtgcgcagcagcaccggcgcatcgacgtcttcg

SEQ ID NO: 6630 - DNA, 897 bp, Glycine max
  Peptide Sequence Number=SeqID_123408
atggacgtgcgtgaccgcggcctgcttggcgaagaagcccagcgccgtgccgcactggacaaccacaccgagcgcctggccgaactggagctgcagcgccgccagcagggcggtgagcgcatcgaggaactggaacgcgagcagggtcgtgccgaagctgagcgcgaccgccgccaggccaagcgcgagcaggcacgccaggcggcgcagcagctgcaggcggaactgccggacgacgcccacggcttcgccgagctggtcgagcgcgcgcagaacgagctgcaggaccgccagcgtgcctcttcggcgctggacgacgcgatcagcgatcgcctgggtggcaagcgcgatgacgagcgccgcttcggcgaagtccgtgcggaactcgaagcgatgcagcgcacgccgtccaacatccctgcgccgatgcagaagctgcgcgcgcgcctggccgaggaaacgggcatcgccgaagcagcgctgccgttcgttggcgaactgatccaggtccgctccgaagagcagggctggcagggtgccatcgagcgcgtgctgggcggtttcgcgctgtcgctgctggtcgatgacaagcattacaacgacgtcgccgagtgggtgaaccgcacccacctgggcatgcgcttcacctactaccgcgtgcgccgcaacgatgatgcgttcgcgcgcgagccgtcggcgaagtcactgctgcacaatctggaactgcgcgagcacgtgttcgaaagctggctgcgccgtgagcttggcaagcgcttcgactacaagtgcgtcgatgccaagcaactgcgcaacgtcgatcgcggcatcacccgcgaaggccaggtcaagcatccgggcgaccgcttccagaaaggacgaccgcattgcggtgggtga

SEQ ID NO: 6631 - DNA, 1575 bp, Glycine max
  Peptide Sequence Number=SeqID_123409
atggaactcagaccttccttcctggttcttacttcattcctcttgttgctgctttggcttgcaagaatttacaagcagaaaatcaaagtaaggagtgtggttcataagcttcccccagggccatggaagttgcctctaatagggaacctgcatcaactggcaggggcaggcacacttccacaccacacccttcaaaatctatcacgcaaatatgggcctctgatgcaccttcaacttggtgaaatttctgcagtggttgtgtcatcctctgacatggccaaggagataatgaagactcatgatcttaattttgtgcagaggccagaactcctttgtcctaaaatcatggcctatgattcaacggatattgcctttgctccatacggtgattactggagacagatgaggaaaatatgtacgctagagcttctcagtgccaagagggttcagtctttctccttcattcgcgaagaagaggtggctaagctcatacaatccattcaattatgtgcatgtgcaggttcaccagtcaatgtttctaaaagtgttttctttttgctaagtacccttatttcaagggcggcctttggtaaaaaatctgagtatgaagataaacttttggccttgctcaagaaagcagtggaactcaccggagggtttgatcttgctgatttgttcccttctatgaaacctattcatctcattactcggatgaaagctaaattggaggacatgcaaaaagagctggacaagattctagaaaacattatcaaccagcatcaatcaaaccatggcaagggtgaagcagaagaaaatcttgttgatgttcttttgcgagtgcaaaaaagtggaagcctcgagatccaagtcacaataaacaacatcaaagccgtgatatgggacatattcggggctgggactgatacttcagcaacagtactagaatgggctatgtcagagctgatgaaaaacccaagagtgatgaaaaaggcacaggccgaaataagagaagcctttaggggaaagaaaacaattcgggagagtgatgtatatgaacttagctacttgaagtcggtgatcaaagaaacaatgaggttacatcctcctgttcccttgttgcttccaagagagtgcagggaaccatgcaaaataggtggatatgaaataccaatcaagactaaagtgattgtaaatgcatgggcacttggaagagatcccaagcattggtatgatgcggagaagtttatacccgagaggtttgatggcacaagtaatgattttaaagggagtaattttgagtacattccttttggggcagggaggagaatgtgtcctggcattttacttggcatagctaatgttgagcttcctcttgttgcattgctctatcactttgactgggaactccccaatggaatgaaaccagaggacttggatatgactgaaggctttggagctgcagtgggaaggaaaaacaaccttcagtttgtcgaattaataactcataatgtagaaaatggtgacccaaaaggctcggccacatttgtgctcaatgaactcatggatcttgcttga

SEQ ID NO: 6632 - DNA, 1572 bp, Glycine max
  Peptide Sequence Number=SeqID_123410
atgtcggagaaattctcggcagcacttcgtattggagatctcaacgattacatcgcaccatcgcaggcatgcatagtctccctcaaaggattaaaaaagaatgataaaccggaggtatcaattgctaacaagcaggtcaactttgaacctgttaaaatttcgcttaaggattgtttggcatgcagtggatgcgtcacatcagcagagacagttatgctggagaagcaaagtttggatgagtttctgaacaatattaattcaggaaaggccgtgattgtgtctctttctccccagtcaagggcttctattgctgttcattttggcatttctccaattcagaaacagtgtctttgcatatgcaagggtaaggctgcatacagtgaccttccctcatacctttgcatagcaaggagctttctggctttcaaaaagctgacaagattttttaaatccttgggagtgaaggcagtttttgatacaagttgtagtagagatttgacccttgtcgaatcttgtgtggagttcatcacaaggtatagacagaatcagttggttgatgatgagaggagtaaatcaagcctacctatgattgcatcagcttgcccaggttggatatgctatgctgaaaagcaacttggatcctttgttctaccttatatttcatcagtaaagagtccacagcaaacagttggagctatcataaagaactatgtgtgccaagaattaggactcaggccagaagaagtttaccatgtcaccgtgatgccttgttatgacaaaaagcttgaggctgctagggatgactttgttttccaatttgagtcccatgttgaagggcttgagagtgaaattaacatgatttcagaggtagattcagtattgacaactggagaagttttggaattgattcagtcaaaagaagttgattttaaaagcctagaagagactcctctggacaaaatactaacaaatattaatgaagaaggatacctttatggggtccatggaagctctggaggttatgcggaaacaatattccgatatgctgctaaaacactttttggaagacagattgatgaccctttgaccttcagaaacatcaggaattcagattttcaggaagttactctggaggcaagttcttttgaactttataatattattattatgctcgtgaagaaggttgttatccggaaggtggtggagggaaaaacagtgttgaaatttgctctctgttatggtttccggaacctgcagaacattgtacgaaaacttaaaaatgggaaatgtgattatcatttcctagaaattatggcatgcccttcaggttgcttaaatgggggaggtcaaattaaaccaaattcagggcaatctcctaaagaactaagtcagttgttagaatcagtttacatggaaaatgttttggtagcatcaccatttgacaatcccatcattaaaggcttatatgacaagtggcttgaacagcctggttctgtgaaagctaggagatacatgcacacacaatatcatcctgttgaaaaaagcattacttctcagttgcataattggtga

SEQ ID NO: 6633 - DNA, 861 bp, Glycine max
  Peptide Sequence Number=SeqID_123411
atgaagatatatagagtcgtattggtatcgcatcgaatagacttagttgagtgtgggaagatgagaagtgtgagcctgagaccagagcttcacattccaatttgttcttcaaaccctccatcatgtgtcaaacccatcaaattagtggtagcatcatcgtatgggaaaaatttgaaaaatccaccttccaaatttgcaatcactcttagagagcacagaacaactttggagcatgcggcgaggttgccattactgaaacatgattccggtattgtggtaatgggagcggtgtgtgtggtggggatattggcggtggttctgagcgaggaaaaggccttggctttgggcccagaaggcccacttgtggaagagttttgggacaacgtgaggagatatggactctacgctctcaccgtcagcacaggtgccctttacaccatcttccgccctatagcagaacttctcaagaatcccatttccgcaattttcatccttgctcttttcgggggttcaatcttcattgtttctcaagtcctctctgccatgaaaatccgaagggtcgagtttgggtttttcccacggtgttcgaagtccgatcaggagtcactctcaaatccacccatatatattgaagccctgaaacggatttctcaattttcactctcactcaccaatactactccgccgcttctccgttctcactccccaagacctcaagccagaaccctctcgcacctcccaggccaacattatcgcacctccacgaccaacaacaacaaccttctcgtacttttcactcctccaatgaacatcgtcagcctcgatctcacatttttttcccgtttcacgctcatagcttag

SEQ ID NO: 6634 - DNA, 741 bp, Glycine max
  Peptide Sequence Number=SeqID_123412
atggaagcccaatttttcttggcagtcataaagttcttcctttcactcttagtgcttttgcttgcaaagaactacaagcaaaagggtctccataaactgccaccagggccatggaagttacctatcatagggaacctgcttcaagtagaagcagcaagttcacttcctcatcgtgctttcagagaattagcccaaaaatatggacccttgatgcacctacaactagaagtgtttggtaacataactactgaaaattgtgaaggatttttgtcgattgtaaaggaaacaatagaagtggcagatggcttcgatcttgcggatatgtttccttctttcaaacctatgcatttcataaccgggttgaaagccaaattggataagatgcataacaaggttgacaagatcttagataagatcataaaggagaatcaagcaaataaaggcatgggagaagaaaagaacgaaaatcttgttgaatccacatctggaaccgatacttcagcaaaagtaatagagtgggcaatgtcagaaatgatgagaaatccaggaggaagggagaaggcacaagctgagatcagacaaacccaaattgctctaccactggaaactcccccacaaggaatgaaaccagaggagcttgacatggaggaagcatttggagctgaggctggaaggaaaaataaccttcacttgattcccattccttacaacccttcaattcatcatgataattgcaaatga

SEQ ID NO: 6635 - DNA, 450 bp, Glycine max
  Peptide Sequence Number=SeqID_123413
atgggtgaagaaaagaaagacgaaggaaacaaagaagaagccaaggaggaaaagaaggaagaagagaagaaggaggagccaccaccggagatagtgctcaaagttgatatgcattgtgaggcctgtgcaaggaaagttgcaaaagcattgaaaggattccaaggagtggaagaggtgagtgcggatagcaggacaagcaaagtggtagtgaaaggaaaggcagctgaccccataaaggtgtgtgagaggctacaaaagaaaagtggtaagaaagtggagctaatttcacccttgccaaaacctccagaggagaaaaaagaagaaaccaaagaagaaccacccaaagaggagaaaaaagatgagggtgagagtgctgaaatgaaagtaacgaaacaaagtgatgtccctccgaaaggcacacgtaacgaggggaacggcggtgacaaatga

SEQ ID NO: 6636 - DNA, 2058 bp, Glycine max
  Peptide Sequence Number=SeqID_123414
atggcttacaatctttgctcttccccttcctctctcttccatgaccttccctccatttcttcttcttcttcttcccgcaaattcaaacttcgaaacttgtcctcttcttctctcactcctcattccaaaacccttctccatgtctccttgcacgaacacgaacccattcccgaacacctaccacccgacgcaaaatcctcgtcttcgtcgaaaagtaattacatctgggtcaacccccgaagccccagggccaaacaactcgagagtagatcctacgatgccaggtacacttctcttgtaaatctcgcccactccttggactcttgcaatccctctcaagaggacgtctctctagttttgaaggacttaggggatagggttatagagcaagacgctgtaattgtcatcaacaacatgtccaattcccgtgttgtaccctttgttctcaattactttcagcgtaggattagacccaccagagaggtcattctctacaacgtcaccctcaaggtgtttaggaagagcaaggatttggatgcaatggagaagctgtttgatgaaatgctccagagaggggtgaggcctgacaatgtcactttctccactataattagctgtgctaggatttgttctttacccaataaggccgtggagtggtttgaaaagatgtcatcattcgggtgtgagcctgatgatgttacctactcggctatgattgatgcttatggcagggctggtaatattgacatggctttgcgcctgtatgatcgtgccaggaccgagaagtggcgacttgataccgttaccttctccaccctgattaagatgtatggtttggcgggtaattatgatggatgcttgaatgtctaccaagagatgaaggttcttggtgttaagcctaacatggttatttataacactctgttggatgccatggggagagctaagaggccctggcaggccaagagcatatatacggagatgactaataatggattttcaccgaattgggtgacttacgcgtctctcttaagggcctatggtagaggacgctacagcgaagatgctctctttgtttataaggaaatgaaggaaaagggaatggagatgaacactcatctttataatactcttctggccatgtgtgcagatctaggcctagccaatgaagcatttgagatttttgaagacatgaaaacttccgcaacttgcctctgtgacagttggacgttctcatccttgattaccatatattcctgcactgggaatgtttcggaagctgaaagaatgttgaatgaaatgattgagtctggctctcagcctactatttttgttctgacatcacttgtccagtgctatgggaaggttgggcgtactgatgatgttgtgaaaacatttaatcaactcttggatttgggcatcagtccagacgaccgtttctgtggttgtcttctgaatgttatgacccaaacaccaaaagaagagcttggtaagctaaacgattgtgtgaagaaggctaatccaaagcttgggtccgtggtaagatatttggtggaagggctggaggagggtggtggggagtttaagaaagaagcatctgaactctttaattcaattgctgatgaagtaaagaagcccttttgcaattctctgattgatctttgtgtcaacctgaatttgttggacaaagcatgtgagcttctagacctggggttgacccttgaaatatatacggatgtacagtccaagtctcaaactcagtggtctctacatctaaagagtctctcgcttggagcttcgctgactgcattacatgcttggataaatgacttgtccaagactttggaatcaggagaggatcttccaccgctgcttggaattaatactggtcatgggaaacacaggtattcggacaaaggtttggcaagtgtagttgaatcacatttgaacgaactcaatgctccattccatgaggctccggataaggctggctggtttttgactacacaggtagcagccaagtcatggctggagtctcgggaattggtaacagcataa

SEQ ID NO: 6637 - DNA, 183 bp, Glycine max
  Peptide Sequence Number=SeqID_123415
atgaagtctgagacaagcacaggcatacaaaaggaaaaaggtgaaggagactggttcggttcggttgagaacagaataatgccaaacgcgacagaacagaataatgccaaaggcagactaggtgctatgcacatcttaatgggctttactttgtgttccgacttgaagcattctctcacttga

SEQ ID NO: 6638 - DNA, 618 bp, Glycine max
  Peptide Sequence Number=SeqID_123416
atggatgagattcacaagcctcctcctgtggtaacagttgtccttaaagttcgaatgcattgtgaaccatgtgctcaagttatccagaagcgaatccgcaagattaaggtattctatctcgatgctgaaacattgtacttaaccggtatggtttcagccgcatattgtattttaaaatgcccttgcagcttatatgctagttattttgccttgtattttaattttggcacctttctccgggttgatggcctctatggtttgttgggttgtcatgtgaatagcactcttctggttagaggagtagaatcagtggaaacagacttggcaaatgatcaagttatagtaaaaggtgttgtcgaccctgccaagcttgttgatcatgtctacaagaggaccaaaaagcaagcctctattgtgaaggacgaagaaaagaaggaagaagaaaagaaagaagaagagaaaagggaagagaaagaagaagagaaaaaagaaggtgaagaagataacaaaactgaaatcaaacgaagtgaatactggccatccaagaactacatcgactatgcttatgaccccgagattttcagcgacgagaacccgaatgcctgctctgttatgtaa

SEQ ID NO: 6639 - DNA, 270 bp, Glycine max
  Peptide Sequence Number=SeqID_123417
atggccaaaaaggtcaacataatgaggctcaaggttgatctggggtgccacaaatgctacaagaaggttacggtactatcaaaagcattgaaatttgttgaacctcccaagctcaaaccacgtctgaagcccaagccgccgccgccgccaccggtttcggttccgattgggttgtgctgtgttccatgctttgatgggtacggtgccctcccccctgttatgacgcttattatgatagttacggcggtgggagcaggccttgttacgtga

SEQ ID NO: 6640 - DNA, 1557 bp, Glycine max
  Peptide Sequence Number=SeqID_123418
atggagtcagtaaactggacgaaagacttagaattacagaggatcatcttaaacaaaaggtgcactgttctgaatctagaaatcaagaaactgacagatgaaaagaaaaatgcattggcttcgcaatatgctgcagaagcaacacttagaagggtacatgcaaatcaaaaggatgaagattttgttccaattgagagagccattgctcctcttgaagctgagatcaaaatgtataagaatgagatcactgcacttcaagaagataagaaagctttggaacgactcacaaaattgaaagagtcagcattgctagaagcagagaggattctgagaagtgctctagatagggctctagttgttgaggaggaggagaacaaactcttagagaaaaaccatcgtcaaaagattttggaagttgaaaagcttagtcaaaccattcaagaacttgaggaagtcatcttagctagtggagctactgctaatgctgttcgtgattatcagcaacagatttctgaattgcaagaagagaagaggacattagagagggagctagcaagggtaaaagtttcaaccaacagaattgcaaatgccgtggctaatgagtggaaggacgaaaatcataaggtcatgcctgtcaggcaatggctggaagaaagaaggattatgcaggcagagattcaacggttgaaagacaagcaagctatatcagagagaacagctaaggcagagtcccaattgaaggataaactgaagctgaggcttaaaacactggaggaaggcttaaagcatttctccaataacccaatcacttcgaatgtgtcttatgcatctcaaaaagcagaaaagtctaacatactaggtttcctaacaaccagtgctggactgagaaagagatccacatcacaaccaagggcatgtacggttggaagctcattgttccagacaccaaatataaaaaacaacagaggagacatcgtagctgggaatttgaagctggggagccctacaaaaaaatatggttctacagaaaatatgttaacgaaagggatatgggcatcaagaagtaaagttgctgataatggtgaaaaggaaaatgaaatgcaggtgaacagagacatgactttaaacagatgcaatgatgaaagtgaagcaacagaaattaaaaccattgttgatgtggaagaagaccctcctgaaagcaagaaaccaaaaggttcaagcagggatgatgtggtctcaggttttctatatgataagctgcaaaaagaggtcatcaatttgaggaagtcttgtgaaattaaagacagtagtttacaagctaaagatgaagaaattaagatgcttataaagaaagtcggtgtactgacaaaggccatggaagtagagtggaagaaaatgaaaagagaggcagctgctagagagaaggaggcttcatcaacaaagtcagatgataacaggaaaaacagaagcgcaaactcctctaaaaggttctttagcttcactttctgtagtgcggctaataactgtcaattgtcaagtttcttcagtccgttttaa

SEQ ID NO: 6641 - DNA, 153 bp, Glycine max
  Peptide Sequence Number=SeqID_123419
atggtatgtgctatgaatggtcatttctttgcaagtactacacggttgaaggctgtacaagttggtcatttgatggccaaagatgttggacatagttctccgcaaactcagctggttttcactttcaggaagttgcgtgccactaatgagtaa

SEQ ID NO: 6642 - DNA, 723 bp, Glycine max
  Peptide Sequence Number=SeqID_123420
atgattgagttgcgaaaacttctggataggtatcctacatctgaactgaattctttctggttaaagaatctctttctagttgctctggaacaattaggagattctctagaagaaatacggagttttgcttttggtggcaacatgctatggggtggtggtcccacttatggggtcaaatcaatacgttctaagaagaaatatttgaatctcatcgatctcataagtattataccaaatcccatcaatcgaatcgctttttcgagaaatacgagacatctaagtcatccaagaactggacgatcctatttggtcaaatacctagcgacaaactcctatgttcctttcattacagtatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggatgtgaatgagtcgaattacttatccctcggtcttttagtgaactatctctccagggattgtgaaagatgttctactagaaatattcttgttattgcttcgactcatattccccaaaaa

SEQ ID NO: 6643 - DNA, 420 bp, Glycine max
  Peptide Sequence Number=SeqID_123421
atggaggctatgaaagagcaaatgaccacaatgatggaggccatgatgagcatgaagaagataatggaagtcaatgcggttgcaattgccgctaccagcgctgttactaaggtgaacccgatgccccctgagaatgtcaataactccactcccatactcattgagagccgacaaccccaaactgatcatgcacatgtctctcaaaccgtgggggagacacatgaaattccccaccacaatctagccgacttcgagccttgcctcggatatgccactgaagggcaagcagttggtgaaatgggaaagttggatcatctagaggaaaggctcagggccattgaaggaggcaaagattatgcatttgctaacctagaagacttgttcctagtacccaatatcatcacccctcccaagttcaag

SEQ ID NO: 6644 - DNA, 1500 bp, Glycine max
  Peptide Sequence Number=SeqID_123422
atggattttgtggcccaattcatgacctttgaggccagatctagcgtcgtggtggtggaggatggggttggggttggggttgcaggcggtggtggtgtacaaggttggggtaacacccgatggtgggatttggtactgagcaaaagagagatttcccaagggttggtagtgccaatagcactattgatagtgagaataggaatttcctatgacaattggaaagtctacataaggaggagagccttcaagtcttgggctgaagttattgaatcttcttctcccattcccataagaagtgctggtgtgagcctgttgtcgtggccggtgccgccgccgccgtatcgaaaccttaatttcaacaacaccaatactctctcatatggcaatccgaaacatcagcagcaacaatctcaggatgtggatgaattggggtccaagttgaatagtatgaacgtgtctttgtctgatgcatcagttgttgacatttttcagatattagcaagtgagaaagtgtcagcattgcagttctttgattttcttaaaggttctgatcctgaactttgttgtgatcctgatataggtagcttgtttattaataactgtgggttgttggggaattatgaggcaatggttcccgttttgagtggatttagccatagaagagtttttttgggaatgaaggcctttgggtttttgcttgatttaggtttggacaaggcttctagtatggagtgtgtgaggaaagttatggctgtgttcaataaggttggtgggatgtatcaaagttgtggtgttcagttgttgatagagatgtttggtctttcgggttcttttgagatagccgagtttgtgataagaacggctgggaggaaggtgaagcattatcatgtcttaatgaggatattgtgcaaaagtggtgattgtaaaagagttagtgatttggttaaggagatgaagagaagtggttgtgatatggatgtaagtacttataatttgttactcagttgtctatgcaagaatggtaaaattgatgaagcatggcaattgcttgaagctatggagaaaaactatggtttaaccaatgcacatagctttgatattctcattaactttttgtgtaagcgccgccagtttgattcggttttgaagcttcttgataaaatgtttttgaagggtattgaacctagtattttaactcatgcggcgataataaagtcttattttgaatcaggaaagtatgaggaagcacatgagtatgtgattggttctgctaataggctaagctattccagcaatgcaaactacggcttgcttgctacccttcagttgaagaatggaaatgtgctgcttgcctgtaaggttctttctgagatgatggacaagggtctgaaacctaatttttcagtgtacaaaaagattaggaaacatctggagaagaaggatgagaaagatttgtctttggaattattaagaagatactcgagtttggttgaaaaataa

SEQ ID NO: 6645 - DNA, 512 bp, Glycine max
  Peptide Sequence Number=SeqID_123423
gcctcacaggattcctttgtcgcccatggacgtcaggatgtactgattgctgccattgggcgactagaacaccctggtcgtgtgcgtgctgctggagccggtgtcacaatcaagcaatactttcgaccaactccaaggacctcctgcacgtctttctccatggcccccgaagacttggagcagctgactcagatgcagtcccattttcagtcgcagatgcaatcacagggactcacactgcctcctaagcctaaggttggtcctttagatgctcatgtcagcacaaaggagagttgtgttgatccttcagggaacgatccagacacggtcaaggttggtgttgaggaggttggagatgcagatgctcccattcatgtacccactagagaggatgataccgtgttcggggtgtttaatgaagacttacccttgtacataaagcatgaagatctgtctgaaatagcacacggtggtcaatgtctcaacatctctgttatacagttgtggattct

SEQ ID NO: 6646 - DNA, 519 bp, Glycine max
  Peptide Sequence Number=SeqID_123424
ttgagattgcctgctatcaaacaacaattgatattgcaatttaaagctgccttccattgtgacaaggacgtcatagaaataccaggcttctatcagcgccaatggctaccaaattatcctgaaattgttgaatttaagtatgatggggaaacctacgaaattcaagacagacaacacaaaggcaaactttactttgctgatggcctaacaagattgaggacagaactgcagatttatgaatctgtgacgataaatttcctggcctgcgaccacccctcaaaatttgacctccacttcactccaccattagaccaattcggacctccactgcaatggaatgtagttgtgcttgacaaaggcattggtgataagtatatcactctcccttggtataaattccttcaagaaggtgattttagccatggagacgagctctcattctactataggcgtgctgagaagatctggaaagttgtcatcaggcgtgcaattgattgggatgatagtgatatagattag

SEQ ID NO: 6647 - DNA, 210 bp, Glycine max
  Peptide Sequence Number=SeqID_123425
atggctggaggcaggctgcttggcattgtcgaggaggtcgacgatggcagggagcggggcattgaagtggagcttgaagtgtccaccgacgaggaagactacggaggcaacaacctagatcgccctaggagacatgaaggtgaaccatcaaatttcatggtggtcaacgcactaactaatgtcccaacaagagacttatcagttgtttag

SEQ ID NO: 6648 - DNA, 372 bp, Glycine max
  Peptide Sequence Number=SeqID_123426
atgcttcacctgcagataggtactttgatttacgtgcaggtggtaaaagcaaaccctggaatgaatccagagctgtcatgcactgatgacttaactctgccttttattttgtttagccagtggaatagcagcagaatttggtggcctaaaagatggctatatgttcccatgtacaatgggtctctcaaggatgtatgtatgcttctcaactctcccacatgtccagtacttgatggtttaggacaagtttgggtcaatgcaacatctccacacacaactattcttgtagctaatgaaattatgaactcagagacattgagtggtactcagcagagaataatgggtgaaaagctgctgcagaggatccagtga

SEQ ID NO: 6649 - DNA, 192 bp, Glycine max
  Peptide Sequence Number=SeqID_123427
atgagaggaggggtgaaagaaactggtagcaacatagggctaccaccacatacatatacacatgttggtgatgttgattttgaaggtttcagtcagggtgatgttgatatggtgttgcctccaaacaattttggaggcctcattaatgaaagtagcttagggtttggtgtgttgcctcgagatgatttttag

SEQ ID NO: 6650 - DNA, 315 bp, Glycine max
  Peptide Sequence Number=SeqID_123428
atgggggatgctagatctttggaagcacatggtagcacagtacacataaacgaaaaggtgagtgaggatctttcctcacttttccagcaaattctagaaaaatatgggctatttttctccgttttatcacccagttatcaatctgatgctggtcactgtgacaacattttaggaagcaacagcaatacgttgcatcaaaagaataaattcataccttcacagctgactcactaccaagttcctttagatcctcaaacttcatcacctgaaacaacattccgaagcagtcgcccagatcagttgttgcaagattga

SEQ ID NO: 6651 - DNA, 252 bp, Glycine max
  Peptide Sequence Number=SeqID_123429
atggagacattatattctttaagttcaacgtttctggtgggggcaagaagtaaaaccagagattcatctcaaatagcagagctggttttgcatgggctactacttacaagtgaatggccgaatttcatttctttggagacgaggtctaggttactaagaaatgtgcatttgagagaaataactagatctgagattgaaaggaagagagaaataatcaaatatgagattgagaacaacaagaaccactattag

SEQ ID NO: 6652 - DNA, 1705 bp, Glycine max
  Peptide Sequence Number=SeqID_123430
atgaagccttttagccttttagtgttatctttatatttcttctctgtggtggggcagcttccttctcaggacattttagcattgctggagtttaagaaaggcatcaagcatgaccctactggttatgttctcaattcctggaatgaggaatccattgactttgatggatgcccatcttcatggaatggagttctgtgcaatgctggcaatgttgctggggttgtccttgataacttgggtctctctgctgaccctgacctgagtgtgttttcaaatcttacaaagcttgtgaaactctccatgtccaacaattccatatcaggaacactacctgacaacattgctgatttcaaaagccttgaattcttggatatctccaataacctcttttcctcatccttgccattgggaattggtgagttacggagcttgcagaatctgtcattggctggaaataacttctccggcccaattcctgactctatttcagaaatggcctccatcaagtccctggacttgagccgcaactccttctctggaatgctgccagtgacgttgactaagacgactagtcttgtatctcttaacttgtctcataatggcttcactggaaaagttcccaaaggttttgagctgatccccgctcttgaaaaacttgacttgcatggaaatatgcttgaaggtaatttggatgttgtatttatgcttttatcaagtgccagctatgttgatttaagtgagaacatgctgtcaagttctgattccaagaagaagtttctaccacgaatatctgaaagtattaagcatctgaatctaagccacaacaagcttactgggtcattggctagtggagctgctgaacctgtttttgaaaacttgaaggtgttggacctcagctacaatcagttggatggagaattgcctggatttgattttgtttatgatcttgaagttcttagacttagcaacaacagattttcaggatttattcctaatggcctgctgaaaggagactctttggttttaactgaattggatttgagtgccaacaacctctcagggccactaagtataattacatcaacaacacttcattctcttaatctctcatcaaatgagttcacgggtgatctgccgctgctgactggaagctgtgctgtacttgatctgtcaaacaacaaattagaaggaaacttgaccaggatgttgaaatgggggaatatagaatttcttgatctcagtgggaatcatttgacggggaccatccctgaggaaactcctcaatttttgcgattgagttatttgaacctatcccataattctctaagcagctcccttccaaaagtcttaacacagtatccaaagcttagagtgctcgacattagtttcaaccaattggatggactacttctagctaatctgctcacactgtccacattgcaagagctgcaccttgaaaataatatgatctctggtggcatcaagttttcatcttctgctgaccaatctgatcttcagattcttgatctttctcacaaccagcttaatggctattttcctgatgagtttgggtcattaactggcctgaaagtgctaaatattgctggaaataatttttctggttctcttccaactaccattgctgacatgagttcactagactccctggatatatcagagaatcattttgctggtcctctaccaa

SEQ ID NO: 6653 - DNA, 150 bp, Glycine max
  Peptide Sequence Number=SeqID_123431
atggatttcaattcatattgcagggtccaggagcacgggggtgagactattattcctttcagctgtgccttggaaaggaatcttgcagatatgccaccagatgaagcggctaagtattgtgaggagaacaaaactcaaaggtccgtttaa

SEQ ID NO: 6654 - DNA, 450 bp, Glycine max
  Peptide Sequence Number=SeqID_123432
atgaggaagccttcttcaagatcgttcttgtacacaggtcttggcacggttcatggcgaggaggtcgatgaggctttagagcatatttgcggaattggagatgggagatcggagcgaagccacaaccgaaacatcagagtcgcgatggggagtcaccatgttgtgccaagacggcggcgaagtcaccaagctggagttaagaacggcaaaaacgcgagatcggagttgggaaggggggaggaatggtggtggcggcgttggttcttaggtttggggatttcttctattttcactctgatgttgtgggaatgtctgaaacggcgtcgtcggaaattgcctcctgcggcgatgaacggttgttgggatcggggagaaataatcaggcggttcatcttagccttggccttaaattactttggttttgaaatatttccaaattttgagatttag

SEQ ID NO: 6655 - DNA, 155 bp, Glycine max
  Peptide Sequence Number=SeqID_123433
atggtcaaaaacgtgttcaacaagttcaatgactatgaaattttttggagagttagacattatcaattaaaaactgaggaatcggtttcggtccagaacatacttcccaaatgtgaagactttagaattcggcttccacacctagcggatttcag

SEQ ID NO: 6656 - DNA, 381 bp, Glycine max
  Peptide Sequence Number=SeqID_123434
atggatctcaaaatgagggaaaaccatacccgacccctcctaggcaacatggtaatcgccccaaaaatcagaggattgatgttacgaggtttgctagtggtagtggtaggaaacccactactttctcaacctagatcatttgtttcagttgtgaaggggcatattcagagagatttccagtatcccaagaaggagcggaatgataggggtctagatgaccaacctaaacgttcgaaggccatgggaagggtctttactcttaacagtgtcgaagcttcgaaatccaaacatctaatccaagaaaaacataagctttttttttcttctttaaataatgatctggtggtagagaccccaactagtggttgtcttaacttctaa

SEQ ID NO: 6657 - DNA, 611 bp, Glycine max
  Peptide Sequence Number=SeqID_123435
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccaggcgaatccggttgttccactatgttatcccaccaaagaagattgtgtctgtcgctgatcatgtcaatactgagtatgaagcgtgggaggttcaagactacactccttgtttggctccaatctactctttcaaaatcggttctgtcacgcggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaagctgcaccg

SEQ ID NO: 6658 - DNA, 615 bp, Glycine max
  Peptide Sequence Number=SeqID_123436
atggaagaattaaacataaatgaagtacatgatttgatgaacaatatgcatcgtgatgaacttatcaatgataatgaggactatgaagataataatattgagtacgtagatgaaccaagtcaatctcctattgatcctccattgactagtaatccacctcagtcaactaaatctcccgctaatcttccattgctagatactcttttgcattcacaaggtgctacttcaagaaatggtccatcaactaatgatggtcactcacaacctacaatagagcattcaagtgtagattcccacgttgaagttgataggagctttggtttatatctggaagacattagtaatctgaagaggtttgatccagatgtgactcgagacattgtatctaaattacttatgagaatgcctatgccagctgaaaatcagaaaaaatattgtcctagaataaatgaaagcttattcaataatttcatgaatgttgctgattacgaaggtcacgggtcaagaggaatgagaacggaaatatgggatggtttagtagtagatatttggaatacactagagtggaagaataagtctattaaagccaaaatgaacacagctatcaaagcttga

SEQ ID NO: 6659 - DNA, 672 bp, Glycine max
  Peptide Sequence Number=SeqID_123437
atgtgcatcatacaattgtattgtctcatcaagagtttaacccattgctggatatacgagcactttcctacagtgcatacatgcgtcgttcatgatgcttatgatgaggggagcccacgggcccgcaggtggcttacgggtaaggctcatatgacggggatcaagggagccccgaatcggagatgtatggatgcctgtactatgactgacgtgtgctggatgccctatgctgagcaccggggagtcaggggctttgacttgatatcgtcatacaccagccagctcagatggggtcagattgtcgtgtacgttcgacttgagcgggttctttggcagtttggctacattcagacgatccctccgccgccgcacctgttcgtcacgtggaccgaggagactgctgagccgagacatctgcctccccctcataatgaggagttcgtcgagccacccatccccgaggtttctgtcgtgtccgatctccctacgcattcagtggggatgactaaggatttaagagcgattgctaaggatttggagcaggtcatcaacctcaggatggtcactgaaggcactgacttatatgaaatcatgactcgttgtctgaggagagctagaggtgacgccgcagatggaagtcttaggccacgacagagacaccacataggttag

SEQ ID NO: 6660 - DNA, 288 bp, Glycine max
  Peptide Sequence Number=SeqID_123438
atgtgtgattcggactcttcctgtgatgaccatgatggagacacagatgaagatacagacgatgatgaagacagatggaagccagaaccaaggccttgtaaaccaccccactaccacaaaggaggagtcccaccaaacttgtctcagaaaaatgacgatctcgggctcgttcaccgttggattatcgtgaaatttgagtaccacgttcacaacccaatttcgaacattctcaccgttgggaatttcaaaatcatatctgagcttagagaaaaacccttcgcattgtag

SEQ ID NO: 6661 - DNA, 495 bp, Glycine max
  Peptide Sequence Number=SeqID_123439
atgggttcttcggaaactatcaatatgccccatgccgtgtgcataccgtacccagcacaaggccacataaacccaatgctaaaactagcaaaactccttcacttcaaaggctttcacatcacttttgttaacactgagtataaccacaaacggattctcaaagctagaggtccttattcccttaatggtctcccttcatttcgctttgaaaccattcccgatggtctacccgagcctgttgtggaggccacacaggacataccttccctatgtgactccactagaagaacttgcttgcctcacttcaggaacctcctagctaaaatcaataattcagatgtccctccagtgacttgcatagtttctgatggtggcatgagcttcactcttgatgctgcagaggaattgggtgtccctcagactcaagttatgttacgaatgggtatttggagactaccatcaattgggtaccaggcatcaaagaaattagattga

SEQ ID NO: 6662 - DNA, 1665 bp, Glycine max
  Peptide Sequence Number=SeqID_123440
gtcatactgagcagagaagtgttgggtgagtcaggtgagagagaggaaggctgtggtggacaaacagcagtggaaatcatagatgggactcttagttgggatgatgataacatgcagcaggacttgaaaaatgttaatctggagatcaaaaagggagagcttactgcaattgttgggactgtagggtcaggaaagtcctctctcctcgcatcaattctaggagagatgcgtaagatttctggaaaggtccgggtttgtgggaatgttgcctatgttgcacaaacatcttggattcagaatggaactattgaagagaacattctctttggtttaccaatggacagacggaggtacaatgaagttatcagggtgtgttgtttggagaaagatttggaaatgatggattatggggatcaaacagaaattggagagcgtggtatcaaccttagtggaggccagaagcagcgtatacaacttgccagggctgtatatcaagactgtgatatatatcttcttgatgatgtctttagtgctgttgatgctcataccggttctgaaatatttaaggtgaattgttacattaagtgggttgagctaacagccttgtcaagactcgaatgtttttgggatgatgaatgcgtgaggggagctctaaaaggcaagaccattattcttgtaacgcaccaagtagatttcctacataatgtggatcaaatattggtgacgagggacggtatgatagttcaatcagggaaatacgatgaattattagattctggaatggattttaaagctctggtagttgcacatgagacctccatggctctagtagagcagggtcagggtgtggtcatgcctggtgaaaatttgaataaaccaatgaaatctcctgaggcaagaaattctggtgaaagcaattctcttgaccggcctgtgtcaagcaagaaaagttctaaactcatcaaagaagaggagagagaaaccggcaaagcatccactgatcagaccaatgttgatgtccttctccccttgttcacgggaattgttattgctatgtacattacagtgctcagcatcttgatcatcacctgtcaaaattcttggccaacatcgtttttgataattcctcttatttggttgaatatttggtaccggggttactatcttgcaacatctcgcgaattaactcgcttagattcaattaccaaagcaccagttattcatcacttctctgaaagcattgcaggggtcatgacaattcgctcattcagaaagcaaaagaatttttgtgaagaaaatctcaaacgggtgaatgataatttgcgtatggatttccacaactatagttctaatgtgtggttgggagtacgcttagagttgcttggaagctttgtcttttgcatttctgcaatgttcatgatcatcttacccagcagtatcattaagccagaaaatgttggtttatctctctcttatgggttgtccttaaatgctagcttgttctgggccgtattcatgagctgtttcatcgaaaacaagatggtatctgttgagaggataaagcaatttacaaatattccatcagaaccagcatggaatatcaaggatcgtatgcctccttcaaattggccaagtcaaggcaatgtagatatcaaagacttgcag

SEQ ID NO: 6663 - DNA, 630 bp, Glycine max
  Peptide Sequence Number=SeqID_123441
atgcaaaacagtggggttaccctaagggctaaatctcaacacttcactagtgtacatgatgacaatccctatgtagcttccattccttactttggcttcattgaagaaatttgggagcttaactatgttaaatttactatatgtgttttcaaatggtttacgttggtagatcttaagaaacttgcttaccaaaatgactctttcatcatggcagaacaagctaaacaagtattttatgttcaagacccctgtgatgaaaggcaaatgactacaccacccagttctcctcctcctcttactgatgcaacatcacattccccttctaccttgaagcagacaaaaaaagtcacacgcttgagatcattggctattatgccagttggggcagagagacccttggtccatatggatcatgcgactgggaaagccgacggtctccacagaaagaagttaaaaacatatttggggatcgttgctcgtgataaggtggatgtgacatacaagaattggaaacaagtccctgctacccagaagaatttgatatgggaggatattcatgtggatgtgagatacgagaattggaaacaagtccctgctgcccagaaggatttgatatgggaggatatttag

SEQ ID NO: 6664 - DNA, 1218 bp, Glycine max
  Peptide Sequence Number=SeqID_123442
atgcagtttaagctaaccttaattgcagaggttgttttcaccatactctacattgttgcttacgttcttttgtttagcagttcctctgaagtgtcgtggaagcaagttgacgagggatccaatggcattgttttgtcggaagaaagtcaagaaacacaacaacatcttgttgacgacaaaatgacagaatctgaggttactgacttcgcttcagcttctctgttatccaaggcattttggatttggataaaccccttattgcgtaaagggtacaagtcgaagcatcctgttaacatcactttgcttcagtgcttttggaaggagttagccttcactgcgtttcttgcaatcattaggctctgcatcatgtttgtggggtcggttctcatacaaagtttcgtagatttcacgtcagggaagagaagctatgcatatgaaggatactacctcgtgttgattcttctcgtttctaagttcattgaagtcttgacaactcatcatttcaacttccaagctcagaaggttgggatgcttatacggtgcacccttatcccttctttgtataaaaagagactaaagctatcgttctctgcacggcaggatcatggggtagggaccatagtgaattacatggttgttgatacacaacaactctctgacatgatgcttcagttacatgctgcctgggaggaacatttcagccagagaattatgggtttccgcgagatggagtatgggtggttctccaagttgatgtactcaatttgtggcactattgttgtgatgtggagcacgccgatgttggtgtcaactcttacgtttggtacgactattttgctaggagttcagcttgatgcaaccacagtcttcaccataacaattgtgttcaagttattgcaaaagcctattaggacattcccacaacctatgatatctctttcacaagcaatgatatcactggagaggatggataggttcatgttgagcagggaattgtcgaacgattcagatgagagagaggaaggttttggtggacaaacaacaacggaaatcatagatggtacttttagttgggatcatgataacaacatgcagcaggacttgaaaaatattaatttggagatcaaaaagggggagcttacaacaattgttgggtctgtagggtcaagaaagtcatctcttattgcatcaattcttggagagatgcacaagcgttga

SEQ ID NO: 6665 - DNA, 1323 bp, Glycine max
  Peptide Sequence Number=SeqID_123443
atggattgtggggatcagacagaaattggagagcgtggtatcaatctgagtggaggccagatgcagcgcatacaacttgtcagggctgtataccaagcatccactgatcagaccaatgttgatgtgcttctccccttgttcatgggagttgctattgccatatacattacagtgctcagcatcttcatcatcacctgtcaaacttcttggcctacagtgtttttgataatccctcttgtttggttgaatatatggtaccggggttactttcttgcatcatctcgtgagttaactcgcctggattcaattaccaaagcaccagttattcattacttctctgaaagcattgcaggggtcatgacaattcgtgcattcagaaagcaaaaaaagttttgtgaagaaaacctcaaacggttctacttagtggttgggatttcgcatagaattgtttggaagctttgtcttttgcatttctgccatgttcatgatcatcttacccagcagtatcataaagccaggcaggtggaaccttcgggagggaaaataataattgatgatattgacgtatccaacttggggcttcatgatcttagatcacggtttggtatcattcctcaggagccagtgctttttgaaggaactgtcagaagcaacattgatccaattggacaatatacagatgaagaaatatggaagagcttggaacgctgtcaattaaaagaggctgttgctgccaagcctgaaaagcttgacactttagggcgggttatactcaagcaaagccggctcttgcttatggacgaggcaactgcttctgttgattctcaaaccgatggtgtaattcaaaagatcattagagaggactttgcagcctgcacaatcatcagcattgtggactgtgacaaagttttagttgtagatgcagggcgagcgaaagaatataataagccctccaacttgcttcagagccagtctctctttagggcattagttcaagagtatgccaaccgctccactggatataagaaatcgagaatctctaatgttcctcttgacatgtctgccctcgtcatccatatattaatgaaaaaatcaaaatgtctcaataaagaatcacaagccatttgtttgatcttagatatacaattgcataagttagcttggctgggtaggctgcgagctaagtctaggactgattttggaggggaaggggaagggaagtgtggccgaggagaggatggggttgtagaaggggaagggtggctgcagagttcagtgcagcgacaatcgttgacgagtagtagcaaaaacaaacggatctga

SEQ ID NO: 6666 - DNA, 117 bp, Glycine max
  Peptide Sequence Number=SeqID_123444
atgaagcttactttggtgacagaagtatatactgtttcaacgacgaaaccggatttacaaggaggagcagcgcaaactaagggctgctaccaggaaaggccaggaggatggggttaa

SEQ ID NO: 6667 - DNA, 225 bp, Glycine max
  Peptide Sequence Number=SeqID_123445
atggcgtcgggctggggaattaccggaaacaaaggtcgctgctacgatttctggatggatttcagcgagtgcatgtctcgctgccgtgagcccaaggactgtgcttttctccgcgaagactacctcgagtgcctccaccattccaaagaggagacatctgtggaagtgtttaagctagagttgaatttgcaaattccctcttctgcttatatccacatcaaatga

SEQ ID NO: 6668 - DNA, 630 bp, Glycine max
  Peptide Sequence Number=SeqID_123446
accagatcttgtggcgggtgaaaatgtagttctatctctagagtttgtgaaagaaacggaaaacagaggcatgttgtctagttggtgtccccaagagcaagtattaactcaccctgcgattggggtttttttgacacacagtggttggaattcaacattggaaagtgtgtgtggaggtgttccaatgatatgttggcctttcttcgcggagcaacaaatcaattgtagattttgttgcaaagagtgggggattgggttagagaaaatggtaagggagttgatggatggagaaaatggtaagaagatgaaagacaaagttttgcaatggaaggaattggcaaaaaatgctacttctggccctaatggatcttcgtttcttaatttggataatatgcaagaaaccaattgtatgttctattgcaaaaaatgggagattgggttagagattgaagatgttaagaaggacacaattgaaagtcttgtgagggagttgatggatggggaaaagggtaaggagacgagagacaaaggtttgcaatggaaggaattggcaaaaagtgttgcttctggccccgatggatcatcatttcttaatttggaaaacatgtttgtgaagttcttctgggcaaa

SEQ ID NO: 6669 - DNA, 789 bp, Glycine max
  Peptide Sequence Number=SeqID_123447
atgtcttcgtctacgggcttgattttccgagggcacgaggcccaacccatggacgacgcctattacccgaagccgcagaagccatggctctccttccgctacctcctacgcgaacagcgtctccacttcctcctcctgggcattgtcctcgccaccctcttcttcttcctcctcccctctggcctccacgacccattccccactccttacttggagcccacccgctggcccaccaactccccaagctacgacgtcgtctccgtgcattccgtcggaaaaatccctctggggattaagcggaagggtctccggatcgttgtgaccggtggggccgggttcgtcggttcccacttggtggatcgcttgattgcccgcggagacagcgtcatcgtcgtcgacaatttcttcaccggaaggaaagaaaacgtcatgcaccatttcggcaaccccaacttcgagctcattcgacacgacgtcgttgagcctctcctgttagaggtcgaccagatctaccatctcgcctgccccgcctcccctgtccattacaagtttaacccactagtgttaattcacaagaccaacgtggtgggaacgttgaacatgctgggactggctaaaagagtgggggccaggttcttgctgaccagtaccagtgaggtttacggagatcctctggaacatcctcagaaggagacctattggggcaacgttaatcccattggtgaattgaggaaaggagagtcaaaccaaccgaggtttttggcttgtgagacacgtgggacatcatga

SEQ ID NO: 6670 - DNA, 1473 bp, Glycine max
  Peptide Sequence Number=SeqID_123448
caagcacttgcatcgcatattctttcccttggaaaaatgcaatccaaggaagagacaagaaacatgagttctttgggcacaatcctcaagcctcatgctgtgtgcgtaccgcacccaacacaaggccacataaacccaatgctaaaactagcaaagctccttcacttcaaaggctttcacataacctttgtcaacactgagtacacccacaaacgccttctcaaatcaagaggtccagattccatcaagggtctcccttcatttcgctttgagaccatccctgatggtctaccagagcctcttgtggatgccacacagcacataccttccctgtgtgactccactagaagaacttgcttgcctcacttcaggaacctcctcactaaaatcaatgattcagatgcccctccagtgagttgcatagtttctgatggtgtcatgagcttcactcttgatgctgctgaagaattgggtgtcccacagttgctgttttggacccctagtgcatgtgggttcatgtgctatgtccaatttggacaactcgttgaaaagggcctagtacccctcaaagactcgagttgtatcacgaatggttatttggagactacaatcgattggataccgggaatcaaggaaattcgattgagggatattcccagttttattaggaccacagatgtagatgattttatgcttgagttcctgcagtgggagtgtgggagggctagaggagcttctgcgatcattttgaacacatttgatgccatagagcatgatgttttggatgcgttctcatccattttgcctcctgtttattccataggtcctttaaatttactcgtgaaggatattgatgatcaagatttgaatgcaattcagtccaatctttggaaggaggagttggagtgcgtggagtggctcgacaccaaagagtctaatagtgttgtttatgtgaattttgggagcatcacggttttgacaaatgagcaattgattgagtttgcatggggtcttgctgatagcaacaagagctttttgtgggtcataagaccagatgttgtggggggtgaaaacgttgttctgcctccaaagtttgtggaacaaaccaaaaatagaggtctgttgtctagttggtgtccccaagagcaagtgttggctcaccccgcgattgggggttttttgacgcacagtggttggaattcaacgttggaaagtgtgtgtggaggtgttccaatgatatgttggcctttctttgcggagcaacaaaccaattgtcgattctgttgtaaggaatgggggattggattggagattgaagatgttaagagggataaaatagagagccttgtgagggagttgatggatggtgaaaagggtaaggagatgaagaagaaaggtttgcaatggaaggaattggcaaaaagtgctgcttctggcccaaatggatcttcgtttcttaatttggagaatttg

SEQ ID NO: 6671 - DNA, 279 bp, Glycine max
  Peptide Sequence Number=SeqID_123449
atgggtgtagaatgtggtgtacggctagcgtgtgacgaatatgctctgttcggtattgattatgaggagcatggacgttctgaaggtgctcgttgttacattaaaaaaattgataacatcgttaacaattgttataactttttcaagtcagttagcgagctacaagagtataaggaccgtgaacctcacggaccagtccatggacctagatccgtttacccaggtcaagcccaggttgaaaacagcattagaaatgttgagaatcagcatgagccttga

SEQ ID NO: 6672 - DNA, 834 bp, Glycine max
  Peptide Sequence Number=SeqID_123450
atgagtgcggttgagttttcatgcttcaaagtacaaacctatatctctatacagaattgttcaagaaacgagcctctgtttctagatccatatgctggttgttttgtccctcataatagtcccaaggatgtgattcaggacttgcatccctattgtcttgcaaccaagttcattgatgataagctgcttcatacagtgagccttattgacggactaaagcagctaattttgttgactgatggcatggacacacggccatacagacttcagttgccctcttcgatcctaatatttgacatatccccagaaagtgtatttagaattgcagctgagaaacttaaaggtgttggggctaagatgcccaaaggttgcatattctaccatattccactggaatcatctgacatagagcaggctatgcaatttaaaggctataatggtagtagacctagtatatgggccttacagggatttccagtgatgacactggcaaattttgaagaggttttgtcaatgataagcagtttggccatgaaaggatctctttttgtgggagaacttcctgcctgcgtagctgagacagacatagaaattaagtccaatacaaggcaatgggtggataaactattcatgagcaagggttttcgggtggaaattatcaactacaaagggtttgcagagagaagtggtaaagattttgtatcaggacactacaataatatactatttgttgcagaacagctgctacattctgatgatcagatggagtcatggagacgagaatttcaaaggatagaaaatgaaggagatgaagaaggttttgaagagttatag

SEQ ID NO: 6673 - DNA, 660 bp, Glycine max
  Peptide Sequence Number=SeqID_123451
atggtggttgggaatgtttatttggcaaggaagtgcaagctaatgtctcaacttggtggagtaatgcagcagtggcggcaagcaactccatccgcaatgggaatcgatttgaaggcaggaggtaagtccaagaagaccaagcgaaccgcccccaaatccgatgatatctacctcaagcttctcgtcaagctgtaccgttttcttgttcggaggactgggagtaacttcaatgctgttgtcctcaagcgccttttcatgagcaaggtcaacaagcccccgctatccctctctagattgatccgttacacgaagggaaaggaggataagatagctgtggttgttggtgccgtgaccgatgacattagggtttatgaagtccctgctctgaaggtaactgccttgaggttcactgaaactgccagagctagaattgagaaggctggtggggagtgcctcacctttgatcaactggctcttagagctccacttggccaaaacacggttcttcttagaggtcccaagaatgcgcgtgaggctgtcaagcactttggaccagctcctggtgtgccccatagccacaccaagccctatgtccgtgcaaagggaaggaaatttgagcgggccagaggaagaaggaatagcagaggctttagagtttga

SEQ ID NO: 6674 - DNA, 354 bp, Glycine max
  Peptide Sequence Number=SeqID_123452
atggaagaagaattctctcttcaagagaagaatattacaatgaagatcatacatatggtaatcgattacatgttgaaaattcaaattcaaaacctttttcaacagctatttctcaaccctgtcttctgcaaatgcttatcatttgaagcagccttgttagattcttctttgacatcatcaaaatcatccttagctcaggctatagggaatccaaataggggagaagctggtagagctgttgagtaccaggggttggaccgcttccaacgaaacaaccctccttcatttaatggaggatacaaccttgatggtgctcagaactggataaggaaattgagaaatttttttgagtga

SEQ ID NO: 6675 - DNA, 498 bp, Glycine max
  Peptide Sequence Number=SeqID_123453
atggttgattcagaaatttgtaaacagatttacactccacaacaataccacaaagaaattagaaagaagaggcctcagtacagacctcccaataaacaaccctctaggaaaaagaatccaactagtaggtattcaattagagcctctaattctagaaaacctactctcaacaaagaaaggcatgttagaaaactcagagataacaaaacatatacaaagcaactagaatgttatgcttgccaccaaccaggacattactccagagattgtccaaacaaaaccaatttgtttataagagaagcagagttgataaaaagatgtaggatgaatctcattcccatagacgagacagtctctaccgactcaaaaatatattcaatagtcagttggtctgactatacttctaaaaaagaagaagttaacaaagattataaaatcttaaacgaattcactagaaatgagtacactaatcactatccagtaactatacttctatag

SEQ ID NO: 6676 - DNA, 126 bp, Glycine max
  Peptide Sequence Number=SeqID_123454
atgactaatgcaaactatctgcaagaatcattgcattcagtctcaaacgggaatctaagttgggtaatccgcaaagttccgcgacattctggaagtcaaaaagaggcattgttgcgcaatccgtaa

SEQ ID NO: 6677 - DNA, 423 bp, Glycine max
  Peptide Sequence Number=SeqID_123455
atgttattatcagaactcagccatgcggccaccatagtcgaggccatgccatgccactccgccatggcacttggcaaaaactcagccatgcaagatgcacaaaagacagagttacgaaaaaataaggttgtagaaaaatacttgggtacggtggcgaggtgtcacgatggcgataaggttgcaaagagagataaagtcgcgaagacaaagcttagacgaagaagaagagaacgcgagcaaaatagggctcgcgttctaatatttttaaataaatacaatcccaatgagaaaggacaatatgtcaagggtagaatgccaagagtttcttatcagactaacaagatttcccctgttacagcaattatggaagttaaaccaaatggattacattatttacatgacaaaacatttagtaccaattga

SEQ ID NO: 6678 - DNA, 378 bp, Glycine max
  Peptide Sequence Number=SeqID_123456
atgttgttcgccaagggagaccctggtattgcggccctttatgacaaactcctagtgtcagaggaactgtggccatttggcaagcgattaatgtctatgtttgaagaaaccaagagccttctcctccaggttgctggacacaaaaatctccttgaaggagacccctacttgaagcaaatacttcgacttcacgattcgcacattacaacccttaatgtcttgcaagcctacacattgaagcgatttcgtgatcctgactaccatccagcagttgagcttgtgaaattcaaacctacaagtgattatgctcctggtatggaggatacccgtattttgacaatgaaaggtattgttgttggcatgcaaaacactggttaa

SEQ ID NO: 6679 - DNA, 1252 bp, Glycine max
  Peptide Sequence Number=SeqID_123457
ccaccacctcagtgtcgctctaggctctgcctctgctttcgctcgcaatgccctctcccttcctttatgttttggtttctactggtttcccgatgggaattacccgtattaccctcaacttggaccgtcgccttctttgtcgcgtcctcctctgacatcaccatctcatcgcgtctccacctgggacttcctcaactttttcgataacttcgacaatggttacccgagttacccgcctcggttcgggtcgagtgtgagcaaccccgattcgaaggaagtgagggagagggaagggattctggagtttgaggatgaagcagaacacaaaatgatgaaaaagaaaaataaggagtttgttttattgaagaaggagaagaaaaatatgggagaggacaagggttttggtgttggagttagggatttcggggagggcccttcgaataccaaaacggtgtcgttgcagcaggtgaatagcagcgaggggagctccaaggcggtgaggtttcacgatggcaatgataatggttccgtcaagaaagagatcaacagcatccccaacactgttgcttccgaagagcacggtgcaaagaaaggggttagtttcaagattgacgaagcaattgtcatgacaatggataatgactcttctgttttgagcagcatcaccactttgtctgtgcatggcaccaaggatcttccgtcgaattttgggaaagaggttgcgttattgcttgaggtttacaaaccgccttatcgatcgagggttcctgcacttagaggtgatgttgactctagcaagatggaagttggtggaacccggaagaaaaagaagtataagaaaatggttcagggcaacatggaaagttcaagttctgactttgcaaagccttcttttccagcaaagaaaagggtacaggtgtcgcaaaatcttctttcagaaactccaatgaagaatttgaaaattggagactctctgagtgaaattaacaaagagaaagagggaacggaaaaggtcctagtcaaggaaagtgaaaggcccctccaaagtgaaaaagataatcctgttctttcacctttcttttggtcgagagaggaaaacaatggtaaaatgttaagtcaacaaaccgatgaggatcaaattattgatgactcaacaccaaatcctccttcattcagtgatctcaaggactccgatgatgaaatccattctaatgtcgatctaatggtaagtgttggattaacaaacaagtag

SEQ ID NO: 6680 - DNA, 209 bp, Glycine max
  Peptide Sequence Number=SeqID_123458
ccttgccttttgctgcatttgcatctttgcttgtggagactgtggtaaaactggactctgttattgaggaagttgaagaacttggaaggttagcatgcttcaaagaatacataaccgatgacaagattattgtgagttgtgagacaccacaagttgatgtgttaaaggaccatgataaaccttctcgggatggctatgactatgagtaa

SEQ ID NO: 6681 - DNA, 126 bp, Glycine max
  Peptide Sequence Number=SeqID_123459
atggaggagcgtcggaaatcacatcggcggtggcgtcgaggttcacaggcaagaaagtttaagaaggaaggatatgcgcgttctcccgttgtcattcagtggcaaacacctcaaatttttgggtaa

SEQ ID NO: 6682 - DNA, 1029 bp, Glycine max
  Peptide Sequence Number=SeqID_123460
atgggaggggcaacactgccaccaggatttcgtttccacccaactgatgaagaattagtgggctactaccttaagagaaaagtggaggggattgaaattgagcttgaagttatccctgtgattgatttgtacaaatttgatccgtgggaattgccggagaagtctttccttccaaaacgggatttggaatggtttttcttctgtccaagggatcgcaagtacccaaatggatcaagaacaaatagagccaccaaagctgggtattggaaagccactggtaaagacagaaaggtggtgtgccagtctaatccatccactgtagggtaccgcaagaccttagttttctatcttggaagggcccctttgggggatagaactgattgggtcatgcatgagtatcgcctctgcgatgatctagggcaagccacaccatgtttccagggtggttttgccttgtgccgagttattaagaagaatgagaaggcaagtgcatcacagggagaacacaagggcaaaagggctggaagcagttccatcaatgggagtgacacctcagtgaaattctctagtgagccattcagcaactctggtgatgcttcctctcaagcaagtcatctgaacaacgagagccgttattcaagccctataacttctccatacaatgtggctccaatgggagagtttaaccaagcttctgtggaaaccaccaatccttcaaacttctggatctcccctgatatgattcttgattcatcaaaggactactctcaattacaaaatgccatggctgaatgttttccacggtatgacttaccaagtgtgatggcaccatggcaatcattggaacatccagaaacttcatctagtttgtcctactcaaatttcaatggggaggttgaatttgctgataatctcagtcaaattggctgcactagacaatggaattccatggacctttatggaaatggggatgtcccttatgatggttatgatcaagttaactcaatctcatatcctgaacccttctaa

SEQ ID NO: 6683 - DNA, 651 bp, Glycine max
  Peptide Sequence Number=SeqID_123461
atgtgtgcttcatccagttacatgaggttctttccctgcataaagaagaattatgattatggtgtcaatatatttctgttgacctacaacttggtagctgtttccggttaccggattgataatgtcttcaagatggcgcatgagcgtttctccaatatagccataggcgttgccatatgccttctgatgagtctattggtatttccaaattggtcaggggaagctcttcacaattccacagcttccaagcttgaaggccttgccaaatctttagaagcttgtgtcaacgaatatttttatggagaaatggaaacttctggtgacaaaaaatcatctgaggatatatatgaaggttataaggctgttttggattcgaaatctacggatgaaacacaggcattacatgcaagttgggagccaaggcatttatgtcgcaaatttccatggcagcagtatgtaaaagttggaactgttattcgtcaatttggatatactgttgtatccctacatggctgtttgaaaacagaaattcagtgtagtaaagggaacctaatccatgtatctaagttggcaacagatgctgagtatgtgagaattgatcaatgttcgactcttacagaatacactttaggaaggaatgatgaactttaa

SEQ ID NO: 6684 - DNA, 1236 bp, Glycine max
  Peptide Sequence Number=SeqID_123462
atggttgaaggggcagcagatcttccagtcccggtgtctgttaattctttcagtccgggttctcctgtgcattcgtcgaatgggatgccgtacactcattcggtctcatcgccatctcccgtggcggcaaagtttactgatgcagctatttgctcattgtcggagaagaaggaatactcgtttgttggcctccgtggcctcgaccccgtgcatgttctcgaagagacacttctggaaggaatcgatgatgtcaatctagtcttggtcgctaaagaacttcatcgcccagacgccacgcgccactgcttggggaaggagggtggagtggcggacctgattctccaaggcagaggagaggaggagctagatgtcgagggaggagggagggaaaggggtagaacctcaaccgtgtcttgcactaagctactcaatttcttctccttcactctgctgagtgctgctgtctccctcaaagaactcatggccgccacactcactcttctaaagcttccaattcttcctaacaagccattactgccacgcccatcaacctcaaaacttgttccatttccttccatctattcaaagttaaatatcccaaaagattctaacccacaaaatttacccttcttagatcaaaacatcgatgctctcaagcctgatgctcttgctgttggaggagagtttgggatattggaaggaagatcatttgctctcatacaccccattgtgatgggttcttttttcttgtataccttgtgggcagggtatttggggtggcaatggcggcgagttaggacaatccagaatgatattaatgaactcaagaaacaagtcaaacctaacccagtcaccccagatggcaaaccagtggaagaagcagcaccatcaccagttgaactccaaatacagcaactcactgaggaaagaaaagagctgataaaaggttcctataaggatagacacttcaatgcaggatccatacttctaggatttggggtgcttgagtcagttggtggaggagtgaacacatggtttaggacaggaaagctttttcccggtccacatttatttgcgggagcagctattactgctttatgggcactggcagcagccctggtaccatcaatgcaaaaaggaaatgaaacagccagaaatcttcacatcgcgctgaatgcagtaaacgttctgctctttgtgtggcagattcccactggaattgacattgtgttcaag

SEQ ID NO: 6685 - DNA, 827 bp, Glycine max
  Peptide Sequence Number=SeqID_123463
atgggtgttgccaaggagagtggtgcgggggagggtggcggcatgtgtgggttgaggtggggagagggttttggatctgaggagaaggaaggggagcgacagaaagtggagaagaaaaagatggagaaaatagagcacaaaacggtgaggacgaatggaataaacatgcacgtggcatccattgggtcaggcccagttgtactgttcctccacggcttcccggagctttggtacacgtggcgccaccagcttctgtccctctccgccgtgggctaccgggccatcgcccccgacctccgcggctacggcgacaccgacgccccgcccgacgcttcctcgtactccgccctccacatcgtcgccgacctcgtcgggcttctcgacgctttgggaatcgagcgagtttttctggtgggccatgactggggagcctccatagcctggcatttctgcttgctgaggcccgatcgtgtgaaggccctcgtcaacatgagcgtcgtgttccgccccagaaaccctaatcgaaagcccattcagagcctcagggccatcatgggcgacgattactatatctgcaggttccagaaacctggggaggttgaagaagagtttgcacgtgctggtgctgcgagaattataaagacatttattgcatctcgcgatccacgaccaccttgtgtgcctaaggagataggatttggtggttcacctgaccttcgtattgatctaccttcgtggctgaccgaagaagatgtcaattattatgccagcaaatttgaacagaaaggtttcactggcggcctaaactactatcgcgctatggacct

SEQ ID NO: 6686 - DNA, 312 bp, Glycine max
  Peptide Sequence Number=SeqID_123464
atggcttttagtttaggaactgttcaaaccgtgaaggaaatagggatgaggaggagaatgatgagcacaaaagcacttccagctgacacaagctcacaaagagcagtgagggagcgatcctctataatagcctctgcctttcctttccttccctttcgttcttttcaagatgcttcatgcggtttcctttaccgtacgaaactgacctatttcaacgttccagacgaaaagaacctctatgtattttatataaaccagacgttgtccttcatacgtctatttgaagtcaatctgtttctttattgctgctga

SEQ ID NO: 6687 - DNA, 283 bp, Glycine max
  Peptide Sequence Number=SeqID_123465
atggcaatggctagcaatgagagtagaagaatggtcactgggaatttgatgaaacgtgtgcttgctttgggtgacaagttgagggtgtttcttagtttggcttgggagagtgtgtggaagatggggcgtgatgatccaagaagggtcatctatgcattcaaagtgggtttctctcttactcttgtgtctttgctttatctcttggagccattcttcaaaggccttggagagaatgttatttgggctgtcatgaccgtcgtggtagtgttccagttcaccgcag

SEQ ID NO: 6688 - DNA, 695 bp, Glycine max
  Peptide Sequence Number=SeqID_123466
gagcaaagtgtggagagaccaaccatcagggaagtggttgaaatgcttgcacaagcaaagaaaccaaacgcattccaaaagcagttgcccagaaaagtagcagataatctcattggaatgcagcgcagctttttatggggaggagggtcagagcaaaggaaaatagcgtgggtcaaatgggaaactatctgcctcccaaaacaaaaagggggcctgggtataaaagacataaggaccttcaacaaagttcttctcgagaagtggagatgggatttgtttcaccaaagcaaggagctgtgggccagaatattggcttctaagtatggtggtgaacagtatggagggtgggctgtggggataaaattcatttctgggaggattaatggactggaattggatgggaatggaacctttcttggagaaggcccctatttgacaatgaggagtgcctacattctgctgcaagggaactcagaggagggaaacatggatgatatattcaaggacttatggaagctaaagatcccagctaaagcatcaatttttgctgggaggaggaaattgcatctcatcttttctttgactgcagcaaaacccaacattttggtgggaatccctatcatggataggcacctcgggggcctatcctataaatccaaggctccattttctgcagcacaacaatgggatgaaag

SEQ ID NO: 6689 - DNA, 144 bp, Glycine max
  Peptide Sequence Number=SeqID_123467
atggcctcaaatcccaaaactttgacctttgaggaggtagctaagcacaacaacaaaaaggattgctggattattatcaatggaaaggggtgtgatgcggttcagaagccacatgttaatctccaatacagtgtattaagctaa

SEQ ID NO: 6690 - DNA, 766 bp, Glycine max
  Peptide Sequence Number=SeqID_123468
attctcttcttcttcttcttcttcactcccaacttcacttgtccacaatgccacactttcaacatctcccccagagaagcacacccgtgtgcccgtgtcaagtcccactcactctccaaaaataataaaacaatctgaccctagcccaatgcactcaccaaacaataacagaaccaccgcatctccaccctctcccctcaccctcccaccttcccagttgatggccgagcccaatataccccaacagcccgatcccaagaccgtgctagtccagaaaaccattgacaggcccaagccctggctcactggcgccactggatcccataaaaaccacggaaaacacgtcaccgtcaaagagagtgaatccaaggagaagggtattcacagaaagctttcgcagtctgaggagtctggtatgagagtcataaccattgcaggggaaaacagaggagcgtacatggaactcatccagtccccgaagaaacacgatccaaagtatcttcacaagaaaggaaattccaacatcaacgtggacggggttgaatccgctgaagaagggaatgtgaacaagaatcagaaaggtagaacttcttcttcgtttcccatggctgcgtacatgaacagcaatgtgcagtgtgtgaacaactcgctgctgtaccacacttcttgctcccatcacaaccccggtgtgcgcctctctctttccaagaaaccattcggggaaggtttccatctcaaggaacacgctgatggtcacaacacttga

SEQ ID NO: 6691 - DNA, 257 bp, Glycine max
  Peptide Sequence Number=SeqID_123469
atggccagaacacgaggtttaggtcgtgccataggtagagttgtaggcagagatagaactgctgacgaggatgttggcgatgttcccgagaggcgtaggcctactgcctcagcccgtaggctacgcgttcatcagatgactacggagggacgtgatatggctgaggacgtcgctgacatgactgatgatgtccctgagcagcctacggaggcacctgagatgcgtgcggacgcacagggtgctgatagtggtgaggg

SEQ ID NO: 6692 - DNA, 762 bp, Glycine max
  Peptide Sequence Number=SeqID_123470
atggaacaaaatgcgtgcaaggaattgtcaaaaattgcttcgaatttcaagtgcgagaaggttctcgaaacagttgatgaatcaattgtatgccccactccacaaaagaacgaggaacccctaactgtcaaatccaaagagggacaaaccaaccttcctgaaaaatactctacgcttgctgatttgtttggtcacatgagttgttcactcagattgttgtatctgtgtaaaaaggctccaattttcaaaatgtttgccgccaggaaattctcccatgcccatcttgcgcagatgaagtatatactccctaaaagtgtgtatatagacagggtgcttgttcatgataagaaaagcttgtgtgtggtgcctgatatgaagatcaccttgaaatttgaggttgtgaaagattgctttggcgaatctgctgatctggctcttcgacgatattttaaatctaagctgattgatttctttgatatgcatcctgaggacatgcctacccaaaagtcaacatcatcttataagccagcaaaaagagtgcttgacttttccctcatggaggacaatgatggcttgggcattgaaatggacaagttagaatctatcagagctctgcatgaatctagcagaggatgttctgaggattgcaactcttttggttctgtttctgcacctcaggaggagggcacacatgcatgcatacttgaaaaaagtgggataaatgagatgtttatgacaactggcaagataatgatgaagtga

SEQ ID NO: 6693 - DNA, 1446 bp, Glycine max
  Peptide Sequence Number=SeqID_123471
atggctttcaatagcttgtactttcgtatactctgtgtttcccttgtgctatccttcttgacatccatttccatagctgataataaccatgaagccgttccaccagaaaccatatgctactcaaccttagacccttcttactgcaaatctgtgcttgctaatcaaaatggcagcatatatgactattgccgcatttctgttcgaaagtcattgtctcagtctcgtaagttcttgaacaacatgtattcatatcttcaacatccttcttcttattctcaacccacaattcgtgctcttgaggattgtcaattccttgctgaattaaactttgaatacttatcaacaacacgtggcactgttgataaagccagcgatgttcttcccacctctcaagccagcgatgttcacacattgcttagtgctgttttgacaaatcaacaaacttgtttagatggccttcaaacttcagcttcagattcaagagtgaagaatgatctttcttcccaactctcggaaaatgcaaagcttgacagtgtctcgctttatttgttcaccaaggcctgggattctgagaacaaaacttcaacatcatggcagcaccagaatgaacgtttacccttgaagatgccaaacaaagtacgtgccatttatgattccgcgagaggccaggggaaaaaactacttcaaacaatggatgataatgaaagcgtacttgtgagtgatattgtggtggttagtaaggatggaagcgggaactttatcactatcaatgatgccatagctgctgcaccaaataacacagctgccaccgatggctacttcattatttttatcgccgaggctgtggtagcacaaggatttgtggcaatgaacataacattccgcaacacagctgggccaagcaagcaccaagcagttgcagtaagaaatggagcggatatgtccaccttctacagctgtagctttgaagggtatcaagacacactatacacgcattctctgaggcagttttatcgcgaatgtgacatatatggcacagttgacttcatatttggaaatgcagctgttgttttacaaaactgcaacatgtatccccgcctccccatgagtggacaattcaatgccatcactgcacaaggtcgaactgatccaaatcaaaacactggcatttccatacaaaatgcgaccataaaagcagcacaggatctggctcccgtggttgctccggctggttggcatgaatggaatgggaatttttcactgagcaccttgtactacgcagagtatgataacacaggtcctggttcaaacactgccaaccgagtcaactggcctggctatcatgttattgatgctactgatgcagctaattttactgtctctaacttcttggttgggaatgattgggtgcctcagactagcgttccatatcagacatcattgtaa

SEQ ID NO: 6694 - DNA, 1821 bp, Glycine max
  Peptide Sequence Number=SeqID_123472
atggctttcaagaacttgtccgctcttactctctgtgtttcccttgtactacccttcttgacaccgatttccatagcggctaataaccgtgcagtggttccaccagaaaccatttgcaactccaccgtaaatccttccttctgcaaaactgtgcttgttaatcaaaatggcagcatcgttgactatggtcgaatttctgtgcgaaagtccttgtcccagtcccgaaaattcttgaactcggtaaattcatttcttcaaggcaaatccactttgtctctacccacaattcgagcccttgaagactgtcaattccttgctgaactaaacttcgaatacttatcaaacgcacttgatgctgttgataaagttagcaatgttcttcccaccaatcaagccgaagatcaacaaacccttcttagtgctgttttgacaaacgaagaaacttgtttagaaggcttgcagcagaccacaacttctgatcaaagagtgaagagtgatcttatctcatcactctctaatgacaaaaagctccacagtgtttctcttggcttgttcaccaagggttgggtgcctgagaagaaaatctcaacatcatggaaaaccaatgggagacatttgggtttccgcaatggtcgtttaccattgaagatgtcaaaccgtgtacgtgccatttatgattctgctagaggtcacgggagaaaactacttcaagataacagccaaagtgtgttggttagggacattgtggttgttagccaggatggaagcggaaacttcaccactatcaatgatgccatagcagctgcgccaaataacacagttgctagtgatggctactttttaatttttgtcactcaaggtgtgtatcaagaatatatatccatagctaaaaacaaaaagaacttgatgatggttggagatgggatcaatcaaacgattatcaccggtgatcacaatgttgtcgataatttcacaacattcaactcagcaacatttgctgtggtcgcacaagggtttgtagcagttaacataacattccgaaacactgctgggccaagtaagcaccaagcagttgcagtgagaaacggagctgatatgtccaccttctacagctgcagctttgaagggtatcaagacaccttgtacacgcattcccttagacaattttaccgtgaatgtgacatctacggcaccgttgacttcatatttggaaatgctgctgttgttctccaaacatgtaacctatatccccgccttcccatgagtggacaattcaatgccatcacagcacaaggcagaacagacccaaatcaaaacacaggcacttccatacataatgccactataaaacctgctgctgatttggctccttcagttggcattgtgaaaacgtaccttgggagaccatggaaagagtactcaagaacggtttatatgcagtctttcatggacagtttcataaatccttctggttggcgtgaatggagtggagattttgccctaagcaccttgtactatgcagaatataataatacgggacctggttcaaacaccacaaacagagtgacgtggcctggttatcatgttatcaatgctactgatgcggctaattttaccgtgtctaacttcttggacggagataattggctgcctcaaactggagttccatacattagacgcaccattgcttgtcgccgtagcgaggaagtgaaatctggaatcccggcaggctccgatttgaggtatggattgacgagaagaagaagtgcagacgatgtagtcttctcgtcagtctgcccatcttcttctcgtcaatcctaa

SEQ ID NO: 6695 - DNA, 1086 bp, Glycine max
  Peptide Sequence Number=SeqID_123473
atgataattaagcggagtttgaaaactggacttcagaagcggaaacagtataagccagagaactgcgataatctcgcgattcagaaggagccgaagccagaaaactgcgataattccgcggttcagaagaagcagagagtaaatgaggtttcttctgctgaaggaggagcctctggatcctgtgaggttcagtccaattcaaattccgtggactcaaatggcacaattcaaggattggtcccacaatcagaagaggttcaaccaccccggccttccagaggtcgagctaagaagcttcccagaaggtttagtgattctgttttttacgaacgcttcgggcttgtagacgagaataagaatactttgcaatacattgctgacaagagaaatcaaagagattctccttgttctccaaattctattgagtccggcgatttcgagttctcggttaagactgttaagaagacggttaacgggggtcgtaagttattggttaaagaaaagagtaatgatgccgctggacatagttccaattctgagggtgtggatggaaacgtttgggcaaaatgtgggaagaagcatcctgcttggcctgctgtagtcattgatcccctcttgcaagctcccaaatccgtcttaagctgttgtgttcctggtgcactttgcgtcatgtttttcggctattccaaaattggaaagcaaagggactatgcgtgggtgaagcaggggatgatatttccgttcttggaattcatggacagattccccgggcagacccaactatacagaggtaaagcaagtgacttccacgcagcaatggatgaggcatacttggtagaaaacggcatttttgaggtacaattgggagctgagcaaaatatggatggtgtggattcctgtgttaaccaggaatgtgctgatcaagaccaggatacaatatcttgtgctggctgtggtttgatgtcgccatgcaaaaccatgaagaagattaaggattcaagctgtgctactcagcacttttgcaagccttgtgcaaaggttctgcctcgactcattctagatttcttcaatttcttgactggataa

SEQ ID NO: 6696 - DNA, 1668 bp, Glycine max
  Peptide Sequence Number=SeqID_123474
atggcttcaaagttttgtttcttcttatttctcattctcttgccattatttgcttcctcagacactgttccaaatcccaccactcctgtctctcccggaaccgcatgcaaatcgactccagacccatccttttgcaaatccgttctccctccccaaaacggcaacgtttacgactatggccggttctccgtaaaaaaatcactctcacaagcccgcaagttcttgaacctagttgacaaatacctccaacgtagttcttctctttccgccaccgcaatccgtgcacttcaagattgccgcactctcggcgaactcaacttcgattttctttctagttccttccaaacagtcaacaagacaacgaggtttcttcctagttttcaagccgacgacatccaaaccttactcagcgccattttaaccaaccagcaaacatgcttggacggtctcaaagacactgcttcagcttggagcgtgagaaacggtctcactgtcccactctccaacgacaccaaactatacagtgtctctctcgctctcttcaccaagggttgggttcccagaaccaaagccaaagcaatgcaccctaccaagaaacaacttgggttcaaaaatgggcgtttgccgcttaagatgtcgagcagaacccgtgcgatctatgagtccgtgagtcggaggaagctccttcaggccacagtgggcgacgaggttgtggtgagggatattgtgacggtgagtcaggatggaagcggaaacttcaccactatcaatgatgccattgccgcagctcctaacaaatctgtctctaccgatggatacttccttatctacgtcactgccggtgtgtacgaggaaaatgtgtccgttgataagaagaagacttatttgatgatggtcggggacggtataaacaagacaattatcacaggcaatcgtagtgtcgtcgatggctggacaaccttcagctccgcaacacttgctgtggttgggcaaggattcgtgggtgtgaatatgaccatccgcaacaccgccggggccgtgaagcaccaagcagttgcacttcgaagtggagcagatttgtccacgttctacagctgcagcttcgaggggtaccaagacacattatacgtacattccctgagacaattctacagcgaatgcgacatctatggcacggtcgatttcatcttcggaaacgccaaggttgtcttccaaaactgcaaaatgtacccacgtctccccatgagtggtcaattcaacgccatcaccgcacaaggaagaacagacccaaaccaagacacaggtatttcaatccataattgtaccataagagcagctgatgatttagctgctagcaacggtgttgcaacgtatttgggaaggccgtggaaggagtattctagaacggtttatatgcaaactgttatggacagtgtgatccacgctaaggggtggcgtgaatgggacggtgattttgcattaagcactttgtattacgcagagtacagcaacagtgggccagggtctggaaccgataatagagtgacgtggcccggttatcatgtgattaatgccacggatgcagctaactttactgtgtccaattttttgcttggtgatgattggttaccgcagacaggagtgagttacaccaataacttgatatag

SEQ ID NO: 6697 - DNA, 528 bp, Glycine max
  Peptide Sequence Number=SeqID_123475
atggtttggcagtctccaaatcaaaaatcaatcttttccaaactcgaattcgattccttggtcacaatatatatcaaggcattcaaaattgtcgaaactgatgcttcagacataggttatggtggcatcctcaaacaaagagtccatggccaagatcataatacatcaagggcacctcaaattcactaccttactaccttacccgtgaattcttacagaaaagtggtaatgtctcctaaggcatcgggaatctccctacggggaggaaggagtacaggcaaaggagccagactggctcttccagagccaaccatcaagaaatcatcaacctcttctgggtcaccaacccaggctgggtcatctacccagaaaaccaatttagaagggtcatcaacccagattgcctcaatcaaacctgagccatccactcaggaatctcccaaaccggcaaccgccaaacaaacatcggccgactatgcatggccaattgaaacccttcaggcccttcaagacatggatggaacctga

SEQ ID NO: 6698 - DNA, 836 bp, Glycine max
  Peptide Sequence Number=SeqID_123476
atggtttcaattttcaaacagttgcaagaactggatgatagaatacaaaagccactagaacaagctcaaagttgtactacaggatacaaagcagcaaacagcacggagagtgaaacgacaactatgaaaagtgaacaagaggtaaagcagtcaaacacgtcaatagaaagatcacaacacattgttggtgttctctgggaatgtgaccgcagcataaaagcagaacaatactttgaaatggaagatgaacctgcccagctgaactttgttgaacatgttgatggttctttgacatcatcagaagattgggctgtgattatcaatggtgggacttctggtcctaaaactgttaagcgcaggctaagcttataccatataaagattaaagaatgggtctcgttgttagtaggaagtaaaagcttcattgctattgtactaaaaagggatatgctaggtgcacccagcaatattgctgccttcttcttgcttctgcttttcttcctttgcatacctcttccgcgagccttctccttcatcgcgagcccaggtgctgcttctttcggttggacgccatttccgttcgagttccggaagaacgttttccggaaagtttctggaagaagtgttcttccggaagtaaccaaacgtcttccggaagaacacttcttccggaagacttccggaaaacgtcttccgggaactttccggaagaagtggttcatccggaagaattccggaagacgcgcacttccggaagaagtttcaaagttccggaagactttccggaagaacccttcttccggagtgttccggaagaaccacttcttccggaagtg

SEQ ID NO: 6699 - DNA, 363 bp, Glycine max
  Peptide Sequence Number=SeqID_123477
atggggggctggaatgataagaggaacgatgacattgacgcgctgctcggggcggatgagaagcttgaggatttcgatgatgatcaggagaataaggagaacaaggaaggtgtggttgttgaggaggagatggatgaggcttttaattttaggctgaatgggattggtagcaatgttgctactggttggtggtttgtgaacgaaggcgaggctgtcctccttgctcaccatgatggttcttgtacttattatgatattaccaatagtgaggcaagaaataatgctcggatattgatctctggctcattcagcaaccggtatgaaaggatcacacggtgtgcaaaaggctgggagtccaaccaa

SEQ ID NO: 6700 - DNA, 1494 bp, Glycine max
  Peptide Sequence Number=SeqID_123478
atgactcggctatttcgatccaaatcttgcggactggtggagttcaacgctgctccgccgagtccacttttccatgatgtgaaaagtgaggacgaagacaatgaagaagatgaagatgaagatgaagaagaggaagaagaagaagaattggacagtgatgatgatgtttcgagcaacccggtttcaacggcgttgatgaatccagggtcaaaagtggagaacaaaggttggcgtggtgggcatggttgccaatctaaccagtttgcgatgttggatattttgttggctgcgttgaagaagtcgctggtgacttgcagtgtggagagagaggatatttcttcgttggatattagctggcccacagaggtgcgccatgtctcgcatgttacctttgataggttcaatggctttctcggtttgccctctgagctcgagcttgaggttcccaagagagtccccagtgccagtgctaaggtatttggagtttctgcaaagtcaatgcagtgctcttatgatgaaagggggaacagtgtcccaacgattctgctgatgatgcaaaagcgattgtattcagagggtggccttaaagcggaaggaatattccgaattaatgctgataatagccaagaagaatttgtgcgtgatcagctaaacagaggtctggtaccacttggaatcgacgttcattgtttatctggtttaataaaggcttggtttagagagcttccaacgggggtacttgattccctcacccccgaacaggtgatgcattgcaacacagaagaggattgcaccaatcttatgaagttgcttccttcaactgaagctgcattgcttgactgggcaatcaatttgatggcagatgttgttgagcgtgaacagttcaacaaaatgaatgctcgcaatgttgccatggtttttgcgcccaacatgacacagatggcggaccctttgactgcattgattcatgcagtgcaagtcatgaacttcctcaagacattgattctgaagacccttcgagaaagagatgaatcaattgccaaggcaagacagctgtcatcactcttagattctccctcttgcaaaggtgattcccatcctttggaagttaataacaaggaggaatcttgtgaagaggaaactgaagagacctgtagcacaaagccacctgtgaaaagcaagttctcaaggacttctaccttgggaagaatagaatggtgtattgaagagaaactttggagatctgaggaaaagggaaatggagttggggaattggaatctgtttcggatagtagctcaccttcaaggtatgagaatggtccattagagaataggtatagaggtatatatgacagtgaacattgggtgaaattgagaaatggagtgcgcaggctgtgcagacaccctgtatttcaattgagcaagcccactaagaagcgtgcaagtcttggtattgtaaatactagggaaggaggtggagaggcttgggcctaa

SEQ ID NO: 6701 - DNA, 2571 bp, Glycine max
  Peptide Sequence Number=SeqID_123479
atggcctctgcatcctccttatcagtttctctagaatgcgtgaacgcctgcaagccgtggagaggggatggaaatgtaagattcgactgtagtcttctatcgtgcgcgtggaaagctccgagggctctcaccgggttccttgccagcactgctcatcctcatcagtgttcgaacttgtcgaatgggcgtaatggacgaaggaaccggtataattttgggtgtgaagcctttagtgtaggtggttcatgccatgatgaaccacttgatatcatactttttgaaggatactctagatctatctcgtgccaaaatgctcctaggagatggcaattgtgttgttctttggcctcgaacactgtcactgagttttccgcggaaagtttgtgggaggatcttaaacctgctatctcgtacctgtcacctaaagaactggagttagtctacaatgcttttatgttggcgtttaaagctcatgatggtcagaaaagacgcagtggtgaacccttcatcattcacccagtcgaggttgcacgcattctgggagaacttgaacttgactgggagtcgattgctgctggattacttcatgatacagttgaggatacaaatgttgttacttttgagaggatagaggaggaatttggtgctactgtgcggcacattgtggaaggagagaccaaggtgtcgaaactgggaaagttgaagtataagaatgaaaatgattccgtgcaagatgtgaaagcagaagatcttcggcaaatgtttctggctatgacagaggaggttcgtgttataattgtcaaattggcagataggttgcataacatgcgcacactatcacatatgcctccacataaacagactagcattgcgatggagacattgcagtcagaactagaaaatctatcgtttatgtacacaaatgcggaagactatgctaaggtgaagagaagagtagcagagctatacaaagaacatgagaaagaacttctggaggcaaacaaaatgttgatgaagaaaatccaagatgatcaattcttagaccttctaacggttaaaacgaaagttcgtgctgtatgtaaagagccttacagtatctataaagctgttctcaaatcaaaaagttcaatcagtgagattaaccaaattgcacagcttcgcattattattaaaccaaagcaatgcattggggttgggcctttatgcaacccacagcagatttgctatcatgttctggggttgatccatggaatctggacccctattcctagatctgtgaaggattatattgcaacccctaaaccaaatggctaccagagtcttcagaccaccgtgattccatttttgtatgagagcatgtttaggctagaagtccagattagaacagaagaaatggatttgatagctgagaggggcattgctgctcattatagtgggagagaatttgtcacagggttggttggaagtgcaacaccaagtagtaaaagctcaagagggaagacagtttgtctaaacaacgccaatattgccctgagaattggctggctcaatgcaattagagagtggcaagaagagtttgttggcaacatgagttctagggaatttgtcgacaccattacaagagatctgctgggcagtcgtgtctttgtgttcacaccaaggggagagattaagaatcttcctcagggtgctactgtcattgactatgcttatatgatacacactgaaataggcaacaagatggtagctgcaaaggtcaatggcaatcttgtttctcctgctcatgtacttgcaaatgcagaagttgtagagataatcacatataatgcactttccagcaaatcagcctttcagaggcataagcagtggttgcaacatgctaaaacacgtagtgcaagacacaaaataatgaagtttctgagggagcaagctgcacgctctgctgctgatatcactacggaagcagtcaatgactttgtcactgattctgacggggatagtgaatctgaagaactgtcaaaaggttccagtggctctaaatatacgtggggtaaaatgtttgtgaatggagccgaaatatcaactttaggaagaagtgagaccgtcctccaaagtaacaatggaagtgcttggatccccaaggtcaatggaaaacataataagcatgtgcagcatgaaagtttcaacggcaaaggggagatgttactgcagggaaaccttgtcgcaaagataattcaagttaacattccaagatataaggaagtcctgccaggtttagaaagttggcaagcccagaaaattgcttcttggcacaatatggaagggcactccatccaatggttatctgtagtatgtatagaccgaaaaggcatgatggctgaggtcactgcagcaatggccactgcaggcatagccatatgttcttgtgtggctgagattgatggaggaaggggaatggctgttatggtcagtgcttgctctaaagtggatctgatactgggtgttttgggatggtctaccggttgcagctggccaagcttgatggaagaccgtggagttctcgaatgctag

SEQ ID NO: 6702 - DNA, 225 bp, Glycine max
  Peptide Sequence Number=SeqID_123480
cttgggaggattgatggggacccggtgttgagagaaacgaggatatgggctacgtgggaatacgtgagctcagatggaggtgggcaacaggggatgagtggtacctggagatatgtcgcgggggtcaggagaccttggggacgtcaggcgagctcctggcagtcaacagataaaaggaacaaagaccacaaagcaaggaggcttgtggtggctggccagctgtga

SEQ ID NO: 6703 - DNA, 759 bp, Glycine max
  Peptide Sequence Number=SeqID_123481
atgacaaggttgagcatttgtcacaattatttgacttctaactggaaaaggagagtagttggtactaggatgtggcttggttgccacgtcagcatgccccccttattttgcagctacaaaagggctctccctctctggtttttttcactcaccaaaaagacgaaagaagcaagcatgtgtggcggagcaatcatcgcagatttcatacctcggcagcgtccccgcaccctcacagcctccgaactctggcccaagcgcagcgaacctcaacctcaacctcctcctcctccagttaagaggcagaggaaaaacctctacagagggatcaggcagcggccctggggcaaatgggccgcggagattcgcgatccacgtaaaggagttcgtgtctggcttggcaccttcaacaccgccgaagaagccgccagagcctacgacaaagaagcccgaaaaatccgcggcaagaaagccaaagtcaatttccccaacgaggacgaccctctgccgcaatacggatcttgcaagagcctcaacttggagttcggttacgatctcaaccaaacagggcttttcccttcttctaacgctgatgagaattgcgggtcccacgtggcttactccgttacggaagccaacaacaaagtagagaagctttccgaggagcttatggcgtacgagaatttaatgaggttttatcagattccggaaaacgtcgttggggatttgtgggcctttcctgacacctctccacctctctga

SEQ ID NO: 6704 - DNA, 2091 bp, Glycine max
  Peptide Sequence Number=SeqID_123482
atggggtccaccgataaagaattggaagagcagcttctcgacgccggtaacaagctcctcctagatcctccctcctcagcggaggagctcctcccactcctcgacgtaatgacgccttttctccctttttcttcttcccttcaaattaagctaagggttggagtggtgccaagtgccaacagtgatgcgtctgacggatgttgggcttggttccagtggtgttgctgtggttatgacagaggttacaccagcttcaccgtacaagtagagtgttgcctatcgagggttgagcagtcccctattgactctatgcaaaatgcactctctccatcattgaaagcattgattgcggacaaacttttaagccactcagatgatgatgtcaaagttgcagttgcctcttgcatcagtgaaataacaagaatcactgcacctgaagctccttatgatgatgctcaaatgaaggatgtctttcaattaattgtatcttcatttgaaaatctacatgataagttaagccaatcatatgcaaagaggacctcaattcttgaaactgttgcgaaagttagatcatgtgtggtaatgctggaccttgaatgtgataccctgattttggagatgtttcagcatttctttaaaaatataagggaacatcatccagaaaatgttttttcatccatggaaacaattatgacccttgttctagaggaaagtgaagatatatccttagacctgctgtctccactcctgaccagcattaagaaagacaataaggaagtttttccaatagcccagaaattgggggagagggtcattgaaagctgtgcaaccaagcttaaaccctacttggttcaagcagtgaaatccttgggtatatctgtggatgattatagttcagtacttgcttcaatatgccaagatacatctgatgacttggagaaaaatgatacatgtgttactagtgagcatgtggaagataagagtgattcagcaaaacaatcactagaggagtcaacacatgtggttaacaaggattcaagtgaagttacaccctctcaaccagaaaatactgatgtaaagatatctccaaagttggtcatgagcaatggtgttgtagaagataatgttttagctgactccaagtccattaaaaaacaagaggatgctgattgttctagtcactctgaaggtttgaatttatctggtcatgaggtgcataatgatctggacactgaaaaagttgacactagtaaacaaaagccagagcaagctaccaagaggcagcgaaagaaatcaagctcttcaactaaatcagcaaaaccttccaaaggtcaagttgctgctaacgagaaggaaactgagaaaatgcttgactttgaaagcaacagcaagaaagttcccagttcctctcacgaggaccattcagctgaagcagcaggacctccagagaatgacaatggcattgatgctaagatttcatcaccaaaggcatgcaatgatgaatctgaagttgttgcttctccaccaagtgagagcttctctgatgaaaatcattcgaagaaaattgggcgaacaaaaaagaaagatggggatgctgagggtgtttcaaaggtgtctgaaggagctagtgattcagaagccaaacctgtcaggcgatccgtgaaaagggcacttggtcagaagtctgatgcgaaaaaaactaatgtggtggattcagtaaaaaaaggaagtgggacagcaaatgatgcagatgctaaaaagcacccagccaagaaattagatgaaaacaaaaaggatcgtgatggatcatcttcaagacaaatggaggacaagaaaaagggcaggtgggggaaggctaactctgaagcaaatgtagtaaagtcatctgctatggatgtggacaaggaaatggtttcttctctgaggtctggtacaaagtcaactaaaaatgaaaattcagaggagactcccaagacaaatgtgaaaaggaaacgcagttcaggaaaagaaaatgaatctaatgcgaaggaatatggtcaaaaccttgttggtttacgggtcaaagtttggtggcctgatgatcgtgagtaa

SEQ ID NO: 6705 - DNA, 744 bp, Glycine max
  Peptide Sequence Number=SeqID_123483
gttttgtatgatgatggtgatgaagaaacattaaatcttgtgaaggaaaaatggaaggtcattgaagctgactcagatgcagatgaggaagaacgaagtgattgtgcagatcttgatgtttccactgatatgccactgaagaagaaagggaaaacaagtgctggtgaatcaaccaagcaaggaaagatggatgtttcttccaaaagtggagcagcagcatccaatagatcaaagggtgcatccacaaagtctagccagaagtccaaggatggcaacaaatccaaagattccaaggctaatagcaaatctgaggatggagttaatagaaaatctaaggacagcactcctaaaaatggtagcagtaaatctattgttgctgctaaaaaaatgagtaataaatccaaaaatactgatacttccaagacaagtgaatcaaaggatgatggcagtatcaaacaaaaaccttctgccaagtttaagcatgaaactccaaaaagtggaaaatccaagcaagaaaccccaaaggctgccatttccaaaggaaaacctgtcaaaagtggtggaaagactgatgttaatggtaccagcaaagcaagatctggtttattgaagagaaaagattccgagaatgagaactctgatgtttcagctggagagagagaagatgccaagggcaagagtgcaaattcatcaaaggcaaaaggaagtgagctgaagagtggaaagaagcgtcggaaaacctag

SEQ ID NO: 6706 - DNA, 2652 bp, Glycine max
  Peptide Sequence Number=SeqID_123484
atggcaatggcgtctaccgatacagagttggaagaacaactcctggaagccggtaacaagctcctcctagatcctctctcctcggtggaggacctcctcccactcctcgaccaagtagagagttgcctatcaagggttgaacagtcacctaatgactctatgcgaaatgcactctctccatcattgaaagcattgattacagacaaacttttaaggcactcagatgacgatgtcaaaattgcagttgcctcttgcgtcagtgaaataacaagaatcactgcacctgaagctccttatgatgatgatcaaatgaaggtggtctttcaattaatagtatcttcatttgaaaatctacatgataagttaagccaatcatatgcaaagaggacctcaattcttgaaactgttgcgaaagtcagatcatgtgtggtaatgctggaccttgaatgtgatgccctgattttggagatgtttcagcatttctttaaagctataagggaacatcatccagaaaatgttttttcatccatggaaacaattatgacccttgttctagaggaaagtgaagatatatccttagacctgctgtctccactcctggccagcattaagaaagacaatgaggaagtttttccaatagtccagaagttgggggagagggtcattgaatgctgtgcaaccaaacttaaaccctacttggttcaagcagtgaaatccttggctatatctgtggatgattatagtgcagtacttgcttcaatatgccaagatacgtctgatgacttggagaaaaatgatacatgtgttactagtgagcttgtggaagataagagtgattcagcaaaacagtcaccagaggagtcaacacatgtggttgaaaaggattcaagggaagttgcgccctctcaaccagaaaatactggtgtgagtatatctccaaagttggtaatgagcaatggtgttgcatgtgttggagaagataatgctttagctgattccaagtccattaaaaaacaagaggacgctgatttttctaatcactctgaaggtttgaatatatctggtgaggaggtgcataataatttggacactgaaaaagttgacaatagtaaacaaaagccaaaacaagctaccaagagacgacgaaagaaatcaagctcttcaactaaatcagcaaaaccttccaagggtcatgttgctgctaacgaaagggaaactgagaaaatgcttgaccatgaaagcaacaacaagaaagttcccagtccccctcacgaggatcattctgttgaagcagcaggacctccagagaatgacaatgaaatcgatgctaagatttcatcaccaaaggcttgcaacggtgaatctgaagttgttgcttctccaccaagggagagcctctatgatgaaaatctttcaaggaaacatggacgaacaaaaaagaaagatggacctataaaagaaggggctgctgaggatgcttcaaaggtgtccggaggagctagtgattcagatgccaaacctgtcaggcagtcagtgaaaaaggcacttggtctgaagtctgatgtgaaaaaagctagtgtggtggattctgttaaaaaaggaagtggggcagttaatgatgcagatgctaaaaagcactcagccaagaaattagatgaaaacaaaaagggtagtggtggatcctcttcaaggcagatggaggacaagaaaaagggaaggcgggggaaagctaactctgaaacagatgtagcaaagtcatctgctatggagttggacaaggaaatggtttcttctccgaggtctggaacaaagtcaactaaaaatgaaaattcagaggatactcccaagacaaatgagtctagtacaaaggaatatggtcaaaaccttgttggtttacaagtcaaagtttggtggcctgatgatcatgagttttacaaaggtgttattgtatcttttgattctgccaaaaagaagcacaaggtcttgtatgatgatggtgatgaagaaacattaaatcttgtgaaggagaaatggaaggtcattgaagctgactcagatgcagataaggaggaacgaagtgatcacacagatcttgatgcttccactgatatgccaccgaagaagaaagggaaaagaagtgctggtgagtcaaccaaacaaggaaagatggatgcttcttccagaagcggtggagcagcaacatccagtagatcaaagggtgcatccacgaagtctagccagaagtccgaagatggcaacaaatccatagattccaagactattagcaaacctgaggatgaagttggtagaaaatctaaggccagcgctcctaaaagtggtagcaataaatctattgtcaccgataaaaaaatgagtaataaatccaaaaacattgatacttccaagacaagtgaatcaaaggatgatgacactagcacgccaaaaccctctgcgaagtctaagcaagaaactccaaaaagtggaaaatccaagcaagaaaccctgaagactctcatttcgaaaagaaaacctttcaaaagtggtggaaagactgatgttaatggagaggtagaaaatgccaagggcaagacttccaagttcatcaaaggcacaagtgagctcaagagtggaaagaagcgttggagaagctaa

SEQ ID NO: 6707 - DNA, 213 bp, Glycine max
  Peptide Sequence Number=SeqID_123485
atggctgggcaactcgccactacgagtggcgttttctgtgccacatggctgtgcccagcaaactcgtcactaggagtgacagtttgctatattatccatgcaaagtacgttaaaaagagtccacatgacctttatttcttcaaccataccttcttaagcatgccaacgttatcgaggtcggaagagatatatacagtttcagtggttagttga

SEQ ID NO: 6708 - DNA, 789 bp, Glycine max
  Peptide Sequence Number=SeqID_123486
atgaagatgagcatatgtgtgaatggagaatcccaagtccctccaggcttccggtttcatccaaccgaagaggaactgttgcagtactatttgaggaagaaggtgtccaacgagaagatcgacctcgacgtgattcgcgatgttgatctcaacagactcgaaccatgggacatacaagagatgtgcaaaataggaagcagcccacaaaacgattggtacttgttcagccacaaggacaagaagtaccccacgggaagccgcaccaaccgcgccatcattgttgggttctggaaggccacggggcgcgacaaggtcatatatagcaacgggaagataattggaatgagaaaaacattggttttctacaaagggcgtgcccccaatggccaaaagtctgattggatcatgcatgaatacaggctagacgacattaataacaccaatgagatggaacacgggtgggtggtctgtagagttttcaagaagaagaatgtccctctcaaaaccctagatagcccaaaatccatgaccatgaatatgtttacagaaagcgactactgtggaggcttcactaactgggaatcccttgatcagcttgtggcatcacaactgaatggacaaactgagacatattgcagtgatttgcaattccccgcatttctatcatcctcatacattgctacaacaacacacattgctcccacaatacaggattaccccagctacgacattgacctgtggaaccactgtgcttcgcgcgtgtccaacactccaaatgtaacactctaa

SEQ ID NO: 6709 - DNA, 297 bp, Glycine max
  Peptide Sequence Number=SeqID_123487
gggagaagcttgccgcccagctcgcccaggcgagcaaggttgcttcctccagaagcaacagccttatggaggaatcttctggagggcccaagtgggcctgctttcgaagaagttacggaaactcacggattgcgcaaaaacacctcttttcgacttccgccacattacggaatttcacggatcgcgcaagcctgcttccttttgatttctgagacgtctcgggacttcatttattgtgcaacaaaggatgccaagtatctcaaagcggctaaccaaaggttgcatgtcatcaagtaa

SEQ ID NO: 6710 - DNA, 182 bp, Glycine max
  Peptide Sequence Number=SeqID_123488
aagaaaaaagaaggagtagagacgagagtcgtcatcacgaaaagggcaggacggacgaaatcagtgtcctatctttgctttcctcttatctccgatgagagtcccgagacgtctcagaaatcaaaaggaagcaggcttgcgcgatccgtgaaattccgtaatgtggcggaagtcgaaaagag

SEQ ID NO: 6711 - DNA, 123 bp, Glycine max
  Peptide Sequence Number=SeqID_123489
atggaggaaaatacatctccaattgacaaaggacaatggcagcctcattctccaaatcatcctattgttgagggcaagatcccgcgaatcgcaacaggcaatagttgttgcattaagacatga

SEQ ID NO: 6712 - DNA, 501 bp, Glycine max
  Peptide Sequence Number=SeqID_123490
atgtcgccacacgggggcgacatggatgggggtgaaaaaaggaaagagagggatggggtttctcttgcttttggcatagcgggccccggcgggaggcccgcacgacgggctattagctcagtggtagagcgcgcccctgataattgcgtcgttgtgcctggactgaggatagatggggcgattcaggtgagatccaatgtagatccaactttctcttcactcgtgggatccgggcgatccgggggggaccaccacggctcctctcttctcgagaattcatacatcccttatcagtatatggacagttatctctcgagcacaggtttgaaaaaggatcttagagtgtctagggttgtgccaggagggtctcttaatgccttcctttttcttctcatcggagttatttcacaaagacttgccatggtaaagaagaagggggaacaagcacacttggagagcgcagtacaacggatagttgtatgctgcgttcgggaaggatga

SEQ ID NO: 6713 - DNA, 270 bp, Glycine max
  Peptide Sequence Number=SeqID_123491
atgaattgtgttttcgttcatgtgtcctccaccttcgagtttggagctatgcgtagtgattgcttagtgcaattctccattctcaccctttttcgaagccccatgaattgtgatttcgttcatgtgtcctccaccttcgagtttggagctatgcgtagtgattgcttagtgccattctccattctcaatcatttcggagccccattaattgcattttcgttcatgtgtcctccaccttcgagtttggagctatgcgtagtgattgcttag

SEQ ID NO: 6714 - DNA, 295 bp, Glycine max
  Peptide Sequence Number=SeqID_123492
atgggagaacgcttagaggatatgatttgtgaccttggacaagagtcttttcagcaagcacatgcccctatgtatgaaggattgcaaagtgattcaaagaagcctttgtatacggggtgcaagaattccttaacgttgttgttggcagtgttaagtctagttaatgtcaaggccatatatgggtggagtgacaaaagctttagttcactgcttcaagtagtgcacgatctgcttccagaggaaaacatgttgcctaaaagttactatcaggcaaaaaagatactatgttcaatgg

SEQ ID NO: 6715 - DNA, 312 bp, Glycine max
  Peptide Sequence Number=SeqID_123493
atgagaaagtggacgttggggaaggagaaaggcacagtgaaagtggtcactgttactgtgtacacaataacattcgaaaaattggacgaaggaagtgtgaatggtcggaaacaagtgtttagcatagtgaaagtgaaaacactagtcgaagatgctgaagttgacacatcgtttctaattgttcgtccaatggggcaaaaggaagccaaaaggaagagcaaggggaagggagtgggaacatctatcaatcctgtggacctgaagggtgtggaggaagcaatgagggaaaaaaatttctcaatgccaaactag

SEQ ID NO: 6716 - DNA, 1668 bp, Glycine max
  Peptide Sequence Number=SeqID_123494
atggttactaaagttcatgcaggggtggaaatggcaatggctggtcatgagagtggaagtactgggaattggaggaaaaaagtggtttttataggtgaccaactgaggaggtttcctagtttggcttggaaaaatgtttggaagatggggcgtgatgatccaagaagggtcatccatgcattcaaagtaggtttctctctcactcttgtgtctttgctctatctcttggacccaagcttccaagggataggagagaatgttatgtgggctgttatgactgtcgtcgttgtctttgagtttaccgcagaaacacctagtatcatggcctcaatttctaacattcttttggtcgcaggggcaactttatgcaaagggctgaacagaggattggggacagtgattgcaggagcactggcattttctgttaaatatgttgcgaatggatttgacaatggatctgaccgcgtatttcatgctcttttcattggaaccaccgtttgtataataggtgctgcaaccagttatatgaggttcttcccctacataaaaaagaattatgattatggggtccttatatttctcttgaccttcaacttgataactgtttcgagttaccggaccgaaaatctcttcaagatgatataccagcgcttctacaccatagccataggctgtgccatatgccttctgatgagtctattggtatttccaaattggtcaggggaagctctccataattcaacagctttcaagcttgaaggcctagctaaatctatagaagcttgtgtcaacgaatactttaacggagaaatggaagcctctaatgataaaatatcatctgaggatatatacaaaggttacaaggctgttttggattcaaaaaccactgatgaaacactggcattacatgcaagttgggagccaagacattcatgtcacaaatttccatggcagcagtatgtaaaagttggaactgttcttcgtcaatttgggtatacggtggtagccctacatggctgtttgaaaacagaaattcagacaccgccatctgttcgagtcttgttcaagaacccttgcacaaggcttgcatcagaagtatcaaaagtgctaatagaacttgccaacagcataaggaaccatcgtcgttgctatcaagaaatcctctcaaacggtcttcaagaagccctgcaagacctcaacaccgccataaagtctcagcctcgactcttcgtaggcacctcaagtgacagccaagactccgacatgttggccatagctgcagcccacgcagcggggctaacaaaccaaggaaatggctcactatcaagtgctaaaattgactctccaaccttgcaagagtgcaaagcacaatgcattgaacaacaacaacaaccaaaggaagtagcagaaagaaaggtgttgagacaccaactgagtataatcgcgatcactagcctcgagttctcggaagccttgccttttgctgcatttgcatctttgcttgtggagacagtggcaaaattagaccttgttatagaagaagttgaagaattggggagattagcacgcttcaaagagtacagactcgatgataagattattgtcacttgtgagacaccacgagttgatatattagaagaccatatacctactcgtggagcagaataa

SEQ ID NO: 6717 - DNA, 174 bp, Glycine max
  Peptide Sequence Number=SeqID_123495
atggagcttgcaaccaagtacatgacaatcagaaagttgaagcaggagaagaagctagtaggtggtggtgcaccagtagatgatttggaggttcctccaattgttgatgatgatgatgaaggtagaggaaatgccattaaagaggacgaagatcatctggaggatgacagatga

SEQ ID NO: 6718 - DNA, 312 bp, Glycine max
  Peptide Sequence Number=SeqID_123496
atggagctacatcaagttgtgatcaactcatatggattgtggcaaagccaggatatctcaagcttcagtgctaggatttcgacaacggccatggtggatattaccacggtcataatgagcttaattaaggatactatctttaggagtctaattagagtaattattgtcgcaacctacccttcggtggaagggcgacgcgtgactcgcgggtgcgtcttccaagaaaggaatacgcgcggagtcgccaccaacgtttatttgaggaaaacgtcggaaaaaccggaaaagacgtggtctacaaattttaaatga

SEQ ID NO: 6719 - DNA, 207 bp, Glycine max
  Peptide Sequence Number=SeqID_123497
atgtcacgaaactttacggattacgcaaccatcccttcttcggcttctggaaggttacgaaactttacggattacgcaataatgtttcctttcgactcccgacatgtcgtgaaacttcacggattacttaacgatgggtgtcaagttcctcgaagtggtcaagcgaaggttgcatgccatcaaacaatgatccccggacaaatttag

SEQ ID NO: 6720 - DNA, 507 bp, Glycine max
  Peptide Sequence Number=SeqID_123498
atggattctaataaaatataccatcatggacgggatcttacttatgctgaatatgtgtccaaattcatttatgttgcacacaaaagatgctggcaaccaagaaaacaaggaaatacaatagggaggcttatatgggtacccccttcaactagagagttgttctacatgaggatgatgctttcctccgttaaagggtcacaatcttacaaagatatcagaacaatagacaatgtcgtctaccatacatttagagaagcatgctttgcaaaaggtttcctagtaagtgatcaagaatttgttggtgctttaggagaggctaacacttggggaactccacacttccttagaaagttatttgtcaagctgctatttatgaataccatggatagaccagaatatgtgtgggaacaaacttggcaatggatggcagatgatattgtatttaatcatagaagacaaggcattcaactcactaacaaagaaacaatgcatctttgtttgacttaa

SEQ ID NO: 6721 - DNA, 558 bp, Glycine max
  Peptide Sequence Number=SeqID_123499
atggctaagtttgaccctgaggtagtcctggagttttatgctaattcttggcccacagaggagggagtgcgagacatgtatgccctcagccagttcttgggtgacccgctagtgttggaggaaggccagcagtgcgagttcagccagaggaggaacagggccgacgggttcgacgaggaggccattgcccagctgttatgcacaccggggcaggatttcgcccggaccgctgtagggaggcgggtgcggatcatgcgcaccagcatgaccaccttgacccagacgtggatgacattgctgctcaacaatgtcttgcctagcgatcataactacgatctccctctgccgaagtgccagttggtgtatgccatcctgacacggatgagcgtccacgtagcccaggtgattgctgatgccatctatttgtttgtaggtatgccacccaccaggcaccctctagacccagataagtctaacagggccttaggatttccggcattgatcacaggcctctgccagtcgttcggaattcttgtcacccctactaaggtgatctga

SEQ ID NO: 6722 - DNA, 402 bp, Glycine max
  Peptide Sequence Number=SeqID_123500
atgtcacgttggcacgctaagcgcagttgtgcgctaagcgtgccatacgattttcagtttttaaaaatcaaaggtagaggcactttgggtgttacctttgcacccaaacctctacaccttcctaaccttcaacacttgtgtattctctgcttcttgtgtactgtttctctgcatcttcattgcatcatatcaagaacaatccaagttaaggttattagttttagggttagtcaatgtaggattttaggggtgaagacccctgtggttctttctggaaatcgcgatgaacgcgctaagcgtgcctgtgcgcttagcctgttcatcgcagctgtcaaaattttggatttccagatgaacgcactaagcggaccatgtcgcgctatgcacattcatccctgctga

SEQ ID NO: 6723 - DNA, 237 bp, Glycine max
  Peptide Sequence Number=SeqID_123501
atggatgccgtgacaaaatgcgcttggctcaggaaagctcggcttagcgtgcgtctatcaacaaaaaatatgattaagttacatgggcttagcgattcagcctcgcttagtcataggcatctcagcaagaggatgagtgttcatcctccaaagatgaaatcacttagcgtggtaggcgcgcatagtgagttcttcagagaacgcctatattcaatgagtactgatgaactcgcttag

SEQ ID NO: 6724 - DNA, 444 bp, Glycine max
  Peptide Sequence Number=SeqID_123502
atgggagttcctaacaattgttcttttgatacactcaagcgtagaatgcacaacacccttcaactaaccaacgatcaattactggatgaaatctactaccaacaaccattcatagatgcagaattattatgtaccattattagaacaccggatgctatactcaacctgcttcaatcaaccatcactcctactcatgatgcaattatgtattacaacgggaagtggaacataccacgtcaaggcgagtttttgggttactcctttgctggaactaatctaataataagatttggcattcctccaggatgtggcatgaagaaactcaaggatttaatcaagcaagtcgcacctataggggtttcccctaatggaattcacggatcacaattggttaggcgattgttctttcgacaatcagtcattctaagtattccgaaaatttga

SEQ ID NO: 6725 - DNA, 330 bp, Glycine max
  Peptide Sequence Number=SeqID_123503
atgatgttgtcaagaggatggtgtcgcaacctacccttcggtgggagggcgacacaagactcaccggtgcgtcttccaaggaaggaaaacacgtggaatcgccaccaacgtttatttgaggaaaacattaggaaaaaccaaaagtggcctatgaattttgagaataaaaggttcgggagtcatttacgtgcgcggaagggtcgacaagagcgaggctcttgctcctacgtaccctcaattgcaatgaggaactcagacctacgtagttctttgaaaagcgagaaagttatgcggagtgttgattttagacttctaaacgattcattttaa

SEQ ID NO: 6726 - DNA, 138 bp, Glycine max
  Peptide Sequence Number=SeqID_123504
atgctgagaggaacgaggataagggctacgcaggagtgcgtgagctcagttgaaagagtggtacctggagatatgtcgcgggggtcaggagaccttggggacgtcaggtggggtgctgttgcccaaaaccatgcttga

SEQ ID NO: 6727 - DNA, 436 bp, Glycine max
  Peptide Sequence Number=SeqID_123505
atggggaagaacaagggtcgtcaatcgcactcagctgcaaagcaaattatggtgaagggtactacctcaggttcaggtaaatcccaaatatctgctacttctggtctggctggttgcttggatgttgtccaagcaaatcagaatgcttatactgcttcacaggataatcttgtaggcaaggtgcttgtaaaaaaggcagggacaagttctgcaaaaactgatgatgtcgcacaccaagtgtttgataatttgtcggaatgcagtgctgaatctgaatcttccccagaggtttcttgcaccttaggggacaatgattcaaccactaataatgattcatctcactcgtgtggctctaagtcatcaccgcagctagacgacaataaggctcccactccttgggtcaatctattcaaagataacagaagtccttccaaag

SEQ ID NO: 6728 - DNA, 756 bp, Glycine max
  Peptide Sequence Number=SeqID_123506
catgaggcgcgtgggcacatggcatccgatcttgctcggtatcttttctcggccagttttgctcacttatcgggatactgcccgacgctggatgtcttccctcccaagctgcttcctgatcacatcaatgcgcatgtcgatcgggaatccgaagtgatcccattcaaggaccggttccgcgtgcagtgcaggaatgaaccgtccaccacggtggtggcccacattgcgaaggatgggcactactacatccactacgatccctcgcaatgcagaagtcttacggtcagggaagcagcacggctccagacgtttcccgacaactacctcttcgcgggcaaccgcacggagcagtacacccaggtcggcaatgcggtgcctccgttgcttgcccacaagctagccaagaccgttcgtagccttttgaacgagatgaataagaggaggcgaaggcagactggttacatcttaaagaagatgccggcgggaaacatcctcgccgctatgcagccattcctcaaccacctgcgcagtctcctcgcgcgagtgcttcaaggcacactcccatacgaccgccatacgccagccgagcgcatgaatcatctccgcatggcgcgtgtcgcgagcgacatttccctggaatttctgcagccagaaatcttcattggtactgggagtggttgtatagcggcacccttcatgtcggtgccagaagcacccatggacgaataccactgctttgtgcttcgggaacaccag

SEQ ID NO: 6729 - DNA, 1254 bp, Glycine max
  Peptide Sequence Number=SeqID_123507
atggccgagacgccgacgcgcgagcaggtggaggagaaggcgatagagatcgccacgatcttcggctatacgggcgatctccgcaatatcgtcaccgaggcgatgatatcggttgacacgcgcatgggtgccggtgtttcgctggtggatgtcactgcgaagcatgatgatcagtgggtccacaagcgtgatgatgtcgcttggacatatgcggaatcctatggaaactttcttctcaaggaaggttggccgccgcagatggtccagtcgctgagcgatgtcacgacccgcattcttggccacctgcaggatccgttgagcgagggcacaacctggaaccgtcgcggccttgtcatcggtcatgtgcagtcgggcaagacggccaactataccggcctgatagcacgcgccgccgacgccggctataagttcatcatcgtcgtcgccggcattcacaacaatctgcgcaagcagacgcagcagcgcatcgacgaggccttcatcggccggtccagcgatcccgaggatcgtcgcaacatcggcgtcggcctcgcgccgggctatccgcatccggccaccctcaccaacatcaacgaggacttcaacaagaacacggcggaaaagagcggctggaagatcaacgacttcagtaagccgatcattctggtcatcaagaagaatgtgacgacgctcacggctcttcacaaatggctgaaggagctgaacgccgagggcgatggccggatttccgacgtgccgatgctgctgattgacgacgaggccgacaacgcgtcgatcaacacgaacaaggaggatctggatccgacacgaacgaatgcgatgatccggcgcatcctcgggctgttcgcaaaatcgtgctatgtcggctacacggcgaccccattcgccaacatctttatcaaccccgacgcctatggcgatgatgtgcgtgaggagctgttccctcgcgacttcatctattgcctggacgcgccaacgacgtacttcggtgccgagaaggtgttcctcgacgaggcgaccagtcaatcgatcgtgaggccgatcgacgattgtgagaatctcattccgtacgcccacaagcgtgacgatcctgtccccgagttgccccccagcctctatcgcgcactcgacgaattcatcgtcgcccgcgccatccggaacctgcgtgggcagacaggcaagcattgctcaatgatggtcaatgtgtcgcgcttcgtgcccgttcagaaggcc

SEQ ID NO: 6730 - DNA, 219 bp, Glycine max
  Peptide Sequence Number=SeqID_123508
atggagatgttagaaaaggctttacaactaatgagggtaacgtatagacatggcaacggggcggggacgggtattgtctccccattccacgatcccgactccccaacgtatacccgtacccatcttcgatattcgtcgggtatgggacggttagtgacatctccgtccccgatcccgaccccggttaaaatgttggataatccccgaacccgtatctga

SEQ ID NO: 6731 - DNA, 837 bp, Glycine max
  Peptide Sequence Number=SeqID_123509
atgaagcaagcaactcttttctccttctcactcttcctactcctttcctccaccaccatggccatttcaccagcacctgcagcagcaccaaaaacacctcctaccccaaaggcaacagcaccatcaccaaaaccattagttcccacactacctcagtctccagactctcctgactcagtccccgacgacatcaccagaatcctgaaaaaggcaaaaatgttctcagtcctaatccgcctcctcaaaaccacagaaatcatgaacaacatcaactcacagctcataacagccaagagtggcggcataaccatccttgcaccagatgattctgccttttccaacctcaaagcaggcttcctcaactccctaaacgaaggccagaaaatcgaattagtgcagttccacatattgccagagtttgtgtcgagctcaaacttcgattccctaagcaaccctgtgcagacagtggctggtaaagaccctgcaaggcttccgctgaatgtgaatgcattaggtaacagtgtcaacatttcaactggggtagtcaatgccaccattctcggagtagtctactcggataacaagcttggcatttatcatgtggacaaggttcttcttcctctagatttctttctaaccaataaggctccagctttggctccaacaactcttgcaaaggctcctaaagctgccaaggaaaactcttctgacgatgatcaagaagaaacagaccaaaatcacaataaatccggggcagtgagtttggttagccttggtggagcaatgttgatgtcgattgggatagctttggtcacagtggcaaccatgtggagttga

SEQ ID NO: 6732 - DNA, 1704 bp, Glycine max
  Peptide Sequence Number=SeqID_123510
atggctgacttgtcttgttccatatccactatggaccgcatcgaagcagccatcgcgaaactcaccgttgcccaagacgccacggtcgccaaactagacgaaattcttcagaagctggcccttctcgaaaatcgttacaaaaaggtgcaaagcttcatggaagagtcgctaaactcgttttctagtcaaggaagggttagggaaaatcaaaccatggaggcggaagttcctggtgaagatggttccaaatatacactgggaagcgatgagaaaccaatgtttggacgaggctacgaatttagcatccacgaccacacagtgtctcatcgccacaggtccttcgaactcgaccattcagactcagaggatgctaatgctgtttcattcgaagtcatgaggaaaaaccccttttgggtgtacgacagagaagcacttcagctgttcagcaagttcaacaaaggtcgcttgcaactcgaacacattttattgggtaatgttgatgtcctgatggctgcacacttgggtgctgtttttatgccacaaggtctgaggcatttccttggtattgacacatttgaccctgaaggttacttaaaggacgctggtaagtggactgttcaacaagctgctgaattatcaattgttgctcccactattgaagcatcattggatgcaaggttcctaagtggcattggtgttattgtgactgatcaacctgtagacaagcagaagttgattgatgatgttaggaaggctcttcatgcagccaaaatctgcagttatgcacaggaaatgaatttgatccgtgcaaagagtattgaaaagggttgggatttgaagttgggtgaactggcccggatttggaaaaggggttgcgttattagagcaatattcttagacagaatcaagcaggcatatgaagaaaatcctaatttggcaaaccttcttgtggattcagagtttgcaaaggaaataattgatcaccaatctgcctggaggagagttgtttgccttgctatcaattctggtattagcactccaggtatgtctgttagtcttgcttattttgacaccatcttacttgcatcaaactatgatgatgcaatttgctatgttgagaccatgaatcttgatggagagacaaatctgaagctgaaacaagcacccgaagcaacttcaaaattgcaagaagactcgaactttcaaaatttcagggctatcatcaaatgtgaagacccaaatgctggggttgcttatggacgaggagttactgaagttgagagagctctgcctaggaggcatgaatcacatccaggccaagagttgaaaaagattagtggatcaaagtcatccattaaagaacccaatgccaatgtaatccagaacttcctacggttgctggttgtatgccatactgcaatgcctaaagttgatgaagaaattggtaaggtttcatatgaagttgaatcaccagatgaggcagcttttgtgattgtagccagggaacttggatttgaattttatgaaaggacacatacaactatttcactgcgtgaattagacatcatatcagaccagaaaatcaataagtcctacaaacttttgaatatattagagtttactagtgcaagaaagcggatgtctgtaattgtgaaagatgtggagggaaactattactacttagcaaaggggctgacagtgtaa

SEQ ID NO: 6733 - DNA, 906 bp, Glycine max
  Peptide Sequence Number=SeqID_123511
atggctccttctctgttcctgatccatattattaaattacatcttatagataacagttgcattgcagctgctttcggggtcctctgcagcctctctacattttcattccccttgtcgaactacatactacaaagatgtttaaaacagcacctgcagcagcaccaaaaaacacctcctaccccaaaggcaacagcaccatcaccaaaaccattagttcccacaatacctcagtctccagactctcctgactcggtccccgacgacatcaccagaatcctgaaaaaggccaaaatgttctcagtcctaatccgcctcctcaaaaccaccgaaatcatgaacaacatcaactcacagctcataacagccaagagtggcggcataaccatccttgcaccagatgattctgccttttccaacctcaaagcaggcttcctcaactccctaaacgaaggccagaaaatcgaacttgtgcagttccacatattgcccgagtttgtgtccagctcaaactttgattctctaagcaaccctgtgcagacagtggccggtaaagatcccgcaaggcttccattgaacgtgaatgcattaggaaacagtgtcaacatttcaaccggggtcgtcaatgccaccgttctcggggtagtatactcagataacaaacttgggatttatcacgtggacaaggtgcttcttcctctagatttctttataaccaataaggctccagcttcagctccatcaactcttgcaaagtctcccaaagctgctaaggataactcttctgaggacgatcaagaagaaacaaatcagcatcagaataaatctggggcagtgagtgtggttagcattggtggagcaacgttgatgtcgcttgcgatagctttggttgcaaccatgttgagttga

SEQ ID NO: 6734 - DNA, 312 bp, Glycine max
  Peptide Sequence Number=SeqID_123512
atggagatgttagaaaaggctttacaactaatgagggtaacctatagacatggcaatggggcggggacgggtattgtctccccagtccccgatcccgactcctcaacgtatacccgtatccgtcttcgatattcgtcgggtatgggacggctagtgacatctccgtccccgctcccgaccccggttaaaaagttgaataatccccgaacccgtatccgatcaactcggatattccccgtcaaaatcaggacgggtttgggcggatatccacgggtacggatttcattgtcatgcctagtaacgcagtgttaa

SEQ ID NO: 6735 - DNA, 2440 bp, Glycine max
  Peptide Sequence Number=SeqID_123513
atggctaaaaggatagaagatgatcagaaatttaaaaacaaaaaaagtaagaaaaggaaaaacttggaggcatcaaatcagttggagaatgatagaaagaaaagtaagaaagaaatgatctctaagacaagagaggaggttgaagctgattacaaggctgcatccttagccccagatgttatggagaagaaacagatgcaaactgaaactctctctgctgtctttgagacatactttcgcattttgaagaagacaatgcagtccataggtgccaggcctgaagcaaacgctggggcattatctgctgcagtggaacccctccctttgcttgctccatgtctgaaaggactggcaaaattttcacatttgattgaccttgatttcatgggtgatctaatgaaccatctgagagtacttgcttctggaagtagcaactcaggcaacacttctgacaagtgttctaaatgtttgaccgtatcagaacgtctccagtgttgcattgttgcttttaaagtgatgaggaacaatcttgatgccttgaatgttgatttacaggacttctttctccatctttacaatcttgtacttgaatacaggccaggaagagatcaaggagaggtgttggcagaagctttgaagataatgttgtgtgatgataagcaacatgacatgcagaagactgctgcatttataaaacgattagcaacgctttcactgtgtgttggatcagcggattccatggctgcccctctcaaaccgccccaacctgctcctaccataccagctgcggctcctcaacaaccattggttccctcattgccacagtcaccaagtgattccactcctgaaagtactccagcacttgacattgttggaatcctgaggaaggcaaagtcattcaacatcctaatccgtctcatgaaaaccacccaattgatcaaccaactcaatgcacagctcctcactactaaatcaggtggcattaccattcttgcacctgatgacagtgccttctcagaactcaaagcagggtttctcaactctctttctgatggacagaagctcgagctcttacagttccatgttctttcagactatgtctctagctccaactttgatacactgacgaaccctgttagaacactagcaggggctaaacctggaaaggtggaactgaatgtgataagttacggagggagtgtgaacatctcaacgggtgaggttaacaccaccatcactggcattatatataccgataagcatcttgctatttataaggtggggaaagtgcttcttcctacggacttctttgcagttaccaaggcacctgcaaaatcaccctctttggctccagaaccttcaagtgacaccgcaaaggcacctaaagctgataaggacgagtcatcatcttcagattcgtcacaggttaatcccactgaacagaactctggcaccgagaagatcgctgtgtacggaatgtggatgtcacttggacttggagcacttctcatgacaaaggctcctaaagcggataaggaaaattcactgtgcccagattcctcagaatcatctcagattaattctacaaatgagaattctggcactgtgaaaatctatgcgcatggcaagtttgtttcatttggtgatgttgtgcctcacagaccagtggaagatcttgcatttgctgtggcacgcttttaccagcgaggctttaactttaagctactcaagataggaaacgagatgatgccacaacttttttggttggttgcttggaaacagtaccatggagggactaattttggccgaactactggtggacctttcatttctactagttatgattttgatacaccaattgatgagtatggaattattagacagcctaagtgggaccaccttaaaaatgtgcataaggcaataaaactttgtgaaaaagcgctgctagctactggtccaacaattacatatcttggaccaaatatagaggctgcagtttacaacataggagctgtaagtgctgccttccttgccaacattgccaaaactgatgcaaaagtaagcttcaatggaaattcatatcacttgcccgcatggtatgtgagcaccttaccagactgcaagagtgtagtgcttaataccgcaaagattaactctgcatctatgatttcaagcttcacaactgaatctttaaaagaagaggttggctctttggatgattctggctcgggatggagttggattagtgaacctatcggtatttcaaaggctcattcattctcaaaattttggctactggagcaaataaatacaactgcagatagaagtgattacttgtggtattcctcaagcattgatcttgatgctgctactgaaactgtccttcacattgaatcccttggtcatgctcttcatgctttcgtaaatgggaagcttgcag

SEQ ID NO: 6736 - DNA, 1092 bp, Glycine max
  Peptide Sequence Number=SeqID_123514
atggggaagaagaaggatagaatcgttcttccaccggagcttccgccggagattcccgacgaggaagttgaagtttccgacgatgacctccaattcgtcaaggagaaccgcgcctatgcctccttgctttccaccttggacacccgttcaatcaccaaatataatgtgtccccatgtcctatctatgttttagactttagccgtgtctcagtgcatgttacacgggttgctgatgccaaagacgatgcattggagaaactttatgagaaacgcatgcaaaagaatgctctcaagaaagaaaaagaagaaactggtttgcaggttgatcgtgtagatgctcttccaatcaagacattggatggaaagatccattaccagacagctacgaagacagtattggaaaatgatccaagtgaagagagaactggagagaatgtcaaaaaagataaaggtatggtcaagctaactaaggctgaaaagagagccaagcttaagaaaatgagaaaagacgcaaaacaacaagggaaagaggtggctaaagcagaagtggaagagacaccacaagcagcagtattggctgaggtaaaggaagatcttacagctgaggaggcatttgaaagtaagaagcataaacttgcagaattggggaatgccttgcttacagatccagagtccaatattaaatttttgaaggagatggtgcagatatctaaagataatgatgataccattgttaaacttggacttctatccctcttggctgttttcaaagatattgtccctggctatcggatcaggcttcctactgaaaaggaactagatatgaaggtttcaaagactgttagaaagatgcgttattatgagtcaactcttctttctgcatacaaggcatacttgcaaaggctagtagccttagaaaagaagcctttatttcagcatgtagcagttcgttgtatttgttctttgcttgatgcaaatccccatttcaactttcgtgaaagtttgttggatgctactgtcagaaacataagctctcctaatgacgctataaggttatgttgtatgtttgctgttgaccatacttcattataa

SEQ ID NO: 6737 - DNA, 360 bp, Glycine max
  misc_feature (194)..(194): n is a, c, g, or t
  Peptide Sequence Number=SeqID_123515
atggtaatgccacctgatttagtagtgaggaactgtgcattgaattggtggatcaattgggtggttttcatgagacggattaggatgttgaatgactttgccttcctcaggattccaacaatgtcaagtgctggagtactttcaggagtggaatcacttggagccgcagctggtatggtaggagcaggttgggncggtttgagaggggctgaagctggtgataattgggctaaggtggttgtcgaatacataaatgaaattagcattactagtgagaaggacaagacagattgcttcttcaacatggtttttgttttgttaaaagaaggtttagatgacataggaaatgattgcaaatga

SEQ ID NO: 6738 - DNA, 1131 bp, Glycine max
  Peptide Sequence Number=SeqID_123516
atgacttatgtgaatgcggtgcacgtgtttagcactttctattccagtcctaaacacatggatactgatgccattggagatcttgttgacaagctcaaggctatccagaatgacaatgtagaagatcaagatcaagatgatgattttgatgatgatgacgacgacgacgaagaacatgaacctatcacacttggttttgttgataagcccaagaataattggtctcttcgccgtcaatatttcccaagcaaagctggaggagtcccggcttggcttgaccctctgaatataccatcagggggatcatttgtgtgtgacaattgtggagaccctttacaattcttgcttcaggtttatgcaccaactgagaaggaaactacatttcaccgaatgttgtttgtttttatgtgtccctccatgaaatgtcttctcagggatcagcatgagcaatggaaacgccatccagagaagccatctaaaaggttttccgttgtcaattacctcgcgctaatccattttactcacctgaatgccctcagtataataaaagccacaaacctgctggcagtggagaatctctgcttactttcagccgctctttgtgattggtgcggcacctggaaaggagacaagctttgtagtggttgcagacaagcacgatattgctctgagaaacaccaggttatgagttggcgcacagggcataaaattgcttgccagcagatgaaagtttcttcacctgtttctggacccaacaaaagtggaaccgcctccttggattctcataaagttggaagcaagaatctatggcctgaatttgagatcaccattgaagatgaaagtgactataagagagacatgtctgaggaaaataccttagctaattccttgatttcaaggaacaggactgatgacacaatgaattcacttttggataactttcagggtgatgatgacaaaaagagttgggcctccttccagcaatgcattgccaaggccccagaacaagtgttgaggtattataggaatactaatgctaagccaatatggcctgtttcaagtgatctgccatcaaatgctgatatccctagttgtagttactgcaccggacctatgtgttgtgaatttcag

SEQ ID NO: 6739 - DNA, 409 bp, Glycine max
  Peptide Sequence Number=SeqID_123517
atgaattcggttataacagtgttgtatttcaatggaagggtatatgaagataatgatggtgtaatatttgaaggaagtaaaaaagcgattcagattaaacgtggaattagtttcaatgccttgaagaaaaaaattggagataaggatgttgctggtggttcaatgtttcattctgcaaattcgcttacatcatgtggaaattatttatctaatgatgagacacaaccggcaacaaatatgagcaatttacatattgacgaagacgatgatgatgatgatgattatcttgtgtctaactcatacgttgaagagtctgtagacgaagatgacagtgttgacggtatatctgaaacagacgatgaagtcaccgacattcctcaaccagtaagaattgttcacccagcagaag

SEQ ID NO: 6740 - DNA, 355 bp, Glycine max
  Peptide Sequence Number=SeqID_123518
tccttttggatctggatcttgggagctgcattttggggcgattggtgatggagatgaattgggtggagacattggggagaggtttagtgtgacgatgaggggtgctgttttttacgtagcaacagtgaaattattcatgcaaatcgctagcatgaacagcgccacactcaggcacgcgacacgtggctgtgtcgcctctgccactggcgacagcactgatgtcgccacctgcaatggcgttttggccatgcagggtggagtcgctggtcaaaccagcgcttccccacgcgtatcaggtacagcttttgcaggtgaaccagcttttgcagtgcagctgaaaacgccaggtccttag

SEQ ID NO: 6741 - DNA, 181 bp, Glycine max
  Peptide Sequence Number=SeqID_123519
atgaccgccagcaaagggaaaacccattttgaagtggttcttcctttggaattgccattcaaggtcgctcccgactggcgatgtcccaccccacataaacaaagaggaaaagaccgaaacacccagcttcctctccaaaaacactaccctcgagaaaatcctattgatcctgatcgcgcat

SEQ ID NO: 6742 - DNA, 417 bp, Glycine max
  Peptide Sequence Number=SeqID_123520
atggaggccatgatgagcatgaggaaaatgatagaggtcaatgcggttgcagtcgccactataattgtcgccactgagggaggcgaagtgttaggaagttcgagcggcccccattttgtgcaaattcatagcaagcattccttcccaccatatggcttgcctcccaactatacaccacccaatgttgcacacactcccaatgagaatgtcaataactccactctcgtactcattgagagccaacaaccccaatctggtcaggcacaggtccctcaacccatgggggagacacatgaagtaccccgggaccacactctagctgactctgagccttgccccggatatgctattgaggggaaagcagttggtggtgtacccctaccaaacactttggggggccctcagtttcgcccataa

SEQ ID NO: 6743 - DNA, 767 bp, Glycine max
  Peptide Sequence Number=SeqID_123521
gaatatttccaaccagtttgaagaagaataaccaattgatatccttggaccttggggaaaataatctttcaggaactattccaacatgggttggagaaaagctcttaaatgtgaaaatcctccgccttcgatcaaacagatttggcggccacattacaaatgaaatatgtcagatgagtcttcttcaggttttagaccttgcacaaaacaatctgtatggcaatataccgagctgtttcagtaacttgagtgccatgacactaaagaaccaaattacagatcctcgtatctattctgaagcacattatggtacgtcttactcttcgatggaaagtatagttagtgtgctactatggctgaaaggaagagaagatgagtaccgaaacattctgggtttggtaacaagcattgatctgtcaagtaacaaattattaggagaaatacctagagaaatcacaagtctaaatggattgaattttttgaacttatcccacaaccaagtgattggtcatattccacaaggcattggtaatatgggatcattacagtccattgatttttctaggaatcaactttctggtgaaatccctccaaccattgcaaatttgagctttctgagcatgctagacttgtcttacaatcatttgaagggaaaaattccagcaggaactcaattgcaaacctttgatgcctccagcttcatctccaacaatctatgtggtccaccactgtccataaactgcagctccaatgtgaaaacccgatag

SEQ ID NO: 6744 - DNA, 150 bp, Glycine max
  Peptide Sequence Number=SeqID_123522
atggccattgagggctttacaatgagaaggggtgaaagaaagaaagggagcgcgctcagcgcgacaccccctcgctcagcgcgtgtagatcgcgcgcttagcgcgcatgttgcaggcttagcgcgtgcttctgttagatcgcgggcttag

SEQ ID NO: 6745 - DNA, 813 bp, Glycine max
  Peptide Sequence Number=SeqID_123523
atggatctttttcaaaacccatcttctctcaaatcaaacaaatttgaaacatccgtgtggattgcaaagcttgtgctcatgtccgtgggggttatctccactcttgttttgttgaaagtggcaatagtcccatacacattccaccttcttctctcaactcttcctcagttttgtgtctcagttagaagctggctaacactcccattcctctacatcattgtcaacttcatcatcatcaccattgcagcttcctccaacttcccccttttttgcaataaccaccccaaaaccttctctgatcgtgaggggacaaccaccaccatttcagacactgtcagccacccaactgagtcagaaaaccaaaccaatgaacctaaggaagaagaaaaggaggttcaacaacaacaacaagaggtggttgaagaagaagaaccagaagaagaggtggttgaagagtcagatggtgatgacacacttgaagctacatggagggctattatggagggacaggggaaaacgatgaaaccacagctgaagaagagtgacacatggggtgcaaggattgccaaagcagagccatttcatcgcaatggggaaggtggtgatgatgatcctgtggcttgggctcagaaggagctcaaaaaatctgacactttcaatgatagagcttccttgagaagggacaaatccatgagtccagaggaattgaatcgcagggcagaagcattcattaagaagatcaacaatcaaatgaagctgcagaggctggagtcttaccagcgtttcagggaaatggtaaaccgtggtgtttga

SEQ ID NO: 6746 - DNA, 1206 bp, Glycine max
  Peptide Sequence Number=SeqID_123524
atggagagggacccaaacatgggcaaggaaaaagtggtttcaaattccacattgcttccctcgtccacaaaagggttcaaggacaagggcatccccaacaatagcatgccctcctggcttctcaccaacatttctgttacaacaagttatgttgaaacggtgccaacctttttcaagcaatcatcaatggaatggaaggaaggaaggaagaagtgtgagatgaaggagaagaattcacccatacagacagacttggaggagaggatgaaagtgttggcaatgagtacaacagaagatgaagaaatgggagacacatttgctgatagagcagaaacttactaccaaaagaggcctcagctactgtcccttctgcaggacttgtacaatggctacataaccttatctgaccgttacatccaaacactggccaaacacaagcaccatagtagacactcttctcaagtttcaactgtagatgaaggcttctctgaccaagaagaagaagctagtggtgtgagccacagtgattcagacattgaaagctcaatctcctaccaacacccccaacacatgatgatgccaataggcctcccaaaaagctccatgcttgatgttgatgctattgttgctgagcttttgataaggaatattgagtatgacatgttgatgcatgaagttggtgtcatggagaggaggtactgtgagtcctcaaggaaaagtgagcttcaaaagagccttcttgaggtgttggagtctgagaggattgttcttttgaatgagaatgctagcttgggctatagggtcaacactttggtggaagaaaacaaggagcttgcatctgagtcagtgttcatcaagagaaaagccggtgagcttgctaagtgtgtgctgaagatgagggaggatcatagagtgtacttgctgcacaggaaaattgaggatcttcaggctcagatacatgccttggagaagaggaacaaggagtactatgataagcttctgagaagagatggtcatgaagatggtaaaaaaggtgtggctttggaggtttgtgttcagatggacaagcaaaagaggttcaagtggaaagatggcaacacttctgggatgaagaaatttcatgggaagaagtcccccccaagtttgtggaaaaagctgaagaacatggatttgttgttgtgtggtactaatccaacttgtgcttga

SEQ ID NO: 6747 - DNA, 198 bp, Glycine max
  Peptide Sequence Number=SeqID_123525
atgggtcttcaagcttatcaatgttcctgtttaatcatgttctacctttgcctcacgaaccccttcatttttctctatgcaaagggagaaacctacattgttggtgacagttatggttgggatgacgtcttggatttcagcaactggcgtgatggaaaagagtttcatgttggtgatgttctaggtaagttaatgtag

SEQ ID NO: 6748 - DNA, 396 bp, Glycine max
  Peptide Sequence Number=SeqID_123526
atgcaaaccaaaaacatctttgaaatacacaatacccaacaagaaaaaataagaatcacaaaaggaagaaaattcactaacctcgacaggagaacaagacgaggaagtgaagaggagacaacaaagaagagcaaccaaccgtggagaggccgtcgaagaggagaaaatgaggcagattttggaagaaaaagaagtggaggaaaaataagaagaagtcttcttgagggaggaagtatcggaaatggtgaaggacattttcaccctttcatcgacattgctgggtgccccaacaaaaatgttgtgtgctccaaacaactgtcaaaacttaacccaaacaacattattatagtactattgattaccaattattcatttgcttcatctgacacaatttaa

SEQ ID NO: 6749 - DNA, 1326 bp, Glycine max
  Peptide Sequence Number=SeqID_123527
atggcaacgacgacgtcgtcttcaagcgaggaagcaccgaacactaagaagaacaagaaggagcgtttaggttggatagaatggttaagaggttggttctatttggtctacgaaatgctctttcagcgcatcatggcgagccacttgcacaaccctatgcctctccctcctgtaaacgacctcacttgcattgtcaccggctccaccagcggcattggcctcgaaattgctaggcaattggctcagtcaggggcccatgttgttatggctgtgaggaacactaaggcagctcaggagttgatccagaagtggcaggttgattctgaaggattgagtattcctctcaatgttgaggtgatgcaagttgatcttctctcattggattctgtcacaaggtttgctgaagcatggaatgcacgctcagcacccttgcatgttctcatcaataatgctgggattttttctattggagagccacaaaagttttccaaagatggttatgaacagcacttgcaagtgaatcatcttgctcctgccttgctttcgatacttcttttgccatcccttattaggggttctcctagtcgcattgttaatgtgaattccatagttaagttagtttggaagacattttctttcttctgtttaggtgcatttcttgtcatcccgagtcctggtaggcttgttttccctcactgtttgctgatgcatcatgttggctttgtagacaccgaagatatgaatgtcacatctggaaaaaggaaattttctagtttggtagggtactcaagcagcaagttagcagagattatgtttagtagtattcttaataaacgactccctgcggaatctggcatcagtgtattgtgtgtatcacctggaattgtccagaccaatgtgaaacagcctctttgcatatgcaagagtaaggctgtgcacaatgaccttcctccatatcttcgtatagcgagtagcttcatggttccgaggtatgcaagagatcttccgaaacttgttcaagctgcgtatcatttgatcccttacttcatctttagtgctcaagaaggtgcaaggagtgctctctttgctgccactgatcctcaagttccggagtattgtgatatgttgaaagcagatgagtggcctgtttgtgcctttatttctcaagattgtcgtccagcaaatccatcggaagaagcgcacaacgttcaaacatcgtatgaagtgtgggagaagacattagagatgattggccttccctcagatgctgtggagaggcttttagatggggaagaagttaaaagccattatagacaagaacagtaa

SEQ ID NO: 6750 - DNA, 453 bp, Glycine max
  Peptide Sequence Number=SeqID_123528
atgaaatgcttcctaccactggtgcaggaaaggggagccaaaatacctgcaccagtatgggagttggttgcacctgctcctcctcctcctccttgtgtgtccatggtgttgcatagaatgtttcattgtgaatcaagatactctgcccccaaggtgctcctttctgatacgagttactttcttacttgtattcctatcattcagactctggcaccacaaattcctgcaaagcttctggcaacacctgctctcctctctactactaacacccagaaaagcaagaacaaaaacatgtacctcagagaaacactacccagaagcagtgatgttctccaaagtcttcatgaagaagatgctcacagtcaaaaggttaatccagatggttttcaagggtgctccagcatatacctggcactagtgtccgagcctatgactaaatctttcatgtgttag

SEQ ID NO: 6751 - DNA, 183 bp, Glycine max
  Peptide Sequence Number=SeqID_123529
atggaaagtctcggattcgaaaacttacccgttgaagaacgaagaacggatgaagaacgaaaattgggggagaagcttgccacccagctcgcccaagcgagtagggttgcttcctccagaagcaacaaccttctggtgggcgcaagtgggcctggttgctatttgcacccccatttttactaa

SEQ ID NO: 6752 - DNA, 207 bp, Glycine max
  Peptide Sequence Number=SeqID_123530
atggagcagagcagaggacaccgtgtggtcatcattgcagccgttgggcttcatgttgaggtacgcggtggtgccacgacagaatttgtcaacgatgttgacgacctggacctccacagcattggtgccttgggcatagaggtagcttttgctgacgactttgttaaagggggagaggatgacataaccgaagttgggatgggggag

SEQ ID NO: 6753 - DNA, 108 bp, Glycine max
  Peptide Sequence Number=SeqID_123531
atggtgactcctggtccacaggtgtactcctcgaatctccccaacaattggtatcagagccgatgtatgggtatcaatggtcatcctaggccagcgaaacaagattaa

SEQ ID NO: 6754 - DNA, 275 bp, Glycine max
  Peptide Sequence Number=SeqID_123532
tgatcgcgcccgcaggacaccctgtggacccaaagaagtccaacagggtcccggggcttccacctctaattacgggcctttgtcagttctacgtagtgcccgtcaccctcaacaacgtcatcaggcctcctactactcgagctttcatcaagaagtattgcgcccctaggcaggcagagggcgagacaccacaacagcctggggatggccagcaacaggcaacaaatgcaccgccgccacctctagagcccctcagctcatccacaaaaaggtag

SEQ ID NO: 6755 - DNA, 178 bp, Glycine max
  Peptide Sequence Number=SeqID_123533
atgggtgccaaatacctcaaagtggtcaaacgagggtcgcatcccaacaacggatggtcttcggacgaaattaggggcgcaaaatttgtctctgcgcatttatcactcatcgagcgtgcggataaccgcatgccatcgagcccgccagctctggatgacaaaaggcgcagaagacgac

SEQ ID NO: 6756 - DNA, 741 bp, Glycine max
  Peptide Sequence Number=SeqID_123534
atgaaggccgatatggaggccttgaaagatcaaatgacctccatgatggaggccatgttaagcatgaagcgactgatagaaagcaatgtagccgcagcggtcgccaccaatgccactgctgaggcggacctgacccatccattcgccataaaccaagtaaaccaacccatactagacatgttaggtcaaggaggagaagtcttgggcagcaccggtggtccacacattgggcataataggaatgcttacccctatcgcttaccccccaattatacgctacctaccatgcacatacccaatgagaactctaatcatgtcgttcccgttacctttgagggtcagcaaccccagcttatagggggcactcgtgaagaacctcgggagcatgctcaagcagtggaagggaaagagaaacttgatctcatcgaggagagattaagggttgttgaagggtttggtgattaccctttcgctgacatggaagaattgtgtttggtacctgatgttgtcatgcccccaaaattcaaggtaccaaattttgataaatacaaggggaccacttgccccaagaatcaccttaagatgtactgccagaaaatgggggcatactccagggatgagaaactgttgatgcatttcttccaagaaagtttggccggggcgacagtcatttggtataccaatttggaggcttctcgtatccacacatggaaggacttgattactgccttcattaggtag

SEQ ID NO: 6757 - DNA, 384 bp, Glycine max
  Peptide Sequence Number=SeqID_123535
atggatttagacagacacttccaaagaatgaacctgagattttatctcctcgatggtctcaacgatccaagcctgaagaatacatatgtggcatcgttactagaagagatacaaccagaattaaacaagatggtagcaaccgcccaaatagatttttctaccatgtctacggggcaaatccatcaattcactctggaggtcgttgacaagttatgcagacaacaccagtatttctcagacatcatgaacagaaaagccaagtatagcagagcatgtaaaaaaccttacttggaaatcaaatgcaaagagaaaacatgtcattgttcaccgaagaaaaagaaagccttacaaactcacacaaaggagaaaagaaggccattatag

SEQ ID NO: 6758 - DNA, 245 bp, Glycine max
  Peptide Sequence Number=SeqID_123536
gtatgatgctgaagccaactattttgacgaaggtgtgagatctgcaaaacaaaagcaacttcaagaaaaactgtttcaacttgtccaaccaacattccaaattgtgctgggatatatgaggtccggaattttggataagtttaaggaagcatttgacaaggcattgaatggaggggaagggttttcttctgctgccaataagtgcatagagatttatatggctcagtttgatgaaggatgtgcag

SEQ ID NO: 6759 - DNA, 525 bp, Glycine max
  Peptide Sequence Number=SeqID_123537
atgaaccctaagagaataaaagtcattcttgagtggcccgctccaccaacaccactcattgagttggtgaggaactatgttccttcatgggaagatgcccaggaaatgagttttcagaccttaccttacttcaacatactaaacaccgctaatacatatggggagggaatgatgcaatcctaccccgcaagggcattggatagaaaactccaagtagattgggccagagatgcaagagaaggccctagggttcttatgagccttaaggtagatttcgggtccatggagggggaggtgagcatttgcttactacaccccattgccacatcatatagtcacactttgtgcatgttgtcgcaacgtgcccttcacgggcgagcgagggcgaggctcacgagtgcgctttccaaaggaggaaagatgcgcggagtcgccaccaacgtttatttgtggaaaacgtcggaaaaaccgaaggaaatcggtcaaaatgaaaatcctaagttcgggagttgtatttacgcttga

SEQ ID NO: 6760 - DNA, 261 bp, Glycine max
  Peptide Sequence Number=SeqID_123538
atggaggacacatggacagccctaagcaattcattcatgtggctccggaaaagggcaatcatgaaacacagctccaaactcgaaaatggaggacacatgaatgcccaacgcaattcattcatggggctccgaaaaagggtgagaatggaggattgccttgagggtcctctcttaggcaatcatgaaacacagctccaactcgaaaatggaggacacatgaatgacaacgcaattcattcatggggctccgaaaaagggtga

SEQ ID NO: 6761 - DNA, 252 bp, Glycine max
  Peptide Sequence Number=SeqID_123539
atgccgcaaaagggagcgcgcggcagctcctcggcggcaaacgcccgcgccgccaaatacggggaatcgtcaatctccggcgtttgccggccgatctgcgcagcgatcagcgcagcgctgccgagggcggtcgtgacgcccaatccctcgtgccccagtgccagccacagccaggaataccgtggatgcgcgcccaacagcggcagcccgtcggcggaggcggcgcgcagcccggtccagcagcgaatgatg

SEQ ID NO: 6762 - DNA, 716 bp, Glycine max
  Peptide Sequence Number=SeqID_123540
atgatgagtaacttagactgtgaggtgctgatcgtcggtgccgggccggccggcatggcggcggcgctggccgcggcggaaagcggtggccaggtgcgaatgattgatgataatccgcatcccggcgggcaaatttggcgcgatgggccacaggtggttttgcctgaaacggcgaaccgctatcggcaggcggtggcgacgaaggaaaatattgcgctgcagcccggttgcaagctggtggcgcagtgtggcgctaaccgattggcatatgaagacgccgatggctgcggcgtgattcgctatcaaaagctgattctatgcaatggcgcgcgtgaacttctgctgccgttccccggctggacgctgccgggggtgactggcgccggtggtctacaggcgcaaatcaagcaggggttggctatccgcggcgagcgagtagtgatagccggcagcgggccgctgctgttggcggtggcgaacagcgtgaaacaggccggaggcgaggtggtactggtggctgagcaggcgccgctttggcggttggcggcgttcgccggcgacctgtggcgttggccaggcaagctgcgtcaggcgttttctctgatgccgcatcgttaccgtgccggtagccgggtgcaggcggcgttggggcaagaacgtttaaccgcggtgcgcgtcaataacggcgggcgggaaagaacgatcgcctgcgacag

SEQ ID NO: 6763 - DNA, 1207 bp, Glycine max
  Peptide Sequence Number=SeqID_123541
atggagatgctgaccaagggtggaccttgggttttacgagctttgcgccaaggatgtgtttgccctaggttttggcgaggctcacaaagggttgacctcgtgtttgacaaccctgtagagctacatcgagactcaccaagggtggaccttgggcttcatgagcctttggagaaggtggaccttgggttttgcgagtcattaaagaagcgagactcaccaaggacggaccttaggtttgacaagcctttggaaaaacaagactcaccaagggcagaccttgggtttaacgagcctttggagaagcgagactcactaagggtggaccttgggtttgatgagcccgtgagactcaccaaggatgcgactaagagcatatctgtcctggatttttttcaaggctcactaagggcagaccttgggtttgacaagcctttggagattcaatcaggccctaagaataactttgttggctgcctttgcttgaccattggtctgaggatgttcgataaaggttacaaggaggccatacctgcatatgaggtgtttctaggtggacttcgccacctcgttgactcaaccagtaaatatttggttgctcctggggcccttggcaatggtctcagtatgttcattccacacattgtgaagggccaaggggagctcaagctatggagtttattaggagggtgtctcttggatgatagtcttgaggttcctggtctttttggtgctggtcagcttggagagcaagtctgctctagtattgctctccttaggtatgtagtatatctcaaaacatttgaagttgtcaatgagatatttggcaatgtggtagtacttgagcagcgttgtttccttggtctagtatttgttgacaactttcccctgcacaagctgcgagggtttgaagttgagcttgagagcttgttccagacaaattatgctagaaaatatgccatgaattgtgtctttgtggggctttcgcaaaacttgtttgatggggaagttcatcttgactactactttgtgactttggaagtatggcctaagatgtcgggtcgagcacttctcaatgtcatcgagtatgtggctagtgaagtggatgagaagttggtgcttcccttccacttgtacgagggccaaaaaggcttgttcgcaggtgatgggggaaatggtcttcttgaaggccaaaaaggcttgttcgcag

SEQ ID NO: 6764 - DNA, 1206 bp, Glycine max
  Peptide Sequence Number=SeqID_123542
atgacaaaggatgcaatccacggtcacaactttgcagcgcaacaccatttcctttctcctttctctctcttggcttcaagcttcttatcttcttgtatgccaagaggtgcagaccaactcgcccaggcaagttgtttacttaatgctaaaggttgcagggttgacacttggtttgggttgccttttgagtttgcaagatttgcctccgactccattggtcatcgaggttctactcctgctattgttgttgctattgctcctactcttccaccttctcttgttgtgcctatgcaggaggttgctcatattgctgttgaagttagtgcaccagccacttcggctagtcctgttgtggcttctttgtccaccatcgttgcagccttgttgagtgtcggtgtgacgaccacaagtgctcctatgatgtcgcctcctcctttttcagctccaccgattcctccctctgctgtgttggcgttggcattaacttccacctcttttcacccccatgtttctttggaccacatctacacctccagcaatgctgattccttgcggggtataggttacaagccgaagcaaaagaccctgggtctagcatgctacggattctaccaaagtctttctccaacgaagtttggtgatcctggaagagaatgggcaaaggcaccaagagggctaagcaaggtagtgtccttggaggctgaggttgccaaatggggggccactgctcgcatagtttggagagtggagcgccctaaggtagctaattccattgttgccttctatgatgttgtgaagtcgaaccaacaactatctttcaaagttggcaatgttcttgccaagttactgtggaccaaattggatggtgatgagttgtttgagcattgcaagtacttgcataaagagaaaaaaaaaccttggcctcgagcttgtcaaggtggttgcaaacctcgaggcctgactgaacgagtcaaagtccaagctggaggatttcgaaccgaggctgtggtgcagcatgaaaagggctttcacaaggccattaggcaggctgagtttttcgccaaggaccttgacttgggtctttttgatcctttcaaggacgtgaaggacggtgttttgcttgacgatgaagacatagctgctaaggagaaggatgctggtgaggagcagagtgctaaagagcaaaatgatgatgccaatgtttag

SEQ ID NO: 6765 - DNA, 645 bp, Glycine max
  Peptide Sequence Number=SeqID_123543
atggcagatcaagaaagtgcacatgaagaaacaccttatggtcctaggtatactcctacatattctcctcgtgctatcactctttcaccttctactgctcatgccctttcagcaacaccaaatgaatctatagaagcacctaaagcagaagaaacaaccgataatttgaaggggacaacagaaacaggaacaatcttcaaggaagagttgccatcacctaagacatgtggactacgagcaataaaaaaagtgggtatgatgctatcctcccaaggagtggacctgatgcaatcctacctcgcaagggcattggataaaagactccaagaagattgggccagagatgcgagagatgcgagagaaagcccccgggttctcatgagccttaggaatatagctccattggagcttgaaggcctaggatcttcttcatcagtggattcctttgcttcttggaagatgaatggcaacggaaggagaaggaagagagagaggagacgccacttcaaggagaagatgagtctagaagaagctcaccaccataggaggccatggataagagcttggaggaagaaggagatgaatgaagggagaggaagagaagagcacaaaattttgtgctctaaaagagctctgaaatctgaa

SEQ ID NO: 6766 - DNA, 336 bp, Glycine max
  Peptide Sequence Number=SeqID_123544
atgccatctactatttgtagggatcgtgcccacaagacacctagtggacccgaagaagttcaacagggtcctggggttctagttctgattacgggcctctatcagttctacggagtgcccgtcgcccccaatagggtcatcaggctcctattaacagggcttttatcaagaagtactgcgcccccaggcaggcgcagggcgaggcatcacaatagcaggcaacagacgcaccgccaccacctccagagttcacctcaactcatccacaaaaaggatggatcgttgcctacgacacatggccgaccagcaggcgaccaagtccaaagccaaaggtag

SEQ ID NO: 6767 - DNA, 537 bp, Glycine max
  Peptide Sequence Number=SeqID_123545
atggcgcctaccaggcaccctctggacccggataagtccaatagggccctgggatttcccgctttgatcacaggactctgccagtcattcggagtccccatcgcacctagcaaggtgattcgaccgcccatcacccgagcttttattgagaagtattgcacgcagggacaggcccagggggatgctccgcaggccgcagacgcgccgccacctcatcaggctggcccagttggatcatttgatacggagttgtatttgcggcatttggttcaccagcaggcggccaaccaccgggcgcatgtacagacccatgattgtctttaccagttgagcctcagcctccagagccagggttttacttcttttccgtgccctactccggatccgttcagggcagaggtcacatggcccggagattggcctgaggcccgggcaggagaggcaccagcagaggctcccgacgaggcagatgaggcccgtgaggacgaggagatgaccgatttacttgatttcttaggagggagcggagccacatga

SEQ ID NO: 6768 - DNA, 273 bp, Glycine max
  Peptide Sequence Number=SeqID_123546
atgggggtgaacttatcagacacagggggtgcgctcaggaaacttcatccagaacattctagaaggggtgatgaacttatcaattatgggctatgtatttcggctattttgggtgaaaaaacatgtttccgtgaagaaaaattgagtcgaagtgctttcgtaacgcttccaagacatttccgtgagcaaatctgtgaagatttttcgccattcttcaccgttcttcgttcttcaactgctttaaccgatcgtttaagtcgttatctcacctaa

SEQ ID NO: 6769 - DNA, 183 bp, Glycine max
  Peptide Sequence Number=SeqID_123547
atggctaattcccataatagctcaacttatccaaaagggtgttacaatggtggtagcaatgctggtggtgatggtgatgttagtggcaatgatggtggcagtgacggtggtgtagtggttgccattggtggtgattgtggtggcagtgatggtagtgatgatgatggtggcaataaattatga

SEQ ID NO: 6770 - DNA, 639 bp, Glycine max
  Peptide Sequence Number=SeqID_123548
atgggagaagaacgacacaaagagatcaaagaggaagtggacaagctcctcaaagcaaatttcatcagagaagtcaaaaaggtcaacgacaaatggcaaatatgcaccgactacaccaatcttaacaaagagtgtcacaaggatgcataccctatgcctagcattgacaggctgggtgataaagcctctgagttccaagtactaagcttcctagatgcttattcaggatacaatcagattcggatgcacactccaaacgaggagaaaacaacattcatcattgaagatgccaacttttgctataggattagacaaaatgtcgagatctacattgacgacatggtcatcaaatcccatagcatagcccaacacgtgaaccctaacagagcaaccggaggaagaactctagagagcaccagaagtgccaccattgctaatggagaacgcttaagcgactacatcaaggttattttgatgatgccaaagaatcaagagtcaagaaaaatccaaagattcaagaatcaagtttcaagaatcaagactcaagaatcaagtttcaagaatcaagattcaagaataatcaagatcaagattcaagactcaagattcaagaaacaagggaagactcaatcaagataa

SEQ ID NO: 6771 - DNA, 366 bp, Glycine max
  Peptide Sequence Number=SeqID_123549
atgacattaatctctgcgtgctatcaggcttttcattttacagatagcaaaaaggtttatacggataaccactcgggtatctccgcccgtcagcgtgactcaaaagtcagtaagacagatcttgtgagcgcggaagatgacgtaaatctccgcgtgtcaacggggttgtcggccgcgattgacgaagggtgcaggagacgacatagcacaaaggtttatatggataaccactcgagtatctccgcccgtcagcgtgactcaaaactcaatatgacagatcttgtgagcgcggaagatgacgtaaatctccgcgtgtcaacggggttgtcggccgcgattgacgaacggcgcaggagacgacgttag

SEQ ID NO: 6772 - DNA, 555 bp, Glycine max
  Peptide Sequence Number=SeqID_123550
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggatctcgttaatccattcatgcgcgtcactaattag

SEQ ID NO: 6773 - DNA, 831 bp, Glycine max
  Peptide Sequence Number=SeqID_123551
atgaccacgcttgctcagacttggagcgttctttccttttctaacctcattcccacttcccacacttctgatgtcactcttgacaaagccaaactcatttatggcatcatcatgaagatggacatgaatatggggtaccttatctcccaccaaatctccctcatagcacagcatgacacatccaaactaggattccctgccttgatcacagctttatgtaaggctagaggacccaggaaggccagggataagagatctgaggccccttccactttagcaccagagacaccagctccttcttcttccacggctccattacctcccactaagattctagttattcctcttacacccacacagataccacttccagctcctttctctgtaggaccatcagattttacttttacaccacagatgctgcactccttgctccagagcatccacaaggggaagtccattatcatgcagagccttcaaggcttgggcttgccctccattatgagcatggaggagtttgatgctcaagtggcctatccaggagaccagccctcttcttctagaggagatggagcctctgtagcccacgagcctatgactgaggagcctcgagcattcgctaagcgcgacactcagtggctaagcgcgaggaagaatccagaagaagatgagctgtcaggctcgctgagcgcaccgctccaggtcatcaagcgcactacttcagctcatccgctaagcgagagaagcgcgctaagacaaaattcacttatgcgcgctaagcgattcagatttgcgctaagcgcgcgtgcacaaaccaacccacctatttaa

SEQ ID NO: 6774 - DNA, 120 bp, Glycine max
  Peptide Sequence Number=SeqID_123552
atgattttaccattgtgcatgtctaacaacggacacttcttcatgctgaaattcactagaaatgctgataatgaatacctaacaattctgtataaccagggggatgatgtaagttcttga

SEQ ID NO: 6775 - DNA, 288 bp, Glycine max
  Peptide Sequence Number=SeqID_123553
atgactggcgaagggattagtccttacattcgggttgtcctcttgaaatgtcagccaccttgtgtcaatcaagctctgtaccttgtgcttgaaggccacgcgttgctcaacataatgccccggaacacccccatgataggtgcaagttgcattggaattgtaccatcgagggaaaggagactagtagatcttcccgaggttcaccatagccatctggttgctaatcaagaatggaaattcctccttaggttggtgcttgtgttgggattagtgttcccagcggggtga

SEQ ID NO: 6776 - DNA, 333 bp, Glycine max
  Peptide Sequence Number=SeqID_123554
atgcctcaacccaatgccacgggagcttctcaacatcgcccgctacaacctctacacttctcggtggggagactacctccgactatggaagaaagagtgaagttagatctcataaaggagaggttgagggccatcaaagggattagtgattatccatttcttgacatggaggaactatgcttagtgcctaatgtcatcatccctcccaagttcaaggtgccagacttcgacaagtacaaggggactacttgctccaagaaccacttaaaaatgtatcgtcaaaagatgggggcatactcaagagatgagaaattgttgatgaacttctcctaa

SEQ ID NO: 6777 - DNA, 600 bp, Glycine max
  Peptide Sequence Number=SeqID_123555
atggatcaagtccgacgtcaagccttccgcaaaacatatgggaaaatctgggatttggctatgatagaagtttccgttgaagccatcgcatccctcactcagtactataaccagtcgcaaaggtgcttcacgtttggggacttgcagttggtaccaaccgtagaaaagtttgaagggatcttggaatgcccgctaggagaaaagaagccatatatgttttctgggttatacccctctatggaaagaatagaaaaaatggtcaagatctcggcacaagagctagaccgagcgaaacaaaacagaaatggggtagttaggataccaaggaagtgcttggaagaaaaagcaaaagctttggtagatcaaggagagtggactttattcattgatgttttagcattgttggtgtttgggatcgtcctctttccaaatgtagatgggctagtggatctagcggtgattgatgattttcttgcttatctccacagcaaggaaagcccagtcattgctattttggtcgatgcctatgacacgtttgatcggagatgcaagaagagcagcgcaagaattgtctgttgcacacccactctttatgtatga

SEQ ID NO: 6778 - DNA, 444 bp, Glycine max
  Peptide Sequence Number=SeqID_123556
atgcggataaccataaggtatctctacatgctactggaccctcgagtcgcgatagcagaagtgagacttttttgcggtcttggccgaaagacgctgacatctccgggaagggtgcagatgaccacattggtctctgtgtgtcaacaggcttgcttgcctctaattgacgaaaggtatctccgcatgctaccggaccctcgagttgcgatagcagaagtgagactatttcgcggtctcggccagaagacactgacatctccgggaaggttgacgaaagatgtggataaccataaggtatctccgcatgctaccggaccctcgagtcgcgatagcagaagtgagaattttttgcggtctcggccagaagacgttgacatctccgggaagggtgtagatgaccacattggtctcggcttgtcaatcagacttggggtctccaaatga

SEQ ID NO: 6779 - DNA, 648 bp, Glycine max
  Peptide Sequence Number=SeqID_123557
atgggaacccaagattctaatgaaactcaaaacttttggcctaccaaacgccaagtgtgtcccatttgtgggaagaaggtgggagtggatctcgttggacattttactacacaacatgggaacttcttgaggatatcctttttgcaagttgttattctagtgatttcagcattgttaactataacttacgtgcagcgcaaaaggagggtcaggaaaggaggctctgcttcaacaatttctatattgagaaaagagttacaagaaggagccttgcagtcccttcttggaggttcttcatacttagcttcctcaaattccgagcccgatcctctgttatcatcatttatgtttaacccagttgtagctgatgagtctgtgagtgcaacacctccttccactgaagatgctctagtaaaagaaagttcaaaagacgatttcttgaaaagattcgagaacttcttgtctgacaatggtatgatgtatggttacagaaaacctcagcagttacagctatcagaagaggatcaagtagagaaggctcggagctcatatgccaatgttgaaagagctggagctgttttgtcttcaagattttattcgatgatccaaatacataaaaagggtgagacggctggagtgtcaatttga

SEQ ID NO: 6780 - DNA, 267 bp, Glycine max
  Peptide Sequence Number=SeqID_123558
atgttgtctcctgaactgctaaaccctgatgtctcgtgcatgtttagcctaatcctaatcaagcatcgtcttcagatccctcttgttggactaaacttgaccagaactgcattaagacatacataccaaaaactagtaccaggcatgctcgctcagcctggaggttcaagcggtgcacttagccaattgattctcgctgagcacatcatgaaaactcatctgcttccaggatcttctacgtgcttagccatgaactgctgcacttag

SEQ ID NO: 6781 - DNA, 405 bp, Glycine max
  Peptide Sequence Number=SeqID_123559
atggataatcattcatggtgttatccagcttgcattcaatgtcatagaaaaactgacatccaaacaggaccattcacatgcggatgtggcaaagataatgatcagcctgttctaaggtatagagttgaagtaatggttagccaaaacaatgacagtagcaagtttttgctctgcgaccgtgaatgtgctgaattgattggtgaaatagttgaagtgaatagggtcaagattgaagatggtgatgttgatttgaatgcttctcctcaagcacttgataggttgttgggttatgtgcttgcttttaaggtcaggattcaatcaaaattcaggaatgtcgttgttcttagatactcaaatgaattagatttgatcaatgttgtgctcgacatgctggctaatactgag

SEQ ID NO: 6782 - DNA, 693 bp, Glycine max
  Peptide Sequence Number=SeqID_123560
atgactaaagcaccattttttgatataaagaaccctattattaatttaaccgaaaaggcaaacaattatatgatgtcgattggctttcgctttatgccaggacaaggggaattcttaataaaagatctccgagctcctgataccttagtgggtttaagaaagttaaaagatagcctaggcttatcgttaacaaaaggtagtcttaacagcaatccattacttaagttaaagggtatttctgactctgtttctaatagtatggagtcgctggcatctcgtgtcttggttgaagtaattacatttaatgaggggtattatggtcgattcttaatcctggtccaaatgggtattggttgtactgtatggtatggcttcgtacctggcgatggtatcaatatgccaattgaaggattaaataccctatttagtcctattgagaattatgatactatctttactaatcctgatgctcatgttataccgggctttaataaaatgactttaattgagggcgtaaataatccagcagcatcgctgtcacaggcatttgctcaagataggcccttcatggatatggatattgaaataccggattctaataaatctattattatcggtgttagcttaggactagcagttgccatcttatttacatttgggattaacccatgctgcggagaagttatagtatga

SEQ ID NO: 6783 - DNA, 516 bp, Glycine max
  Peptide Sequence Number=SeqID_123561
atggcaattaggatttcaagatgcagcaacacctatagtgcaaggaataatagacttacatcacgatatcattttcttcgtcattcagattgcagtttttgtagtatggatcttgcagctcgtgctttatggcatttcaggtctaaaataaatccaatcccgcaaaggattgttcatggaacaacaatcgagattctgtggaccgtatttcctagtgtcatactgatgttcattgctataccgtcatttgctttgttatattcaatggacgacgttgtagtagatccagccattactatcaaagctattggacatcaatggatgaaggagttgatcccaattcttttagaatttatcaaaagctatcttaagcttttatccgaggagaaacctttattgcactatcaccccttctaccgcattaccattggaccgaccacaacattatcattgccgtcaagaacattagcttatatgttgtctatagcacctctaaggattggtcctaatagataa

SEQ ID NO: 6784 - DNA, 495 bp, Glycine max
  Peptide Sequence Number=SeqID_123562
atggttgttcaatttgaaagtgaatgggggcttatatacgggtctacattggtggaaactgcggccatcaggtcaagccatgaggacgatgtcgcctttttggaactttctttcgcggaagttccaggcggtgtgttggaggacgatggcggcgacaatggtggcgttgccaatgatggagatctcattgacggttcgagattggaggatgttggattggagatcattgaagtaggagtggtcgggttggcgaaggtattggagttgccagtggcgctgcccagcgaggatagaggtcgggcaacaactaaagttgttgtagttgatgcacgcgacgacaacttcgtggtggccgaattcgaattcgatttccgacggagttatgaaggtggaagagagtttgggttttttaggtatgtcagagttgttgtggtggttgttttcgtggatggtggtggaagacattgggatttgggattaagaaatgaggaatag

SEQ ID NO: 6785 - DNA, 312 bp, Glycine max
  Peptide Sequence Number=SeqID_123563
atgccaaagcagtggtcaattaacgattatgtgttgaaagcagtgagttggcacctagcaaagagtaccttgtctttttatcctgaaattttcaagattgatgctgtgaatgctacatctggatctgcttatgctgaggttggaaataccaagatttgggccaagagagagcaaggttcagaccacaaagagtacagttcaatgcttcataaagctttggaggaagcaataatactggaaacattccccaagacaactctggacattcatgcattagtgttggaatctattggcaatactctcattttgtga

SEQ ID NO: 6786 - DNA, 478 bp, Glycine max
  Peptide Sequence Number=SeqID_123564
atggctatggagggttctcaatggttgagtgaccttttgtgtatgtgtgagttgtttgagaatgagagtgggtggttccaaaacgggattgggagggttgtgggtgatgggagtaatacttctttttgggaggcaaaatggttagagggtgaaagattgagttctagacttatggatatggcaactgttgtggagaagaccaaggtttcaatgggagctacctatggtgcaacatttgggaaagataggttgtttggattcggtaccaaggacaccgggaacaaatggttcctcttcaatgatagtgacgacggtcctttaggctgcggcagtggagggaagaagggtaagcgagaaagcgcaacgggaaccaatgctcttgaactgggagcagagaacgtggagcagcacgatggcggctctcatgtggaggaggaggcagtaagagtcgacggtgaagcggaagttgtagtggcgg

SEQ ID NO: 6787 - DNA, 312 bp, Glycine max
  Peptide Sequence Number=SeqID_123565
atggctctggtgatggattccctccttaagaggattgcatcatatgatccaacccttgatactcagcatgatgtaagcttcattggagcttgtaggcctaggatcttcttcatcaatggattattttgcttcttggaatatgaatggcagcgaaatggagaaaagaagagagagaggagacgccatttcaaggataagatgattctagaagaagttcaccaccataggaggccatggataagagcttggaggaagaaggagatgaatgaagggaaagggagagaagagcacgaaattttgtgctctaaatga

SEQ ID NO: 6788 - DNA, 1953 bp, Glycine max
  Peptide Sequence Number=SeqID_123566
atgaatctcagcaacggcaagggatccacttcgagttctcctctgaaagccggagattctgtctccgaccagtttccggcgggtctccgggtgctggtggtggatgatgaccccacttgccttatgatccttgagaggatgctccgtgcttgtctctatgaagtgacgaaatgccagcgagctgaggttgcattgtctctcttgagagagaacaaaaacgggtttgatatcgttttaagcgatgtgcatatgccagatatggatggatttaagcttttggagcatattgggttggagatggaccttccggttattatgatgtcagctgatgatgggaaacatgttgtgatgaaaggggtgacacatggtgcctgtgattacctgattaaacctgttcggattgaggctttgaagaatatatggcagcatgtgattcggaagagaaagaacggtttgagagatgtggagcaatcgggtagcgtggaagaaggagatcagcctccaaaggtatctgatgatggagattactcgtcttctgtgaatgaagccagaagctctaagaagaggagggacgaggacgaggaaggagatgagaaggatgattcctccacgttgaagaagccgcgagttgtttggtctgttgagcttcatcaacagtttatggctgctgtgaatcaacttggaattgataaggctgttcctaaaaagattttggaattgatgaatgttcctgggctcactagagaaaatgttgctagccacctccagttatttgaaggtgtcaactcatttgccgtctggtttttggtacagaaataccgtttgtatcttagaaggctgagtggagtttcacagcagcagggtaacttgaacaactccttcatgagctcacaagaagcaacatttgggggaacctcaatcaatggaattgatcttcaaactctttcagctgctggccagttcccatcacaaagtctagccaagcttcaagccacgggacttggcaggacaactgctaaagctggtgtgcctatgcctctatctgatcaaaaaaaccttttcagttttgagaacccaagattaagatttggagaagggtcactacaacatttaagcaacagtaagcctataaacttgcttcatggaattccaaccaacatggagccaaaacaactcgccaatttgcaccaatctacccaaccccttggtagcttgaatatgcgagtcaatgctcctgtcacacagaacaaccctttgttgatgcagatggctcagtctcaaccaagaggtcagatgctaggtgaaaatgctggttctcatgtaaccaggtttccgtcatctttggtgcagcctacagtatcaaatggtatttctaatggtgttttgggaaatgggattgctggcaccagcaacataactacttataatccagttcaacaaaactcgtcattgttgagttttcccatgaaccaaacaaatgaaatatctgtcagtaatttccctcttagaagcagtccaggtataactagtatcacaaataaaggtatgtttcatgaagaaggtacctctggtattaaaggacctggtggatttgttcaagggtatgacatgtttaatgaactccaccatcagaagtcccatgattgggacttaacaaacactggcatgacatatgatgctgctcaccatgcaaatcctttacaaggtgaaggcatgcatcaaagtaatctccaaaatgttggtcaacaccacaataaccttcttcttgacaattcagtaagggttaaggctgaaagaattcctgatcctagctgccagattaataacctcttcgctgatcaatatggtcaggaggatcttgtcagtgcatttctgaaacagcaagaaagcattggaacttctgaaaatgagtttgactttgatggatattccttagacaacattccggtttag

SEQ ID NO: 6789 - DNA, 1845 bp, Glycine max
  Peptide Sequence Number=SeqID_123567
atggcaaagttcacttcacaagaagttgatgctcttcaaaatggaggtaaccagcgtgcaagggaaatatatttgaaaaattgggacttccagagacagcggttgccagataacagccctggaattcatgaagatgagattaggcgtgccagttcttatcattcatattctcaaagtcctccgtatgattatcaatatgaggataggcggtatggaaaacaagcagctgcactgaccaggaagcctggttcagataaagctcgctatgaagggaagatgtctagtattatctacagtcctggccgcttcagtgatcacgcgtatgatgacagatttgcgaatgagggatctggtccaagaatttctgacttttctgtgtctagtggtggtgaacaattcaaatccgatgttcagtctcccaattttcataaggatatcaagattagaagtccatcctatcagcagcgttctggttctggttctagttcaagtgaagatgtgtggtatcaagcaagaaatgcatctttggaaactaatgccaatgccaagagagatgcagatggaattcgtcctccacagagaactgtgtcagcacaatcaagagacaacaaatttccatccttgagatcttataattctggcagtttagttgattttttctcagaaccagtccaagcttcagaaccacttcagaataaagcatttggcattcccagaccacctggtcctacaagatctgttagcatggacctctccaaggcaccactggaatcagcttcatctgttgatctttttcagttaccagcagcaccatctcaagctccaacattggatttgtttcaatcatctctttcatcggcagatccatctttcaacgagaatcaacttagtcaaacatcccatcttgcatctattgattttttttccgatttttctccgcagccttctactgtaacctcagatgggaaggcactggaattatctgtccctaaaaatgaaggatgggcaacttttgatatgcctcagagaacctcctctactgcacaagtggaaattccaaccactgtaccctcaaatgctaaatctttagaagaaaaatttgatccattttctacctcaaatgcaaacatgcaatggccatcttttgatatgcctcaaagcacctcctctactgcacaagtggaaattccagccactgcaccctcaagtgctaaatctttacacgaaacatttgatccattttcaagctcaaatgcaaacaggcaatggccatcttttgaaatttctagtgtcagtgtaccttcttcagttacatctaatttatggcatgatggtgtgtggaatggagaagaacaagtttctgctatggcagcaaacactcaaccatggaatgcatttgaagattctggtggccatcatcctgtggattcccttagtcaaggattacaattgcacaattttccatcagctgataatcatattttgggtttaagagagtctgagggatccaatgaagatggagttaaaggctttgcccctgttggtggatttgataatcatgacatcccatctcatgtcagttgctcagcatatcccccacccatgcttcctccaatgggagatattcaacctaatcaaatgaaatctaaatcaactaatccatttgattatccctatgaatctgatgtagatcacaacaatatgtttcttgatatgagctctttgcaagctgcactgccagatgccctgtttccagccaccttccatggtgggatagctgaatcttggcttcctcaaaacacggtgaccccatatatatcatctgctggagaaggtattgcttga

SEQ ID NO: 6790 - DNA, 162 bp, Glycine max
  Peptide Sequence Number=SeqID_123568
atgaactcttggggtggtgatggccaagtcattaacacatttaaggaaatgaaaaggtgggatagtgatagcaattcagcaacagaacaccacataggccacattgcagaagctactaacaggccaagaagagtgagtaagaagcccacttacttgctttga

SEQ ID NO: 6791 - DNA, 463 bp, Glycine max
  Peptide Sequence Number=SeqID_123569
atggggattagtgttaggagcacgtacaagcttataatggagaagtttgttgaccaacccagtttgtgtagagaaggggattggaacttgatttggaagcttcatatcccacctcgggtgaatgagggttgttgggagaagcttaaccacaagcagcgtgttgatgattttgtgctcgaggttgatagccccatttttaagcttttgcagggtttgagagatcaacaaagaaggagagtagccatgcttctgtggagcatctggcgtcgacgaaatgagaagttatggaacaaccaagctgagttagatgttgctgctattcaaaggggtgatgacactactacaaaatggagctcgtgctgtgagtacgtgagagagcctgtgcctgtgacctgtgtggcatctcccagaagtgtagctgctgtgacccgccatggtcttcgcagcttaggtcatcgtaccg

SEQ ID NO: 6792 - DNA, 419 bp, Glycine max
  Peptide Sequence Number=SeqID_123570
gaggaactaaggacaacataccattccttagaagtgcatcaaattcatcagttatggcttttctccatgagtgggtggttggatgttatgagcaggtgttcgggtttgaagatgttgttcttagatctgtatggagtgggttatgtgttggagtgagagggatagtgatatgtaaaggcatagatagccatattgggacgttgcatatcctacaaatatgcatggctgatattttggttgaagtttgttggatgcatagggatgcaatcatgggaaacataagcaaccaaaggagtaaagtaagtggcagtgcagaaggcaaatgcccagaattggggggggtggagaagaccccaaacatcggtgtagataagctcaagaggttgcttgcttttgatactggatgtagaaaaaggtag

SEQ ID NO: 6793 - DNA, 552 bp, Glycine max
  Peptide Sequence Number=SeqID_123571
atgggaaccagagtgtggtgttgtttcgtgatgttcctctctctcaatgctcttgcaatagcattggaagatcacaaccttaaaacgacgtcgaaggatgacatcaagtgcactccttgcggtcaaattccctcgccgcctccaccctctccgccgccgccagctccgaccactacctactgccctccgccgccatcgcctccaagctccggcggtggtggtgcttactattactccccgccgccaccctctcagtacacctactcctcgccgccgccgccggcgtccaccagcggaggcggtggcggtggcgcgtactactacccaccgccgagagggtactacccaacgccgcctcctcccaacccaattgtgccctatttcccgttttactaccatacccctccgctgtcgtccacggcggcgcctccgccggtgaaaggctcgttggaaattgaaggtgttggcatgtggttgataatgatactaatgatggatacggtgactgttggaagagtcactcagaagaatttgcttacaattcttagttag

SEQ ID NO: 6794 - DNA, 2256 bp, Glycine max
  Peptide Sequence Number=SeqID_123572
atggctgacggaacccgacttagcaaaatcgagaatgagttatctcgtatcgaggcacaaaactcgagtttccaagagcgcatggaagcacaaatgacccaactcatgtctttgttacaaaagaagaaatcagatgacgaaaaccttgacgccgagtccacgcactcgatttcgcaaagcccgccgcgttattccaccacactcatatccaccaaagattgcaagattgatcttcctaagttcgacgaaaccgatgttgatgattggatttttcgtttagaggagtattttgatgttgcacaaactcctttggagcaatgtatcaaagttgcgagttttcacatgataggaccttcctacgcttggtacaagtggatgattcataacaattacactcaagattggacgatttttgttgatgcgttatacaaacgctttggctcaaacctttacaccaacccgcaaaaaacactcaaggaattgaaacaaggcacagtgaaagaatatcaaacacaatttgaggctttttccaccagagtaaatgggttgagagaacaatggcttgccaagtgccatatcctattagcacctgatgatctggtagatgtatgccacggcctattggatgctgatgcaagtaacaatgcagccatcgagggaacgggggttccagacattagttttaacgccctatcaggagaatatagtcctcgcacgttacgactgaaagggacataccagggacatacctttaacatattggtggataatggcagttcattcaattttataaaacctgcagttgctcgtcgtttaagggttcacgtcactaatattgaaccattcaaagtttttgtcggtagcgacgattttatatggtgcaacacctgcagctatgatgttccaattttagtgcaaggcatttcttttccggttgacctccaccacttagaaatttctggtgctgatatggtttttagtttgtcatggttacaaagcttgggtcaagtgttgaccgactacaaccggttaacaatggaatttgattatcatgggactccaatcattttgcatgttgagcacttgttaagtcctaacccaatcaagaaccgtcgcattaaccatatgctccttcacgatgatatttcctcattgtgcactatgcgagtatgccagccagataaaccgactgctacttttccgctagtagttcaagaattgttgaaagaatatgctgctgtttttcaagagcctaaaggtttaccacctacaagggatatttcacatcgcattcctttgcattcaaattcaaaatcagtacagatcaaaccttataaatatcttcacttccaaaaaatagaaattgaacgtttgactattgtggccccaacaccattactgtccgtgacttgttttcgatgcctacaatcgaggagattatggatgaattgtagggtgtcatcattttcaccaaactggatttacgctcaggttatcaccaaattcgtatggaggaaagagacatacataagacagcttttcatactcataatggtcactgaatttttagtcatgccatttggacttaccaatgctccaactacttttcaggctaccatgaatcgaatttttccaccttttttacgtaactttgtgtctgtattccttgacgatattttgatctatagcaaaacttgggaggaccatcttcatcatcttcgattggttctggagacactacaaactcgttctttttttgccaagcttactaaatgtgatttttgcaaagactcagtgcattatttgggacatgtcatatccgctaaaggtgtggaggttgataactctaaaattgacattattctatcttggccattaccatacactattaagcagttacgagggtttctaggtctcactggttactatcgtcgttttgtaaaaggctatgccaccattgcttttcccttgacgaagatgttgaaacacgatagtttttattggactcccgaatctgaaacaacattcaagttactcaaccaagctctaacttcaacaccaatactcgctcttccaaattttttgctttcgtttgaagtcgagactgatgctagcactacaggaattggtgcagtgttgactcagcaaggtcgtccattggctttctttattaagaagctttcacattgcatgagcaacgcatccacttacgtgcatgaactctatgctattacgcaggctgttgcgagatggtga

SEQ ID NO: 6795 - DNA, 1632 bp, Glycine max
  Peptide Sequence Number=SeqID_123573
atgtcgctgaggccgaatgctagaaccgaggttcgccgcaaccgctacaaggtggcggtggacgccgacgagggtcgccggcggagggaggacaacatggttgagatccgcaagagcaagcgcgaagagagcctccagaagaagcgccgcgaaggcctccaagctcagcagcagttccccactcctctccaagcctcctccattgtcgagaaaaagttagagagtcttcctgcgatggtagctggagtgtggtcggatgataacagccagcaattggaagcgaccacgcagttccggaaactgctttcgattgagcgcagtcctccgattgaggaagttattcaagctggggttgtgcctcggtttgtggagtttcttgttagggaggattttcctcaactacagtttgaggctgcgtgggctctcacgaacattgcatctggaacttctgagaataccaaggtggtgattgatcatggggcggtgccgatatttgtcaaactacttagttcgcccagtgatgatgttcgggagcaggcagtatgggcgttgggaaatgttgctggtgactccccaaggtgtcgtgatcttgttcttagtcacggtgccctgatcccattgttggcccagttgaatgagcatgcaaaactttccatgttgagaaacgccacatggaccctttcaaacttctgcaggggcaagccacagcctccatttgagcaggtgagggcagcgcttcctgctctagaacgattggttttttccaatgatgaagaagtcttgacagatgcatgctgggcgctatcatatctttccgatggaacaaatgacaaaatccaagccgttattgaggctggtgtttgtcccagactggtgcagctccttctgcacccatccccttcagtgctgattcctgctcttcgcacagttggaaatattgtgacgggagatgatatgcagactcagactatcatcaatcatggtgcgctcccatgcctcttgagcctgttgacacacaatcataaaaaaagtatcaagaaagaagcatgctggaccatatcaaacattacggctggaaacagagatcagatacaggaagttacatgttctgtaacatggagatgtggtgtggctgttattgaagctggtctgattgccccccttgtcaatcttcttcaaaatgctgaatttgacataaaaaaagaagctgcttgggcaatctcaaatgctacatctggcggtacccatgagcagatcaagtatttggtgagccagggttgcatcaagcctctctgtgatctgcttgtttgccccgacccaagaattgtcactgtctgtttagaaggtcttgagaatattctgaaggttggggaagctgagaagagcttgggtaatactggagatgtcaacttgtatgctcagatgatagacgaagcagagggattagagaaaattgaaaacctgcagagtcatgacaacaatgaaatatatgaaaaggctgttaaaattcttgagacatactggttggaagacgatgatgagacactacctgcaggcgatggtgctcaacccggttttaattttggaaacaatgatcttccggttccatctggtggattcaactttagttga

SEQ ID NO: 6796 - DNA, 235 bp, Glycine max
  Peptide Sequence Number=SeqID_123574
actcaactttaagctctctaagcggtattttggagcttttcgaatcttggaatgcattggcaaggcttactcaggtccaactcctcctatgtccatcacatgtgatgatcatccaaaacaccagttacctacaccgcaggctatcatttctgaacacagtgtcccaactccagagggaaatcaataccaagttttggtcgaatgtgctaacgagtcacgcgaagaagctacttag

SEQ ID NO: 6797 - DNA, 528 bp, Glycine max
  Peptide Sequence Number=SeqID_123575
atggtttggaggtatgttaacaatgggggttacaatgtaaagagtgcctacaatcttatcatggaaaaatttgttgatcaagctagcttgtgcaaggaaggagattggagtttaataaggaaaatagatattcctcctcgggttgaggacacaagtcttatttttaaacttctccaagttctgaatgaacagcaaaggaagagggtggctatgatgttatggaggaatgaacagataggtggaacccaccttgtcatggaacgtttaaatgcaagtgtgactgacatgagagtgtgcatcatggatgaatatggaagagtagtggcgttgagaacagatcagcggaggctatgcatggcagtccaagaaggagaagccttggctcttgttgcagctatggagttcgtaatttcatcgggatataacgctgtcacttttgaaacagattgcaaatgtgttgtccacaagataagagtgttaagctttatacgagtcaagcttcaaactccacaagagacagtctcttga

SEQ ID NO: 6798 - DNA, 621 bp, Glycine max
  Peptide Sequence Number=SeqID_123576
atggacacaggcgggaaagaaaatggagccaaatcagaatgtgtttatagtggaagtgggaaagtgccattgctatgtgctgcttctgcttttgttggacttgcatttgccatggtaatggaacatgcttacatgttgatagcagtgagtaaatcatcaccttctttgcttacctgggaccctgattctccctctgccaagtccctaacatggcaggcagggtttttcttcattacaacttggatttgttttggagtagcagagattttgttgctggcagcacttaatgtagaatcaggccatctaaagaactggaccaggcaaagaacaggttgccacagcatcagagaagggctgttctctgctgctggtgtgtatgcattagccacagttttcttggctgctggtttatacctaacagcactacgtgcacaaagaatgtcagaggagctagtaaatgttcgaagggagcttctagaagcctctgccttgtatgcttctccaccaagatcacctcaaccacaatatatgtcaactgttgccagggaaaaccccacaacaagagagactcagaatgagcttctgttatctatgtttccaactccattcatcaaaagttga

SEQ ID NO: 6799 - DNA, 237 bp, Glycine max
  Peptide Sequence Number=SeqID_123577
atgatgattctaaaattggttgtggagacaagtgtgggcacagtaacaaagggaaaatgtcctatggagggtagtataaatgcaggggtgtttctgaagaagttcgtccaatttggtggacatggtgttttaagcagcgatgaggttgagttgattggaggtgagtttcacaatggcttcttcgatgcgatccatattggacttggaacaagtagactcaaccaaggagctcgataa

SEQ ID NO: 6800 - DNA, 456 bp, Glycine max
  Peptide Sequence Number=SeqID_123578
atggttaaggagaagtgtaaggaggtaagtgtttcctccaagaggttagctaagaaggaaagtcattttgcaataaagacaaacattaaagaaacttcccttcttagacaacctccacatcttctcctttgtaaaagaacacttgttagcactgccatatctcttgagcttgagattattcctcaagtcaaggagttgttggataagggtttggttcgtaagagcttaaatcattgtgctttgttggtgcccaaaataggtattatgaggcaccaaatccctatgataggtgaagctttccagttgtgtggagtccacctcagtggtcctcttgctatgctatcctaccccgcaaaggcattggatagaagactccaaatagattgggtcagagatccaagggaaggccctagggttctcatgagccttagggaagattttgagcccatgggctaa

SEQ ID NO: 6801 - DNA, 411 bp, Glycine max
  Peptide Sequence Number=SeqID_123579
atgggggtgcaaatagcaaccaggcccacttgggccctccagaagattcctccagaaggctgttgcttctggaggaagcaaccctgctcgcctgggcgagctgggtttcgaccgttcgtcgacgttcttcattcgttcttcatcgttcttcgatcttcaacgggaagagtcgatcctgaccgtgataagatagatatcgaatacttcttcaacattctagagcttgagaagaaagggttaagattgaacaagaaccttgaactctatggcatacgggcatatttcgatgatcctcaaaaagggttaaggttcatattgttgaatccacttccttgggcattggatagaagactccaagaaaattgggccagagatgtaggagaagatcctagggttctcatgagccttggg

SEQ ID NO: 6802 - DNA, 162 bp, Glycine max
  Peptide Sequence Number=SeqID_123580
ctcagctcatcagttgggcttagcgcgatagaagaatctgatagagcatcaacatcaagaccgcgcgctaagcgtgagatcaatgcgctaagcgcaacggttgtcttcaatgaggctcagcgcatgactggcgctaagctcaaatccacttattcgcgctaa

SEQ ID NO: 6803 - DNA, 333 bp, Glycine max
  Peptide Sequence Number=SeqID_123581
gttcaaacagttaaacagggttatctgttaaaacgatcatcaagctcacgtggagattggaaacggaggttctttgtacttgataaccaagggaatttatattattacagagtgaagggtgtcaaacccatggctgaaaatgaagctgataggatggactgggtaaacaaaattactggagctatcacatcgctttttaattctcagtttcttcaacagcctcaatttggtagagtgcattcccagaatagaaactcagcaactggtgcttctttggcaagtcaatcagaggatagtcagaaatcattgagggatgacgtatattccaaggaa

SEQ ID NO: 6804 - DNA, 183 bp, Glycine max
  Peptide Sequence Number=SeqID_123582
atgctcaatggaacgccccagggcttctccgtgacaagcacacattacgttcgagtcgtatcctcgaaaaaatggagattgaggaaacctagcaggggttatggctaccattgcattatcgagtggatatgggagcaagtggtgttcgtcattggaagtgcggtaggtaggctttgtggttga

SEQ ID NO: 6805 - DNA, 585 bp, Glycine max
  Peptide Sequence Number=SeqID_123583
atgtcagtttatgttgcgcttaccgagaagggcattccctttaccgtcaggcgcgttgacctgtcgcgcaatgcacagcttgacgaggaataccgcggcctgtcgctgacctgccgtgtgcccacgctgcaaattgatgatgtcagcctgaatgaatcctcggccatcgccgaatatctcgaagagcgttttccggcgccggagtttgagcgcctctatccgcgcgatcgcgaaaaacgtgctcacgcgcgcgaagtgcaggcgtggctgcgcagcgatttactggcgctgcgcacggagcgacccactgaagtgctgtttgctgctgaacgctttgctccgctcacgcccgctggcgaacaggccgccagtaaactgattgccgcggtgcagcgcctgctgccggacggccagcagaacctgtttggcgagtggtcgattgccgacaccgacctggcggtgatgattaaccggctggcgctgcacggcgatccgctgccggtgaagctgcagcactatgcagaattccagtggcagcgcgcctcggtgcagctgtggctggccgagtcgggtaaagcacgctaa

SEQ ID NO: 6806 - DNA, 222 bp, Glycine max
  Peptide Sequence Number=SeqID_123584
atgcatctacgtgatcaaggatctcataaccactcacaaactcatctcaagctctcagaacggtttccgcttcaatctctggtctctgcagatcttcacacagcaaaatctctcaaaactctctggaactgggacctttctctctctagaatcactagacatgcaaagcttcagctctcagcccaaactcccttcacaaaatctgatttcaggcttaaatag

SEQ ID NO: 6807 - DNA, 465 bp, Glycine max
  Peptide Sequence Number=SeqID_123585
atggggaactgtgcgttcaaagggattagcacaagtgagggagtttctaatgacaagatggtgaaggtgcttaccccaaacggaggcatcatggagctgtacacccccataaccgcggagtgcataaccaacgagttctccggccacggaatattccgaagccgccgagacttgttctcggagccgctgcaccactacgaggagcttcatgcgggggagctctactaccttctccctctcgacccttcttgtagtgtttccaagggagggagtgtggaaggtgaagctggtgataagcccggagcagctgttggagattttgtcgcaggagtcgcggacggaggccttcgtagagagcttgaggacggtggcaaagtgcggcaatggggtgccgtcggcggcgagttccgatcactccagtggtggataccaccagttggaagggcactgtggctccgaatcaag

SEQ ID NO: 6808 - DNA, 732 bp, Glycine max
  Peptide Sequence Number=SeqID_123586
atgcacaagaaggtcgtatatgtaaaaatatgggcgaaagaaagtaacccacgtgagaaagggccattttctgaatgcgctctatctatctcttccgatctggctactaaccctaacccgcttcgaaccgtggcttcctcggcctcgcagaacctctctcgaagaaaatcttcttcttcgtcttcgttttctcaacaaacttccgggtcgacccggatcgtttaccgcgaacctcggatcccatcggaatccaattttccgatctggcagcagaactggttcatcgcattgctcttcctcatggctctcggattcttcgccctcgctctcttcctcttcatcactttcgactctgacatcgctccttcttccaccgcatccgccgcttcctccgaaggcgtcgaggtgcaggttacttacggcacggttctgaagcttatgcacgagaagaccaaatttcggttgcattctcatgacgtgccctacggttctggcagtggacaacaatcggttactggtttccccagtgttgacgattccaatagttattggattgtaagacctgagccaggaacttctgctaaacaaggtgaccccattaaaagtggcacaatcattagattgcagcacatgaggacaaggaagtggctgcacagccacttgcatgcatccccgatatcaggcaatcttgagtacagtttccgccttttctatgtattgattgatgcttga

SEQ ID NO: 6809 - DNA, 3807 bp, Glycine max
  Peptide Sequence Number=SeqID_123587
ggatcttgcgatggggacaaggtttgatgtggagaagttcacaggggaaaatgatttcaacctgtggaggatcaagatgcaagctcttcttgttcatcaagggcttgatgatgcactacaaggagcctccaagcttccatctacactgtcagacaaagagaagaaagatttgctcagtaaagctcacagcataatcattctttctcttggtgatgaggttcttcaagaggtagctgaggagaaatctgcagcagggatttggctgaaacttgagagcttgtatatgaccaaatccctaactaacaagttgtacctgaagaaaagactacatcagctgaagatggaagaaggttcttcaatcaaagaacatgtttctttgttcacaaaggcagttcttgatctgaaaagtgtagatgtgaggatagacaaggaagatcaagcagtaatgttattatgttctcttccatcatcctttgaaaatttggtggacactatgctttttgggagagatacactcaccttggaggaggcattgatggctagaggaagatcagaaaagagggattcaaagagcaagaacaagaggaggtccaaatccaagaacaagaaggcctgctactactgcaagaaagagggtcatttcagaaaagaatgccctgaaaggaagaagaagaacaatggtaaatacaatgatgaatctgatatagcagtggtggctgatggatatgaaagtgttgaagtgctctccatctcaactgaaaagcacagtgaggaatggattctagactcaagttgctcattccatatgacacccaatctggaatggttcagctcctataaggagatagatggagggaaggttctcatgggaaacaatatggcatgtaatgtcattggcattggaactattaaattgaaaatgcaagatggatctgtaaagttgctccctgatgtgaggcatgttcctgagcttaaaaggaacttgctctctttgggaatgctagatcaatctggatgttcattcaaaggagaaggtggaactttaaaggtattcaaaggttcattacaaataatgaagggtacaaggcagaatggcctttacaaactgcaaggtaacactatcttgaactcagctggcctagtttctatctctgaaccaaatgcttccaaactttggcattatagattaggtcatgtgagtgagaaagggctagaagaactacataaacaaggattgatcggtaatgggaattatcaaaagctaagtttttgtgaacattgtgtatatggaaaacaaaagagagttagtttccataatgcaactcacgcaactcagggtatcctagattatgtacactctgatgtttgggggccagctagggtaccttcattaggaggagcaaaatatttcataactttcattgatgattggtctaggaaagtctggacttatttgttgaaacataaaaatcaagcttttaagtgtttcaaacaatggaaaatgcttgtggagaatcaaactggtaggcatgtgaagctgctcagaactgataatggccttgaatacttaagtgaggaattcaatgaattttgcaaaaacaatggaataagaaggcacaaaactgttagattgacccctcagcaaaatggccttgctgaaaggatgaacaggaccattttggagagggtgagatgtatgttgtccaatgcaaaattggcaaagagtttttggggagaggctgtgaatacaacatgttatctaataaacagatgtccttcaagtgcaattgaattcaaaacaccagaggaaagatggacaggaaaagctccaagctatgaaaacttaagaatttttggatgcattgtatatgttcattctaatgaaggcaaacttgaacctagagctaagaagggaatcttcttaggttatccggaaggagtgaagggatataaagtgtggttattggatcctgcaggtcccaaatctattatcagcagggatgtcttatttagagaagaagacatgatagtagattatcaacagaagtctgatttagttcaaaagggtgttcaagctgagcaaaatagacaccctgatcaaggaattaggttggaggtggagaagcttgcacaaacatcaagtccagtagaggatagaaatgaaacatctcgtgatgaacctatgatttcatcaattcctgaacctgttgatacttcatataacctggtcagagacagacaaaaaaggcagattaaagctcctgtaagattgggttatgctgatctcatagcttatgctttgacaatgcaagatgagtttgactctttaatgaagaatgatacttggaaacttgttgaaaagccagcaaagcagaaagttgtagggtgtaaatggattttcaaaaggaaaccagaagaaacaggaatggatagctacagatacaaagcaaggcttgtggctaggggtttcacacaaagagaaggaattgactataatgagattttttctccagttgtgaagcatacaagcatcaaaatcatcttggcactagttgcagttcacaaccttgaattggagcaaatgaatgtaaaaacaacttttttacatgggaatctagaagaaacaatctatatgagtcaacctgaaggatatgaggtaaaagggaaagaggagatgatggtatgtttgctgaagaaatctctgtatggactgaaacagtccccaaggcagtggtacaaaagatttgactcttttgtagtgtcaaatggtttcagcagaagttcctatgacagttgtgtctacttcaaaaggttgaagcctgattgttttatctacttattgctctatgtagatgacatgttgattgcaagtgcagatatggaagccatcaaagaattgaagaatctgttgcaatccgagtttgaaatgaaggatttaggggctgcaaggagaatactgggaatggatattatcaggaaaagaaatgaaggtctgttatatctatctcagtcaagctatgtgcagaaactattgagaaggttcaatatgcttgattcaaaacctgtatcaacacctattgctggacattttaaattgtcaatcactcattctccacaaacagaagatgaaatcaaagatatgagtagaatcccctactcgaatgctacaggttcacttatgtacgctatggtctgtacaagaccagatttagcatactccgctagcattgtaagtagattcatggcaaatcctggaaaacaacactggagtgccgtaaagtggatcttaagatatctaaagggttcaaagtctgttggtctggtctatggaagaaattcagaaggaatcaatggtctgtcaggctatgttgatgctgattatgcaggtgacattgacaaaagaaggtccttaacaggatacttattcactttgtatggaagtgtcataagttggaaggctaatttgcaatcagttgtggctctatctaccactgaggcagagtatatagctctcactgaagctataaaggaagccatatggcttaaaggtcttgttcatgagctcgaaggaaagactggtcctgttgaagtatggtgtgatagtcaaagcgcaattgatctctctaaaaaccaagtttttcatgagaggacaaagcatattgacattaggatgcattacatccgagacatcatagcacaaggtgaagttgaagtgagaaaagtggctggagcaaacaatcctggagacattctctgtaagagactggaggaaagagagcttgctggtcctaatattgaagatccaag

SEQ ID NO: 6810 - DNA, 789 bp, Glycine max
  misc_feature (201)..(201): n is a, c, g, or t
  Peptide Sequence Number=SeqID_123588
atggagatgagcatatgtgtgaatggagaatcccaagtccctccaggcttccggtttcatccaaccgaagaggaactgttgcagtactatttgaggaagaagatgtccaacgagaagatcgacctcgacgtgattcgcgatgttgatctcaacaggctcgaaccatgggacatacaagagatgtgcaaaataggaagcagnccacaaaacgattggtacttgttcagccacaagtacaagaagtaccccacgggaagccgcacaaaccgcgccaccagtgttgggttctggaaggccacggggcgcgacaaggtcatatatagcaacgggaagataattggaatgagaaaaacattggttttctacaaagggcgtgcccccaatggccaaaagtctgattggatcatgcatgaatacaggctagacgacattaataacaccaatgagatggaacacgggtgggtggtctgtagagttttcaagaagaagaacgtccctctcaaaacactagatagcccaaaatccatgaccatgaatatggtcacagaaagcgactactgtggtggcttcactagctgggaatcccttgatcagcttgtggcatcacaactgaatggacaaactgagacatattgcagtgatttgcaattccccgcatttctatcatcctcatacattgctacaacaacaacaacaacaacacacattgctcccacaatacaggattaccccagctacgacattgacctgtggaaccactgtgcttcgtgtccaacactccaaatgtaa

SEQ ID NO: 6811 - DNA, 405 bp, Glycine max
  Peptide Sequence Number=SeqID_123589
atgttcggcaccgtcgagcacgacgaaattcgacgcgcttatcgtaagatggatctgtggtatcctgataggtggatcaaggacccaaagcttgcactagaagctaaaaagagatttcagcgcgttcaagaggcttattcagttttgtccaataaagggaagagaaggatatatgatgctggcttgtttggtctgattggagaggacgatgatgagggatttgttgatttcatgcaagaaatggcctcgacgatgcagaaagtgagacccaaggatgagaaaggcatgttggaggatcttcaaggattgttaatggttatgatggcagataatgaaggaatgggaaagtctgggttaagctggaattcatctccatgtcctacaaaaaggacacgtatcttgtga

SEQ ID NO: 6812 - DNA, 480 bp, Glycine max
  Peptide Sequence Number=SeqID_123590
ttggtggaatctgttttaaacaaggttgtagaggagtttgagcaacgaattgcaagccaaggtgaacagacaaaagtaacttcaagagatcccgtttctcagagcaacgggtctgctatggcagataaaaagggggagaagaagattcatgtggtaacgaaaaaagaggattgcattaataaaaatgaagttgctactatggtaacacaaaggcaacttatgaagcagcaaatgctcttcgaccagcagcaaagagaaattcaggagctaaggcatagtcttcactccacaaaagatggtatgcagttcatgcaaatgaaatttcacgaagacttctccaatcttggcacgcacattcatggcttagctaatgctgcttctggatatcatagagttcttgaagaaaatcgcaaactatacaatcaagtccaggatcttaaggaaaaagaagaaataaacaatttaatcgatgctctttaa

SEQ ID NO: 6813 - DNA, 1485 bp, Glycine max
  Peptide Sequence Number=SeqID_123591
atgaaaacaagttttaatcaggatgcactatcgactatttatacatattatagaacacacatagcattgattgtgctgcccttaactattgatacattagaaattcgaagtagttcacaaaaaggactcagcgtgccagatgcaagccttgtccctgtatcatctactattgatgttattgaactaatgaaccttggtcaaaggaaccgtgctgttggagcaacagcccttaatgaccgcagtagccgatctcatagttgcttgactgttcatgttcaaggaagagatttggcatctggagcaatccttcgtggatgcatgcatttggttgacttggcaggaagtgagagagtggataagtctgaggctacaggagatagacttaaagaagcacagcatattaacaaatctctttcagctttgggagatgtcattgcttcccttgctcagaaaaactctcacgtaccttacagaaatagtaaactcacacaactactccaagattcacttggaggacaggctaagacactaatgtttgttcacataagtccagagagtgatgctattggagaaacaattagtaccttaaaatttgctgaaagagttgccacagttgaacttggtgctgctcgagtaaacaaagatagtgcagatgttaaagaactcaaagaacagattgccagcctcaaggcagcactggcaagaaaggaaggagaatcagaacattcttttttgggcagctctgaaaaacatagaacaaaggctagtgagctatcaccttatcatataaaccagcgaggtcctgacgctgtggatcagcttggatgccggcaaccaatggttgaggttggcaacatagaacttcggagtaataccacagtgaggctcaaaactcagagctttgattttgatgagatatcagcaaattcaccatcatggcccccagtgaacaatagtcttgcacaaaactatggggaggatgacaaagaatctggtggttctggagaatgggttgataaggtcatggtcaacaagcaagatgtaaacaaaactgagaacctcttgggatgttggcaagcagcaagcaatgggaacttatctgaggccttttatcagaaatacctcaaagattctcccaaaatgtactcagaacaatccgataatatgttcatgggagccaatcagtttaacattgccggttcagatgacatggatgagcttgatgctgcaaccagtgattcctcagaacctgacttactttggcaatttaatcattccaaacttagcagcgtgaccaatggaattggatcaaagactatgaggtctaaggcagcaaaaaacagccctgagttgagcaagagtgctgttcattcttctcctctaggtccttcaccttcattgaaaaactcaaatggtgtcccacatcgaacagggaggcatacagctccagttgacgtgaaacgtagaactgggagtagaaaataa

SEQ ID NO: 6814 - DNA, 315 bp, Glycine max
  Peptide Sequence Number=SeqID_123592
atgacatcatcatcatccaacttaacagccctttttgcttcttgccccaaagtcacatgcttgagcatggtgcggtgttgctattccattctagataggcaagtgtttgggtcttttagaaaacattcttattcaggtccattcaatcaacaacaccatcacaatgatggcatgaggcatcattcaattaggcttgtttcaaaggagcagtctatagcgattgacgcttgcgaaaagcttcaaggagtatattcccttggcttggtcacggggagaagcaacaattttgtggtctttgcctttgaaaccatttag

SEQ ID NO: 6815 - DNA, 297 bp, Glycine max
  Peptide Sequence Number=SeqID_123593
atggttgagttggttcagtctgagaaggcacattatgccggtagggatcccatctctgcactgaagaaatacatgattgagaacaaattagccagtgaacaagagttgaagaccatagataagaagatagaggaggttgttgaggatgctgttgagtttgcagatgagagccctcatccaccccgcagccagcttctagagaatgtctttgctgatccaaaaggttttggaattggacctgacggcaagtacagatgtgaggacccaaaattcacggaaggcacggcgcatgtctaa

SEQ ID NO: 6816 - DNA, 264 bp, Glycine max
  Peptide Sequence Number=SeqID_123594
atggaatcagaatggcaaaaggtcttcttctcttacttggaattatttgggttggttcagcaaaggcactggggtggggagtccatgtttgtgagtttgaacgcagggcacttggagcagcaaagtaaggcatcgtccagaaagtgctatgcttttctaaagccaaagatgtggttggtctcaattaagaacaggataagtgacaagcggtttttcttagaaattcgaatgggtccacagcttatgatcgagatgatcaaataa

SEQ ID NO: 6817 - DNA, 1278 bp, Glycine max
  Peptide Sequence Number=SeqID_123595
atggacgaaaatactctagaaattgggcgggcttacttaagcaagaagaagcttccgaatcagaccctgttctggccaaagaaatcttggacttactccagctacctcatcctccttctcaagttgggtcgctccaaacacttcactttcctcgacggtctcctccgtcccctcaagtccgattctcaccccatcactcccaccctcttcacttacctattcaaagtctaccccgaagccgatttgcccgacaaagccctcaaaaccttctacaccattctccactttaattgcaagcctctccccaaacaccttaaccgcattctcgaggttctcgtctcccaccgcaactaccttcgtcccgccttcgatctcttcaaggactctcgcagctacggcgtggagcccgacaccaagtcctgcaacattctcatgcgccccttctgtctcaacggggacattagcattgcctactctctgttcaacataatgtttaaacgagatgttgttccggatatcgagtcttaccggattttgatgcaggccttgtgtaggaagagtcgggtgaatggagctgttgatcttttggaggatatgttgaacgggtttgttccggattctttgacttacaccactttgttgaatagtttgtgtaggaagaagaagttcagggaagcttacaagcttctttgtaggatgaaggtcaaaggagatgggcgtactcatgatgcttgcaaggttatttctgacatgcgggccaatgggagtttgcccaatctcgtgtcttatcgtactttggtgagtggtttgtgtaacatgggaatgcttgatgaggctagtaagtatatggaggaaatgctgtccaaagatttttctcctcattttgctgttgttcatgccttggtgaaggggttttgtaatgttggtaggacagaggatgcttgtggagttctcaccaaggcactagagcatggggaggctcctcatgtggatacttggatgatcataatgcctgtaatatgtgaagtggatgatgaggggaaaagcagtggtgctttggaggaagttctcaagattgaaataaaagggcatactagaattgtggatgctggcattggtttggagaactacttgattgggaagatacgatccaggcggtttgaggcagtgaagacaaactggattggtttggttgtaaatgctaacgctttagtctggtatgtctgtcgtgtgtggaggaggactatggcaagcagagccagattggaagttgtttga

SEQ ID NO: 6818 - DNA, 738 bp, Glycine max
  Peptide Sequence Number=SeqID_123596
atggcggcagaggcggcgttgttcttttctgtggcatcagtggtggaggacgtgcttcagcagcacggtcctcgcctcaaagatcttgatttggaatctaggaaagctgaagaagctgcatcaagaagatatgaagcggcggggtggttgagaaaaatggttggagttgtagcagccaaagatttaccagcagagccctctgaggaagagtttaggcttggtttgagaagtgggattattctctgtaatgttattaataaagttcaatccggggctgttcccaagtgtattcttctttttaaggttgtggagagtcctgttgattctgcattgatccctgatggggcaccattaaccgcatatcagtattttgaaaacgtgaggaattttctggtagctgtccaagaaattggaattcctacctttgaggcatctgatctggaacaaggaggaaaatcatctaggattgtcaattgcgtgttggccctgaaatcttacagtgaatggaaaatgagcgggtcaaatggtgtgtggaaatttggtggaaatctcaaacccactgtgacttcaaaatcttttgtgagaaaaaattcggatccatttactaattccttgtcaaggacttcgtcgctcaatgataaatctattgctgcttttaattctgacgtcgagtctattaaaatggtagtctggttcccactctttgagtatgcttgttcgggcaattttatcggataa

SEQ ID NO: 6819 - DNA, 513 bp, Glycine max
  Peptide Sequence Number=SeqID_123597
atggtgtcgctgttcaagggctgtgactaccatcattggctcgtcgtcatccatgagtccgccggcaaaggctgcaccaagccacaaatgattgattgctacattcaaaccctcgccaaggttcttggaagttcaagttccccccctctagttcttccaaattcaagatttgttctgagatttttgttgtttccgtttttatcaagtttttgtttccatggttttggaggtagaagaataggaaaagaatgtgttgatgtcgcggtgggttcttacatggtgttgtcaaaggagtctacagggtgttgtgaattggggcatgatgcaggggttatttatttggtaatcaaatccgcttcaggaagtcttataacaagatgggaagggcttgagtattatgatcagagatgggtagaggtgaacttgcaaggagcttctaatgtatatggcggctgctatgactgggaaggggtttttaataaaaaaaatcctacaatttgtagtgatctttaa

SEQ ID NO: 6820 - DNA, 258 bp, Glycine max
  Peptide Sequence Number=SeqID_123598
atggcgagtacgtccagtctccggcacggtcggagaggcaccggacgacaacaaagggggcagtggagggagaacaatggaaggaagaataggacgaagcgggcaacacgcgccaccgccacagaccaccaccatcaacctttcgcccacaagagtaacagcagagaagccacatgccgaaaaagggagcacatgttggatgagccattaggagtaactaacgagggagtgacacgtgttgtgcaacccaccacatag

SEQ ID NO: 6821 - DNA, 2094 bp, Glycine max
  Peptide Sequence Number=SeqID_123599
atggaacttccacatcagtttcttctacttgccattgccgccgattcaactacgctggttcaacacgagaagaccaaatgcagtgaaaaacaaaacccttacttctactggaaagtaccgattgcgtcaatcaacattggaggggtgacgaagaacgacaaccaccaccactgggagagcgatgattggcgtggacctagcacaggaacgttatccttcaaccataggagggagaaaatgttggagaaagaggcctttgtaaagggtgttccaattggacaggctcttgatatagacattccccctccacggcccaaaagaaagccaaacaatccttatcctcggaagaccaggattggtaccacatcattacatagtggagcaaaggatggaaaactcaatttagttgaatcttcacatgttaatcaagcactggacttgaaaaaagaaccacttccagagaaacatgatttagacgaagggctaacaactgtaaaagaaaataaggatgagaaccacgcaaaagtatttactcttctccaggaggtaccctgttcctctgtatcttcagcaaatgagagttcaataacaatgtctgtgccactgggaaatccatgtgccttcaaggagattacaccttccgtgaaagaggtaatagcacgagatgaaaaaactgaatcttttgtcactgttgaacctgaaaatgggaagttggagatcaatgatggaaaacagactaatggcactagtaaagactccaggttagaggattctgatgctttacatatgaaattggttcaaaatgagaaaccagatggtcttgattgtgaattaacaatagatgggatgcaaggcaatcagaattaccctaggcatgttactgtgcacgttgttgatgggaaccttggaacaaatactcaaaatccatcacaagatatgttgtttcgagattccatgtttcagccaataggaggggttaacgggcaacgaaatgtttttaccaatacagctccatcgaacacaagtgaaagtcaaaataacactgcacgatcttctgttcatcaatcatttcttccttatcctcccttcacacaacacaaccaagacgattaccaatcatttcttcacatgtcttcaacattttcaaatcttattgtctctaccttgatgcaaaacccagcagctcatgctgctgcaagtttcgctgctacattttggccgtatgcaaatccagaaacttcagcaaattctcctaggtgctcccaaggaggttttacaaatagacaaattggttcccctccaagcgttgcagctattgcagctgctactgtagcagctgcaactgcatggtgggcagctcatggattgcttcctttgtgtgctcctcttcatacttcttttgcctgtcctgcatcagtgactacagttccatcaatgaataccggtgaagcaccggctctgaaggcagagcaagaaaaaactactctacaaaatcctcctcttcaagatcagatgctggatccagaatactcggaagctcaacaagctcaacattcagcttcaaagtcaccagctgccattttatcagattctgagagtggagatgccaagttaaatacttcatcaaaggttactgatcatgagacgaacaaaacaatttctgagcaccttgattccaacaaaacaaagggaagaaaaccggttgaccgttcctcatgtggttccaacacggcctctagcagcgatgtggaaactgatgcactagagaagggtgagaaagggaaggaagagcctgaaatacctgatgctaaccaattagccattgagtttagtaatcgtcgtagaagcgttagcaaccttactgattcttggaaagaggtttctgaagaggggagactggcctttcaggctctgttctccagagaggtgttgcctcaaagcttttcacctcctcatgctttgaagaatacggatcatcaaatggacaacgccaatgataacaagcaaaacatagatgacaaagatgaagatcttgacggcagcaagaaatgcagttctaattatgaagcgatgcagaaaaacctgctattgtag

SEQ ID NO: 6822 - DNA, 399 bp, Glycine max
  Peptide Sequence Number=SeqID_123600
atgagggggagcgacttcaactacaaggaacagaagcaagcacagccaactgttcaacagctgctaagtgtgcaagggattgtgacaagtggcatcaatttagtggttaatgcacttttcctgaatcctttaatattgttttttggggccttctcccctcaactgaaatctcatccacaaactccgacgccattgttttcagtccgtaaaagcgccgccagctgtcatacgtggggccctcaagttgcgcggcaacggcttcgtccaatcacaccgccgcacggagcgtctctcttcacggttcgttacttgctgtgcgttccatggctcaatttagatttgtttctcgatgataataatctaagcaccagacatacaattgtaacactttttgtttaa

SEQ ID NO: 6823 - DNA, 693 bp, Glycine max
  Peptide Sequence Number=SeqID_123601
atggttccagagggtgtgattgaaaagatgatgaaggtgtcaagggagtttttcggtttaccagagagtgagagattaaagagttactccaacgatccattcaaggcaagcaggggacttcttgagacttcactgtcaccctatcgaagattacataaaggaatggccctccaaccctccatctttcagatgataagcaatgacaagtataagagtgttctgcatcgagctttggtcaattgcaagaaggagagggtgtccattccatcatatgatactactagaatgtctgggacaggggactttccaaacaaacttgcctcgatatcttcaaggcctaatactgctatcagacctggcttccactgtgaagcatcaggccactcatcgatctccaaggccttcatggccccagtcactctcacatcatccaaaacattagccaagcttgccaaagttatggattttttcaggtatgtaaacttgatgacttattacaccatgatgaacagagaagatgttgcagaatacagcatgaagatgagagaattagcgttgaaattggtggaggcaatttctgaaagcttaggtgagaaggcagttgggaagcatggacagcacatggcaatgaactactaccctccgtgtccagagccagagctgagacgtcatcaccatactccttcaagatga

SEQ ID NO: 6824 - DNA, 163 bp, Glycine max
  Peptide Sequence Number=SeqID_123602
atggttattacaaccttcaacggaaccggcgttggatttggtacgctggtttgggtttcacgatttctgcatattcggaatctcgattccctctcacacgctaaattttctttttcaggtttcggcgtaggttgcggtttcggtataggatggggtttcggag

SEQ ID NO: 6825 - DNA, 162 bp, Glycine max
  Peptide Sequence Number=SeqID_123603
atgaagcatgtaaggattaacagaaacttcatcaaatcagatattgaaaatggtatgccattgaacttattgggtcttggtgcagtatttaatggctatgactatgacatactgtatgaagtgtgttgccttcccccccacaccaaaaatcctactagttga

SEQ ID NO: 6826 - DNA, 366 bp, Glycine max
  Peptide Sequence Number=SeqID_123604
atggaagatgagactttgagtcttggcctctccactgcctccagaagctaccaatccaggctcaagtcacacttcgcagagctattcatcgattttgatgaggtcaatggggacgaggagttgaggacggcttatccatgccctttttgcactgaggattttgatcttcttgagctatgttgccatattgacttggaccatcctgtagaagccaagtctgggacaaaaacacaccagttggactactttagggagatttcaagtaaccaccatgaacttttaaatccatcaattatgcagccccctccccaccctcaaactatgaaaagtaaaccggatccgtcaaacagttcctggttatcatga

SEQ ID NO: 6827 - DNA, 921 bp, Glycine max
  Peptide Sequence Number=SeqID_123605
atggcgacgagaaatcgaacaatagaatttagaaaacacagagacgccgtgaagagcgtgcgcgctcctctatcctcctcggcatctgcctccaccggccccgtcatcgaaatggttaccacttcgcttcttcctcccaatcgatcctcctcctatgctcttctaagcacacaggaacctgctccatccacttctagcgattacctgggagatataagggatgcgtttactgtggggttgccgccatcttgggtggatgattctgaagaaatagctacgaacatacaacgtgctagggttaaaatttctgagttaaccaaagctcatgcgaaggctttgatgccatcctttggggatggcaaagaggatcagcgtcatattgagactctcacccaggaaattacgtctctcctcagaaagtctgaagtgaggctcagaagactttctgctgctgctggatcttctgaggattctaatgttaggaaaaatgtgcagcgttcccttgctacagatcttcagaacctgtcaatggatctccggcgaaaacagtcagcatatttgaaacgtttgcagcagcaacaagagggttatgatgggattgacttggagatgagctttactgggagcaaatttggatcgcaaaatgatgaattcagtgatgtggttgtcaaatcagtccatgagcttgctcaaatcatgaaggatctctctgtccttgtgatagaccagggaacaattgtggatagaattgactacaacattcagagtgtttctacatccgttgaagagggtcttaagcagttgcaaaaggtatggggatttgcttttgaagttcctttggctaaaatgattggctccttattgagaggcaaattggggatggcactgtacagcatcccttcgtgcaaacattggtattag

SEQ ID NO: 6828 - DNA, 2575 bp, Glycine max
  Peptide Sequence Number=SeqID_123606
atggtgaaaacggcatcgccctcttcttcttctccggtgaccataacggtgtcgtccggaggacgacgccgcagcatgggcctaaccagtcctattccacgcgcctccgtctccgccaacaaccccgcttcccctctcagagcttccggctgcggcggaaggcggatctccggcggcggagcgtccaaagacggcggcatcgaagaaagcaacaccgaattcgtgtcgtacaccgtccatatccctccgacgccggaccgcaggccgctgacggcatcggaggacggaaagagcggcacgagcttcatctccggcacgatcttcacgggagggtacaactccgtgacgcgcggccacgtcatggagtgctcgatggagagcgacgcgcaggcgaaaacgtcgtcgtcggtttgcggaatgaagggctgcgacgaagaagcgataaagggaaggctgtgtggtgggccgtgcgagtgcgggttcaagatctgcagagactgctacttggagtgtggtgggaagaacggtggaggaaagtgtcctgggtgcaaagagccctataagtatgtgagtgatgatgatgaagatgatgaggaagaggacgaggaccagcctcttcctctgccttccatggcggagtttaagttggataagaggctttctgttgtgaagtcgttcaaggcgcagaatcatcctcctgactttgaccacacgagatggctatttgagacgaagggaacttatggctatggaaacgccgtgtggcctaaagatgggtatggtcctaacgggttcgatccccctccggagtttggagagaaggctagaagacctttgactaggaaggttggagtttcagctgctattatcagcccttataggttgcttattctgctgcgtcttgctgccttgggtttatttcttacgtggagggttagacacccaaaccatgaagcgatttggctatgggctatgtcaattacctgtgagctttggtttgcattttcgtggattcttgatcagcttcctaagctctgtcctgtgaacagagtcactgatctctctattctgaaagggcggtttgagtctccaaacctgcgaaacccgaaagggaggtctgatcttccaggaattgacgtgtttgtttccacggcagaccctgaaaaggaacctcctcttgtcaccgccaacaccattctctcgatccttgcaattgattatccagtggagaaggtcgcgtgttacttgtctgatgatggtggagctttgttgacatttgaagcccttgctgagactgctagctttgctagaatttgggttcctttctgtagaaagcaccacatagagccgcgaaaccctgaagcatattttgggcagaagcgtgattttctcaagaacaaggtccggttggactttgtgagagagaggagaagggtgaagagggagtatgatgagttcaaagtgaggataaactccttgcctgaatccataaggagaagatctgatgcttacaatgctcatgaggagctacgagccaagaagaaacagatggaagcaggttccaatgtctctgaacccattaaagttcctaaagctacatggatgtctgatggttctcattggccaggaacttgggcttcagcagaacaagaccactcaagaggggaccacgctggtataatccaggcaatgttagctccaccaaatgcagaactagaatttggtacagaaactgatggggagaacttgattggcacaacagatgttgatattaggcttcccatgcttgtttatgtgtctcgtgagaagaggccgggatatgatcacaacaagaaagcgggagcaatgaatgctcttgttcgcaccagcgccatcatgtccaatggaccattcattctgaatctcgactgcgatcactacatctacaactccttggctatgagggaaggcatgtgctttatgcttgacaggggtggtgataggatatgctacgttcagttccctcaaaggtttgagggcattgaccctagtgaccgatacgcaaaccacaacacagtgttctttgatgtgagcatgagagctcttgatggcttgcaaggccccatgtatgtgggaacgggttgcatattcagaagaacagctctctatggatttagtcctccaagagccacagaacaccatggttggttaggcaggaggaaaatcaagttatttttgagaaagccaaaggtgtcaaaaaaggaggtggatgaagtttgtctgccaataaatggtgatcacaatgatgacgatgcagacatagagtccttgcttcttcccagaaggtttggcaactctacttctcttgctgcatccattcctgtggcggaataccagggaaggttgcttcaagatttgcaagaaaagggaacacaaggaaggtcagcaggttcccttgtcgtgcctcgcgagccattggatgcagccactgttgctgaggcaataagtgtgatatcttgtttctatgaggataaaactgaatggggcaaacgagtggggtggatatatggttcagttacagaagatgttgtcactg

SEQ ID NO: 6829 - DNA, 183 bp, Glycine max
  Peptide Sequence Number=SeqID_123607
atgaataacccaagtggactacctattccacatagtgggacaagaaagagcttactgtcatttattcagaggagtacaacaaaaagaaacataacatcatgcccttctgctggaccaaaaacagaacaaaacaaagagacacaattactcatggacacgaccacgtttgcttgcaacaggtaa

SEQ ID NO: 6830 - DNA, 669 bp, Glycine max
  Peptide Sequence Number=SeqID_123608
atgtcctgcccccatgtcactggcttagctgcccttcttaagggcattcacccagaatggagccctgcagctataaggtctgccctcatgaccactgcctacagaacctacaaaaatggccagaccataaaagatgttgccacagggttaccggctacgccatttgattatggcgccggacacgttgatccagtggctgcttttgatcctggccttgtgtatgataccaccgtggatgactacttgagcttcttctgtgccttgaactacagtccctatcaaataaagcttgttgcaagaagagactttacctgcagcaaaaggaaaaagtacagagtggaagatctcaattatccatcttttgctgttcctttcaacacagcttatggagtaaagggtggttctagcaaaccagccactgtccagtatacaaggactctaacaaatgtgggtgccgcaggaacgtataaagtttcggtgtcgcagtctccggtgaagattgtggttcaacctcaaacacttagtttcaggggacttaacgagaagaagaactacacagttacattcatgtcttcttcaaagccttctggaacaaccagctttgcttatctggaatggtcggatgggaaacataaggttactagtcccattgctttcagttggacttaa

SEQ ID NO: 6831 - DNA, 222 bp, Glycine max
  Peptide Sequence Number=SeqID_123609
atggtgccaagtacatcgaggtgtttgtcggctcaatgtagcttgcaaagaaagcgaaccaaatacaacatacatcaagtacacccactgaaagttacaaaggatctaggtgaccatttagacatgtcgtttgaggggatgaaggagtatcaagaactactgaggcaattggaaccaatgtttgaagaagagagtgacaattctttcaaggacacgtcttag

SEQ ID NO: 6832 - DNA, 2268 bp, Glycine max
  Peptide Sequence Number=SeqID_123610
atggtggtgaagatgatgaggtggcggccctggccgcctctcctctcgaagaagttccaagtgaggctgcacgtgcggaggctccagggctgcgatctgctgcagaacgctgcactccaaggttcaagattggtccttgagattcgctggaagggtcctaagttgatccttggctctctgcgatggaactccgtcgccagaaattttactaaagaggcggactttgaactcgacggcggtggcgccgccgtcgttcactgggacgaggagtttcagactatgtgcaatttgaacggttacagagacaatgtctttcacccttgggagatcgctttcactctctttaatggattgaaccagaggccaaaaaacaaggttcctgcaattggaaccgcattattaaatattgctgaatttgcatcttcaactgatcaaaaggattttgatttaaacattccactcacactaaccggaggttctggggagccttctcctttactctgtatatcaataagtttgatggagctaagcgtagctcaagaaagcttggagccagttcagagatctatagtgcctgtgccatcgccctctgccaagtcgggagaaacagccttggcagaaaaagatgagctttctgcaattaaagctggtcttaggaaagtaatgattttgacggagtttgtatctcccaagaaagcaaaaaagggttgtcgtgaggaagaaggcagtgaaggaaggtgctctaggagtgaggatggtgaatacaattatcctttggattctgagtcacttgatgattctgaggaaggtgaaacagatggggggaaggaggattccagtgttaggaagtcattcagttatggaacactggcttctgcaaatgctgggggattttttcattccaatgcgagagtaaattgtaatgatgaagactgggtttattacagccatcgcaagtctgatgttgggtgttcacagagggaggattctactgcttcttcttctcagccttatttagtacaaagttccaagcgcagcatacttccatggaggaagaggaagttgagtttcagatctcctaaagcttataagggagagccattgttaaagaaggtgtatgcagaagaaggtggtgatgacatagactttgatcgccgtcaacttagctctgatgaatccctttctttgacttggtacaagattgaggatgacacgtctgcacatcgatcatcaatctctgatttcggggatgacagttttgctgtagggagttgggagcagaaagaagtcacgagtcgtgatggtcatatgaagcttcagacacaggtcttctttgcttcaattgatcaacgcagtgaacgtgcagcaggtgagagtgcatgtacagctcttgttgctgtgattgctgactggttccaaaataattgtgatcttatgcccataaaatcacagttagatagtctaattagagaaggctcctcagaatggaggaacttatgtgaaaatgatgcctacagagagcggttccctgacaagcattttgacctggaaacagtcattcaagcaaaaatacgtccgcttactgtggctcctgggaagtcctttattggtttttttcatcctgaagggatggatgaaggcagatttgactttctgcatggtgccatgtcttttgataatatttgggatgagattagtcgtgctggacaagagtgccccagcaatggtgaacctcacatttatattgttagttggaatgatcattttttcatccttaaagttgaatatgattgttattacatcattgacactttgggagagagactttatgaagggtgcaaccaggcatatatcttgaaatttgacagcaacacaatgatgtacaaaacgccaaatgttgctcattcatcagacgacaagacatccaatgaccagcaaactgtagcagaaatattagatcctaataatagtcaaacccaacaagtaaatagcaaggaggtggattctgttgcaggggaaaaagaacagttgaggactgagcaagaagaacaagttatatgcagagggaaggaagcatgcaaagagtacattaaaagcttcctagctgcaatccctatcagagaattggaagcagatgccaagaaaggtctcatttcttcagcatccctttaccatagactgctacaaattgagtttcactacacccaactgttaggtgaaacatcaccaatggctgaactaagagaccttagctcttgcaataactaa

SEQ ID NO: 6833 - DNA, 912 bp, Glycine max
  Peptide Sequence Number=SeqID_123611
atggggcaaactataccagccttatgtaatctcaattgggcacatgattcaggtggttttgataccaaatgctacttggggtgcccttggaccacagttatttgtttgctgaatgcgaaggagacaaaatgtgccggtcatcatgattcgatacattcggctaaaagccgcgttgtcctcagattcaatgcaacaattggtatcaagagccaggttcttgaagggatcttgcgatggggacaaggtttgatgtggagaagttcacaggggaaaatgatttcagcctgtggaggatcaagatgcaagctcttcttgttcatcaagggcttgatgatgcactacaaggagcctccaagcttccatctacactgtcaagatttgctcagtaaagctcacagcacaatcattctttctcttggtgatgaggttcttcgagaggtagctgaggagaaatctgcagcagagatttggctgaaacttgagagcctgtatatgaccaaatccctaactaacaagttgtacttgaagaaaagactacatcaactgaagatggaagaagatgtgaggatagacgaggaagatcaagcagtaatgctattatattctcttccatcatcctttgaaaatttggtagacactatgctttttgggagagatacactcaccttggaggaggttaaagctaccctgaattctcgagaattaaagaaaaagataactgaaaataaaggtgaaggtggagatcccgaggcattgatggcgagaggaagatcagaaaagagggattcaaagagcaagaacaagaggaggtccaaatccaggaacaagaaggccggctactactgcaagaaagagggtcatttcagaaaagaatgccctgaaaggaagaagaagaacatggtaaatccatga

SEQ ID NO: 6834 - DNA, 765 bp, Glycine max
  Peptide Sequence Number=SeqID_123612
atggtgagaggaaggtttgtgagaaaactaaaactcgtcccaaccataaccaacttgaagaaacaagacctagttcttcagaaaaagttcccaacctcatatgatgactacaaagggaacaacctacccgagctagcggttaaggatgataatcattttgaggaggaagaagccaccgttggttccaaaaagatcacagaactcgcagaagaaaagttagtgattactaaaatgccatcgtgcaacaataatgaatacccatctctcagtgacttcaaagagttacgtccacaaggggggaatagccactcaatcattctctacacaacaagcttgagagggataaggaaaacctttcaggactgtaacacgatccgtttcttgttgaggagcttcaaaataatgtaccatgagagggacgtgtctcttcacttggagttcagagaggagttgtggaaaatcttgggagggaaagtgattcccccgaagcttttcatcaagggaaggtacattggaggagctgatgaagtggttgggttgcatgagatggggtggcttgggaagtttctagaaggaacaccaactcactctagtgattctccttgcactggctgcgccaacatgagattcactatttgttccaactgttgtggaagttgcaaagtgttcactgacaatagcgacaacaaaaacaacgatgaatgcttcgttagatgttctttgtgcaacgagaatggccttgtcaaatgccccgtttgctgctag

SEQ ID NO: 6835 - DNA, 2046 bp, Glycine max
  Peptide Sequence Number=SeqID_123613
atggctaaggaggaggctttctggtgctccatgtctattcaggtagttctggagttacaagttcatggacttccagattctgtagggggtaatgggggcaatgaaatgattttagataggtctcagacggaatgttcacatagtggctctgttataatgaatggaagcaccgacaatgtgatcccctgcatatcagcgaccaaccattttcgaggcagtagctgtagagcaattcaatctttgggcttaacaggattacagaatcttggaaatacatgttttatgaatagtgccattcagtgtttagctcataccccaaaacttgttgattttttccttggagattactgtaaagagataaattatgaaaatccgttgggaatgaatggagaacttgctctagcttttggagacttgcttagaaagctgtgggttcctggagcagcgcccattgcaccaagaacgttcaagatgaaactagctaattttgctcctcaatttagtggttatagccagcatgactctcaagaacttcttgcttttttgttggatggattgcatgaagaccttaatcgtgtaaaacgcaaaccatatcatgaagttaaggatgcagatggtcgtccagatgaagaagtggcagaagagtattggcgaaatcaccttgctcgcaatgactccatagtagttgatttgtgccaaggtcaatttcggtcgacattggtttgccctatttgcaagaaggtttcaatcacatttgacccttttatgtatctatctctgcctttaccttctactacgatacggaccatgactttgacggtcataagcactgatgggataacatcgccttccacaattacggtaacagtgcctgaaagtggaacacttaaggatcttattggggcattaagtacttcttgttctctgagagatgatgaaaccctcttggtggctgagatatacaggaataaaatttttcgagtattcgaggatccatctgatttgttagttgaaattagagatcaggacaaacttgtcgcttaccgaatgcagaagtgtaatgagcctagtcccttggttgtttttttgcatgaacgtttggcggaaaattttgggaaggagaggtttgaaaacaggttgtttggtattccgcttgttacaaggtggtccagtatttcctgtggatatgatgatgttcaaaaggagtttctgaagttaatcaatccatttctgatgcgcactgaagatgtattacatgagtatgataagaatgatggtgttaataaaagagtaagtgaagatgatgaattgggtgatgctactaactctgcagcaataggaaatgatgcagactcaaacagtggaacagaggatggcattcattcttcaactgcctttgaattctacttacaaggaatagagagggcgaagataatagtgaaaaaaccattaccacaagtcacaacattgcctggaaagctgcctgtggtagttgtcttgtggtcggataagatgcttaaaatgtatgatacatacctgcttgactcattgcctgaggttttcaagccccagctatttgccaagagaatgcaagaatcagtttctatttacaagtgccttgaagccttcttgaaagaggaacctcttgggccagaagacatgtggtactgtcctcactgcaaagaacctcagcaagcatataagaaactagatctttggagattgcctgaaattcttgttgttcatttgaagaggttctcatacagccgctacttcaagaacaagctggaaacatttgttgatttcccaattaatgatctggacttatcaacatatgtagcccacgggaatagccagtcttccaaccgctatgtgttatatgcaattagttgtcattatggagggttaggaggaggtcactatacagcatttgtccgttatggctatgataaatggtatgattttgatgacagcagggtcgaatctgttagtgaggacatgataaagactcctgctgcctatgttcttttctacaggaaaatttag

SEQ ID NO: 6836 - DNA, 447 bp, Glycine max
  Peptide Sequence Number=SeqID_123614
atgtgggtagctcttttctacatccttgtaaggccctcaaaccaatcctctacatattgtctaaacacccttcgccaggagttgagaacgagggagatgtgcgtttcagtggtggaaagtggaaaccgtaatcgccaagctggaaagaaaacgctccatttctgcgccactctctgccttatcgccccatttccgttccaacattgtcagagagcaacacagattagtcgtagcagtgagaggcatcggagggggaataaaacatggtttcaacagcaacagaaacagagcaagattagaaagcgccagggtgcgcacgttagcaccgaaccccgtgggttcctctcccctaactcgcttcgcccccacggcattcctacgctgatccacactcaaaacgcatcacaaaaaacaccgtttcgcaaccctaacggaggaggggggtaa

SEQ ID NO: 6837 - DNA, 140 bp, Glycine max
  Peptide Sequence Number=SeqID_123615
aatggaaaatgattccttctccttctgcctctcaacccaaaaagacgaatactttgcctaagctttccatctctgttgaattgccacctcacataagaagaacaaccgtctcgttgtcaccgccaatagcaacacattga

SEQ ID NO: 6838 - DNA, 711 bp, Glycine max
  Peptide Sequence Number=SeqID_123616
atgcagtcaagactagcagaagcaacaaggagaacatcttgtgcattatcctcaaccactcgcttcactctaaaacgacaactttgctctggcactcgtatccgaaccgcagaccccgaaattcattcgggagagctagaagctggtcccaaagttcacagaggacaaccccaaggtataagtacacaagataaagcgaaggaagccaggtattctgaaacagaacgcaatgcgagcaaagcgcacgagatgttgaaatctccaaaatctccttgtgaaccttcacggaaactgaagagcgcgggggtgaaccagagattggacccaagcattcagcaaaagcgggagaaagggtcgaaggtgggtattgaagaggtgagctgtgctggtcttgatggaacgccgtggccagaggacacaaacaaagggaaagagaaagaagataacagagagtactttaaacgccacaaggcatcgcccttgtcggagatagagtttctggattcacgaaagccgattactcgagcctccgacaagaccgcggattctggaagaggtgtcggtgtgattggctggctgccggagcagatggagacggcggaggaaacgctgatgagggccgctgagatgtggcgagagagagccatgaggggtgatcctgatgcgcctcattcaagggtcctcagagctcttcgtggtgaagacttttga

SEQ ID NO: 6839 - DNA, 324 bp, Glycine max
  Peptide Sequence Number=SeqID_123617
atgtcaaatgctagcaaggtcatactcatcgtagaggctgaggatctcaaaatggagctaggcggccatggaaagatcaactttttcggggtcggtgatggccatgaggtcgtgaagcttattggagaggcggagggtgtgaatggagtgttggaggagctcgttggtgcaatggaggttggagagttgggcggttttggtgacaacaaagtggtgagagttgaagagcttggagcggaggcaacagactgcaacatggaaaacatggatctgagggaggaaggactttgctttctttctttttttaataaaataatttattaa

SEQ ID NO: 6840 - DNA, 153 bp, Glycine max
  Peptide Sequence Number=SeqID_123618
atgggggaggggtcgcacgcgattacaaaggtggtggtgtcgcgcttgcagtggttgggttggatggctatggctgcactacattggtggtggcaacgtggggcatatgaagtggttggggtgagggtggaaggttgggagtggagcatgtga

SEQ ID NO: 6841 - DNA, 141 bp, Glycine max
  Peptide Sequence Number=SeqID_123619
atgagtctccggggtgaagatgggggggctgtagcacctagtggcctaaacttgttagagtctacgcaattgaagattggaaagcgacccaacaggaagaaagcccaacggttttctcagagggtagtgagggccttgtaa

SEQ ID NO: 6842 - DNA, 1242 bp, Glycine max
  Peptide Sequence Number=SeqID_123620
atggagttgatgcaacaagttaaaggtaactattctgatagcagggaggaagaggaggctgcagcagagattatcacaatcacaagggaaccagaaagcagcaggttacaccaacaagatgcagcatccaattttggaaagaagctagacctgatggacttgtcactagggagcagcaaggaagaggaagaagggaagttgcaacaaggaggtggaggtggaggagtggttcatcatgctcatgaaatagtggagaaagagaatatgtttgagaaagtggtgacaccgagcgacgtagggaagctgaacaggctggtgataccgaagcagcacgcggagaagtacttcccccttgactcctcatccaacgagaagggtctgctcctgaatttcgaggaccggaatgggaaggtgtggcggttcaggtattcctactggaacagcagccagagctatgtgatgactaaggggtggagccgtttcgtgaaggagaagaagctggatgccggtgacattgtctccttccagcgtggccttggggatttgtatagacatagattgtacatagattggaggaaaaggtctgctcatcctcatgctcatcatcatgcccctgatcctttgtttcttccctctatcagatggtactctctccctcccaccatgccacctcgctaccaccacgatcatcactttcaccaccatctcaattacaacaatctcttcactttccagcaacaccagtaccagcttggtgctgccacagccgctgccactgctgctcatcatggtgaccagaattcgggatctgggtcactctattacctaaggtcctccatgtcaatgggtggcggtgatcaaaacttgcaaggacgagggaacaacattgtccccatgatcattgattctgtgccggttagcgttggccatcacaacaatcgccatgggaatgggggcatcacgagtggtggtgctactagtagtggaaaaagactaaggctatttggggtgaacatggaatgtgcttcttcggcagaagattccaaaggcttgtcctcgggttcggcagcacatgtgacgacagctgcttcttcttctcttcatcagcgcttgaggttgccactgccacatgaagacccactttcgtcgtcgtcagcgaggtttggggatcacaaagggggcagtactgggacttcgctgctgtttgatttggatccctctttgcagtatcatcggcagtga

SEQ ID NO: 6843 - DNA, 660 bp, Glycine max
  Peptide Sequence Number=SeqID_123621
atggaaacacaacctgaatgcgctgtcatcaacatcccaaacataaaaacagagcaacatgtgtccgtgtccccaaagaagaagaacggtggcggcatgcgctttctcagggtggcactcttcaagatgcgagggcgttccgcaaaaccaaccgcgcttcaggtggataataatgaggatggtgagaggtccaagagcacttgggggaagtttgtggggtccatgaggccattgcaccttcaaagcacccaatctccacgctcatcacctgattctccatctgaatataaatcggattgcggcggctatgtttctgattttggggcggaggaggagccttattcgccttccccacctagtagccgttacgcttcagccgtagggttgaacgaactcgttcaaaatgacgaggaaaatgagaagcaagaggtgattgtggaggactacgagcaacacgttgatggagacggggatgagatgattgatgccaaggctgaggatttcattgctcagttctaccaagaaatgaagctgcaacgtttggattccgtggatcgtcgttacgttgagcgaagccaaaggcgtcaagatagatactatttttgcttgatgaggaacaggaacatgaagatggcatgggcaaaggtgattcttaaatga

SEQ ID NO: 6844 - DNA, 255 bp, Glycine max
  Peptide Sequence Number=SeqID_123622
atggtggctcggcggcaagcaactcttcgtggtcaccgatggtcgtgggtggtggagaagaaggtgttacggtttgggtgggcatttggagaagaagagagtgaaaaatcgggtgaaattggtgagtgtgaccccgagatcaaaaaagcctgtcacatgaacaatgttgaagcaaggagaagaaaaatggtcatcgatggagaacaagagcgcaccttgcaggatcaccgcacccctcgtgtgggattactataa

SEQ ID NO: 6845 - DNA, 1499 bp, Glycine max
  Peptide Sequence Number=SeqID_123623
atgaacctcaaccaccacgacgctcccccttacgagcacatgctgaaggaatccatcaaccgcttcttcgccgaacatcgccgcggcgccaccgacttcgccgacttcacctccatcttctcccgcatgctccactccacccccgaaccccccctcccactcctctggttctacgcagccctcgaatttcgcgccacgcgcgaaccttctagaagagccagagacctcttccacttactcgcttcctgttccggtgcgcgcggctccaccaaacgaatcgctgcactcgcaccgttactctttgtattacaccgctcagtacttcttcggggagaggaattgttgttgaagagcgaggtggaggggttggtggaaggggttgtgagttactgcagcatctgttgcggcaacgagatttgccgcgaagatgacgtggcggtgttggagttcggggatttagttaaggtgtggacggtggatgatgatgaggattataacgagggtggggttttaggtttagggtttttcccctttgtgagtgaagaatttaggaaagggatgattgagaggggctgcgaggttggggtgttggctggggttgttatgtgggaagcgcttttgctgaagctctgtttggcgttcgagaaagggattggcagagcggagcaggagaagagggtcatggcttccgcggttcagaccatcacagggtttcggagctttcgcttcttggaggctcttcgctatgcgaaggtatgggggagggatgttgtacgcagccttacccttgcatatgcgaaacttgacattggtccaatccttgtgctttctggggtgacctcattacagttttcatgtttgttcttcctgaatgctgattggtctacattcagatacccttttcaggatgatgttggaaccagttttgccagtgacctctctactggtcagtaccatggttctgaaaatgaagttcttttaaaagaagtcctgtacaattctgtgatgatgatagactattcattcattaatcctcaagcagaattttcactatatgccaacagcttgaaagattttgctataacttggttgtttgttgctgagttagctgtacagtctgctaggtatgagaaaaagactgtctattgtgtagctgtgatagatgaagggtggcttctagttgctgaggaacaaggaattgcagtatttgctggagaaactgccaagcagataaacatcatgctcaaagctaactttttcacttcaagaaccgagtgcttgcttccagtgatcaaacatttcttcaacaatctgaataagaatctctatttgaattctatgaatggagaagccggggcagataaacttgatggtgacgtagagatgcttgatactgtggacactgtaagtttgcctgccgctgatagtctgaacagagttattgaaggaacaagaaaacgcaaagaagggattgaggatgatactataacacagctgaa

SEQ ID NO: 6846 - DNA, 1833 bp, Glycine max
  Peptide Sequence Number=SeqID_123624
atggccgacgaatctcaatattcggctaaccccgacagcacccctacccctccctccctcaagcgcaagtacaacgacgaccaccgccctactggattctccgacggccccgacccggcggcgccgccacccccctcctacaacaacgtccctcccccttcctccgccgcctccgacttcgagctcgccaaacagcgcgcccaagaagtcgccgctcgcctcctcagcggcgccgctcccctcgaccccaccaaacgccccaagcacgacaacaacggctcctccttcgactccatcgatgtgaagggtccatactcggtgccgtcgatttcgccgtccgcggtgtcatactcgtaccagggtggtggtgcgagcaagaagattgacattcccaatgggagggttggtgttatcattggaaagggtggtgagaccatcaagtaccttcagctgcagtctggtgccaaaattcaagtcactcgtgatatggacgctgatccgaattcggctactaggactgttgagcttatgggttctcctgatgctattgccacagctgagaagctcatcaacgaagttctcgctgaggctgaaactggaggttctggcattgttgctcgacgagtggctgggcaagctgggtctgatgagtatgtgtcgaagatcccaaataacaaggttggtcttgtaattggtaaaggtggagaaacaataaagaatatgcaagcttcaactggagcaagaattcaggtgattcctcttcatcttccacctggtgacacatctaccgaaagaacattaaaaattgaagggacccctgaacaaattgagtctgccaaacaaatggttaatcaagtcatcagtggcgaggttcttggggacatcaaggttaccttaatgccatatagttgtgttgaagtggctactcattgggattatagcccgttcaaccatgggttagtttgtattggaccattagtgacaccaacatggaatccctttgttggtgttctctcagcttgcaatgggagggtgtgcttctgctggagtaactcggttatatctcgaaccagtacgaatcgtcagagaaatccatctatgtctggtggttattctcagcaaggttaccaagctaggccaccgactagctggggtccccctgctgctccaatgcaacaatctggttatggctatgtgcagccaggagcatactctggtccaccccagtataacgtgcctcagcaaccatatgcaggctatcctccccagtcatctggtggatattccgccgccaactgggatcagtccactgccccacagcagcagtctgcccatgccgggtatgattactatagtcaacagcagcagcagcaaaatcctgcacctccatccgatgggactgcttacaattacagccaaccaccttcctctggttatagccaaccggggcagggctatgctcaggatggctatggtggatatcatgcgccacctcaatcagggtatggtcagccaccatcatatgatcagcagcaaggttatagctcagctgctagctatggtagcaacccagccccagagggccacactgccaattacggatcccaaggggattcaacccaagctccacctgcccagcctccaagtcaaggttatgggactggccaacaacctagcccaaatgctgccaactatgcaccacaagctcaaccaggttatggggtgcccccaacctcccagccggctacttatggcagtcaacctccagcacagtctggttatggatctggcgatggaccccctcagacccaaaagcctagtggcacacctcct

SEQ ID NO: 6847 - DNA, 216 bp, Glycine max
  Peptide Sequence Number=SeqID_123625
atgaatgtccaaacgtatacatggtcacgggggcacattcttactgatgtttttgttggcgcaacgacattccttggaaccccgcgcaatagtgaagaggagtgggttttgagtgaaaaggttccatgggttactaggattattttgaggagttatgaaattgaaattggtttgtactttgatttgagaatggagaatgaaaagggggaattatga

SEQ ID NO: 6848 - DNA, 306 bp, Glycine max
  Peptide Sequence Number=SeqID_123626
atggtaagggctccttgttgtgagaaagtgggattgaagaagggaaggtggacaacggaggaggatgaaattttgaccaagtacattatggccaatggagaaggttcgtggagatcattgccgaaaaatgcaggattgttgagatgcgggaagagttgcaggctaaggtggattaactatctaagagctgatctcaaaagaggaaacttttctgttgaggaggaaagtaccattctgaagttgcatgcttcgtttggcagcagtaaaaataagacgcgagacaacccggggcacaagacaagctaa

SEQ ID NO: 6849 - DNA, 207 bp, Glycine max
  Peptide Sequence Number=SeqID_123627
atgaaacaaaatttaaatttaaatgttggggtggagggggtgtgggaagaggctgggagtgtgagaagaagagactgggagtgtgggaagaggctcagaagggtggggggggtagcgcctgacccctggacgctaccaaaggcgctcgcgtcaggggcgctacctgctgtgccacgtgtcatgtgcacagtggaagtgtcagtctga

SEQ ID NO: 6850 - DNA, 1152 bp, Glycine max
  Peptide Sequence Number=SeqID_123628
atggcaaatccaacgtggagaggcatgattggttggaacaaccaaatggtcgctgtgattggccagtttcgaaacgaacacgttgcaaagccaaagccaaagccaaagcgtattccgtattttcgactccggagtcaagtcttggcggaatcactttcactaaagagctattacgatatacttcaactgtcgaagggtgcatcggacgagcagataaagagggcgtataggaagctagcattgaagtaccatcctgataagaaccccggcaatgaagaagctaataagaaatttgctgagattagcaatgcgtatgaagtgttgtcggatagcgagaagaggaatatttacgataggtatggtgaggaaggtttgaagcagcatgctgctagtggaggcagaggtggtggaatgaacttccaagatatttttggctctttctttggtgggggacaaatggaagaagaagagaaaattgtaaaaggagatgacgtggttgttgatttggatgcaacacttgaagatttgtacatgggaggtaccttgaaggtttggagggaaaagaatgtactaaagccagcatctgggaaaagacgctgtaactgtagaaatgaggtttatcacaagcaaattgggcctgggatgtttcaacagatgacagagcaggtctgtgagcaatgtcccaacgtcaaatatgtaagggaggggtatttcatcactgttgatattgagaaaggcatgcaagatgggcaggaggtgctattttatgaggacggtgaacccataattgatggagaatctggagatttaaggtttcgtatccgtactgcacctcatgacgtcttcagaagagaaggcaatgacttgcacactactgtcactataactctggttcaagcccttgttggttttgagaagaccattaaacacctagatgagcatctggtggacataagcacaaagttgacagacttatattttttgacccgtcaggaaatcacaaagccaaagcaggtgaggaagttcaaaggggagggtatgccattgcatatgagcaacaaaaaaggagatctttacgtcacttttgaggttctattccccacgtcactaacggaggagcagaaaacaaagataaaagcaattcttggttag

SEQ ID NO: 6851 - DNA, 4137 bp, Glycine max
  Peptide Sequence Number=SeqID_123629
atgacccacaaattagataccctaatcaccaccctttctacctccaaatcccttgattccttgcccacctcttttcctcataacccatcaccttcaccttctgcttcccaaccaccccgcgtcaaacttgatgttcccagatttgatggtacggaccccttaggctggatattcaaaattactcagttttttgaatatcaccatacccctgaacacgagcgtttgaccatcgcgtccttttacatggacggacgtgccttggcctggtaccaatggatggtcggcaacggccaactctcgacttgggcaggtttccttcatgctctccaaacaaggttcacgtcttcacaatttgacgaccctaccggaaccctgtttaaattgacacagcgcaccaccgttgcagcttacctttcagagttcgaagataccgccaatcgcgtggtgggtcttccaccgcattttctcctcagctgtttcgtttcaggactgaatccagacatccgccgcgaggtccaagcgttacaaccattaacgctggtccaagcggcgggccttgcccgcttgcaggaagagaaacttgttgagaaccgccgctccttccgaaatcggtcaccttccttctcgatggttccaccaaccccgatttctgttcccccctcaccacgcaccatctcggtacagtccctctcgccgatgccgttgaaacgcctgacgccggacgaactggcctctcgcagggagcgaggcctctgcttcaaatgcgatgaacgctatcatcgcggccaccgctgccaagctagggttaatctcctaattgtggatgaggaggagcgttctcctaaagaagctgtgcctttgggcctttcacccgaaccgcatcacccgcatgacccgaatgaagcccaacttaatcttcactctctcacgggtccattagcaccagaaacactccgtttctcaggtttagtggcttcaaaacaggttttaatcttggtggatgggggtagtacccataatttcatccaagatgccatgcttccagaattgggcctctttcctagtgacaccacacccctcacggtcatggttggtaatggccaatacctccattgcaaccaaatttgcactgaggtctcaatagtcattcaaggaattcacttcatcattgacctccacgtcttacccttatgtggcgcgaacgtagtccttggggtacagtggttgtggtccctgggacccatcctcactgactacaccactttgtcaatgaagttcatgcatgaaggccgtaccattgaactcaaaggagatgacacctctgcccttcaaccattgtcggttcctcaagcccgacacctggttcaaacctatgatcctagtgcttgctacctcctctcggttacttccctcgaaacaccttcgaacacctccacctatcccccagacattcaatccttattgaccaaatttgcttccctatttcaacctccccagactcttccaccctcacgacccacagaccaccatattcaccttgttcctaactctgagcccgtgaatgtccgcccatataggtatccacattatcaaaaggccgaaattgagactcagaggttctgtgttgattacagagaactcaatgctctaacgatcaaggatcattttccaataccagcaatagacgaattactcgacgagctaggaggagcagcttggttttcaaaactagatctactacaggggtatcaccagatcctaatgtcggagggtgacatcagcaaaacagctttcagaacccatcatgggcattttgaattcacggtgatgcctttcgggctttgtaacgccccttcctccttccaagctacaatgaataccatattccgccccttccttcatcaattcataattgagcattttgttttgaaattctcaaaatgcaccttcgctcaacctcaagtggagtacctcggtcacgtggtgtcttctcgaggagtagcacctgtgttagctaaggtgcaggctattcagcaatggtcagaaccacgatcggcgtgtgcactccgcaattttttggggcttgtaggattttatagaagattcattcgtggatatgcatcaattgatgcgcctttaaccaaacttctcacatttgaagtttttcattggactccagaagctgctgccgcgttcactactctcaaacagatgctgacttcctcccctgtcctacgattaccggacttcaatctccccttcaccgtagagacagatgcgtcaggaacgggcatgggcgcagttttaagtcaacagggtcacccagttgcctatttcagcaaaatgtttcccccaaaactccttcaggcctctacttacattcgggagctatttgcaatcacggtcgccgtcaagaggtggcgccagtacctccttggctggagcttcacaattctcacagaccacagaagtttaaaagagcttcttactcaggtgattcaaacacttgagcaacagaagtacctcgcgcgtctcatgggctacgattacaacatacaatatcgttccgggagttcaaatgttgttgctgacgtgttgtcacgagtgtctgaaccaattcctgagctgtttctcttgttatcagtgccctgtttcacatttttgcaggaactcaaggcccaattggagcaatgcccagactacattcaactccgacaaaccattatagctcaacctgatcaaaatcctgatttctcaatcaccaaggacttcgtccttcacaaaggccgtatttggctcccttccactatgcccattgtgaacactctgctacaggagtaccattgtacacccacaaggggacatatgggtgtcacaaagacgctggccagactaacagagaatttttattggcaaggaattcgcaaggatgtggaacgattcgttgcttcatgtctggattgtcagcagacgaagtacgaaacacgcaaaccgacaggactgttgtgtcccttgccggtgccttgtcggccgtgggaggacttgtccctcgatttcatcacggggctgccgacatttcgaggaaatacttccatcttggtcattgtagatcgattctcaaaaggaatccatctgggcatgctcccaacacatcatacggcgtacacggtggccattctctttatggaccttgtcggaaaacttcatgggatgcctcggagcttagtattcgatcgcgaccctctgtttctcagcaaattttggcaagagcttttccgccttagtggtaccaagctgcgcttaagctctgcatatcacccacaatcagacgggcaaacagaagtcttaaatcgggtgattgaacagtatcttcgagcttttgtccataagaggccttcttcatggggcaaactgctgggttgggtggagtggtcttataacacttcctggaactcaagctctggtctctctccatatgagatcacattcggaaagaaaccctttaattttctgcaatatttggtaggagactctaatgttgatgttgtggatactatgctcaaagaccataagaagcgtcgtgaagttgaataccaggtgggtgacatggtcttggtcaaacttcgaccacaccggcaggtttcgatcttgggtcaaacagaacgcattgggtctacggcctacaaactacagttaccagaagaagctaggatacaccccgtcttccactgctctctcttgaagtcgtaccattccactgagatggataccagccctcaccccagcactttaccgatactttcgaacgatgaccatttactgattcaaccactgactttcttaaatactcgtcgaaacaaagattctgcactcgaagtccttgtgcagtggcaggggctttccccagatgatactacctgggaaaattgggatcagttgcgagctgattaccaccttgaggacaaggtgcttccggaagcagtggaggctatacaggcttgtggaggccagaagactgttgatggtaggcgatttcgaacagggggtggtgtattgtggagtatcattaaggttcgagaaccaaatgcttacaaagagataatgaataaggcaaaggagtttgaggagtgtgattga

SEQ ID NO: 6852 - DNA, 249 bp, Glycine max
  Peptide Sequence Number=SeqID_123630
atggacctgatgtctgtaattccagtagccattggaaccggcgaggaggacggcccagcgggtgccctggacgttgtcatcgttatcggtttcggagggcagtcggagaaagtctccggcgaggtgagggcgggcggagacgagggtggcgaagggtatgagaaggaggagcgtgggaagaagaagagtggccatatggagagtgaccaccttgcctttttcgctgacgttttcgatagcacttcatga

SEQ ID NO: 6853 - DNA, 693 bp, Glycine max
  Peptide Sequence Number=SeqID_123631
atgtggaacaaggtaaggactagccccactgaccttccgggctactccattcgccgggagctactcttttatcacaacaagctatggcttctgtcagattgctcttttattagtggaattcagttattgcaatatagccattctgttatggaagcatacatgaatggaccagtgtctcagaaagaacctgctcctggacttgcatactttcacatcccgctacccgaatatgctagttttgactcatcaaacttcacaggtgtgaaacaagaaggcataagttctgcttctgtgaattctggcttcttcacaacattggttgaagcaggagatgtgaaggcagttttcactggccatgatcatgtcaatgacttctgtggcaagctaacgggtatacatctttgttatgctgggggatttggatatcacgcttatggaaaagctggatggtccaggagagcaagagtggtgctagttagcctggagaaaacagataatggccgttgggaagatgtcaaatcaattaaaacatggaagcgccttgatgatcaaaatctaactggtattgatggtcaggtcttatggagcaagagctttggcagtaagatatctctggattctggaatacttggtgtactctatttcttgatttcaaacttgtgctacagactaatagatgaaatctatctttag

SEQ ID NO: 6854 - DNA, 1107 bp, Glycine max
  Peptide Sequence Number=SeqID_123632
atgttgttcatctacactttatacgacgtggcacttccctggaaccaagcgttttgctacaacataacgacacccagtagcatttgtgggatagctccgtcaatttccattactgcatctgcacgcgccaatgattacgcgtcacactctcaggtgaaagctgttgggagcttctccttgttttccagattctcttttagattccctttgaagtccttttggccacgaccaccaacggggaatgcctccggttaccacggtctcgccgtcgacgacgacgccgttttggcagagaatgcaacggccgagacagaacgaggagaaggagagggacaaaatgggaactgggttttgaagatttttcatataaggtctgtttggagaggggaacagaggagcgatgaaggggaagctatggccaatggtcaaacggataaagagtgtgatgattgtagggttgaagaagaagaaaatgaagaggtttcgttcgatagagactcgttttcgagaatgcttcgcagggtgtcattgtccgaagctagattatatgcgcgcatatcccacttgggcaatttggcatactctattcccaaaatcaatccagggaaactcttcaaacactatggactgcgttttgtaacttcatccatagagaaaaagaaattagctgtggcagctgaaaaaaatcagacaacatttgctgctactcagaaggaagaaactaatgaggagaatgggggagaaacaaaagaggaaaagaataatggtggatacatgataagtgcatctgctgcatatgagattgctgcttctgctgcctcttatctccatgctcagacaaggagcatacttccattcaaatcttctgatgctgtggaaggtgaaggttcacatgaagcaagcaatgaaagatttaacggcgagaagatggcaaacacggaggaggcaaatttgaaggcaactacggattcggtaacagcagttgttgctgcaaatgagcaagtaaagcaggtttttgcagatgatttgaactcaacaagctcttcaccctgtgaatggttcgtatgtgatgatgaccagacctctacaagatattttgtgatccag

SEQ ID NO: 6855 - DNA, 234 bp, Glycine max
  Peptide Sequence Number=SeqID_123633
caactaggcccacttgggccttccagattcttcctccagaaggtggttgcttctggaggaagcaacctggctcacctgggcgagctgggtggcaaactcctcccctattttgctatacatagggggaggagtgaagaagaaaaaggttcagccttcttggcacttcgtattcacttgaaattgctgaggataattgtttccgtgaagaaaatccaagccgaggcacttccgtaa

SEQ ID NO: 6856 - DNA, 312 bp, Glycine max
  Peptide Sequence Number=SeqID_123634
atggaatctgatgcactgacatggggagacaaactcatgctatggggattgtcattccatggttttcatggagcaaagcccgaagaaaggacgctgggccagaagttcttcatagatatagatgcttggatggatctcaaagcagctggcaaatctgatcacttatcagataccgtttgttacacagaagaaatatatgatatagctaaggaagttcttgaaggctcacctcacaaccttctggagtctctggcccaaaaaattgcaattactatcacaaatcataaagaaatatctgctgttcgagtgaag

SEQ ID NO: 6857 - DNA, 810 bp, Glycine max
  Peptide Sequence Number=SeqID_123635
atggctaataaagaattgaacattgcgttgatgtatctacatagagatacagtggtatctcagttgcagaaggtgttgctgatcgatcttgggaagaaaatgaatcaggaaatgaatggggttgaggctgagagggtgaaagtgaatgtgcatgacaaaatagattacgtgtttaaggtggtggtgataggggactcagcagtgggtaagactcaaatactctcaaggtttgcaaagaatgaattctgctttaactcaaagtctaccattggagttgagttccagactagaagtgtgacaattaatggcaaagtcatcaaagcccagatctgggatactgctggccaagaaaggtacagggcagtgacaagtgcatactacagaggtgcattaggggccatgctagtgtacgacattactaaaagacagtcttttgatcatgtggctaggtgggttgacgaattgcgagcacacgccgacagttccattgtgatcatgctcattgggaacaaaggtgaccttgtggaccaaagagtggtacacgccgaagatgcagtggagtttgcagaggatcagggcctctttttctctgagacttcagctctcagtggtgaaaatgtggagagttcctttttcaagttgctggaagagatccatagggttatctcaaaaaggtccttggaatgtgataatgggaaggccaatgctgacaacaatgttgccactcttaaagggtcaaaaatagatgtaatctcaggtgctgaattggaaattgcagagatgaagaagttgtcttcatgttcttgttaa

SEQ ID NO: 6858 - DNA, 534 bp, Glycine max
  Peptide Sequence Number=SeqID_123636
atggtgaaaaaaggaaacattgtgcagtatcgggaaaggttggacaacacccttgccttacctgatctgacaaatgaacagatactcaaaacgcttgtcaaaagtcaactccaacgttcttcagaagtggaaattgaaggatgtaatgagaaagaagttgaaaccaagactacagagttatgcaaccttcttgatatgttgagaagtgcttctggagacaatggtggaggatctagtagtacatcacacgctgattggaaactttatgcctttcatgggagacccccctctacaagaaatgaaaggatgaaggttccatggccactatctacaagggaggctatagtgcattattatctgtttgagtactttcaagatgacttagtagttattcttttgaatacggtctctgagtcaaaaactgataatttaaacaaggatgcaattcctgaagcaaaggatgtcgtgagaattgatttagtgggaggctatgctatgcaaaaggtgacatcagaaagaagttattttcggtga

SEQ ID NO: 6859 - DNA, 294 bp, Glycine max
  Peptide Sequence Number=SeqID_123637
atggggttaaagtttgacgtatcgtttgggaaagggatatatgcaaatggaaggtcagaaataggaaccttttttccgaaaactttccagaagaaccttcttccggaagctttccggaagaaccttcttccggaagaacaatttgtattctaccggaagaaccttcttccggaaagcttccggaagaaggttctttcggtagaacaatttgttcatccggaagaaggttcttccggaaagcttccggaagaaggttcttctggaaagttttcggaaaaaaggttctttcgatag

SEQ ID NO: 6860 - DNA, 1056 bp, Glycine max
  Peptide Sequence Number=SeqID_123638
atgggcaatgataaagacaaagacttcagcaaggctttggaggacacgttgtatgttagaatacacgaagctctattaagcactagggaatcaaaggctatggctggggaagagcttaagcaagatgcaagcattgttcctactgaagaacttgttcaaagtgaggatgaggcaaaagatgtaacctgtgaggatagcagcaaccagtgttcaaataattacattggagagactttagatgcaggtagtgaagaagttgttgaagcagattgtaaagaaattttgcaaattgaagaggatgtcaataaggtacttagcattccaatcgaggaaggtaattcattaagtgtactgatgggaaaggaaaatggtgagattgtagaaacagatagtgaagagattgttgagattgagatggatgtcaacaaaatgcatgaccttccagttgaggaagatggtacaaagagtgtactgaaggacagaatgaatgcatatatacgctcagatgtgagaaatgctctagaaacaatagagagggttatttcagtggttagagaatgtggatttcattccctcgggtccactttaaactctgctggtgaagagttccactgcatggaaaatggtggcacagttgattcagattctgcaaaagttattgaagtatgtttgaaaaatgaggttagtgtcaaagtatcaagcagcaatatgctggaggaaaatttagaagaacctgggacgatacaaagcttcagacacacaggaacaaatgctaacaaggaagtaaactataagaaagtagtaccagcttcaccagagcagaatctttcaagaccaatggaagcaaaccaggctgattcatattctttgaaaaatgggacaactctggaccaaacaatatatgataacaagcaattaaacagtgatgcagtccaagatatgtcttcagatgacctgaaaaagtcaaccagggagataaacatacagggtgtgatttttaatcctccattcactaattcgatgatccctatggatgttttgaagtcaaggtcttga

SEQ ID NO: 6861 - DNA, 339 bp, Glycine max
  Peptide Sequence Number=SeqID_123639
atgtccaaaaagtctgttgtatcttctagagctatctatgggcgtatgacagtgttgatatttgatggccaagcagccctagttataagaacctttgtaccccacttaggctttgactcagaagaagaaataagaaggcctgctgaatgttgcaatcaaacaaagagtatactgaagaggatatcacagatgaggtacttaaaggaagagtcatcctcagtgccctctgtgaggagagggatacctattgaagaatatcgtcggccagaaacctatcctaaatccaacgaaaatgaatcaggagatactgattttgttgcaatggctaaagatgtttaa

SEQ ID NO: 6862 - DNA, 1425 bp, Glycine max
  Peptide Sequence Number=SeqID_123640
atgggaaacaattgtctcggatcgaaaacctcaaatgatgcactatttccctatgttcttccgagttcattctggtggcttcatcaaacaagtgtcaaagaaatttctgatgcaccttcaattgtgagtagaattcaagacacacattttctagagaatgttcaagaaaagccaccacttgtagtgaaaattaacaatgaggagatgaagctgaaaccagttccacttccaaccaataaacaccagaaagagactaacatgtcttcaggggaacaaataaggcaaatacaaaaaatgcctcacaaagttaagaggctaccaatagggcttcaagccgagtcaattttgaagagaaaaaatggtaactttaaggagtactataacttgggacaagagcttgggaaggggcaatatggaacaacattcctatgcactgagaaagccactgggaaaaagtatgcatgcaagtccattccaaaagtgaaattggctatggatgatgatgtggaggatgtgaggagggagattgagataatgcatcacttggaagggtgtcctaatgtgatatcaatcaaagggtcttatgaggatggtgttgcagtttatgttgtgatggagttgtgtggagggggtgaactgtttgataggatagtggaaaaggggcattacacagagagaaaagcagctaaacttgcaaggactatagtcagtgttatagaggggtgccactcccttggagtgatccatcgggatcttaagcctgagaattttcttttcgttgatgggaatgaagagtctactcttaaggccatagattttggattgtctgttttcttcaaaccaggagacatttttaaggacgtggttggaagtccttattacatcgcacctgaagttctacggaggcattatggtccagaagttgatgtgtggagtgcaggtgtgatcatatacattctcttatgcggaacacctccattttggggtgaatcggagcaagagatatttgaagaagttttgcatggtgatcttgatttctcttcagatccttggcttaatatctctgaaagtgctaaagacttggttaggaaaatgcttgttagagatcctagaaaacggatgacagcacatgaagttcttcgtcacccttggattcaggttgatggagttgctccagacaagcctcttgattctgcagttttgagtcgcctgaagcagtattctgtaatgagcaagctcaaaaaaatggctcttagagttattgcagagaatctctcagaagaagaaatttttgaactgaaagtaatgtttaagatgatagacacagacaacagtggtcatattactttagaaaaacttaaggctggattgaaaatgcttggtgctaatctcagtgaaccagaaattttggatctaatgcaagct

SEQ ID NO: 6863 - DNA, 357 bp, Glycine max
  Peptide Sequence Number=SeqID_123641
atggcagatgttgacaacagtggcacaattgactacagagaattcatagctgcaacattacatttaaacaaagttgaaagagaagatcatttagttgctgctttttcattttttgatagaagtggaagtggctacatctctcaagatgagcttctaaaagcttgtaaagaatttggcatggagaatgtctgcttggaggaaatgatccaagaagctgatcagaataatgatggccgaatagactacaatgaattcgtggctatgatgcagagaggcaatgcagatttcagtcaaaacggtttaaagggtgacactgattttagtattggatttagggaggcactattagtgtgttga

SEQ ID NO: 6864 - DNA, 1371 bp, Glycine max
  Peptide Sequence Number=SeqID_123642
atggagacagtgagaattattactgccatatcaagtaaaaaagggtggcatatgcaccatatggatgtgaaatcagccttcttgaatggtcctctagaggaggaggtttatgtgagtcaaccacctgagtttgaaataaaaggaagtgaagagaaggcgcctagagcctggaacaggcgcattgatggctttctaatgaggcttggattcctcaaatgtacaactaagcatggtgtttatataaagggcagcaatagtactatcttgactgtagtgtgcttgtatgtagatgacttgcttgtgacaggaaataatgagactgagattgccaactttaaaggagagatgatgagagaattcgaaatgactaatttggaccttatttattattttcttggaattgaattcaagagaactgatgagggagtgatcatgcatcaagggaggtatgcaagagatgtactgaagaagttcagaatggttgactgcaattctgtagacacacccactgccactggtgtgaacttggtgaaagatcctaatgaagaagaagtagatgtaactttgtatagaaaaatggtgggctcactgaggtgtctttgttgtaccatacctgacttattgtatgctgttggcttaattagtagatatatggagaatcctaaactttctcacttccgtgctaccaagagaataatgaggtatgtgaaaggtactctcgattatggtattctgtttcccagtgctgccaaaaaatgtaatgttctgggatatagtgattctgattggtgtggagataagagtgataggaagagcacaacaggttatgtgttcttctatggtgatgccccaatctcgtggagctcaaagaaggaacaagtggtggctctctcctcatgtgaggcagaatacattgcagctgctatgacagcgtgtcaagctcaatggcttgataatatttttggtgaactgaagatgaaggaaaagggtactattacactgatggtggacaacaaatctgccatcaatttagctaaacaaccagttgctcatgggaggagcaaacacattgaaacacgatttcatttccttagagagcaagtgacaaaaggcaagctaagcgtgaagtattgtccaactattgtggacaacaaatctgccatcaatttagctaaacacccagttgcttatgggaggagcaaacacattgaaacacgatttcatttccttagagagcaagtgacaaaaggtaagctaagcgtgaagtattgtccaactattgtgcaagtagcagacatattcaccaaaccattgaagatttatcagttcaaagagttaaggagcagattaggagtgattgaagtgcagtga

SEQ ID NO: 6865 - DNA, 1326 bp, Glycine max
  Peptide Sequence Number=SeqID_123643
atggaatctgaaaacggggttgctgtggaggaagagaaacgtgttattggggtaacaaccaaggtggagaatgtaaagaaagaagttgaaaatgactgcaatggtgcagaaattatgaccaagaatgaagtatctaaacccacagtagtggctaaacgccccatttctgctggtgacaaagttgcagttgaagcctccaaaacttatgcaaataaaaattcaaaaggtgctactactaaggaaactgttggtagagcaagtgttgcttccaagaacaacaaatatgccaaagataaacccattttgaagggtccaagttcaatatctcaaaaacaaaggccatccctttcccaaagcctttctttcccagccaaatcagctggtgaagatgccatgcagaaaagcattgatggatatcttgtgaagcctaaagttagaaataatcaaggtaatgggattagaggtgaggcccccattcgtcatttaaacaagtccacaaactctgaagtcaactcactggcaaaaaccaacactggcatgcctggtttgaaacgctctgcgtttggaaggtccactacagttgctgcattcaccaagagccaaacttctgaggcatcgttacccgttgaccaggtgtcaaacacagcaaaaactgcaaaagcagataaagagaatgatgattctcattccacaacttctgctactccttgtctgagaagcagtggaagtggattttcctttagattggaagaaagagctgaaaagcggaaggagtttttctcaaagttggaggaaaaaattctagccaaggaagcagagaaaaccaacctacaagctaaatcaaaggaaaaccaagaggcagagatcaggctattgaggaagagtatggcattcaaagcaactccaatgccaagtttctataaggaaccacctcccaaagttgagctgaagaagataccaacaacacgcgcaaaatccccaaagcttggaaggcacaaagaatctgctatgaacaacaattcaggagaagacaagacttgctccattccacgtgggaaacaacagcagaatgattcaaacaaggttaagggtcataaagatatggtttcaaagaaaccaatccggaaaacccaagccaaggtgaagtctcaggaaaatgtaacgccagaaaacaaagaacaatgccaagatacacatgttaacaattctgaatgcaaaaatgacatggagttacaatctgaaacaggtcatgcaccaaatagtacactgcttctaaattcaactacacctgagcttttgtcatatgaggttactgttggagtgtag

SEQ ID NO: 6866 - DNA, 1011 bp, Glycine max
  Peptide Sequence Number=SeqID_123644
atggtactggctgagggagaatccttacccgcttactccagatactacaggatgcccactgatatcagagagattgaggctgctttgtgtatacccagccgagggtttgttttatatgctgaaggccatcttgggaagatcctcaggaaagatctaacaactcttgctcagctggacatgaatgtaggagctcttatctctggccagatcacatctatggcccagtctaactcctatagacttgggttccctactcttatcacagctctatgtaggtccagaggggttgcttctgacagcctggtcttcgaacgcttgagcccagtcattaacttcgcctatatcaggaagaattgttggaaccctaatgatctaacagttactattagaggggccaagagagcgagggcaaggccagttgaggctccttccacatctgcagctcctcctctagctcgtagctcagtagctccttctaccccaccttctgtagactttcaacgtcttgaagccatgcttcgaagcatacatcaagggcagattgttttattacatagtttacagctggtagcacctccggactttattccttatgtagagcagtttaatgagtgggtagcctggcctgggactcagcctccccttcatagggaagacgaaggtcccaccgctcaagtaccacagcagatggaggatgagtcatccgagacttccactccagagcccctaatcaaaaggaagaaggtagttgaaacacaagaagcagcagccacttctgagaaatctcttgaggccacttctaagaaatctcttgaggccagtcctgagcctccagcaccagtggcagatacaacctcaccgcagcaggcaatagaaccgtccactgttgaggatcagactacaccagtcatgtcttcgaatgcctctcctatagctactcatgtggttcgttttacggacgaggaggatgttcagacacaggacactcaggaccaatcacaggacttttaa

SEQ ID NO: 6867 - DNA, 600 bp, Glycine max
  Peptide Sequence Number=SeqID_123645
atgggtgaatcagatcagactatttccaccagtgttagtcatcccaacactttaactgtgctacagtctcctagtccagctgcccctgctactacttcacaaacaggtgcagtatctgtcaactcatctgaagctacaacaccagcctcatcaccatctaattcttctcctttgcctcaagggacttctgaattacctaatactccacccgcaatagtatcatccaatgttgaaattactgctgctgaggtatctttatcttcccctgttactgattctgtacctcctgtcacacctaatactccacccgcaacagtatcatccaatgttgaagttactgctgctgaggtacctttatcttcccctgttactgattctgtacctcctgtcactgcttctcaaaatgctcttgttagacctgataatgtgcttatgtgcacaagagccaaagctggtgttgtcgagcctagactccatcctacacttcttgctcattctgagcctaagtccactaaaactgcgctttccaatcctacttgcctggcagcaatgaaggctgagtatggctttgatgaagaatggcacatgaactgttactga

SEQ ID NO: 6868 - DNA, 192 bp, Glycine max
  Peptide Sequence Number=SeqID_123646
atgatccagagggaatggaggaaggaattggcgtttcctgtgacccggaatgccgttgactccgactcgaagtgccctttcgcttcttcgaaggttcagccatttgaaggtgcagggaggcgttgtaatcgattacacaaatatggtaatcgattaccagagagcaacattgccagaaataactgcttgtaa

SEQ ID NO: 6869 - DNA, 1414 bp, Glycine max
  Peptide Sequence Number=SeqID_123647
cgacataggatcaaacacgatgaagctcagactcagatctttggaatctaaagaaaccctcaaaatcgaagtccccgattcctgctgttctctgcagcaactcaaagacaccgtttctcacaccatctcttcttcttcttcctcttcctcttctgtgcacctttccctaaacagaaaggacgaaatccacgccccttcgccggacgagccactccaatctctcggtgtcgccgccggcgacctcatcttctactctctcaaccccaccgccttctccctcgaaacccttccccacaagccagaaaccgctcccctcgacggacccaccatccaagactcgccggaaaccctcgccggcgacgccccctccgttcccaccgccgaaaagcctccgactttggactctgcggaaccggaacccgcggaaatgattgatgggtctgacgggaccgtggtggtgagtaccaattccgagcctttcttcgtgagaagggttctgaaagaagcgcttgggaacaacgttactgatttcaagttgttagtgtttgcggttcacggtgttgttctggaatctgggtttgttagaatcgacaaggattcgcgtatggcggttagttgttctgaccttcttgatgattctccttcggctttttcttcggtgatatcgttgaggtataccctgcctgagattctggctaatggtgcttctcacagtgtgaatttgaagtttcagacattggggcattttgtgaatgtttgtgggtcgttgtctgatgatgttaggtcgatgttacattttgtttgtttggatacacgtaaatatgttaggcctttagagtcgatgctggctaattctgaaaccaagggtagtcttaatgatggggaagatattgtctttggaaatgaagtttttgaaatgtggaagatggggaaagataggcttgcattgccactgttaattgatctttgtgagaaggctggggtggatcttccgccttgttttatgcggctaccgatggagcttaagctcttgattttggagcgtcttccgggtgttgatttggccaaagtggcttgtacttgttcggagctgcgatacttgtccaccagcaacgagttgtggaagaaaaagtatgaggaggaatttggaaaagagggagatagaaaagggtggcttttcaaggatttgtttgctttgtcctgggaaacaaagaagaggcgtcaagcggttccttttcgacgacaggggatttcaagaaacattattttctcgcccaaccattttggaatgcctccagtttggggtggagaatatggtgtgcagccagtatttggtgtgccattccctagataccaaccaaggcggaatatcattcctccatgtactctgactctgggagatttcaatatataa

SEQ ID NO: 6870 - DNA, 111 bp, Glycine max
  Peptide Sequence Number=SeqID_123648
atgtcaactgttcaggtaagattgaaagtgacccgacgtcgcatcacaaacactcggcaatcttcaatggggaagataccactagggtatatcaaaatagtgacggggtaa

SEQ ID NO: 6871 - DNA, 516 bp, Glycine max
  Peptide Sequence Number=SeqID_123649
atggcactaactgttacagtaaacaagtatgcttcatctaatctgcaagctgttcccagaacacaaggaaaagtagcaaccaaaaaaaccacaccaaccttaagcaccaatgtggaaatgggaagaagaggacttgtcttatccactgtaatcgccaccacgcaagtacctgaacctgactctaggactcagcttcttaaaaaatatcagaagaaatcagaggaaaacaaggagaaaaatgacaaagagaggctggagagttattacaagcgtaactacaaggattactttgaattgatggaagggacattgaaggcaaaggatgggaagctttctgatacagaaaaggtcggtggtgctcagatgacattgaatttgcttctgtacactgttgctttacctatggaactgtacattagagatgtacataggtaccttgtagattgtgattcccgtgtccttgaaatcctccgagtacaactatttcaagtgatcgagttaatgaatttaatttga

SEQ ID NO: 6872 - DNA, 2421 bp, Glycine max
  Peptide Sequence Number=SeqID_123650
atactgatagctctactctttttgattgcattagcgtgtggaggcctctctgccgagatggcaaataatccgcaatatccaggcttacagcctcttcggcctcctattgctggttcactggatcctccgcgcaattttgttccacctatgcctgttcaatttcgccctgttgttcctacacaacagtctcagcagttcatttccatgccttctcaacattaccaacatcaacctgttggtcctggtggtgttcccctgattggtgttggaatgcctccccaaaatcaacggtcgcaattttctcaaccgattcaacagttgcccccgagacctagtccgcagttaccacccccatcacaggcaattccaatgccggttgctcgtccaaacatgcacatcccatctgaatcgatgatgcatcagcctgattctcaagttcattctcaagctcccaatgggtacacaccaggtttaggtggtccggcaatgccactctctgcgtcatatacgtttgcaccatccgcttatggtcaagtgcagactaattttagttctactggccaattccaacctgttcctcaaattcatgctctcacgggttcttcatcccagagcattactacaggagcaactcttcagagcaatggtgggcaaccttcagttacaactgttatgccttcggctaccattgcccagccacagctcgctaagaatggcccaaccgattggattgagcatacctctgctaccggaagaacggtagatgcaaccacaaactggaaggagtatactagtcctgatggaagaaagtattactacaacaagatcacaaatgaatcgaagtggtcagttcctgaggagctgaagttggcccgtgagctagttgaaaaagcaattgtcagtggagctcgtcctgaagcattgctaaattctcatcctcaaccctctccgacaccttctgcgattgaagcaacacccaatgcagataattcatctttacccagtcaaggagaaccgtcaagtcctgtttcagtttctccagttgttactacatctataagtaatctacaatctgagatgccttctggatcatctccatctcctgcagatgctataactggaacaaaagtggatgaactggaggcacctttaaatactgtcacaccatcagatactagtgtgggaagtgataaagctattgttactgatattaacactgctgtaacaccaatgaatgatgttgacaatgattcagctcaagctactctaggttctgcagatggagtttctgcagaagataaagaagatggtaaaaatgattcgataggagagaaaagtaatgatgaggctgcagaaacaaaggcagttgagccagaacccccagtttatgcaaataagatggctaaagatgcattcaaagcactcttggagtctgtaaatgttggatctgactggacttgggatcgggtaggcaacatttctatgcttcagtccatgcgtttaataattaatgataagaggtatggtgccttaaaaacacttggtgaaaggaagcaagctttcaatgagataattgtgtttgtcaaacctgcggttgtggctgttgttgccactatactgaagcaggaatccacggacttgacttcatccgctagatggagcaaagcagtgtccatatttgaaaatgatgaacgtttcaaggctgttgaacgtgacagagatcgcagggatatgtttgaaagcttcttggaggaacttctaaacaaggaacgagcaaaggtacaggaggaaagaaagcgaaatataatggaatacaagaagtttttggaatcttgtgactttataaaggctagtacacagtggcgaaaagttcaagatcgcttagaggctgatgaaagatgttctcgtcttgaaaaaattgatcgcttggaaatattccaagactatttacatgatttagaaaaggaagaggaagagcagaagaagatacaaaaggaagaattgagaaagacagaacgtaaaaaccgtgaggaattccgcaaattgatggaagaacatatcgcttcaggcattcttacagcaaaaactcactggcgtgattattatacaaaggtgaaagatttacatgcttatgtagcagtggcatcaaacacctcaggttcaactccaaaagacttgtttgaagatgttgctgaagagctagagaaacaactagtgtttgacgagctactagaacgggcaaaggagaaggaggagaaggaagctaagaagcgtaaacgtctttcggatgatttttttcatctgctacattctaccaaggacattactgtgtctttaaagtgggaggattgtagaccacatgttgaagatagccaagagttcagagcaataaggctttatcattctgctctagaaacttaa

SEQ ID NO: 6873 - DNA, 390 bp, Glycine max
  Peptide Sequence Number=SeqID_123651
atgtcgcaaaccctaggattaggaggcgtaatccctcgcttcgtgaatcggtcatggctccgaaacctgacgggtagtgttatacgtgtgcaatgtgatgaattctggcatatgacaaaagttttgagggtacagctcttcaatgggaaaggaagtctggtagaaggatgtatacagaacattgatcgcactggacttgattttgttgcattgaatgatttgatatcaatacctccaccaaatacacaattgcatgtatttgctggttttggtactctgaagggtggccgtgctgactggcttttagagaaatgcacagaacttggagccaatagtgttactcctctattgactgaacgttctccatcaatctcctgcaaatgggagtga

SEQ ID NO: 6874 - DNA, 1623 bp, Glycine max
  Peptide Sequence Number=SeqID_123652
atggattcctcttccatctatggtgtctcacacagacacttcctcaccctcttccttcttttccttctgccactccattctcactctgcattctctcataactcttcttcctcgtctcaaattaactctaattccatccttgtcgcgcttctcgattcccattacaccgaactcgctgagcttgttgagaaagcgcttcttctccagaagctagaagaagccgtcggcaaccacaacatcaccatcttcgcgccgcgaaaccaagccctggaacgcgacctagaccctgaatttaagcgattccttctcgagcctcgcaatcttaggtcgcttcagacgctcttgatgtctcacattctcccgacgcgaatcgcctctcaccactggccctccgacgacctccgccaccgcactctctccgatcaccgcctgcatttggcctccaagccctccggccatagaaccgtcgactccgccgagatcctccgcgccgacgacgtcctccgccccgacggcgtcatccacggcatcgagcgtctcatcgtcccccgatccgtacaggaggacttcaaccgccgccgcaacctcgccgccatctccgccgtccttcccgagggagcgccggaggtcgatccccgtactcaccgcctcaagaagcccgctcccgttcccgccggcgcgcctccggtcctcccaatctacgacgccatggcaccaggcccatccctcgcgccggcgccggcgccgggaccgggaggcccgaagcaccacttcaacggcgagcgccaggtcaaggacttcatccacacactcttacattacggaggttacaacgaaatggctgatattctcgtaaacctaacgtctctggccaccgaaatgggaaggctagtttcagaaggttacgttctcaccgttttggctccaaacgacgaagccatggcgaagttaacgacggatcagttgagcgaacctggcgcaccggaacagataatgtattatcacattattcctgagtatcaaaccgaagagagtatgtacaatacggttagaaggttcggtaaggttagctacgatacactgcggttaccgcacaaggttctggctcaagagtctgacggctccgttaaattcggtcacggcgattcctccgcctacctgtttgatcctgatatttacactgatggtaggatctccgttcagggaattgacggcgttcttatccctcctgaagaagaagaagaacgcactcgccgcaccactccacttgttaaggttgctgctcctaaaccaagaagagtgtttggttggagtgaattgagggaaaagttgtttgggttaagcacttttgattttatgttttatattgatggcattgagctttctggaaaggactggtgtagaatagaataccactttagggttttggtatccactttacacgcattattaaactatcttgggttaataatagaagaggagaaaagcgcttcccattctgctctgttgagtaaagaactatgtatgaatgtgagattcttggaagcggtgaggaacttgccaaatatcaaagatgcagacaaaagggagggtggtgtatgccgaattttcatttctgtttag

SEQ ID NO: 6875 - DNA, 486 bp, Glycine max
  Peptide Sequence Number=SeqID_123653
atgaagcctatagttggacctttggggattgttaaattatggttaaatgccatcttagccaaccacataacccctgaaatagatattcctactcacttcaaacttaaaatcaaaggggctcgactgacttatttgactccaagcaaagaattttgtacatatgaatgctacaccaagtatatcaaagctttcttgaattttgctcagtttgataacaccttggctctattttggactgcaaattcggtaggccctgaatggctaaacttaagattccctcttgacactcctagccaacaagctaaattagtcaaaatctggagtagttttctcagttggggcatcatttatattggaaccacttcgaaagacctcaaattctatctatatcaacctcatattttcacaaggcagtttgaatgcccggaattctacatcggtcatggccatgaaaacgtcgtagaatgctatcccatggtaaagtag

SEQ ID NO: 6876 - DNA, 261 bp, Glycine max
  Peptide Sequence Number=SeqID_123654
atgtcaattctagatctcataatcgaggaaaatgccatcaaggtggattcaactcttgaccaacttctaaatattggaattgaacagaacactccagctattgaggagcaagttgggatcaaagttcctgtttatatttctgctcccattccagtcattgaaacaaataaacctatacttgaacaaagcatatgttgtcgaagaatcacccatgatggatgcaaaggatcttcaaagggaaacagatccattggatgttga

SEQ ID NO: 6877 - DNA, 1294 bp, Glycine max
  Peptide Sequence Number=SeqID_123655
agacatggtccaaacaactattgatgaagggagactgaagttcgaggaaaaaccaatgaaagtggacactgacccatttcacattcaagctaactatgtagagcccatgcaaatcaagatgattggggccttgatttggacattgaaagtaagcacccctctgtctgaagaggagataaatcaagccctagaggagtttgaaaaagaggaagacgccatgtttgatacgtcggcggctaaagcattcgaggcttcgaaaattcaaaagagtttcaagaaagtacagagtttgaagggagtagtttggcacttcgaaggggaggaacaactgaaggttcgaggaagggatattatagctatcaaaatcctccttgggtccacatcctggattcaaaaagaaatgatagcggactctttcgagtttaggtttgaggactcattggaagccatatgtggagtcatctcgatcttacctgtggaatacacaaaagattatcagaacatgaatattttgagcgattatacaagagaggattattttgatgatccttttctgagtcccaaggttgtttgggttacacaagtctcttgtttcacaccacatcaaaatgctgcaattttcaatctacccactaaggatatgagatgccatatgaagccactccatttgattgctatggtggaggaccaaattattaataagatcttggtctatggaggggatgcatttaatatcttgccaaggtctatgctgtgcaggtttggaaggacaattgaggattcaattcttcacaatatagtggtatctgacttttatggaaaaccttcagattctgaggaagcgatttgcttggatgtttcagtaggaaatagaaggagtcctacaatgtttttggtaatttggtcacaacacaatttcaatatgttgtcgggaagggaatggatttatggagttggcgatcaagcaatggtgaggactgcttcgttcgaaattgaagattcattctatgtgaacaacaaatcagcatatgcgagattcgtggctcgcttatcggcttacatagctgaaaataaaagcaaatggctactacaatcgtcgaaaatgagaaaccagctactgcagttgtcgaaaaagaaaacacggctactacggccatcaaaatcagaaaaaacggctactacgatcgtcaaaagcaaaacaatggctactatggccatagaagagaacatgatggatactgatgccatcgaggtagaaaagagaatgatggatattaatgccatcaaggaataa

SEQ ID NO: 6878 - DNA, 375 bp, Glycine max
  Peptide Sequence Number=SeqID_123656
atgaattcccaagcagcaagcagacacaagcagttgcagggtccaaagcctgcttctctaattattaacagaaactccacaaagatcagtaagcagaagcagcacctctcacatcattcaccagttatagtgcatttgaaatctcccaaggtcattcacgtcaggcctgaagaatttatgagtctcgtgcagcagctaactgggaaccccgtatctgcagctgctgttgctgccaattctccaaaaatggagaagagtagcaccgttgcagccatggatgaaaacccagtagaggattttattggtagcctagggcgtactgccaatatttcagttgatttccaagctttaatgcactttgtagattttgtataa

SEQ ID NO: 6879 - DNA, 426 bp, Glycine max
  Peptide Sequence Number=SeqID_123657
atggagaactccatgagattaggattgatggctgtggttgctgtatctggaagcatggccttcttggttcatcaagtccataaacgtatactatctaacttcatggagaaatttgagtgtgaaatgggtggcgtcttatacgcacatggccaaaagaatttgtgtggatcagagaaacatcaagcaaagaagaaggtgcggtttgcaaaagaagcattgggaaacaataattgtcgtaaaggtgatagaatggttaagataagggtgcaacggatcaaggctgaggaaattttggtgatcaagaatgttcagaaatggaggcatgggccgaaattagaggacatgatgcctcctaacagggcagttctatacaggggaattatgaaacataggaataggagtatttatgggagacttcgattttag

SEQ ID NO: 6880 - DNA, 558 bp, Glycine max
  Peptide Sequence Number=SeqID_123658
atgaggtggaaaggaaaaggacgttatttgttagggttgcaagatagagtccacgcccacgatgtcgaacaggataattctccggcaggcgggtgggtcgacgaaccggcggcagccgctgctgctgcagcggcgtccctcgaagatggcgacgcgcgtgggggaggtggtgggcggcacggcggcggagtgcgtggcggtgtgctgctgcttcccctgcggcgtggcgaacttcctcctcctggcaatctacaaggtccctgcggggctgtaccggcgagtgctgaaaaaacggcggcaccagaagatgctgaaggaagggctgcggaagcccacgcgccgccactgctcgtgcggcttgataacaacgatgacgccacgcgcgcgctcgagaaggagatgtgggaccagttttacggcactgggttttggagaagctcttctaacagagaagtcagagaagaagaagtaaaaccctcccaaacgctcccttcttcaaatattaatgttcttgttcccaatcctcagcctcagctttttgcttcaagttcaagttga

SEQ ID NO: 6881 - DNA, 2397 bp, Glycine max
  Peptide Sequence Number=SeqID_123659
atggaaaatgcaagcacgtctagcttagcgagaacgaaatcggatcagctactggagacggtggccacaacagctgagaagtcgccaccttcggcggagggaggcggggtcctgtcaaggaaatcgagctggaggatgacggcgtcgtcgccgggtggcggcggtgggagaaacacatacataaggaaggcaaggagcgctcagttgaaggtagaggtggacgaggttggcagcggcgtggctcttagccgagcttccagcgccagcttgggcctctcattctccttcaccggcttcactctccctcccgatgaaatcgccgattccaaaccattcagcgacgatgatatcccggaggatattgaagctggaactcctaagccaaagtttcagacggaacctactctgccaatatatctaaaggcaacgatgaagcttcatttagcgatcaacaccaccaatagaacatgttacatggctatcaatatagcatggtcaggttcagtcttgtacaaagtttcattccatttcacagatgtgacatacaaagtagtgatgaaaggcataactacaactaaggagaaggatatcttaaaggggatcactggttctgtaaatcctggggaagttttggcattgatgggtccgtcaggaagtggaaagacatctttgttaaatctgcttggaggaaggttgattcaatccacaattggtggctctatcacttacaatgatcaaccttattccaagttcctaaagagcaggattggattcgtgacacaagacgatgttctgtttcctcaccttactgtaaaagaaacattgacttatgcagcccgcctaagattgccaaatacattaacgaaagagcaaaaggaaaaacgagctttggaagtcattgatgagctggggttggagaggtgccaagacactatgataggaggttcctatgttcgaggaatatctggtggagagaggaagagagtttgtattggcaatgagatcataatcaacccttcacttctgtttcttgatgaaccaacttctggtttggattctacaacagcgttaaggatagttcagatgctacaagacatagcagaggctggtaaaaccgtggtgacaacaatccatcaaccatcaagcagactctttcataaatttgataagttgatccttctaggaaaagggagtttgctgtactttggaaaagcatctgatgcaatggactatttccagtttataggctgtgcacctcttattgccatgaacccagcagagtttttattagaccttgcaaatggaaacgtaaatgatatttctgtgccatcagagttaaaggatatagtgcaggtgggaaatgctgaagctgaaacatgcaatgggaaaccttcagcctcagttgtacaagagtatctggtggaggcatatgattctcgagtcgcagaaatagagaagacaaagttaatggttcctgtccctcttgatgtagaactgaagtctaaggtttgttcttgtaaaagacagtggggagcaagttggtttgagcaattttccatattattttcaagaggattcaaagaacggaggcatgactactttagctggttaagaatcacccaagttctagccactgcagtcatcttaggattactctggtggcaatcagatgctaaaacacctaaaggtttgcaagaccaggccggactgcttttctttattgctgtgttttggggattctttcctgtgttcactgcaatattcacatttcctcaagagagagccatgctgactaaggaacgaacaaccgatatgtacagactaagtgcttatttcgtggctagaactacaagtgaccttctactggacctggtgctaccagtgtttttcctccttcttgtttatttcatggccaatttgagactcggttcagggcgttttttctttagtattcttaccgtttttctctgcatcatagcagctcagggtcttggacttgctataggggctacacttatggacttaaaaagggcaacaactttggcttcagtaactgtgatgactttcatgctggctggagggttttttgtgaagctgcatctcgaacgccgtttgtgtttaccgttaccggatccaggccatcgcagggggccaccgttggcgagtggccaaggaaaacctctccgctaccgggaaggggaaactgcctctgacgtcgaggtcgacggaggatatctacacgcggtcgcagctgtaggcgtcggcagcgaacaaggagagcttcttcacccgaaagatggcggagaaacaagtcgcaatttctttgggttgttgggatttgggtttggacagtgggtgagtagtgtggtttggactgaatctccagatttggtttga

SEQ ID NO: 6882 - DNA, 191 bp, Glycine max
  Peptide Sequence Number=SeqID_123660
atggtttacgagtctcaaattccagcccagttcaacttttttggagaacgggccgagccagcctatcatacttggcctgatttgacacccctaaccaaatccattcacttaggtagtgatattgctaccattggtaccaccatcattagcagtgatagcaatatcgacaatgacaataattgtgacgatag

SEQ ID NO: 6883 - DNA, 222 bp, Glycine max
  Peptide Sequence Number=SeqID_123661
atgaagattgaagagagtgggtggtggctgtccaaggttgttaatgcttgtttgtctcatgcttcggctgtttccaatgttgaggtccaacacacctcacatctttctaactctcaaaaaaagcctgcgaagcttcttagtacagaactgtgcactgttttctggccccattttcctccgtggacccccctctttcatcccaattcagatttacaaaaataa

SEQ ID NO: 6884 - DNA, 556 bp, Glycine max
  misc_feature (463)..(463): n is a, c, g, or t
  Peptide Sequence Number=SeqID_123662
atgcttaactgcacaaagcccaacatgagtataaagacagcaacaaagaggaaaaacaagaagtatagaaataccaaaacagaggccaagcttgctgctgtgaaagaaagatttggacgagagatccatgtttttgaaacatcagttgtttctttatcttcaaaggctgcattatccaatggagaggagactgatgacttctatgagtttactgctgaagattattacaggcttttggctactaaaaaggaagataaattcttgaagactcgaaaaatccgagaagcagaagaggcagctcgtaggtcaagaataaccaaagctgtaattagagttcgcttccccgataatcacacgttggaggttaccttccacccatccgaaacaatccagagtttaattgatctcctcactaaagttattgcacagccagagcaaccattttatatatacactactccgnctaagaaggtgatcaatgacatgtctcgggatttttacactgctggcttttgtcctggtgccattgtgtacttctcatacaatgtcccaaaag

SEQ ID NO: 6885 - DNA, 1142 bp, Glycine max
  Peptide Sequence Number=SeqID_123663
atgtcggtggaacaaaagctggtgacccttctccgcttcgaagccacgcttgccgattcttttctcgccgacctcgatgaactctctgataacgaggctgaaattcccgaggataacgatgtggatgccgcagacatggaagaggatgtcgatggcgaccttgccgacctagaaaacctaaactatgatgacttggacagtgtttccaagttgcagaaaacccagaggtacactgatgttatccagaaagtggaagaggcacttaataaaaaggagtctgaggtcttgtttcaggtagtggatatagaagatgatcctgaataccaactgattgtggattgcaatgcactgtcagttgatattgaaaatgaaattgttattattcacaactttattcgtgataagtatcggttgaaatttccggagcttgagtcactggtgcatcacccgattgattatgctcgtgttgttaagaagataggaaatgaaatggatctgactcttgtggatttagaagggcttttaccctcggctattattatggttgtctctgttacagcatcaactacaactggaaagcctctcccagaagaagtgcttagtaagacagttgaggcctgtgatcgagctcttgatcttgactcagcaaagaagaaagttcttgatttcgttgagagtagaatgggctacattgcacctaatctttctgctatagttgggagtgctgttgcagctaaactcatggggacagctggtggtctagcatctcttgcaaagatgcctgcttgtaatgttcagcttcttggtgccaagaaaaagaatcttgctgggttctccacagcaacatctcaatttcgtgtaggttaccttgagcaaacagaaatatttcagactactcctccttctctaaggatgcgagcatgccgactcctggctgcaaagtctacacttgcagcccgagtagattcaatacgtggggatccatctggaaagactggaagggctttcaaggatgagattcacaaaaaaattgagaagtggcaggagccccctcctgctaagcaaccaaaaccgcttccagttccagattctgagcctaaaaagaagagaggtggtcgtcgtcttaggaagatgaaggaaag

SEQ ID NO: 6886 - DNA, 312 bp, Glycine max
  Peptide Sequence Number=SeqID_123664
atggctagcaatgagggtcattggggatatgcatctcacacagggttgaaggggagcaaacatgaggatcatatttactgttctatgatattttatagtgtaaaacatgggtacttgttggttgacttcaataggattgattcaaagaaatgggttttcatatctgatcaacaaaaggacttggagggaaatgtagagcatcgggtatgcgtaaggcatttatataacaatttcaggaaaatgcacctgggtggtcacttaaaagatttaatgtggcaagttgcaagagccacaactgttccttatttctag

SEQ ID NO: 6887 - DNA, 501 bp, Glycine max
  Peptide Sequence Number=SeqID_123665
atgacaataacacgacatcgagaaaaaccaaaaaacaataacacggcagcgagaataatgcttgtttgttatgaagaaactagaaacgatagcgagaaaaatcgaaaaaagaaacagggagcagatgagaaaagaaacaagggcctacctgtgcagggaaatggaggcgacgacgtgaaacaatggaggcgtttggttcgcttgcgggaaacggcaaggagaagacaaagaagaaccgtttttgtatttgtgacggcggaagcaacggacaccgcgtcgtaccggagtcgtacccgcatgtgtgtccggtgcgagtccgatgtgggacacgccgctaaagtgccgcgcccgtgcttcttagtgtatatgtgtattggaattagattcacgcatttgttgcaatgcactaaggcgaatctcaaagaacaattcagcgttgtcgatattgaagtgagagaggaaggcaagaacaaaaacaatgatgtttttctcaacgcctga

SEQ ID NO: 6888 - DNA, 1869 bp, Glycine max
  Peptide Sequence Number=SeqID_123666
atgagcatcaccagtggtagcaactcaatcctgaaaacgctgaggttgaagaatcccaagcttgtactgttagagtgttgttccaatgctagggacctcaaaatcatccatgcccacatgctaagaacccaccttttcttcgacgtgtttgcagccagtcgcctcattgctttctgcatagactcaaccaccaacttgctgcattacgccataagggtcgcgtcccaaatccaaaatcccaatctcttcatctacaatgcactcatacgtgggtgttccacaagtgaaaaccctgaaaactcctttcactattatatcaaagctctacgctttggtctattacctgataatatcacccacccttttttggttaaggcatgtgcccagcttgagaatgcacctatgggcatgcaaacacatggacaagccattaagcatggatttgaacaagatttttacgttcaaaactctcttgttcatatgtatgcctctgttggggacataaatgctgcgaggagtgtttttcagaggatgtgtcggtttgatgtggtgtcatggacttgcatgattgcggggtatcaccgatgtggggatgctaaatctgcacgtgaactgtttgatagaatgccggagaggaatttggtgacgtggagcacgatgattagcggttatgcccggaacaattgttttgagaaagcggttgagacgtttgaggctcttcaggcagaaggggtggttgctaatgagactgtgatggtgggagtgatatcttcttgtgctcatttgggggctcttgcaatgggggagaaagctcacgagtatgtgatgaggaataagttgagtttgaatctgattcttgggacagctgtggttgatatgtatgcaagatgtgggaatgttgagaaagctgttatggtttttgagcaactgccagaaaaagatgtcctttgttggacagctttgattgctggattggccatgcatggttatgcagagaaagcactttggtatttttcagaaatggcaaaaaaggggtttgttcctagagacattacgtttactgcagtgttgacagcttgcagccatgcaggaatggttgaaaggggtttggaaatattcgaaagcatgaaacgtgatcatggggtggagccgagactggagcactatggatgtatggttgatcttcttggtcgtgcaggaaagttgagaaaggcggagaagtttgttcttaaaatgcctgtgaagccaaatgctccaatatggagagcattgctaggagcttgcaggattcacaagaatgtggaagttggggaaagggtggggaagattttgttagagatgcaaccagaatatagtggtcattatgtgctactctccaacatatatgctcgtgcaaataagtggaaagatgttactgtcatgaggcaaatgatgaaggacaaaggagtaagaaaaccacctgggtatagtctcattgagatagatggaaaagttcatgaatttacaattggagataaaacacacccggaaatagagaaaatagaaagaatatgggaagatataatactcccaaaaataaaactagctggctatgttggaaatacagctgagacaatgtttgacattgatgaagaggaaaaggaaggtgcccttcacaggcatagtgagaagctggccattgcatatggaattatgaagattcgggctcctacaccaattcggattgttaaaaatttgcgtgtctgtgaagattgtcacacagctaccaagttgatttcaaaggttttcgaagtggagttgattgtgagagatcgaaaccgattccatcattttaaagaaggcacgtgttcttgtatggattactggtga

SEQ ID NO: 6889 - DNA, 1287 bp, Glycine max
  Peptide Sequence Number=SeqID_123667
atgcggagcttcaggatgagaaacttgttgtcccgtgtcaaaaagaaaaccatcaaaaacagaaacagaagttgcatttccattacaaaagagttagcacatctagtggaacaagaagaagaagaagaagaagttaatgaagaaggtttcaacatcaaaagctctgccccatcacacactcacggtgttcaacccttggggaatctctatctgaacacaagttccaccaactccagagacactggcttaggtaatcttcacaccctttcggatgagcttgttctcgacattctcgggtttttggattctacttccttaggggttttagcctctgtgagcaagtctttctatgtgttcaccaaccatgaacccctttggaggaatctcgtgttggagaatcttctcggtgggtttcagtacaaagggtcttggaaatccacttatgtttctgcttgttacccttcatttgataacttcgctgttgctcttgggggtttcaaagttagagacttttactcggattatctcttccagagttggctctgtgctaacctcgaaatgaagcctgagtggttggagagggataatgtggttcggaagagaggaatttcggtcgaggagtttgtgttgaattttgaagagcctaataagccggtgctgttggaagggtgtattgataattggggtgctttgaggaattgggatagggattatttggtgaggttgtgtggtgatgttaagttttcagttgggccagtggagatgaagcttggagagtattttgggtactcggatcaggttagagaggaaaggcctttgtatttgtttgatcctaagtttgctgagaaagttccaaaattgggtgatgaatatgaagttccggtgtactttagggaggacttgtttggtgttttgggcaatgagaggccggactacaggtgggttattattggacctgctgggtctggatcttccttccatgttgatccgaattcaacttcggcttggaatgcagtgatcaaggggtccaagaaatggattttgtttcctcctgatgtgattccgcctggcgttcatcctagtcctgatggtgcggatgtggcatctcctgtttcaataattgaatggttcatgaacttctatggcgccaccaaaaattggaacaagaaaccaattgagtgcgtatgtaaagctggagaggtgatctttgtgcctagtggatggtggcatttggtgatcaatctggaggaatctatagccataacccaaaactatgtcagtaggtga

SEQ ID NO: 6890 - DNA, 852 bp, Glycine max
  Peptide Sequence Number=SeqID_123668
atgataagatttaatcttgcttggataatcaagattagtttgaggaacagggggataaactttgttgctattgatctaaacaagccactaccagaacaaggtccttttgatattatcttgcataaggctattagcattttgtccggggaggtttggcgtgagattattgaggattatagggaaaaacatccagaggtaactgtccttgatcctccggatgcaatccaacatttacacaatcgccaatccatgctgcaagatgtgttggatctgaacttatctgattgtcatggcaaggttggtgttccacgtcagctagttatcacaaaagagaaagacccctctagtatcccttatgaagtcactaaggctgggatgaagttgccattagttgcaaaaccgctagttgttgatggcactgcaaagtcacatgaactatttcttgcttatgatgaattctctctttcagcggttgaacctccactggttctacaggagtttgtcaatcatggtggtcttctctttaagatttacattgttggggaaaccataaaggttgtgaggcgtttctctcttcctaacatcagtaagcgtgaactatcaaaagttgctggtgtattccgttttccaagagtttcatgtgcagccgcttctgcagatgatgctgatctagatcctaatatcgctgaacatccaccaagacctttattggagaggcttgcaagggagctccgtcatagattgggactccacttgttcaacatagatatgattcgagaatatggaaccaaggatgtgttttacgtcatcgacatcaactactttcctggcaagtataacttgtcccattag

SEQ ID NO: 6891 - DNA, 1278 bp, Glycine max
  Peptide Sequence Number=SeqID_123669
atgggtgatgaacttgtaattgatggtggaatggcatgctttgaagttgttgaaaagactggaaatgatttgcattgcaagtgcatagatgctggtcttttcctgcctggagccaaacttagtttctggagagatggaaagcttgtgagagggaataacaagctccccactctatcaacaaaggattgggctgacattgactttggtatagcagagggagttgatttttttgccttatcttttgtcaatcatgctgattctgttaaggatctaaagaactacctctcttcaaagtcaaccaaatccataaaagttttggcaaagatagaaagctcagaatctcttcataaactggaggaaatagtgcgagcttctgatgggatcatggtggctcggggtgaccttggggtcgaaataccacttgaacagattcctacggtccaagaggatataatttatgtatgcagacaattaaacaagccagtgattgtagcttctcagcttcttgagtcaatggtcgagtatccaacaccaacacgtgctgaggtagcagatgtttctgaagcagttagacagtatgctgatgctttgatgttgtctggagagtcagctattggatcatatgcacaaaaagctttggcagtcttggatatggctagcagtagaatggaatcatggagtcgggaggaaaacagacaaagtcttgttaactaccatcaacttggagcatcattgccagaatgcataactgagcaaatatgcaattgtgctgttgaaatggccaacaaccttggtgtggatgccatctttgtgtacacaaagtatggacacatggcatcacttctatcacgcaaccgcccaaatcctcccatctttgctttcactaacgatgacagtacccgcatggctctgactttgcaatggggtgttgtaccccttctggttgatttgtccgatgatgctgaatccaacatctcaaagtctgtccaacttatgaaatctagagggttgatcagccaaggagatgttgttctagtggtctcagatgttgctccaacacgtgccactcctatggctttccagtctattcagcaagttttgaaacctctttcaagagattcttatgaattacacttcgtgaattgcccattaatactacaatggcaaagcttctcagcttacacgctactccatgactcggtttcgtctttccatgatattcttacggaagggatctctgttgcttgctatgctggctacctacagtctgctaagtag

SEQ ID NO: 6892 - DNA, 249 bp, Glycine max
  Peptide Sequence Number=SeqID_123670
atgaagaaaagagatacgggccatcaaagtgtgtcattggagaataagacaggagattcaactgtgctgaagataggagattcggctaaagttctgataaaacaaggcatgaagggaaaaaagaataaatatgggtttaacaaaaataagcgtgagaagacagagaagaaaatggtggtggatgatgaaactggcgacaaacataagctgtatgaagtcctaaggatgccatgtaaaacaaaatactga

SEQ ID NO: 6893 - DNA, 486 bp, Glycine max
  Peptide Sequence Number=SeqID_123671
atggggctacacgccctcccatacagaggaatacacgtcctcgccttcagaggtatacacaatcttgccatcataggagtacacgtcgtcgccttcagaggactacatgtcctcaccttcagaggattacacatgctcaccttcagaggactacacattctcgctttcagagggctacacaccgtcaccttcagaggactacacaggactaacggtcttggccttcagagggcaacacgccctcaccttaaatggcctacacaccctcgccttcagagggctacacacgctcaccttcagaggactacacgtcctgaccttcagagggcaacacgccctcaccttaaaaggcctacacgccctcgccctcagagggctacacatcctcaccttcagaggactactcgtcccttccttcaaaggactacacgtcctcaccttcagaggactacacgtcctcaccttaagagtgctacacgcccttaa

SEQ ID NO: 6894 - DNA, 381 bp, Glycine max
  Peptide Sequence Number=SeqID_123672
atgtcacaaaggaaggacaaggaacttaaggggagtagcaacgggcccattggcggttaccataggtggttgaaagcctatgcacaagatctggattggctcctaactttaaggaccactaaggggatggagggtgaagctctgaaagaagacgaagaggtacaggccctcaagacaaagcttgagaaagcccaaacaatcaaagaaaagttcaagtcagcagctgttaggatccaaaagaagaacactgaactgagagacgtcaatatagccaccaccaaggccttggagctagaggccgaaaaaaattccgaggggttctgtggagcaataacaacgagcttaagctccgaagagaggaaagggaccaatcgcgagtag

SEQ ID NO: 6895 - DNA, 661 bp, Glycine max
  Peptide Sequence Number=SeqID_123673
gcgcatcctcttcgtcgtcttccaccgtattgccttctgccaacggcgtgttggcggtcaacagggtgcgcgccagaatgatgccgatcgccaacgccagcaggatcatcaggcgcagcaggttggtggtgttgtccacctgcttggactcggtcgccagcacgtgggtgtcgagggtgatgcggataaagccgatcgggccgtctttgccctgaatggattcgaccaactggtggttgaagtagctgccagcgcgcttgccgtcgagcgacagccgatcgcgtatacttatctgctccccggcgtgggagaccagcgtgccgtccaactgatacacgctgacgtcgagaatgcggctgtgatcggtgagctgcttgaggatggcgtcgatgcgcgggttgttgccgtcgtcgtccagcagcggcgccaggctgtaggcgacctgtttggtcagcgtctgcgccagctcttcgacctgttcggatcgcgccatttggtgactcaggctaaaataagaggcaccctgcatcagcagcaccagcaaagccaggcaaatcaggataatagcggtacggtgcaggcgaaatttcagtttagcgcgagccatgcaggttccttgggcatcggggacactttatgttgccagaaccgctggcgatag

SEQ ID NO: 6896 - DNA, 315 bp, Glycine max
  Peptide Sequence Number=SeqID_123674
atgaccatggaatcgcaagcaaatggtgtacacagctctaaacatgatgatgatggtcgcttaaaacgaagaggaacatggttaactgcgacttcacacatagtgacggctgttattgggtctggggtcctatcactggcatgggccgttgctcagttgggctggattgctgggcctgccattctgacaatcttttctgtcatcactgtcttcacttcttctctgctcagcgattgttataggtaccctgactctgttcatggaaccagaaaccataactacagggagatgagaaagaggtacgggaccacataa

SEQ ID NO: 6897 - DNA, 897 bp, Glycine max
  Peptide Sequence Number=SeqID_123675
atggacttgcagtacattccccaaaggatgaaatcaagaggagctgatcgatttgcagtcatagttgcaataggacttgcatgggcatttgctgaaattttgactgcagccggtgcctacaataaaagaccacctaaaactcaattcagttgtcgtactgatcgatctgggttaattagcgctgctccttggataagagttccatatccatttcaatggggacgcccttctttcaatgctggtgatacttttgctatgattgctgcttctcttgttgcaatagtagagtcaacagggacattcattgcagcatcaagatttggcagtgcaacccctgttccaccatctgtgcttagtcgcggtgttggctggctggctatgggtctaagttgtcttgactctaggcataagatgagttatcaattttcaatcaatcaacgaaaatttggagcagttcttgcttcaatacctttgccaattatagcagctatttactgcgttctctatgcctacgtagcatcagctggccttggtttccttcaattctgcaatctaaacagttataggtcaatgttcatcgttggcttttctctcttcatgggtttatctgttccacaatatttcaacgaatatgtattgctatccggacatggccctgttcatactggcaccaccgcgttcaacaatatagtgcaagtgattttctcatccccagcaacagtggcaatcatagttgcttacttcttggatttaactatgagtcgtggagagggctcaactcgccgagacagtgggagacactggtgggaaaaattcaggaccttcaaccaggatactagaactgaagacttctattcacttcctttgaacctcaacagatttttcccatcattctga

SEQ ID NO: 6898 - DNA, 468 bp, Glycine max
  Peptide Sequence Number=SeqID_123676
atggaagcttgttcttgtggtacgttgttcatcgcgttaagcaacaacttcccggtgttcattactgtgttgcctgttctccctcatggcgtacctgaagggattcgtgttgggtttctgcattgcttggctgcgcttgggaccattgtcatggcttcctccacccctgtacctttgatgggtggtgacaataaatttatacattccatgagagccatacagagggcacttattactgcatcggtctttcaaatcagtattggctttggacggattttttgccaggcaatgtgcctcagcccccttagtgtggttccccttgtcactcttactggcctaggactcttcctattagcatttccaagaatgctagattgcattgatattggtctccctgcatttcttatccttgtcatcgtgtcccaggtatgttgctttctttaccaaatactgaggcaaaaagtataa

SEQ ID NO: 6899 - DNA, 339 bp, Glycine max
  Peptide Sequence Number=SeqID_123677
atggatagaaacagagaggaacagaaaagacgaatattatcagcaagacacagagcgttctacgttgtgacttgtgttgtgagtagtgaaagcgatgatgactgtttttattttcattatcatcagcaaaagaagatatttatactagaggaaatcaccattcatatcatctgcaacatgcaccaagggaaatgcgagaagaatgtttacacagtaatgcgccttcatgcgaggttaagacaatggggttgtgtcaaggtgtttctgacattaaaagtggaaacagagggcatgaagatggattttgaaatttggcttattcttcttatcaaaagctaa

SEQ ID NO: 6900 - DNA, 975 bp, Glycine max
  Peptide Sequence Number=SeqID_123678
atgccctcctcctcaacaatgcctctctcgccggaccctcccttcctctgcaccgaagacgccagcgaagtcacctccgaccaccaccatccaccgtcccccttcccggattccgacgaggccgccatcgccggactccttgacgccgagacccaccacatgccggaaaaggactacctccgccgctgccgcgaccgctccgtggacgtcaccgctcgcttggacgccgtcaactggatcttaaaggtccacgcattctacgagttttccccggtaacggcgtttctctccgtcaactatttggaccgttttctctctcgatgttctcttccgcaagaaagtggtgggtgggcatttcagctgttatcagtggcatgtttgtctctagcagcgaaaatggaggagtcccatgtgcctttcttactggaccttcaattgtttcagcccaagttcgtcttcgagcccaaaacggttcagagaatggaactatgggttatgtctaacctcaaatggagactccgctctgtcacccccttcgactatcttcattatttcttcaccaagctcccttcttcctcttcccaatccatcaccactgcctccaacctcattctcagcaccactcgtgtcattaacttcttgggatttgcgccgtccaccgtcgcagccgctgccgtgcagtgctccgccaacggccaattaccgctgagttttcatgacagattaaacagtgaaatggtgagatgctgtcaccaactaatggaggagtacgtggtggacacgtgtcccgcatccattaaagtcagaataaccgaggcggcggcgccgtccagccccgtcggcgtgctcgacgccgccacctgtgggagctgcgacacaccttccgagaggaattttgctggctcagccgaggaacaagccgagccgccaaataaacggcttcgatcctctgcctcggatgcaccccggcggtag

SEQ ID NO: 6901 - DNA, 285 bp, Glycine max
  Peptide Sequence Number=SeqID_123679
atggaaacggtgagtgagggtaggcgaagacgttgtgactctaacgaacatacacttgccgcacttttcaacaactctgacagaccggtgtcgttttctttgctgcagctatggctcggaaatcatacttgtacaatactagctagaaatagaattagaataccaccggttacaatggcttcttttttattaggaataaccttagtctttcaatattttataaataattcttcttggcatgtccaaattggtcatttgatgtttggcttaaaatctccaacctga

SEQ ID NO: 6902 - DNA, 216 bp, Glycine max
  Peptide Sequence Number=SeqID_123680
atggactggcttacagggttcgtggtctgtgcgggcccatggaccgggccatttgaccctcgggacgcaagacatgggcatattaatttattaggtccatgtaaaaatgaggcgcgggctgacccggttcgctgccaatgcaagtttatgcgaacagaccttacgcgagacggattagtccgcttactcatccgtaatgctcagagagagatatga

SEQ ID NO: 6903 - DNA, 219 bp, Glycine max
  Peptide Sequence Number=SeqID_123681
atggatgttagaggtttgggtgttaggaacaaaggcagcacgcaatacgttgttaagggatcacagaaagaatttccgcgggagcttcttcaggagttgaaaatcgtctgtcaggataacatatctcttgattatgatgaaagatatatccatggaaaaccacaaaacagctttcacaaggctgtcaatatcccagatgtgattgtttatccaacatga

SEQ ID NO: 6904 - DNA, 318 bp, Glycine max
  Peptide Sequence Number=SeqID_123682
atggatgttgttgttgagcctggcattggatggatggagcttaacgagtatttggaaccttatggcctattttttccacttgatccaagtcctggtggtagcattggaggcatgtgtgctacatgttgctctggttcgccagctgtgaggtatggcactatgcgtgataatgtcatcagtctcaaggtggttcttgccaatggagacattgtgaagactgcatcacgtgctaggaagagtgctgcatgggactacattggtcatatctctagtcaatgtgggatctcaacatcagcatacatatccttttttgcttaa

SEQ ID NO: 6905 - DNA, 825 bp, Glycine max
  Peptide Sequence Number=SeqID_123683
atgtgtttttgttttccacttgtagtgtgtgatcaacagttcttctctgagttgatgaaggaagcatcagatgtagtaggatactttagttcaagagttaagaatctccttcatcttcatattgcaacaggaatgcagagatatgtattgcgtttgcgccagtgctttaaagatgataggcaagcccttacccaagaagggaggattctaattgagtacattgcaatgaatgctattgcaatgaggaaaatacttaagaaatatgataaagtacacagctctgtgaatggagagaatttcaaatctaggatgcatgccgaacacattgaaattttgcactcaccttggctaattgagttgggtgctttttatctgaattctagtggactggatagttgtgaccttgatggagtctatggtcgcttttcatgtgagctaaacataactaaagctgtaatgacattggttcttcccgattctattaatctcgagcatgatcttacttgtgcaatttgcctggattttgttttcaacccatatgctttgagttgtggtcatatcttctgcaagtcatgtgcttgctcagctgcctctgtgatgatttttcaaggccttaaagctgcaagtcctgagtcaaagtgtcctatatgcagagaggttggagtttattctaaggccgtgcatatgttagaacttgatctgcttgtgaaaagaaggtgcaaagactactggaaagagaggctagctggtgaacggggtgataagttgaagcaatccaatgactactggaatttacagtccacatattcaattggattgatgtag

SEQ ID NO: 6906 - DNA, 789 bp, Glycine max
  Peptide Sequence Number=SeqID_123684
atggtgaaaacaaagcagaaacgcacaggggaagttcctggtaaaaaaagtggtacttcttcacattgccttgttgattctggagacggtgataatcagcatgaggatagtgattggattatagtgaaaaagcagagagtcaccattctggtgcctgctgcacctctcaatgatagatcattaatagcaaatcaaggaccaaatcacatgcatcttatgcctcctgaaatagcaagtaaccatgtgcagcttcccatgcagacatctactgtacatccttcaggtaaggaacatgagaaagccactttattggctgtccaaaaggagactcatgccgaaagaaaagctctccttaccttacctaaatcaactgtggtcaatccaccatctttagatcaaagaatagaatcagaaaatccacaagcaatgaacagtttgaagttacataaactacttggagtttctgatgcatcaaaagttattaagcagcctagaacactacttgcaccaagaaggtccttcaaccaggaaactctgaataaaaatttgcgagcatcaaaccttgagaggaagcttgaaagagctggtggactgagcaactggctgacttcacttggactggggcagtttgtgagaatttttcaggggaatagtctcagtaagtatcagctggtaaacctaaccatgaaaaaactcaaggatatgggcgccagtgcagtgggacctcgcaggaaactgatccatgccatggactgtgtttgtcagccatattgctttgaggcgttgtag

SEQ ID NO: 6907 - DNA, 165 bp, Glycine max
  Peptide Sequence Number=SeqID_123685
atggtggtggtgataataagggtgttgatggcggtgacgatgatggtgggttggaataatggcgacaacaatggtggagtgaatagtgacaatagtagcaacaacgacgatggaaacaacaaaagtagtgatggaatgatggtagtggtgacaatgacagtgtga

SEQ ID NO: 6908 - DNA, 168 bp, Glycine max
  Peptide Sequence Number=SeqID_123686
atggtttatccgatccagataaacttcaacatttcccttcattcatcttctatctaccaacacgatatcggtgtaactattcgttgtcgtttccccttgggtcggattccgatctacaggtcgatggtgctcttcctaggatacggtacaattgattttcaattatga

SEQ ID NO: 6909 - DNA, 474 bp, Glycine max
  Peptide Sequence Number=SeqID_123687
atgaaatataggtgccctgcatgcaggaattataagcctcactacgaaaaggttgcaagattatttaatgaacctgatgcagtgcatccaggaataatattaattacaagggtagattgtgggttaaagataaatactaagctctgtgataagttttctgctgatcactatcctatgctcttttggggttctccttctaaatttgttggtggtggttgggaacctaaacaagagaaaagtgatatacgtgtgattgttggtgcacgcacagctgatcggttgcttgattggatcaacaagcaaataggcagttcattcggcctggatgatcagaaatttcaaaataagcttccttcatccaatgattcagacactgtacagattgcaagagctatctacgatgatgtagaagaggtaacttctacaggttttgacatcatcatagagcaccaggaactcgtgcttcacttataa

SEQ ID NO: 6910 - DNA, 231 bp, Glycine max
  Peptide Sequence Number=SeqID_123688
atggatcggattccttcgatctacacgctgatggtgcttttccgtggtacggatttgaagcctggtgccaccgatctacctactttacagaggtctatttcgaaagattgtttggtcaacgatcggagattgctgcgcagattgagtgaagacgagggtgttgttgtaccaatgtcgtaccaatgtcactttcgttgtaagatcatcgacctaggcgtctggtggagttga

SEQ ID NO: 6911 - DNA, 120 bp, Glycine max
  Peptide Sequence Number=SeqID_123689
ggtaatgcctatgcggatgctcttgcgactttggtttatgatttagagagtgactatgagatttttcagcaccctcctgcagctgtgcagagtttgggggagttactccaagacttatga

SEQ ID NO: 6912 - DNA, 447 bp, Glycine max
  Peptide Sequence Number=SeqID_123690
atgtacaaagataattggacccaaccttggcccatgggctcagaaatctaccctaaggttcatgagaaccctagggccttcttcagcagctctagcccaatcttcttggagcctcttgctcatggttctagtgattggtcccttcctagggaggattgcatcagagtggcgcgacgttgttggaccgtgctggtgctgcacgcggccagcattggggtcgctatgttcagatataggatggagatggtgtggtggttatggattgggtggtggcgcggtgagggatcgtgtgcaaatctagtcggagtgggttcagatctggggtggagttggttcaaatttgtggcgaagattgtgcagtgctgcgcgagtaggggtcgtgggttgggtggtggcgtgatgaggggacgcgacggtgttggaggatggggtggggtggttcgatga

SEQ ID NO: 6913 - DNA, 522 bp, Glycine max
  Peptide Sequence Number=SeqID_123691
atgagcaagaggctccaagaagattgggctagagctgctgaagaaggccctagggttctcatgaaccttaggactcatcttctccttgaagtggcgtctcctctctctctccctttctccattccgctgccgttcatcttccaagaagcaaaggaatccattgatgaagaagatcctaggcctacaagctccaatggagcttgcatcacactccctacccacgacccacgacccctacgcgcacgacctcaatctctgaggctcttcgtgtttgggatggagaccggggtctatggtgtcggggtggttgttgttccaatgatgatggagtctcaggtgaagcacgcacttgttgtcaaagttatgggtcgtactggatccagaggacaagtgacccaggttagagtgaagtttttggatgatcagaaccgtcacatcatgaggaatgtgaaaggacctgtgagagaaggagacattctcaccctactcgagtctgaaagggaagcaagaagattgcgctag

SEQ ID NO: 6914 - DNA, 264 bp, Glycine max
  Peptide Sequence Number=SeqID_123692
ttttctcctcatgtgtgttttttcattgactggcacaaagactcactgcattctcaggcagaacaaaatacttgtggttgccttttttccaccaaaagaacaggagatgatgtgaatcacagtcttagcaatctggctgtaattagccttcacagttgtgcaccaagacagcttgccacgatgcacttaacagttgctttgattttcccatctctccacaagtttgcaagcatcagtcacaatactgatattgtgggcatgtga

SEQ ID NO: 6915 - DNA, 1254 bp, Glycine max
  Peptide Sequence Number=SeqID_123693
tcctccaaggctttcaaagttggcggttataaatggaagattgttttgtatcctaaggggaggaatgtggagtatttgtccttgtatatgaaggttgctgattctctaccaccatatggatggagcagatttgtatatttcaggttggctcttattaaccaggtggatagcaagaagtcaattgtaaaggaaacccagcagaagtttaatgctggaaacagtgcttggggttctccatctttcattcctctcagtgaattccatgaccttgctcaaggttatcttgtgaaagatgcatgtataattgaagctcaagttttagtctctaaggtcgcatttaacattccaggcagcttagcccaaagcattacgacaattcatgaacctaatggagatcaagctaggctaacagaagtggaaatgacaccttcagatttgacatcaagtcctacaagtacccaaggttctaaagatgatcacgtaaatgaaatagaactgcaactcatacactcagaagatcaagaaataggaccctcagcctcagatttcactccaagtcctaaacaagttcaatttgctcctagtgctccccctatgtatccttctttatttgatgaatctgagcaagtgatcttaacccctctaagtgaccttatagatttcaatagtgtagaggcagaagaagcatcctttattccattatgggaggaggtatgttcatggcatccatcactaatagagaatcaaagaaggagaagtcccaggttcatattgtgggcattcattgccttgggacgagtgctacatttccttaagactaagacaattagggatatgggtaatgatgattgtatgatgcaccttcaagttctatgggaagaacttcaaccctttggatttgacttgacatggctagagccccatgttcaatcagcaatgagtgcaaaagcttattttgaaagaggagagtacgtgaaaagtataagggtcaatatagcttctttagagatagaattgaagaagctgaagactaaactggctgttgcagaacttgaccttgaggttgcaaggagagacttggcagaggtagaaaatgatttccaggagagggacatggatgctgaacttgatcgagatggaaatagcggaaatccagcgattttgtgcgaaggaaccgcgacggatgagagagaaatcaagagagagaaagagattggttgggataagagaaccaaaacgacgacatttcgttga

SEQ ID NO: 6916 - DNA, 420 bp, Glycine max
  Peptide Sequence Number=SeqID_123694
atgttagcatctaaaggtgatttttcaccacaaaaacctgagaaagtacaagaatttaagcagcaacatcatcatgatgcggagactgaaggaagtaacttcttatctgatgagaaagacaaagagaatataaagtcagctgaagctcccagccccatcttaaagatattgaaaagcgaatttgaatgtcttcctgcctacatgaagggactaacatcatgggaggatctagtcgtggctgttgataagattaattcaagcctaagcaagaagaccaatggatgcagctacttccaccaagatgaaattccttcatttgaattaggtcctaaaacaagatcatatttgctgcttctagtgcgcatgaaccgattggttgttgagacgattgatggtttactatcgtacagagtattgtag

SEQ ID NO: 6917 - DNA, 2091 bp, Glycine max
  Peptide Sequence Number=SeqID_123695
atgatgccgaaaccgatgaacgttttgacaacaaagccctcacctttgagcaccatggtggtgctgctgatcctctgcattctgggtttctacgctctgcatttgcctcactcttccacaccttccttcacttccaaaagcctttctcaattggaaaaactttttctttccacttcctcaaactctaccatttcttcctacctccgcgctcttaccctgcaccctcacctcgccggaacaaaacccgcttcagacacaacccgccacgttctcaaccacttcacttcattgggcctacaggcccatacaacaacgtacaccactctcctttccttccccgtgcgctcttccctctcggcgcactttagcgatggcgcttcggtaagcctgcggctcaccgaagcgtcggggccgggggtggtggcggcgtaccacgcgtactcgccgtcgggcaaggtgcacgcgcgggcggtgttcgcgaactacgggagggagagggactacctcgcgctggcggcgatgggagtgaacgtgagcggctgcgtggtggtggtgcgtaagggcggaaggatggggcggggcgcggtggtggagagggcggaggcgaacggcgcggcggcggtgctggtttacggcgagggtgacacgtggcggaaggggtttgagaggggacatgtgatgagaggggggataggggacccacttactccagggtgggctggggttgagggtggtgagacactggggttggaagatggtgaggttttgaagaggtttcctaaaattccatctatgcccttgtcagctgaggtggctgatattattttgtcctctcttgggggagttcctctgccccttcaatggaggggtacccttaagtctatggtcaggaatgttggtcctggccccaccattctcaatttcacttaccagggtgaaaagaaggtggccaccattcaaaatgtttttgccgtcataaagggatcggaagaacctgatcgatatgttctgcttgggaaccatagagatgcatggacgtatggtgctgttgatcccagcagtgggacagctgcactactcgatattgctcgtcgattttctgctctattgggcttgggttggaagccgaggaggacaatcattctctgcagttgggatgcagaggaatttgggatgataggatccactgagtgggttgaacaaaaccttattaatcttggttccaaagctgtagcataccttaatgtggactgtgctgtgcaaggtcctggtttctttgttggttcaactcctcagctagacagtcttattcttgaggtcacaaaaaaggtcaaggatcctgactctgagggggtatcattatatgaaaattgggctgctgctgctggtggaggcaataatattcagaggctcagtggagtagattccgattttgctccatttgtgcaacacgcaggggttccatccattgacatgtattatggaagagattttcccgtctatcacactgcattcgactcctataactggatggcagagtatggagatccattcttccaccgccatgttgctgttactggagtttgggggcttctggcccttcacttggctgatgatcccgttcttcctttcaattacgttccatatgcaaatgagttacagttgtacaaaaacacgttgagcaacttgatagaccagaaaatttctctacacccattaaccctttcaattgaagaatttgcttctgctgccaaagaagccaatgatgaattaaagaaactgagattgcaagaaagtgaaagttgctttgtagatatgaaaaagcgagcattgaatgatagactaatgcttgcagaaaaaggcttcttggatgcagatggacttcaaggaaggcagtggttcaagcatctcgtgtttgggccttcaagcaaccatgaaaagttgaatttcttcccagggatttctgattctatcactagattgtcgggtataagtgaaagagaaaggctatcatcaatccaacacgagatttggagggttgccagagccattcgtagagctgcttctgcactcagtggagaattcacctaa

SEQ ID NO: 6918 - DNA, 276 bp, Glycine max
  Peptide Sequence Number=SeqID_123696
atgaatgacgatgcattcactcacctgtcaatgtttatgggaggaacttgtgaagcggtccggatttcaattgtcttggtggaacaagcagctgaagtgaataaactcaaagacaatgtggttgatttggaggttaaaatgaagaagttgaggggagagttgaaagctgcagaagctgagtttgaggtagcaaggagagccttggctgaggcaagaaaaggtttcatagagatagaggtggatttgaatgctgaattaggctatgccatgttttaa

SEQ ID NO: 6919 - DNA, 168 bp, Glycine max
  Peptide Sequence Number=SeqID_123697
atgtgggcatttagtctagggtatgattctcgcttagggtgcgagaggcacaaagacaagcactgcattctaagacagaatacaatgtttgcggttgcgtttcttccaaaagaacaggagaacgaagatgcaaatcacagtcttaacaatctggcatggctgtattag

SEQ ID NO: 6920 - DNA, 222 bp, Glycine max
  Peptide Sequence Number=SeqID_123698
atggatgaacatccagaccttaccaaccccaagtattctattctgcctgagaatgcagtgcttgtctttgtgccagtcaatgacaaaacacacgtgagagcaatacaggcaccatataaatatgttggctggctgtcactctgcactgaaaaattgccagacaaaactgttaatgtttcacttcattcatcccaacggattcacatgcagcctctgatgtag

SEQ ID NO: 6921 - DNA, 2439 bp, Glycine max
  Peptide Sequence Number=SeqID_123699
atggacatgcctaccattgatgtggaccttgggcctgaaaagcttgaagatgagaaacagggaggtcccttgttgcattgtgatctttgtgatacagaagtagttcacaagttggctcaaatgttccttccaggtctagccagtgcttgtgttgataacacatcgggagatctcttcaagactccgggttcagtggctgttgatttgaggaaggaaatgatagagtatgttacccaaagaagtgaatcatttgttgctgagtctgttatcttggaaggtggtccagacggtgaagaatcagaccatccttttgatatcatttctgatttcgttgatgactttgtgagttcaaagaggaatctgtttagtcgagtttcgggatggttgctgagtgaaaagagggaagacagaatagatgattttgttcaagagatggaaatgaatgggttttggacacttgacaggagagaaacaattgcagaaactttgctcaagaatgttgactttgagaactcatatcattgcaacatgagttttaattctgctgaagaacttgtcaatcatgttgataactgcaactttagaactatgatatgtgaaaatgagggatgcaattccagattttgtgcagctcatttgaagaatcatgattcaacttgtcctttcaagataattccatgtgaacagaagtgttctgattgcattatgagacgtgagatggataggcattgtataactatttgtccaatgaagcttgtaaattgtcctttttatgttgtgggttgtaggtcagctgttgcacaatgtatgattgaaaaacatcgtttagatgacgttcattctcacttgtggcacttacttaaaggcatctacaagcaagcatatggggatgatcttaaacgacgagtggagcaaattgtacaggcatcatcaagcagccgtttagcagaggctcgggatgttagatctttaaacttcattgtcaaggacattgaagctaagttaggacctttcaaagtgagtgttttggagaaaaataatgcagagattgttaccaagaatgacgaaggggaagctggtgacactgaaaagagcatgaaggcttcagatatggtcaattcaccagataaagctgaattgagtgacatgaaaaatatgaataatgcaaagagtactaccaagaatgaagatagggaacctgttcctgttgaaaataaaggttgtgaagagatggcacaaacttcaaacacgacaaatttatctgataaaactgaagttggcctcccgaatgatgagaacaaagatgctgcagctagtgaattaaaaatcaagggggacgaagagcacactcaaacacataaggaaaaattatcaaatgaagaagttagtgccccagatgagggcagtgcagagaatatcatcaaaagcaaatgtaatgaagacaataaatttgaagataaagacaacgaacaaagcatacaaaattcaaaaatggaaaccaagggtggtttagagaataatgttaagaacaaagatggtgacttaaaaaagagcgcacagacttcagacggctgggaagttaaacttggttgcatgcgaagagcaagaaatatgagaccaaacatcgtttctgaggccgggttgcctactaggatgagtcaatggtgggaaagcattccgtttctcacttctgcagtggtggttgtctgtggaatcatttacttggtttgtcttttggttggatatgattccttcaacgaggtttgcttcttgccgtctgcggttgtttcgcggtttcaagtttaccggatttatacctccattcttttccacggttcactgcttcatgttgtcttcaacatgatggctttagttcccttgggctctgagctggagaggatcatgggctcagttcgcttgctttatgtcattattttggtggctacaagcaatgccatattccatgttctcatagcactgctggtggcacacaatcctttacttacatatgattacctcatgaatgagtgtgcgataggcttctcaggagttctgttttcaatgattgttatagagacaagcctgagtggagttcaatcgaggaggacccttggtgccgttcaaggtcaaactgcttctcatctccattcagattcaaaccttcaagctagacttttggaggatagcagtcccaatagtcctttagattcatccactcctagtaatactcaacagttgtcagaaggaaggcattcagttgacgatgtagctacagcagctgctggtgttccacagaatcagggtgcagttgtttcggaagaaaggattaaaaaacttgtatcaatgggctttgataggacgcaggtggaagtggcgctggctgctgctgatggtgatctcaatgtggcagtggaaatactcatgagccagcagggttga

SEQ ID NO: 6922 - DNA, 1140 bp, Glycine max
  Peptide Sequence Number=SeqID_123700
atggacaatcagaagggaatgagtattagttttgagacattcacgtggaaaattgaaaatttctcaaaacagaacaccaagaaactacaatccaagactttccgaatccgaggttataaatggcggattcgtttgtatccattaatgaagaatgttgaccatttttcattgtatttgatggttgcggattctttacctccgtatggatggaacagaaatacgcatttcaagttggctctagttaatcaattggatggcaataagtcagttgtaaaggagactcagcagaagttcaacggtggatatcgtagctggggctcattttttgtgaatcttagtgacttctatgactctaaacaaggctatcttctgaatgacacatgcatcattgaagctcatgtttgtttctcagatcttagcactcttgaagctaacaatttgaagaaaatcactccaaccaaagactctaaatcaggtgatcaagcagcaagaaattcagaatccacacagcagggagatgataaagaagcagaaacagaaatagaaacagaaatatcagatgagagtgagacatttagttcttcaacctgtgggtctagtgaaacagaatgggaaattcaaagttcagatttgacactaaaagaccttctagatttggcgagtttaggaaaagaagaagctgcttgtgttccactgttggaggaagcatgcatatggcatccttccctgataaggagccagaggaaaagttcaagatggttcaaactatgggcattcacatctttaggccaagttctgcatttactcaagacaagtaaggtgaaggatatgaatgaggaagcatgcaatcgccttcaagggttatgggaggaacttgttaagcattctggatttcaattgtcttggttggagccttatgttcaatctgcattggatatgaaaactcatttggataaaacagatgaagtgaataaactcaaagacagtgtggttgctttggagattaaaatgaagaagctgagggaagaattggtagctgcagaagctgagtttgaggtagcaaggagggccttggctgaggcaagaaaaggtttcatagagatggatttgaatgctgatttaggttatgccatgttttag

SEQ ID NO: 6923 - DNA, 975 bp, Glycine max
  Peptide Sequence Number=SeqID_123701
atggtgcaggaggtgatctgctgcgatcaggatgtcgccatggccaagggtctctgggatggctgcgggccgctccggtgtggcggacgaaagcgcgacgcgcctgcggaggtcggatgccgcccgtccatagccaccctcggcaaccggggcggcgaagagccgcgtgaagcggtgggccgcctcctccaagtcgatgcgatcctgcggtcgcttcggaccggcgatgcttgggcgaatctcggacaggtcgatctccaggaccctggaatagtcgatctcgcccgggcgcaccgtgccgaacagcccctgcgcccggtagtaggcttcgagcgtggcgacctcggactcgctgcgtccggtcgcccggcagtaggcgaccgtctgctcgtcgaccgggaagaagcccatagtggctccgtactcgggagccatgttggcgagggtcgctcggtccggaacggtaagcgtcgagacgccgtcgccgaagaactcgacgaacatgccgacgaccttggcgcggcgcaggcgctcggtgacggtcagcacggcatccgtaatcgtgacgccctcgggcaggcgtttggtcaggtggacacccacgacctccggcgcgacgaggtggacgggctggccgagcatggcagcctccgcctcgatgccgccgacgccccagccgagcacggccagaccattgaccatggtggtgtgcgagtcggtgccgacgagcgagtcgggataggcgatctcggcgccgtcctcgttcctcgtccagaccgtctgcgacaggtattcgaggttcacctggtggcagatgccggtacccggaggcacgacggaaaagttgcggaaggccgactggccccatttcaggaaggtgtagcgttcgccgttgcgcgcgtattcgagcgcgacgttgtcgccgagcgccttcggggtgccgaactcgtccacttttttttttgtgatcgatga

SEQ ID NO: 6924 - DNA, 813 bp, Glycine max
  Peptide Sequence Number=SeqID_123702
cgatggagggcgcgagttgcgtggcatagacgctcgggcacatccgatgcccttcgcgaaaaaacaacggatcgttcagcgccacgcgcagccgcgacagcgcgtggctcaacgcggatgtactcatcgccagctcatcggcggcgagacgaacggaactgtggcgatagatggcatcaaaaacaagcaacagattgagatcgaggcgtctgagcgccggatgcataatattcatcattgggcccgtccggacgatgcttctgccatctacaacatgatttatgagctggcggtgtatgaaaaagccccgcaggaagtggttactacccccgacgagatccgcgaaaccttgtttggcgacgacagtaagaccgaagcgctgatctgcgaaattgacggtaaaacggcgggctatgccgtgttcttcaccagctattcaacctggctcggacgcaacggtatttatatggaagatttgtatatctcaccggactatcgcggccagggcgcgggtcgagcgctgctaaaaaccattgcccggtatgcggttgcgcgccgctgcggacgccttgagtggagcgtgctggactggaaccagccggccattgatttttacctcagtattggcgccgcggcgcaaagcgaatgggtccgctatcgcctcgatggcgaagcgctgcttgctctttgcaaaaagcacagcagccccgaaagagcggagctgctgaaaggcaaggcgtcgcttacgccgccaacgtgcggagacggaatgacatttttcgacccgctcccagatgtgcggcgtagtgagtg

SEQ ID NO: 6925 - DNA, 129 bp, Glycine max
  Peptide Sequence Number=SeqID_123703
atgacacttcaattagcagatcgttctgttaccagaccctatggtgttattgaggatattttggtcaaggtgaaggagttcaatgaggaggttctgaaggttggaaccaagtttgatccagatccatga

SEQ ID NO: 6926 - DNA, 810 bp, Glycine max
  Peptide Sequence Number=SeqID_123704
atcttccagtctccattcccaaaatggtataaccctagtgcaaccttcgcataccatggggggaccccaggccactcgatcgaacagtgcttggccttgaaaagcaaggtccaaagcttgatagaagccggatggtttacttttcaagaggatgggcctaacataaaaacaaacccgcttgccaatcatggaggaggggcggttaatgccatcgagggacacgactccccaaagacctcaacacccatcagcagtgtcggcggtagatctattctatttccttacaagaacaaccgcgcagttccgtggaggtatgcccctccgggcgttaggaagggagaagctaccgatatcagctcactatcggccaaagtgaccaacatcaccgggctaagcggcataacccgcagcggtcgcgtgttcgcagcccctagcctgctgatacagcccgcaatcactaaagggaaagcaaggatgaccgaaggacaaaatgtcaaagtgatccccgcaccggacgaggatgtttcgacgaaggatctttataagggaagagagggctgtggcaagaaagaggtatcactcgaggaggccgacgagttcctccgcattatccaacaaagtgagttcaaagtcttgaatgaagctcatgtagcccaagacatcttcgtagaaggctttgggggaatcgtcaataacatcacagctaacaactacctcaccttcgctgaagaggaaatccccgccgaggggagaggacataacagggctttacatgtgtcagtcaaatgcatggaacacgttatggccaaa

SEQ ID NO: 6927 - DNA, 2424 bp, Glycine max
  Peptide Sequence Number=SeqID_123705
atggctcaagccaaatatactagaatagacaataacaagcgaccgtcaagttactgttcaacagtgactattgtcgtgtttgtagctctttgcttgtttgggatttggatgatgacatcgtcatctgttacacccgtgcaaaatgtagatgtgtctcaggagaataatagtgaggtgaaggaacaggcaactgacccctctaataacaattctcagcagtttgaagataatcggggtgatctgtccgaggatgcaaccaaaggggatggtagtgtcacccctgataaaaactctgacgtgaaagaaaaacaggaggagaaatcggacgaaaagtctcaagaaaaaccttctgaagatacaaaaacagaaaatcaagatacaagtgtgagcgagaagagatctgattctgatgagagccagcagaaatctgattctgatgagagccagcagaaatctgattctgatgagagcgagaagaaatctgattctgctgagagtgagaagaaatctgattctgatgagaatgaaagggagaataaatctgattcagatgaaaatgaaaagaagtctggtgatgcaagtgaaacaacagataagactgaagaaaaagtggaacaaagtggtaaccaagagtctgatgaaaactccaatgagaagaaaacagatgacaatgccaacagtcagggttcaaatgaggtttacccttccgtggctcagtcagagcttctgaatgaaagtaccactcaaaatggttcttttacaactcaggcggcagagtcaaagaatgaaaaggagtctcaagtatcctccaagcaatctactatttggaaactgtgtaatgtcactgctggccctgattacatcccatgcctcgacaacttgaaagcaattaggagtcttccaagtaccaaacactatgaacacagagaaaggcaatgtcctgaagaacctcctacctgccttgtccctcttcctgaaggatacaaacgcccaattgaatggcccaaaagcagagagaagatatggtattctaatgttccacacactaagcttgctgaatataaggggcaccagaattgggtgaaagttacaggcgagtaccttacttttccaggtggtggaacccaattcaaacacggtgcacttcattacattgacaccatacaacagtctgtaccagatattgcttggggcaatcgctcacgtgtgattttagatgttggatgtggtgttgccagctttggtggctttctctttgaaagagatgtacttacaatgtcattggcaccaaaagatgaacatgaagctcaggtacagtttgcacttgaaagagggattcctgctatatctgctgtgatgggcacaaagaggcttccctaccctgggagagtatttgatgtagtccattgtgcacggtgtagagttccatggcatatagaaggtggcaaacttcttttggagctgaatagagttttgcgacctggtggtttctttgtatggtctgctactccaatttatcagaagcttcctgaagatgttgaaatatggaatgaaatgaaggcactaacaaaagcaatgtgctgggaagttgtgtctatcagcaaggataaacttaatggagttggtatagctgtgtataagaagccaacttctaatgagtgttatgagaaacgttctcagaatcagcctcctatatgtccagactctgacgatcctaatgcagcatggaacattccattgcaagcttgcatgcacaaagtgcctgtgagttcaacagaacgtgggtcacaatggccagagaagtggccggcaagactgaccaacacaccttactggttgacaaattctcaagttggagtttacggaaagcctgcccctgaagattttactgctgattatgaacactggaaacgtatagtgtccaaatcttatcttaatgggataggaattaattggtctaatgtgcggaatgtcatggatatgagatcagtctatggagggtttgctgctgccttgaaggatttgaatatttgggtcatgaatgtggtttcagtaaattccgcggacacacttcctattatttatgagcgaggtctctttggcatgtatcatgattggtgtgaatcatttagtacctatccgaggtcctatgatctacttcatgcagataatctattttcaaatattaagaacaggtgtaatttaaaagctgtagtggctgagattgatcggattcttaggcctgagggaaagcttattgtccgggacactgttgaaatcattagcgagattgaaagtatggtgaagtccatgaagtgggaggttcgcatgacttactctaaggataaggtgggatttttatgtgtccagaagtccatgtggcggcctaaagaattggagacactcgagtatgctattggttaa

SEQ ID NO: 6928 - DNA, 486 bp, Glycine max
  Peptide Sequence Number=SeqID_123706
atggcggtttccgaagaagaatgctcttctgcgaagtcaggttcatcaggtccctcttcttcgtcttcctccgcctcgcgttactacctctccaagtgcgttttcagaggcagcgtcgttcttcatgtcctccacgctcacatccgttctccctcctcaaacgacgtcgttttcggcaaggagacatctatagaattggtggttattgatgaggatgggaatgtgcaatctgtgtttgatcagcctgtctttggcaccctcaaagatcttgccatattgccctggaatgagaaatttcgtgccgcgcgtgatccgcagctgtggggtaaagaccttttggttgctacatctgattctgggaagttgtcgttgcttacattttgcaatgaaatgcataggtttgtacctgtaacacatattcagctatctaatcctggaaaccaaatggattttcctggaagaaagctagcagttgattccaggtga

SEQ ID NO: 6929 - DNA, 1650 bp, Glycine max
  Peptide Sequence Number=SeqID_123707
atgggccacggcaagagacttaatgtgcagaagtttcatttagagggcactccacggaaggtcttgtatcatgatgaaagcaagatgttgcttgtgatgaggactgaactgaattgtggtccatgtttgtctgacatatgttgtgtggattccctaagtgggtcagtactgtcatcttttagacttgaacttggagaaacaggaaaatctatggaattagtaagagttggaagtgagcaggtgcttgttgttggaactagtctgtcttctggtccgcacacaatgcccactggtgaagctgaaagttgcaagggtcgtcttcttgttctctgtcttgatcatgtgcaaaattcagatagtggttcaatgacattctgttcaaaggcagggtcatcatctcaaaaaacttcaccattccatgaaattgttacatatgctcctgaactgttatcgagcagtagccttggcagcagtccggatgataatagttctgatggcatcaaacttcatgaaaatgaagtatggcagttccgattggcttatgcaactaaatggccaggagttgtacttaaaatctgtccttatcttgatcgttacttcttggcaacagctggcaatgctgtaagtagcaaaactgttgcattttctccattcattctgtcacttgctcactgtcccatcctttcccaaattctctatccaaatcagaagttctatgtttgtggtttccctaatgacaatcctcaaagagtgagaaggtatgctatgggaaggacgcgctacatgataacatctttgactgcacatttgactagaattgcagttggtgattgtcgtgatggtatccttttatattcttatcatgaggaagcaaaaaaattggagctactttacaatgacccatcacaaaggatagttgctgattgcattctcatggatgctgatactgctgttgtttcggatcgtaaaggaagcattgctgttttatgttcagatcacttggaagcatcagacaatgcaggtgcacaatgcaacatgacactaagctgcgcttatttcatggctgagatagctatgagcatcaagaaggcttttctttatgtgatctatgcatcaaacgtgaatgttctacggctttctgattctacagtaatggaaatgatgggctcatattcatacagacttccagctgatgatgttttggaaggtggaaatggccccaagacaaatgttgattcattacaaaatactattattgccagtaccctgttaggaagcataatgatcttcattcctttatcaagaactgaaatggcagttgtaaatctgcctggacttgttagccaccctcctctaaatactccgaggagcagagaatcagaacccttaatgggcatgacttgcattaactacctgcctgtgtggcaaggacctcgggaggaagaatatgagctcttagaagtagtgcaagcaagacttgttgtccatcatttgacagcgcctgttctaggaaatgatcatcatgagtttcgcagtcgcgaaaatcgggttggagtacccaagatacttgatggtgacatcttgacccagtttctggagctgacaagtatgcagcaaaagatgattttgtcactggagcaaccggatatg

SEQ ID NO: 6930 - DNA, 336 bp, Glycine max
  Peptide Sequence Number=SeqID_123708
atggagtccaaagcagcagctctggaaaatgaagtagccagtctcagatctactcttgctgaaatgaagtcccaggcagatgagcaccaggaaaagttgatggagatgttgacaaagggaatggagaaattaacttcttcattcggatggaagaagcttcaagggaatctaatggatgagttccgccaatcagtgaaaaaggtggaactgctgatgttcaatggagaagatccagttggatggatgagtgatggcatcatttttgagcaacttacggctcttcagcaagtagggagtgtagatgagatgagtaaatacaggaatttgaaaagttaa

SEQ ID NO: 6931 - DNA, 510 bp, Glycine max
  Peptide Sequence Number=SeqID_123709
atgggtcgaaaacgtgcttccaaaaacacccacagggctctagtgttgggtgtttccgaagaattgttttcaacttcacggtgttctttaagcttctctagacgggcatcggtgcatcctactgttgtaaaaccacagccttccaatgtgaggcgatctgaacgcattaaaagtaaaagtttagttgttagtcaccctaacaccaattgtgacattgaagtcattgagtatataactctcagcgatggtgagaaagatgaagcagatactcaactggagcacgagtcggagctggcagataatttaggtgaaaagaagagtttggaacaaaaaattaactgtgccttgcaaagaatagatgctcttaataaggcagtggacgagaatattgccttttgtgaagccccatttaggagcatgtatattgactcacaaaagaagattaaagctttagcaagtgaaaatcaaagactaaatggaaagctggaaaatgctcttggcgaaaattga

SEQ ID NO: 6932 - DNA, 291 bp, Glycine max
  Peptide Sequence Number=SeqID_123710
atggtcagaggtttatgtgagaaggctaaggagattttaatggatgaaagtaatgttcagcctgttaaaagccctgtgacaatttgtggcgatattcatgggcaatttcatgatcttgctgaactgtttcgaattggagggaagtgtccagatactaactacttgtttatgggtgattatgtggaccggggttattattcagttgagactgtatcggatgaaaatagaaaatgggactattcccaagtggtagatggttcagggtttagaatgtgctgcaaaggtgaataa

SEQ ID NO: 6933 - DNA, 1623 bp, Glycine max
  Peptide Sequence Number=SeqID_123711
atggagggtgagggtgcagcagtgtggcaaggtgcggttttaggtggaataatcttctggcttgtttctgcttcatacctcaacgttactcgcaaacttaggtctttcttacaaccttgggttactcatcacgttgtcactcaaacccctattatcctcaagatccagagttacgggtttgggttcctggatgcacttttctctgggttgtcttgcgttgtttctgtgcccttctacactgcttttctccctctgctattctggagtggtcatggcaaattggcgaggcagatgacgttgttgatggcgttttgtgattatcttgggaactgcataaaggatgtggtttcagctccaagacctgcttctccacctgtcaagagagtaactgccaccagagatgaagaggataatgcgttagaatatggattgccttcctctcacacacttaacacagtttgcttatctggctaccttttgcactatgtcctgactcatactcaaattcaaggtgcctatgttacttatcttggagtttctcttgcctgcatgctggtgtttttcattggtttgggaagaatttatcttggcatgcatagtgtggttgatgttcttgctggccttcttattggactcgttgtccttgcattttggcttacggttgatgaatacatggacagttttgtgatctcaggacaaaatgaatttggttttggcccgggaacccccttttgggctgccttgagctttctcttgctttttgcttatccaactcctgaacttccaactccaagctttgagtatcacactgctttcgatgagtgctcaatggaaaaactctccaacaatgaagtgtttagccctccattagcaaggagggctctatacaaggatgaaataatatggaaatggaatgcgagcgttagtgattgggtgcttagcgggattggacgcgctaagcgcgagaagagacaaaagtctcgctggggggctggctgcgcgcttagcgggctgctctctgactttacattctctagggttccactcttgctgagcgagctggcttcctcgctaagcgatgagaaggaaggactgttaggtagcaacactttactggagtgttggcaagtggtagagatagcggaccaaaacggggcacaagagaattgtggtgttagtttgggcagagagctatcacttagaccttatgctctggggctggtctctggggtgcaacaaacataccatcaatttcaccatgccaatgttcctcgtttgttctcgtcagagctgactatacctgtatttctgggaaggatgctattgggaatacctacaattctaattgtgaagttctgcagtaagactctcgcaaaatggaccattcctgtggtagcgaacaccttgggcatcccaataaaatcaaccggctatatacctacactgaatggatctgtgacaggtaaaatgtctgataagcttaaacaaggttacttgcaaaagctcctttcccagcacaaggcattcgatgttgataccggaattagatttgttcagtatgcagggcttgcctggtctgtagttgacctagtgccatctcttttttcatacatgagcttgtga

SEQ ID NO: 6934 - DNA, 177 bp, Glycine max
  Peptide Sequence Number=SeqID_123712
atgttgctaagtagcaacgtcatcaatatctatgtaagagtggtcatgttggtgcgcatgatccgcactcgtctctttgtagcggcacagttggtcgccctccaatatcacggggttgcccaggaactgataaaaggaaactactggccccttaatcgggagcgcaagtctcggtaa

SEQ ID NO: 6935 - DNA, 623 bp, Glycine max
  Peptide Sequence Number=SeqID_123713
gacaacacgtcctcacctttagaggactacacatcctcgccttcagaggactaaacgtcctcgccttcagagggctacacgccttcgccttcgtaaggctacacgccctcaccttcagtggactacacgtcctcgtcttcagaggactacacgtcctcgccatcagaggactacaagtcctcgccatcaaaggactacatgtcctcagcttcagaggactacacgtcctcaccttcagagtgccacacgccctcaacttcagaggattacatgtcctcgccatcagaggattacatgtcctcagcttcagaggactacacgtcctcaccttcagagggccacacgccctcaccttcagaggaccacacgtcttcgccttcagaagactacatgttctcgccttcagagggctgcacgcccttgccttcgtagggctacacgccctcaccttcagaggactgcatgtcctcgcctttagagggctgcacgcccttgccttcagagggcgacacgtcctcaacttcagagggttgcacgctctcgcctttagagggctacgcatcctcactttcagtgggctccatatccacaccttaagagaatttaaggtctactgcccttaa

SEQ ID NO: 6936 - DNA, 817 bp, Glycine max
  Peptide Sequence Number=SeqID_123714
cgttgcaattcagatgttggaaatagtgggaagcaaagacactaaatcagttgtcatcactggacattccattggaggagccactgcctctttgtgcacactctggcttctgtcctacctccaatccatctcttcatcagtgtcagtattgtgcatcacttatggggcaccattgcttgggaacgagtccttttcccaaatcattttcaaagaaagatggggtggcaacttctgccacgtggtgtcaaagcatgacataatgccaaggttgctctttgcccctataacctctctctctactcagttaaattccctgctacagttttggcacttgtcgatgacttcaccagatatggggaagcttgcaaatcagatatctgaaaaagagaaagataagttgttcactgctgtagtagattacttggaaacggcaacacaagatggagaaacatcagtgccaattttgtttcacccttttgggagctacttttttgtctcagaagaaggagccgtgtgtgtggatagttcagctgctattataaagatgatgcacttgacgcttgcaactagttctccagctagtagtattgaggaccatctgaaatatggggattatgtcaataaaatgtctgcacaaacattgtatcagagcaactccatgcaaaagagcattcctgattcgagctatgaagcagggcttgaattggccattcagtcttctggcatagcaaaccagattctaaaagatttaagtggtgctaggtgggcctatacagtatcacctaaacaacttaaagcttttacaataggcggatga

SEQ ID NO: 6937 - DNA, 1749 bp, Glycine max
  Peptide Sequence Number=SeqID_123715
atggcggatccggccggaatccggccccgcgagtggtgcgagcgtggtgttgcggtggcggcgttgatagggttacagtgcggctgtgagctcacgccttacgtgctcctacgccgacctgataagatcgttaccaccgacgatgtccccgaaaccgccccgttagacggccatttcttgcgttacaagtggtatcgtgtacagagtgataaaaaggttgctgtttgtagtgtacatccttctgagccggccacactgcagtgcctaggttgtgtaaagtctaaaatacctgttgccaaaagttaccactgcactccaaagtgtttttcagatgcatggcagcatcatcgtgtcttacatgaccgtgctgcaagtgcagccaatgaaaatggaaatgaggaagaagagttatatgggcgatttaataattctggatctggatcaatcaataccagcttatctgcctctgcatcaagtgctagcttgacaaatgggtctgcacctgtgtatccggcagccgttacgcaacgaagtggtggtgaaacttggtttgaagtagggcaatttaagacgtataccccaacagctgatgacattggacatgtccttaaattcgagtgtactgtagttgatgcagagaccaaacttactgtagggcatgtaaacactctactaacttcccgtgtcattcctgctccctcgcctagcccgcgccgactgatacctgttgatgggatgggacatttggatgctgatgggcgtataacatcttcaggaacttttactgttctatcatacaacatattatctgatgcatatgcctcaaatgatctatacaattactgccctacgtgggctctttcctggccatatcgtaggcaaaatttgttacgagaaatagttggttaccgtgctgatattatttgtcttcaggaggtttacaatggaaacattaatacaattgatgggtgtgcaacatttttccgtagagacagattttctcatgtgaaaaaatatgaggttgaatttaataaggctgcacagtctttaacagatgctgtgattccgaccactcagaagaaaactgccttgaatagactggttaaggataatattgcactaatagtcgttttagaagcaaaagttatcaatcagcctgttgataatccagggaaaagacagcttctttgtgtagcaaatacacatgtaaatgttcaccatgatttaatggatgtcaaactctggcaggtgcacactctcttgaaaggattggagaaaattgctgccagtgcagacattccaatgttggtttgtggggactttaattcaattccaggaagtgctcctcatgcacttcttgcaatggggaaggtagatccatcgcatcctgatttagcagttgacccacttaatatattgcgtcctcacagcaagttggttcaccagttgccactggtcagtgcttattcgtcttttgcaagaacagttggtcttggatttgagcagcataaacggagactagatgacacaacaaatgaacctttattcacaaatgtaactagagattttattggctctcttgattacatattttacacagcggattcattggttgtggagtcattgctggagttattggatgaggaaagtttgaggaaagacacagcacttccttctcctgaatggtcctctgatcatatagctctgttagctgagttccgctgctgcaagaatagatctaggcgctga

SEQ ID NO: 6938 - DNA, 273 bp, Glycine max
  Peptide Sequence Number=SeqID_123716
atgcagatccatcggaaaaaacttgcgtccaaaaaaataaggtttcacttttatgaacgcaagaacaaaattgtagaaaaagtttttgattttttacaccccggtgttgttgctgataactcacttgccgtagccgtgtcgctggaggtgccgattcggagtcgcaggaggccaagatcggcaatcactaggatctcgttgcgaacggtcaagatgatggtgtcgatgacgtcgctaatgtcatcgtcaacggcgcgatttcagagtggttga

SEQ ID NO: 6939 - DNA, 1093 bp, Glycine max
  Peptide Sequence Number=SeqID_123717
atggaagatgaagtgatgagtgaagtggctgctccacctcgtcgtgttcttcttgtatcggctggtgccagccacagtgtggcacttctgagtggaaatgttgtttgttcgtggggacgaggagaggatggacagttaggccatggtgacactgatgatcgactatttcctacaaaactgagtgcattggatggccaagacataatatgtgttacttgtggagctgatcatactatggcacgttctgagtctggcagggatgtatatagttggggatggggtgactttggaaggttgggtcatggtgatcatagtgacttgctcattcctcatcccataaaagcattacagggtctaatgatacaacaaattgcctgtggggacagtcattgtttggcagttaccatggacagccaggaaatacctatcaaaatggttgctgctggtgctgaacatagtgtagcaatcactaaagatgggaatttgtatggatggggctggggccgatatggaaacttgggattgggtgacagaaacgatcgattgctgcctgagaaagtgactgttgatggtgacaagatggccatggttgcttgtggctggcggcacacaatatgtgtttcatcttctggtggattatacacaaatggatggggcaaatacggccagctaggacatggggattttgaggatcatcttgtgcctcgcaaggttcaagccttgagtgataagttcatttcgcaggtatcaggtgggtggaggcatagtatggcactcacgtctagtggacaacttttgggctggggatggaataagattggagttggtaacaattttgattgttgctctcccatgcaagtgaactttccccatgatcagaaagtacaaatgatctcatgcgggtggagacacacgattgctgttactgaacgtgagaatgtatattcttggggaagaggagcaaatggacaacttgggaatggagaaaccatagaccggatctttggtgatgaagtccgtcttgtgattttggtcttgggtgtttttaccactcatgaagtaggtagtcaaactgtggatgaacaaggggctt

SEQ ID NO: 6940 - DNA, 179 bp, Glycine max
  Peptide Sequence Number=SeqID_123718
attcaattactcacaccttcatcgtttgtatttgggagataatattcctggagagagaaaaggaatcacacaaagaaagttcatatgaaggcttcaatcctttctccatctctctgacgtttgagaactctatcggagtagtcggaggaaaaattggaggaatctcagggaaccgctag

SEQ ID NO: 6941 - DNA, 558 bp, Glycine max
  Peptide Sequence Number=SeqID_123719
atgggaagctatataccccagctgctgttgatctcttcaggatacttggtgagcaagtacaaattgttcgggataatagcactgatctcatgttatacagaattgccttggcaatcattcaggtgttctgtcactcttcttttggtggccaagaaacacaattgctccctcaataaaccctcacatgatatccatatcgcgacccagaaactgatgataactacacccacagatcgagagaaagagatgatagatggaggtgttgacgccaaaagggtggtggcagcagaggaggtggagacagaggtgtcgcggcttcattactatggtttaatcaatgttctgagagaaggagtggtgcggcagatcaagaatcagggagaagagcctgttgatttgaggagatcacttaaacttttctcagattttacacaaaagattcttaccaagtatccgatggatacgaaggatatggatgtctccattgaatttgtatatgaattattcactagggttatgagggagcgtggtgctacatctgagaagctatttggatag

SEQ ID NO: 6942 - DNA, 351 bp, Glycine max
  Peptide Sequence Number=SeqID_123720
atggagtacatgtgtaaaagagatgcttcattgttgctgagcaagattttgaatgagtttgacaagaggatgatgtggatgtcatgtactagtgcctttgttgggtgtccagcaagtgatagcaaaaaggatcccttgcaagttactaaggttgttaacaagccaattgatccatgtgttgatgtagaagggtggaactacgtccatgatgagtggatgccatacttctttggaataatgacaatctcgggaataggcgtcaccaatctttcaaagtgccatacttcatcctggtataggtcacaaactttcaagtgggtatcgtggatgaaaacaaagggaactaagtga

SEQ ID NO: 6943 - DNA, 942 bp, Glycine max
  Peptide Sequence Number=SeqID_123721
atgcaaaacacagaaaattcaggttcagaattcacagagacgcgagaggcacttcaatccggaaacgatcgcactctccgacgccgaaggagaaaggagaactcgcgaaaggagctccgagaatggctctccctgcaaattctgcttcttcagaagcacgaggggcactctggggagggcgagagagagaatggtgagaagggcgtcgatgacgtggcttgggggattgggttcggaggtgaatttatcgagagagacgcgtgcggcgcagaagtaggcgaagggagtggagggttggttgttgtctttgagctcctgagacatggcgccgacgacggcgcagaggtggtggtgggtttcgtcggtggagttggcgaagcgagagaggatcgaactgcacaaatcatcattggattcgtctatgccgaatgcggcttcctccatttcaatgccttccatggtcgattcgatgataaaaccctagctagctccaaaggtttatcagtttacgcacgaagagcaaaagcaaaagacctaaaccgatttagagcattgtttaactacttttattactacgcgggaaatattgggcttcttggcccagtccaccgcatggacactcagatttcttttgaggtttttttgttcgtgcaccctaactatcacagcctacacccctttcattacggaaagtggagcatgcttatggaaaacttcttaaggtccaaggagtattggcaagttgtatcagatggaattcctgtaccagaggccagcatggtaatgacagatgcacgaaaaactaaaatagaagggttgtgtttgaaggatctcaaggcaaagaattatcttttccaagcaattgatcgcccaatcttggaaaccatcctttgcaaggatacatctaaggacatttgggattctatgaagaagaaatactaa

SEQ ID NO: 6944 - DNA, 4254 bp, Glycine max
  Peptide Sequence Number=SeqID_123722
atggaaggcattgaaatggaggaagccgcattcggcatagacgaatccaatgatgatttgtgcagttcgatcctctctcgcttcgccaactccaccgacgaaacccaccaccacctctgcgccgtcgtcggcgccatgtctcaggagctcaaagacaacaaccaaccctccactcccttcgcctacttctgcgccgcacgcagtgcccctcgtgcttctgaagaagcagaatttgcagggagagccattctcggagctcctttcgcgagttctcctttctccttcggcgtcggagagtgcgatcgtttccggattgaagtgcctctcgcgtctgttgatcaccagggaaagtgtagactgggagtaacaagcctacttgaaaggtttattctgcttgttggtggagcaaatgcaaatgctggtgaaggagctaaggaagctcagcagattctgtatattcttgatgccttgaaagaatgtcttccttttttgtcacgtaaatctaagaccagcattcttaattacttcaaatacctcttggatctgcatcaacccttagtcacaaggcgcataacagatggtttgagttttctctgtcattatccaacatcagaagttcatcctgaagcactacttgagttgttaaactcattggctcgttctatcgaatcgaataagatgtctggagacagattgacatttactgcccgcttgcttgatgctggaatgaataaagtttattctcttaaccggcaaatatgtgttgttaagcttccgattgtctttaatgctctcaaagacatcttggcatctgaacatgaagaggctatatacgcagccactgatgcattcaaaaacatgataaattcttgtattgatgaaagtttgattaaacagggagtggatcaaatcagtttgagtgaaaacaaagaatcaaggaagtcagcgccaaccatcattgaaaaaatttgtgcaactattgagagcttacttgattatcattatactgctctctgggacagagtatttcaaattgtttcagccatgtttcataaattaggaaatcattctccttattttatgagaggaatactcaaaaacatggaagatgtgcagaagcttcctgatgaagattttccatttaggaaacagctgcatgaatgctttggatcagctcttgttgcaatgggacctgaaactctgttgtctcttatacctctaaatttggaagctgaagattcatctgatgcaaatgtctggctttttccaattctaaaacattatattgttggcgcacctctaaattattttacagaagaaattctgactatgattaagcatgcaaaagagaaggctcaaaagcttgagaagcaaggattgatggtgtcatcaaggaatgcagatgcacttgcctactctttgtggtctctgctgccttctttttgcaactatccttcagatactactaaaagtttcatgaatctggagaaacatttacgtcgtaagctgaaagaagaacctgatattcgtggaataatatgcactagtttgcaacttcttattcagcaaaacaatattgtggattcaaaagacaagggttatattggtgaagatatggccaaagaacaagttccagttcattattcacagcaggttgcaagagacaatttatatgtgctgaagtcatctgcaaagcactggttagaagatctttcagaagtattccttaaatctacaaaagacgatgggggttgtttgcagcgtacgattggcgatgttgcttctatagcagataaagcagatgtacgcaaattattccaggagaaaatgttgaagctttataaatgcactcgaaaggccagcaaagcaggcagttccaaaagttctcattttatgcaaattgatgatgcatcaaacaatttgtccctaacaattttaagggcacagcttcttgatttggcagtttcactgttgcctggtttagatgctgaagatattgctctattgtttgaagcaataaagccagcattgcaggatgctgaaggtgtcatgcagaagaaggcatacaaagtactttcgatcattctgaggagctcctccaatggttttgtttcatcaaagtttgaggagttgcgtcaaactatggttgaaattcttccgtgtcatttttctgccaaacgtcatagacttgattgcctttacttcttaatagttcatgtctcaaagtccaaggataatatggagcactggcgagacattttccttactgaaattatacttgctcttaaagaggctaataaaaaaaccaggaacagggcttatgatattctcgtcgaaattgcccgtgcatttgcggatgaagagagtggtgggaacagagaaagcttgaataatttttttcagatggttgctggacactttactggggaaactccacatatgataagtgcagcagccaaagggttagcccgtttggcttatgagttctctgatcttgttttaacttccttcaaattgctccctggcacacttactctcctgaggagtgataacaaagagataatcaaggccaatcttggttttttgaaggtattagtagccaaatcacaagcagaagggttgcaaatgcacttgaaaagcatggtggagggtttgttgaagtggcaagacaactcaagaaatcattttaaggctaaggttaaacttcttttgggaatgcttgtcacgaagtgtgggctcgaggctgttaaagccgtcatgcctgaagaacacatgaaacttctttccaacatacgcaagatcaaggagcggaaagagaggaatcgaagtgctaaatcggaagaagctagatctcatttttcaaaagcaactacatccaggcaaagcatgtggaatcatacaaagattttttcggattttgatggggatagtggcaatagcgatgcagaatacatgatttctagagggagtaaggcttccttgcatcccaaatcagcagcatcttcatttaggtccaatatcagactgaagaagaatttgcctgagcacttgtcggaccaatcagatgatgagccacttgatttgcttgatcgacagaaaacaaggtcagcgcttaaaatgtctgagcatctcaaaagaaagtcaaggttagatgatgaggtggagctagattcagaaggacgcctgattatccatgaggaagtggaatggaggaaggaaaaacatgcagatgaagattttgattctaggagtgagcgtgatagtcacatatctgcaaagtctggaactaaagcccagaagaagagaaaaacatcagattcaggttgggcttacacagggaaggaatatgctagcaaaaaggcaggtggagatgtgaagaggaaggacaaacttgaaccgtatgcatattggccacttgatcggaaaatgatgagtcggcgaccacaacagcgggctgctgcaagaaaaggtatggctagtgttgtaaagatgaccaaaaaacttgaaggaaaaagtgcctctggcattggaccgttggaagggaaagccttggttcgcttggatgatattgatgctcttgccactgcaagtgattatgtaacagtatcaggaggatgggatatgccaaggttggtaagagaattaccttcacatatttgtgatgttccgcctgcggttagtagagatgacgatgtccctgtgtggaaacactctacggatggggtgttcaaggtagcttctgattacaaacagaataatagggatcctttatttcttgctatttggaatcgggtgctgactgaaagtcatgggaatggaaacgcagcttgtggaggagttcttagagatcacctgggtaatgtggttcttgcctgtgcttacaacctaggagtctgttctatatcccatgcagagctctgggcgattttgatagggttgaagattaattgggcgagggggtttaccaatctcagtgtggaatcggattcgatatttgctattgctatgttggaagggtcttgtgagcaggggaatgggtgctttcgactgctgcaagcaaggagtttaccagtaatgatgctgtttattctggggagcatatttttagagaggcaaatcaagttgctgataccttggcaagatatgggattgtctattcttgatgaggggaaggtgtttgattatgtcccagactttttatcgctttctgttatagctgataaagctaatgtaattttcccacgtgggttttaa

SEQ ID NO: 6945 - DNA, 1851 bp, Glycine max
  Peptide Sequence Number=SeqID_123723
atggcaatcttcaacaagatggggatccatggtgacaaaaaggaggatatcactatagttgagaagattcttcggtccatgactccaaaattcaattttgttggttgctatattgaagaagctcatgacatcgaggaactctcaattgatgaactgcaaagttccttattgattcacgagaagaaaattaatcagcaggagatagaggaacaagcattgaaagtctcaacagaaaatcactcaacatcaaaaggagaaagaggacgaggaagagggagagttagaggcatcagaggcagaggccggggaagcaattatcatggcaatcaacaagaacatcaacaacaccatgagaatcaattccacagaagaggaagaggtcaaggaggccatcattttatagctcacagaccaaagtcagcagacaagtcagatgttgaatgctaccgatgtcacaggtatggccattatcaatcagaatgtcaaactaacttgaacaaagacaatagagagaaaactaactttgttgaaaaggaagaggaggtgtcgcttttgatggtgtgtcatgtgaaggaagaaactcaacaaaacatgtggtatttagacactagctgcagcaaccatatatgtggagacaagatgatgttctctgatttagatgaaaccttctgcaatacagtcaagtttggagataattccacagtttctgtcttggggaaaggaatgttgcaagaaaagggatatgaaaattctatcaaagatggagtatgccagatccgagatgctaaaataggcttaattgctcgagttaagatgacagcaaatcatatgttcccactttatctccacaacaccagtcattcatgtttttcaaccaaattgaaggatgatgcatggatttggcattttcgctatgctccctctgaagtttatgaagaatgtgtggttagcaaacaacatcgaaatcagtttccacaaggaaaatcatggcgagcaagaaaggcattggagttggtgcattctgatatccgtgggccaataaatctatattcaaatagcgctttcactgcatttaaaaatttcaaagtacttgttgagaaagaagtcaatagcccaataaaagtacttcacagtgatcgtggtagagaatacaactcacatgaatttgtaaatttttgtggggcccatggaatcaagaggcaacttacagctacctacacacctcaacaaaatggtgtctgtagccttttgacaaggagtggtgctcctaaaactttctgtcctgaagctgtaaattggagcattcatattttgaatagaagtcccacacttgttgttcaaaatatgacaccaaaggaagcatggagtggacaaagaccagtagtagatcattttagaatttttaggtgtgtcgcctattcccacattccaaatcaaaggaggacaaagctagatgataggggagaaaaatgcatctttcttggtgttagtaatcaaccaaaagcttataaactttacaatcccatcactaagaaaattattgttagtcgtgatgttatttttgatgaagaaaggtgttggccgtggattagtagcgatgttgttgagcaacaaatacctacaaactttgatggagttgacgaagaggacagacagcaaccagtagaaaatgatcaacaaattccaccagaaaatgtagcagatacttcaggctcaccaacaatggcatcagatgatgaacgacctcaacgtggtacatcctttgtggcacaagtagatgatacatctacttgggttgttatactgagaacaagagaaggtacatctcttgtggatcaattcaaatggagg

SEQ ID NO: 6946 - DNA, 289 bp, Glycine max
  Peptide Sequence Number=SeqID_123724
atggtccatgacatctccgtcaaggtgaaactggaagtaacagggacatcgacagccctaaatgtgtttggcagtagacgaagcagcgatgtaacacgatccatcttttgccccaatttttgcaagatggttacttccatacttcaacttgactcgatgaaccttttcgtaaaagcacaagcttggttcagccccataacccaaggaatggcaattttgaccaccaatacttcaacaacatttaatagggatgaaagactcgggaatacgcctgctaagcatggaaaac

SEQ ID NO: 6947 - DNA, 765 bp, Glycine max
  Peptide Sequence Number=SeqID_123725
atgcaaccacagaggttaaggcagcatgccatgttgcaaccatctctctaccaccaccccgctctccttactcctcctcagatagagcctatcttgagtggaaatctgccacctggctttgattcgagttcatgccgcagtgtttatgttggcaacattcatccccaggttacagattcccttcttcaagagcttttttcaactgcaggcgcccttgaaggatgtaaacttattaggaaagagaagtcatcctatggctttgtggactactttgatcgcagttctgctgcatttgccattgtaactctcaatgggaggaatatttttgggcagcctattaaggttaactgggcttatgctagcagccagagagaggatacctcaggtcactttaatatttttgtcggtgaccttagtcctgaggttacagatgcgacattgtatgcttgcttctctgtatatcctagttgttcgatgttttggttctgtgattcaatttatcaggatgcccaaagtgctataaatgatttgactggaaaatggcttggaagtagacagattcgttgtaattgggcaaccaaaggggccagtgccagtgatgaaaagcagagttcggattcaaaaattgtcgtggagttgatcaatggatcatccgaagaaggccaggaaacaaccaatgatgacactcccgagaagaatcctcaatataccactgtttatgttggcaatcttgctccggaggcaaggataatatttttcccatag

SEQ ID NO: 6948 - DNA, 201 bp, Glycine max
  Peptide Sequence Number=SeqID_123726
atggagggagcatatatatatatcattatgatcaagccttcgtcattggctcactgtgtgatactatcggaggtgattgtcggcaacgacaatttcttcttcttttttagatttcaaatcctatcccttggccttggacaagaaaaaacaaaaacctttcttaaggatgtttcaatgtgcgacaacatagtgcgatgttga

SEQ ID NO: 6949 - DNA, 498 bp, Glycine max
  Peptide Sequence Number=SeqID_123727
atggcaaggcttgaaagtgtggatgatcatagcataagagggggaattcaagagactcactttagtccctacaatgttcttgaagaaggtatatacacatattgggctcccggggagaaccaaactaagtggatattgtacatagatctccaagaactagtatccttcaatattttgcaattacaagagcctattaacatgggacagagggtgatagagtttcatcttgaggctttgagcctagatggtgtgtggatgagagttgtatatggcaccaccattggatatcagaggctgttgcggtttccaaaactgaagtctcagtatttgaagctagttgtggacaagttgcgcagacccgttgatatctttggaatctacatggatcctgttaccgttttgagtgacctttctgatagaaaatcaggagcctgtttcaatggaggtcaagttcttcaaaccactagaaacagcagttacctaagtgctacaatgtaa

SEQ ID NO: 6950 - DNA, 273 bp, Glycine max
  Peptide Sequence Number=SeqID_123728
atgaattatctctttgatagctggatttctctgattcatcagctccaaccaggggccactaatttttctgatttgggtccggacacaaggtggatcggtaatgaatatggtgctgctggatccacctgctggtctctatacaacaagacgggctgtgaaattggttatattgatagccatgctaagcttttttatagagcaattttggaagtcatggaattgggtctttctattattcatagatgggtattcagaggattgagcttactctga

SEQ ID NO: 6951 - DNA, 1071 bp, Glycine max
  Peptide Sequence Number=SeqID_123729
atgatgctcagaattcgtagccgcgatggcctggagcgagtgagcgtcgaaaaccccctcgccacaacagtctcggacctaaaacggattatccaaacccaattgggaatcccggttcacaaccaaaccctctccaccaaccagaacctcctcttggccaaatccctcgaagatctcctccgattcaccgacatgtccaacctcgatgcgtctctctcgtctcttaacctcggccacggctccatcgtcttcttggcctacgagggcgagcggcgcgtggcgggccccgccttcaaccccgccggctccttcggccgcaagatgaccatggacgacctcatcgccaagcagatgcgcgtcacgcgccaggagaatccacactgcgagctcgtctccttcgaccgcgactgcgccaacgcgttccagcactacgtcaacgacactctcgccttcgccgtcaagcgcggggggttcatgtacggcaccgtttcggaggtgggaaaggtcgaggtggacttcatctacgagcctccgcagcagggttcggaggacaatctcgtctttttcagggacccagaagaggagaagtttgttgaagctattgcggtggggttggggatgaggaaggttgggtttattttcacgcagacgattactcaggataagaaggattacactttgtcgaatagggaggtgcttcaggctgtggagtaccatgccgagagtgggttgaaggagtgggctactgcggtggttaagcttgaggtgaatgaggaaatgggtggtgctgatgtgcattttgaagcgtttcagatgagtgatgtgtgtgtgaggttgtttaaggaagggtggttcgagacggagatcaaggaggacgatgatcccaagttgtcgaagatgaagaaggatgtggttgtcggggttaaggatactagagaggttgacaatgatttcttcttggtcgtcgtcaaaatcgctgatcatcagacaagtgcggttgatgctgggacaattggggttgcaaaaaccgtgattttttttaaattggggtggctgttggagggggaatag

SEQ ID NO: 6952 - DNA, 162 bp, Glycine max
  Peptide Sequence Number=SeqID_123730
atggagtctcaggtgaagcacgcacttgttgtcaaagttatgggtcgtactggatccagaggacaaaaccgtcacatcatgaggaatgtgaaaggacctgtgcgagaaggagacattctcaccctactcgagtctgaaagggaagcaagaagattgcgctag

SEQ ID NO: 6953 - DNA, 538 bp, Glycine max
  Peptide Sequence Number=SeqID_123731
atgaagatgagatttttccttgtagcttgtttggcaatgttctgcatcctagaggtttgccaaggaggcaacctcagaaagcaattctacaagaaaacctgtcctcaagccgagcagatggttagaacaaaaatccaggaacatgtctctggaaggtctgatttgcctgccaagttgattagaatgcattttcatgactgttttgtcaggggttgtgatggttcggttttgctggactccactgccaccaacactgcagagaaggatgccattcccaatttatctttggctggctttgatgtcatagatgaaataaaagaagcattggaggcaaaaatgtctcggagctctagggacgctgttgccgtcaaatttaataagccaatgtgggaagtgcttaccggtagaagagatggcagagtatccataagtggtgaaaccttagccaatctgccagcacctttcttcaatttcacccagctcaaacaaagctttgctagtaaagggcttactgtgcatgacttggttgtgttatcag

SEQ ID NO: 6954 - DNA, 399 bp, Glycine max
  Peptide Sequence Number=SeqID_123732
atgacagggcaagtggtggtgaccaacggtggcggatgcggtggtgtcgggaagggacggagaggcggcggcggcgaagaggagcagaacccggcgtccccggtggcggttctgctggcggcgttgaggaagtcaatggtggcgtgcagtgtggacagtcccgacgatgtaatctccgccgtccatcatcccatggagatcggatggcccacaaacgttaagcatgttagccatgtcaccttcgatcgcttcaatagttttctgggtcttcctcttgagttacaggttcatgtccccgctcccgttcccagtgctagagattttatcgttggtgggtctgtttccctagaactgaatgtgttgacgctcgatggaggaatggacgttattcttagatga

SEQ ID NO: 6955 - DNA, 663 bp, Glycine max
  Peptide Sequence Number=SeqID_123733
ggactgctagacggactttcccatgagcaagttcttgagtgcaacacagaagatgaatctgttcagcttgtgaagcagctaaagccaactgaatcagccttgctcaactgggctattgatctcatggctgatattgtagcagaagaggattataacaaaatggatgcaagaaacattgctgtggtttttgctccaaatatgactcaaatgtctgatccaccaactgctctgatgcatgcagtccaagtgatgaatttactaaagaccctaatactgaagacacttagagaacgtgaagaaacagctgcagcaggatattcacccatgtcatctctttcatccgattgccaatctgaggatgactatagtcagcaagaaatggataccagtggcgaattgagagagaccaagttagatgatgatgatgatgagaagttagagagccccaagagttgctctggctacaacttggaatctgctttatcatttactgatatcaaaactgtggattcgtgctcgagtccctcttatgaagatgactcaagaacaactttgactaccgaggaatcaaatgctgacacaagtaccagcaccgatgatgtggagatgattgataaatttacagattctgtttcactagttccactgtttgcatctagttaa

SEQ ID NO: 6956 - DNA, 372 bp, Glycine max
  Peptide Sequence Number=SeqID_123734
atggacatgatgaagaatagcccttttgatgtctcttcttcttacttgcttattgaggccagtggtgactctgaagccgattggaacccctacactaagggtgaacatgcagatgatgatgctcaatcttgcatctatgatagttctgagatttgtaatgcttctgaactcaatggatatgatgagtcttggaatattgatgatgatgttgaagatgagaagaaagatgatgttattcatcatggaacttcatattgtgatgatgatgatatgcaacaccagaagtcctgtgtgtctgatgattcaggccaagaattggtggatgagatggaaaagaacaggcttttctgggaagcttgtttggcatcttga

SEQ ID NO: 6957 - DNA, 1318 bp, Glycine max
  Peptide Sequence Number=SeqID_123735
atggcggaagagagtaaatctagcagcgaggaaagtgtgaagctgttcgtagggcaagtgcccaagcacatgaccgaacccgaactccttgcaatgttcaaggagttcgcgctcgtcgacgaggtcaacataatcaaagacaaagcaactcgtgcttcccgaggttgttgcttcctgatttgtccgtcaagggaggaggcggataaggccgtcaatgcgtgtcacaataagaagacgttacccggggcatctagtccattacaagtgaagtatgcagatggcgagctggaaagattaggtcatgccttgataagtagttttctgtggtccttgaatccagaacacaaactcttcattggcatgcttccaaagaatgtttctgaagttgaaatatctgctcttttctccaagtatggaactataaaggatttacaaattttaagaggttctcagcaaacgagtaaaggttgtgcatttttgaagtatgaaaccaaagaacaggctcttgctgctttagaggcaatcaatggaaagcataaaatggaggattcgagtgttcccttagttgtcaaatgggctgatactgaaaaggaaaggcaagctcgtagagctcagaaagcacagtcccaagcttctaatgtaccacatactgattctcagcacctgtcaatgtttggagccttgcctatgagttatgttcctccgtataatggatatgcttatcaggctccgggaggttatggcctcatgccataccgcatgccaccaatgcagagtcaacatggttaccataatgtgatgcctcacatgaatcaagtaaatgcattacggcctgatcttggccccaacatgaaccctagaaattatcatgtgcctcctgcaagttatgttagctcttatcctgctgtgccaggtctacaacatcctatggcatatcctacaggaatgattagtccaaggcccatgaatacttctcctggttcagtttcacctgctggtggaaataacagctctgctgcatcttcaggtgccagcaaaaattctgggggtcaggttgaaggaccacctggtgcgaacctatttatttatcacatacctcaagaatttggagatcaagagcttgctactgcttttcaaccatttggtagagttttgagtgctaaagtttttgttgataaagcaactggtgttagcaaatgttttgggtttgtaagttatgataccccagaggctgctcaatctgccatcagtatgatgaatggatgccaattaggaggaaagaaattaaaggtccagcttaagagggataacaaacagg

SEQ ID NO: 6958 - DNA, 1248 bp, Glycine max
  Peptide Sequence Number=SeqID_123736
gaggtgaaagatgtaacaaggttggagagaaaactggatagcctggtagtaaggggattaaaaatgcctgtccatacaccaaagcatgaaagagagagggtgaccatggaagaagtcagtccaggaggacgagagaaaaagggaccagaagaagctaacgtgaaagacaagcacaagatggaaggcaaccatgtggataccaagacgaaacaattccaacaaaagagagagacaacctcgtattccaagatcctgatggcggaaggaagaaacacgggaccgggaagatttctcaaaaacccgagcctatctggtgttaaccttgcgctatttgatagaatggaagacgatctcatgtggaatggaggtgaagacgtcacaccaaaatatattagtgatgacatgatattgctaatgggacttacagagaccatagctacacaaatggctaaagaagcaaatgagcaaggctcatccgtgttctactcactagaaaagtgggcccctcagttgagaattggctatcacctagtctggctattgtgctggagtatacctctgcatgcctgggatttggagcatattagacagattatgacattggtaggagaagttcacaaggttcctttaagcacttcacctagccatctgctcccccgaacacaaggttcaagatcatcacaggatccaaacacaaacaacaaaccgggaggagaccagtcagggtcacgatgttttgcgagaatgctccaaccatatgggatcagcataggcttaaaggagcactcaaacccggtgacccccaaggcctacactccgaagagtccgtcagggtctctccctcctgattcagacatgattttgcaattcccaacggtgagaatgcttgaaattgggtttcaaacgtggtgctccaatttcacgacgatccaacggctagacaagacgcagatattagtgaagacaccatggcagccattaattcagcacaaggtctccgcatggattaatggggttgaatacactgtgcatatagctgaagaaacatgttacaatctggatagatgcaaatgtcgcggaagaagcttcataggctcgtcagaggaaataagttctgatgatagtgagagtgaaatagggacgcaaatggcgatcaaaggtataacgctagaaacagacccatcggaggaggacattcctccgagcacagacggtgatgagcagagtcgacgagacacgaaggagtga

SEQ ID NO: 6959 - DNA, 249 bp, Glycine max
  Peptide Sequence Number=SeqID_123737
atgtcacgctctcgtccgtcgtcattatgttggactagcctcaatgaggaactagagcaacttcttgtgaatgtgcctaaattaacaattgaagagcatggagaatggagggaaatgacaaacatgatgcagaatgtcgcagctccacgagaggatttttttcaaaccgttcacgccagggaccagattttcgatgaagttagtaaggtatatgctgtcaagtggaaggatgtacttgacgatgcatga

SEQ ID NO: 6960 - DNA, 135 bp, Glycine max
  Peptide Sequence Number=SeqID_123738
atggtgcaagtgtgcaactctaacacaattgggacatcatggatagggtgtatgttaggaatcaagtgtttgagtggtgttgaccttgatcaactgtgtataactcaagctaatctagcgttcgagttgaggtag

SEQ ID NO: 6961 - DNA, 1380 bp, Glycine max
  Peptide Sequence Number=SeqID_123739
atgtcagagcagaagaaacccccccaaagcagagttttctatgttagaatgaagctcctgcacaaacaagggaacaagcctcagcaagacaaaaacaacaactgctttcacacatattacaaatgggttctctggttttctttctccctctatttcttcacttcctatctcatcactagcaaccccaacaacacaccaacctctgcagacacatcccatgtctcaaactccgaatccaacgttgtctctcctacccttgtcgaatctactacgaacactctaggggtgctgaagaatatgaaggtgttcgtgtacgagcttcctccaaagtacaacaccgattggcttgcgaacgagaggtgtagcagtcatttattcgcttcggaagttgctattcacagggcactgttaacgagcgaggttcgcacgtttgacccatacgaagctgatttcttcttcgtcccagtttacgtgtcttgcaacttcagcgccgtcaacgacttcccggcgattggccacgcgcgaactcttatatcctccgccgtcaacctcgtctccaccgaatacccattctggaaccgcagcagaggatccgaccacgtcttcgtcgcttcgcacgacttcggcgcgtgctttcacaccctggaggacgtggctatggctgatggaataccgataatcttgaagaactcgatagtgttgcagacattcggcgtcattcaccagcatccgtgtcaagaggttgagaatgtggtgataccgccttacgtttcgccggaaagtgtaaggagtacgctggaaaagtttccggtgaccggacggcgagacatttttgcttttttccgagggaaaatggaagtccatcctaaaaatgtcagccgacggttttacagcaagcgagtgaggacggagatatggcggaagttcaacggtgaccggaggttttacctgcagagacataggtttgccggttaccagttggaaattgcacggtcggtgttttgtttgtgtccgttagggtgggctccgtggagtccgaggttggtggagtcggttgcgttgggttgtgtgccggttgtgattgcggatgggatacagttgccgttttcctccgccgtgcggtggtcggagatatcgttgagcgtggcggagagggacgtggggaagttggggaagattctggagcgagtggcggcgacgaacctgagtgtcattcagaggaacctgtgggacccacggacaaggcgggcccttcttttcaacaacaacaaggtgcaagaaggggacgccacgtggcaagttctggttagtttgagtgagaagctaggtaggtcgcagcgaaggtcttcggttgctggccaattgaagagtgacacgtaa

SEQ ID NO: 6962 - DNA, 471 bp, Glycine max
  Peptide Sequence Number=SeqID_123740
atgagcagaaatgagaagctacaagacaaggttgcaccgatcacaggcgcagccagtggaataggaaataggaaaggctacagctacaaaattcatcaacaatggggccaaggaatagcctgcagaagtcctctaagcattgttgacttggacctggaactgtttgacaaagtcatggacataaatgttcgtggcattgtggcaggcgtcaagcattcagcatgtgtaatgatcccacgtggaagtgagtccattctctgcacagcaagtgtcacaggtgtaatgggaggggtggcacagcacccttacaatatccaaggtgtgaattgtgaaccgaatgatattgctaatactgcacttttccttgcgtctgatgatgccaagtatgttagtggacacaacttggttgtggatggaggtttcacatcttttaagaatttggaatttcctgcaccagatcaagtgcagtag

SEQ ID NO: 6963 - DNA, 1899 bp, Glycine max
  Peptide Sequence Number=SeqID_123741
atggaacatgttgctgcatatactcagcatcagcaagatggtcacatggaaattcctgtgtatgatttgccttctaagatcttatgcaagattatgcatattgaattaaaggccgaagccttctcagacgaggtttatgctcaagttacattagttccggcgctcaagcaagataaccttcgtttggaggtggaagagaatgatcagataccttccataactacaacctatacttttagtaagatactcactccatcagacacaagtacacatggtggattctctgttccgaagaaacatgctgatgaatgcttccctccgctggacatgactcaacaaacaccagcgcaggaaattgttgcaaaggacttgaatgggtttgagtggcattttcgacacatatatcgtggtaagccgaaacgacacttgcttactagcggttggagcacattcgtgaatgcaaagaaacttgttgctggagattcatgcattttcgttagagcggaatctggagaaattcgtgttgggattcgtcgggcaacggaacatctcagcaatgtatcgcaatcttcatctctgatatcgggtcatagcatgcaacttggaattttggctagtgcttcccacgctgttagctcaggaaccatgtttattgtctattaccacccatggacaaatccctttgaatttattgttcctttgcgaacctatctgaagtcaactgtaccagactatccaattggaatgagggtacaaatgcagcatgaagttgaagaatctttaagaagacatgcaggtacgataattggtcatgaagatatcgacaagattaggtggcctggttctgaatggagatgtctcaaggtgcaatgggatgccgtactagatgacaaaatgaatcctgaaagggtttgtccttggtggattgagcccttggaatctgccaaggagaagaagcaagttcctgctctccccacaacaaaaaaagcacttgcacttaaccagcgctctttgcctggaataagtagctttggcatgcatgatggtcagaattcagctgggccttcatctcagactcggagagaagatagagacttgcaaggtcaagattacagcggcatacattctgcacagcctttacaaagagcaccaccaactgatgttatccacccctcgaaggtcccaatccgtggctcgcggtttgggaaggagaatccgaatcagcttccctttcccatgcaaggtcctcttcataaatctcttagcagatcaatgtcacttacacatgaagacctgtcaattacaagctcaaatctaagctccattggttctgaatctctgggatggccttcaactgaatctagaaatgaaaatgatgttccttttgggcagcctggcagttgcagtacattcaagctttttggagttagcttaattgaccgctcctcggagctcccttcattgcaatctgctgctttcaacaagacttcgagtctcctttctaatcctccaatgcgtgttgccccagggaaaacatgtaagaagtgtcaccgtgttaataatcggagctgcacaaagccatctagagaggatccagattttttcagttggatagaaagggtaccaagatgtaggcatgctagatccttattgcttgactgtccaagcgttttggtgcttaagttgggaactgctcttggaagagcagtcgaccttgcacgctttcatggatataccgaactcattgctgaactcgactccatgtttgagtttcgaggaagtttaatcaatgaaagcagtggatggcatgtcacatgcatggatgatgatggagacatgatgcaattaggagattatccatggcagttaagtagtggtgaaactaacagtatcatatga

SEQ ID NO: 6964 - DNA, 298 bp, Glycine max
  Peptide Sequence Number=SeqID_123742
tgcgcgtcttccggaattcttccggatgaatcacttctttcggaaagttcccggaagaggttttccgggagtcttccggaagaagtgttcttccggaagacgtttggttacttccggaagaacacttcttccggaaactttccggaaaaggttcttccggaacttccggaagaacccctaacgggtcttccggaagactccgtcggaagattagggacacctacctcgaacggaaatggcgtccaaccgaaagaagcagcacctgggctcgcggtgaaggagaaggctcgcggaagag

SEQ ID NO: 6965 - DNA, 2985 bp, Glycine max
  Peptide Sequence Number=SeqID_123743
atggctgaggcttcttcgcctcgctctcaaacttcatcatcccctggcggatatacagttaaagacgcaaatgaagaggatcaatttagggaaactgagctcttcgaggactcctttgtgctcaatagtccattcactgaaatggaggttgaaaaccttaatctgaacactgagattgtagaggatacggagcctgcagaggacatgacaactggtacaatgtgtgagtatgaacaagttgtgctcgacagtgaggacgaagaaatgaatgatagaggtgttggcaaaggatttcttaaggatgaaactagtccaacagtgaaaattcattcgactctctttcaaaagagacagcccaagccaccttgtgagcaagtagatgcaaatgccaccacttttgggaagtctactgctgggtacaaaggagctttagttgatgctgacggctttgatgacaacaaccatttatatccacctgcaatgctaagtcacattcactcaccagagcctggggattccactgaagctgcacttggctttgtggatcagtacttgtcatcaaatgatgtggacttgtttcaagtaattcattatggaaagaccactagggagaaatcaccttatgtcttgagttctagaggaccactaaatctggctaagaaaattaaagctcgaactcaaagtgaagaaaaagaacctttcaaatgggttgatagttgccaacatgacaacaaagctggtatttttggtaaaaaaattgaagaatcttcaaattttggaagatacaaacagacatatacgagaaaaagacaaaaagaaggtggccatcttcagggacaaggaaactgtaatacaagtaatagatgtgatgagaagttacgccaaggaccaagaacggaaactgaaaataataactctctcaaggaattggatgttcaaccaagtgctataagtgagaatgttaatgtttattccagtgtaacacatatagaagacttgtatgatattggtttagacactcaaatagctgctgaagctatgaatgccttagcctttgtgcccccttctggctgccagttcaatgatactcatcaaccagagaatgcattagatggctctttgagcgacttgacagaaaatgaagctcttctgaagaattcttcagagattcagaatcctggtttacattctatcacaataaaatcaaataagaaaaatccatcttcctctagatttagtaaaataacttttagctcttcttgcaagcacactgacaagcaggagccaagtcttgtatcatggaaaatgaaaaaaatgagaagcaagccaaattctgagggacagattgataataatactagtttgccaatatgcagtaaacatgtattgcttgaagcggtttgctcactgggagagtccacaagtttgcaacctgctgctgaagaacctaaggattggaacaatgagagcaggcagacaagaatcaaagatcaaccaagtcatcatacagaggggaacaataatgttacggagaagggtataaaacacaagaggaaggggagtggtttagtggctgaaccagtgaagtttggtgttaggacaaagcgtcttaaattgcctaccaattcatgtacagttgctaggaaaagcaggttgaatcatctggctcaagttagtccacagttatctgcaatcagcagtttttcaaggcctgattcttgggtttatccaaaaagatcgagagggaaaagaaagggggataatgtgggaaccaatcttaatgcaccaacagttgtgtgtattgatggaaaagaaaataatgttttctcccctagaggtctagaggatcaagatgatgtggataaaccatgttttcctcacacccatccactctgcaatgcttcatgtgtagacaatgccagatgcttgttgcaggggaactttgtgccaccaggttcagctggtgatgcaatgaaggtagataacttgcatgatatgcacccgttattgctggcacatgttgaactatcatcaaacaaaagcatcgcacaatcgagatcagaaattccagctacagttactgcaagcaaaggcataaaagtttcaaatgctaaccatacatacactgagcatcacaaaaagccatgtgaaaaatccctgccaaagacttcggtttcagttttgaaagagcttatcagattaggagttcctgagttcacgtcagatatgatgtggaagcatctgagacatcgaagagatatgacagatgttcaagtactgtttagccaacatttggatgacagtattatcaagcagcaaaaaaagatcttggcacgtctcaatatatctgttgcgtcaagttcaatcgaggccacacatttcatagcagacaaatttacacgcacaaagaatatgttggaaacaatggctcttgggaaattagttgtgaatcacttatggcttgagagctgtggacaagccaactgttttattgacgaggaaaattacattctgagggatatgaaaaaggaaaagcaaataggctttaacatgcctgtttctcttgctcaagcaagacaaaagccgctcctaaagggtaaaagagtctacatcacgccacatattaaacctgataaggaagttcttgtaagtttggtcaccgatgttcatggccaggtagttgatgaaagtggggtgtgcgcagacatgaatgataatagcttagatgatctgttgattctttcttgtgaagacgactatgcaatatgccaccgtttccttaagagaggaactgcagtttacagcccagagcttgttctgaatggaattgtaatccaaaaattggaactggagagctacataaatgccatctttgatctcaaccatgtgcagttgtttgccactacaatgatttgttggcttgaagtaaaaacacctaagaaaatattgagttcaagttgtgcaaaaagcacattgggttgttga

SEQ ID NO: 6966 - DNA, 252 bp, Glycine max
  Peptide Sequence Number=SeqID_123744
atgttacagaactttacggattgcgcattaacacttcctttcaactcccgacatgccacggaacttcacggattgcctaatgatgggtgtcaagtacctcgaagtggtcaagcgaaggtcgcatcccaccaaacagatggtccccggacgaaattagggtcctttgtgataatcctagaatacctcgagatcgatctcggtgtatctaaattcctaatacaaaggagtcatcaccaagatctttcattttga

SEQ ID NO: 6967 - DNA, 204 bp, Glycine max
  Peptide Sequence Number=SeqID_123745
atgaagacagagaaacagaaatccgaaagaaagaaatggttgttgagaagaagctttggcaatgaagtttccaccacgtgttgtttgcgttgggtaaagggaagcggcaaagttttgttgtatgcgcaccgcaagcaattgcgtggttcgcttcctttcaagactctgttggtcagtgccattaatgtgaaccagctcacatga

SEQ ID NO: 6968 - DNA, 393 bp, Glycine max
  Peptide Sequence Number=SeqID_123746
atgcctccattgccttcatatgggtatgggagggagcatcctgggcctcgatatggcagtttgattcatggtcaacatcttaaagatgttgtgataacagggcataacggtaccataaatggacagggacaaacatggtggaaaaaatatcgccagaagcgtctcaaccacactagggggccacttgttcagatcatgttttctagtgacattgtgatcaccaatataactttgcgtgactctcctttctggacacttcatccatatgactgcaaaaacattacaataaaaggtgttactatattggctcctgtgtttggagctccaaatactgatggcatagatcctggcgagtatcttctactgaatactaaactttatttcatatcttaa

SEQ ID NO: 6969 - DNA, 230 bp, Glycine max
  Peptide Sequence Number=SeqID_123747
tcattcggggttcccgtcacccccagtaaagtgatccgaccgccgatcacccgggccttcatcgagaagtactgcacgcctaggcaggcgcaggcactaggttcgccagtaggcagccaaccaccgtgggcaggggaggagcctacaggatcccccggtgaggcagaggaggcccgtatggatgaagatatgaccgacttgctcggtttcttgggaggaagcggagtcac

SEQ ID NO: 6970 - DNA, 708 bp, Glycine max
  Peptide Sequence Number=SeqID_123748
atggttgagaactcgacgctagggcgcttccaccaccaaaggctcgaccttcgccgctgggtccccgcgttcttcacctcgcacaagaccctcttgacctttctatggatcgccgccttcgcctccgtttttctgtggcagaggaacatagctggtggctttctggtctacggaggaattccggccaggcccatgcccatgctccgccccatggccttcaatttgacggatttcggaggggtcggtgacggcgttactctcaacaccgaggctttcaagagggccgtttcagcggtttctaagttcggcaagaaaggcggtgcgcagttgaatgtgcctcccggacgctggctcacggcgccgtttaatctaaccagccacatgactctcttcctagctgaagatgctgttatacttggcattgatgtggtttggacacatacatataaagaagaaaagctagtgaagaaagtagaaggtatgatttgtagtcccatgaaactaaagagagagagagagattaaggaggacatcagagcccccaggagagaaataacttttagtggaagaactaaatcgttcataaagtacagtgataaatacttctgtactgtttctgttttaaatgaaatggttttcttcatggactttgtttgtctgttccgtgtgtcaaacaaaagcagtcatatgctacttgcctttggataa

SEQ ID NO: 6971 - DNA, 1077 bp, Glycine max
  Peptide Sequence Number=SeqID_123749
atggcatacgacgaccacgaccttgtagaatgtggagcatatccaatagtgattatctatcactctcctcgtaagtcctgcgtttccagacccagtggaagtagcgaaatgtatcgaacggcggcgaagcggttgttgtgcggtgcaagatactactataatggcaacgttggactccgattccggcctcctcagatatttataccctcttctcgcttttccacatccgagactcaacctttacccattccacacgctacggatcgtaccattccagtcgtcgtcaccaccgaaaccgaaaaccctaactcttcagattcgtccgcttcttcttcaccttcatcttcctcaacagctgatgatgccacaaaacccagggccaagtatgaggaccaacacactcgcgtgcttcaggcctcgctctcttacgtcttaaagttggggtggacagaagctgcgctagttgcaggagccagggatgtcggtctttcgccatctattgttggatcttttcccaggaaggaagcagcactggtcgagtatttcatggatggctgcttacaaagacttgctgataaaattgactcagatgagagtttacaaaatttgacaccaagtgactgcatctctaagcttatcagatttcgtttagaaatgcaagctccatatatatcaacatggcctcaagctcttagcatccaggcacaacctgttaatgttcctacaagttttaagcagagggcagtgcttgtggatgagatctggcatgctgctggtgataatgcctctgacattgattggtatgccaagcgcactatccttggaggaatatactcaacaactgagatttatatgctgacagatacctctcctgatttccgtgatacatgggctttcttggatgctcgagttaaagatgcctttgatttaaagaaaaccattcaagagaattctcagtcatcaaaattttcaggcacagtatttggcagaagctgtcagtaccgggctgggaaactcctttcaagggtttgtcgggaaagttttccagagatgagtcgtggtgggaatttatgctga

SEQ ID NO: 6972 - DNA, 1690 bp, Glycine max
  Peptide Sequence Number=SeqID_123750
cgaattcgaatgcacaggaggaggcggaggagggagtggaaactacttattagggaatcgggatgaccaaactaataaaaacacagggttaaggatgaaggtaggctttaatggattaaggggtaaagaaatttcgcttatttccattgttctcatgtctgtaactatcattttatggtcatgggagaaaatgcctggtcttagtgcctttcttcctcctcaaacaccaccactgcaactgccttcagatcatttagctagtcgtcgttcagaccaggtgctagaaccagatccacatttgggtgaagatggctcgccgttggcaaaggcaaagactgccaatgaagcagaagaactacgtctcaagggagcatcatggacggtccctgcacaaagctcttctggaaagaacatgggtgaagagggctcatcattagcaacggagaagatcttcaatgaaacagaagaactaaatctcgagggagcatcgcgaacagttcctgcacaaagctcttttggaaagaacatgagtgaaagtaataccaaaacaacttcatataccgaacaaattctttcaagtgtgccagatgatgaagcaaaacacaagagaatcttggaagtctgtaactacgcaaaaggaaaatgggtcccagacaacaaccggcctttgtattcaggttttggttgcaaacagtggctatcagggatgtgggcttgccgcttgatgcaacgtactgattttgaatatgagaagcttcggtggcaacccaaggattgtcaaatggaagaatttgaaggttctaaattcttgagaaggatgcaaaacaaaactctggcttttgttggagactcgttgggccggcagcagttccagtctttaatgtgcatgatcactggtggtaaggataagcttgaggttgaagatgtggggagggagtatggattggttatagctgagggctctgcccgccctagtgggtgggcattccgcttctcaagcactaatactaccatcctgtactactggtcggcaagcctctgtgatgttgaacctattgatgtaaacaacccaaacacggattatgcaatgcatcttgatcggccaccagcattcttgcgccaatatatccacaagttcaatgtcctggttctcaacacaggtcaccactggaatcggggaaagctcacagctaatagatgggtaatgcatgtcggtggtgtgccaaatactgataagaagatagcagtgatttggggtgccaagaatcttacaattcacagcgttgtaagttgggcgaattcacagcttccaaaatatccaggtttgaaggtattctatcgttccatctctcctaggcattttgttggtggggactggaacacaggaggcagttgtgacaataccaaacccatgtccgttggaaaggaaatattgggagaggagtctattgatgaaggtgctgcaagtgcggtaaagggaacaggggttaagctcttagacataacagctctttctcagcttagggatgagggtcatatatcacggttcagtcttacagcgaagcctggggtgcaggattgcttacactgttacaaccattccttcgcttggaaatggtcattcactttaaaagaaaactatagttttgcagaggacgcagtcatggaggttgcaatgtgtcctagctga

SEQ ID NO: 6973 - DNA, 1254 bp, Glycine max
  Peptide Sequence Number=SeqID_123751
atgaagcggtacgcccgcctgaccgagcagttcgaggcacagggcggctatgcggccgaggcggaggcggcgtccatcgcccacaacctgtccctgccggatcgcatcctcgaccagccgctgtcgacgctctctggcggacagcgtcgccgcatcgagctcgcgcgcatcctgttctccgacgcgcagaccatgatcctcgacgagccgaccaaccacctcgacgcggacagcgtggtgtggctgcgcgagttcctgaagggatacaagggcgggctgatcgtgatcagccacgacgtggaactcgtcggcgagacggtcaaccgggtcttctacctcgacgccaaccgtcaggtcatcgacacctacaacatgaactggaagaactacctgcgccagcgggtggccgacgaggagcgccgcaagaaggagcgcgcgaacgccgagaagaaggccacgacgcttcagctgcaggccgctcgcttcggagcgaaggcctcgaaggccgccgctgcacaccagatgatcgcgcgtgccgagaagctgctggcagggctcgacgaggtgcggcaggaggatcgggtggcgaagctgcgtttcccgaagcctgctccctgcggcaagacgcccatgatggcgtccgggttgtccaagtcctacggctcgctggagatcttcacggacgtcgacctcgccatcgatcgaggctccaaggtggtcgtgctcggactcaatggtgcgggaaagaccacgctgctgcgcatgctcgccggcgtcgacaagccggacacgggacagctcgagcccggacacggactcaaggtcggctactacgcgcaggagcacgagaacctcgacgtgaaccgctcggtgctggagaacatggtctccgccgccccgcacatcaccgagaccgaggcgaggaaggtgctcggttcgttcctgttcaccggcgatgatgtgctcaagcccgcgggcgtcctctccggtggggagaagacgcgcctgtcgctggcaacactggtggtgtcatcggcgaacctgctgctcctcgacgagccgacgaacaacctcgaccccgcttctcgtgaggagatcctcggcgcgctcgcacactacgagggtgcggtcgttctcctctcgcacgatcccggtgccgtgcagtcgctcaatcccgagcgcgtgctgatcctgcccgacggcgtcgaggacatctggagccaggagtaccaggacctcatcgagctggcctag

SEQ ID NO: 6974 - DNA, 999 bp, Glycine max
  Peptide Sequence Number=SeqID_123752
atggggactccctcgcagatacaagaacaatccaggtgttggccattgccaaccatcactcgtagaggtgagatacttcggcatggaaggcctaattgggtcaccaaagtgggctgcacgaagttgtgggtgctgccgtcgtcgacgagcaacaccacacggtggttggccataatccccaccatacgtaaagccttaagtgccagatggcctgaaaatgaattaaggcttctttgggcctggaacgggtcgggttcatttgacgggtcaggtggtgggtcagttgggtctattttagggtctgaggtgaagcataacccacgctctcggcgtgaggttatctcctccggcgtgagatgtttcattatcggcggaggggtcgcggaggggctaggagcaaggggggtagaggttgacgaggttcagaggttgcagggagaacacgaaaggggttgggtggctaggggggtgcgtgaggccgtgggggattgcggttgtcggcaatcttctcctcctgaagcttggccagaccggcggcttggacgagggacttctctgcgaatctccgaggtgaggcttgagatgaagcagctcagcagaaagggagatggcgggccgattatccgagcaaaccttgtctgcagggcttgtaggaacccaggccatgaggtgaactgggcattgcttgacatccattggaaccaagcaagtgcccttccctccatgagggggttctggttgcgtagaggaaaacgaggaagggcggtgaagaagttcatcaagtttaaggttcatggtctgcatggtgtcggtgaggcgagtgaggatggtttccaggttgctcgaagatgtctcgtggggactcgtcatagtatcaagggaaacgagagcaccaatgttatgaacttggctgatttagagcatcagcaggaggattgtggaagatcgcgtgagctggcaattccaattagattccttcaggcgaaatccttcaaatag

SEQ ID NO: 6975 - DNA, 1368 bp, Glycine max
  Peptide Sequence Number=SeqID_123753
atggacttacacgtattacccgttgttggcgccaacgtagtcttgggagtccagtggctcaagacattgggcccaattctcactgactatggttccttgcgcatgcaattcttctaccaggatcagttgattgaattaaaaggggacaacgcgattgactctggcctcctcagtcaccatcaactccggcgactctgcaggacacagacccaagcctcttattttcgaattgcgatcttaacagacaaccagaagcctacccactctcaagacttacccacagaaatacaagccttactcatacacttctctaccctgttccagagtccctccggcctacctcccacccgagacaccgaccatcatatccacctccttccacacaccgaccctgtcaatgtatgcccctacaggtatccccattaccagaagaaggagatagagcagcaggtgaatgatatgttgcggaaggggctcatcaggccaagtaccagccctttgtcgtctccggttctcctcgtccgtaagcaagacggctcttggagattctgcgttgactacagggcccttaacgccgtgacagttcgtgacagattttcgattcccacaattgatgaattgttggatgaattgggaggagctcaaacccatcatggacattacgaattcaaagtaatgccatttgggctctgcaatgcaccaagctcattccaggccaccatgaatagcatattccggcagcatctccgccactttatcatcgttttcttcgatgatatcttggtgtatagcacctcactcgaagctcatcttcagcacttaacaatcacgtttcaggttgagtatcttggccatgtcgtgtctcataagggagtcgaacctgtagcctcgaagatagaagcaattcgacaatggccaacaccacgatcagcaaaagctgtcaagagctttctaggacttgcaggcttttatcgacgatttattcgcaattatgccaccattgctgctcccttagttcgactcacgactaaggacttttttgattggtcccctcaaactcaagaagcttttgatcagttgaagacagctttgtccaccgccccagtcctagctctcccggatttcacattaccattcaccgtggagactgacgtctccggtgtcggcatgggggtcgtgctcactcagaaggggcaccctgtggcgttttttagcaaaccttttacccccaagcttgccgtagcctccacctatgttcgtgaattagttgccatcaccaccgcggtcaaatggtggcggcaatatctgttgggtcaacgcttcattattatcacagaccaccgtagcctcaaggaattacttactcaa

SEQ ID NO: 6976 - DNA, 912 bp, Glycine max
  Peptide Sequence Number=SeqID_123754
atggtggcatctttgttcattgacatggtggtcaagatacatggggtccctcatagcctggtctccgatagggaccccctcttcatcagcaaattttggcaggagctgttcaaggctagcggcactcatttacgcatgagctctgcttaccatccgcagagcgatggtcaaacagaggtgcttaacagggtagtggagcagtatctcagagctttcattcataggagaccaaaccggtggggaaagcttttgccgtggattgagtggtctcataacacatcttggaacactggcattggaacaacaccttatgagatcacatttggacggaaaccattcaatttccctgagtatatcactgggtcttcaaacatcgaagccgtggaacacttactgacggatcgagatgctacattccaaacaattcgcaagaagctccttaaggcacaggaggccatgaagaggcaagctgatagcaagagacgtgatgcacaatatcagataggggactgggtagaagaccgcataggcaccgtagcttataagttgaagttaccagactcagccaggattcatcctgtatttcactgctctaagcttaagccttttcgggcagatctagagcaacacccaaaactgaatttgccttccacttttgtcaatgaccaacctggtctctctcccgacgagacctcttgggaggattgggagcagttacaacaagacttccaccttaaggacaaggtgcgtctacaagggccgaagagtgatatgaacagagaagcttcaatggaggacagtatagacataacagcaactacagaaggtgaactcacaaacaaagaggtgaaaagggaaacagtactcaaaagaaagatcaaaaagcccaccaatttgaaggatttcgtctga

SEQ ID NO: 6977 - DNA, 429 bp, Glycine max
  Peptide Sequence Number=SeqID_123755
atggatggtggttatgaaataaattctgcatcagatgatgagcccatgcgaaaactttttcttttattggtgcccaatagaaaaaaacctagaaaagaagaagaatcactaagacaagagctaggtaagcaagaaggagaggctagaaaaggcggggcaaggggctctccatctctaggaagattgtgtccaggatcaggtaatctaagctctggtcagctcgtagtagcctgtgctttattacaggtagtcattccccccgttcctttagtcttttcaacggtacttgaatctgaagtcgcggtcatgtctcgcccccagtatagtgaccgattccatgtttcccccgaatttcatcagttccaggctttcctctcccagcaagaggatgcgcgccttaacttaaaagagctaacacgctttacataa

SEQ ID NO: 6978 - DNA, 846 bp, Glycine max
  Peptide Sequence Number=SeqID_123756
atggcaaaagaatcctcgtattcccccgaagatagattattacgagctatacttggcattcagaaacgtgaaattaaagtaggagataaagtggctgggagacatggaaataaaggtatcgtttcaaaaattttgtctagacaggatatgccttatttgcaagatggaagacccgttgatatggtcttcaatccactaggggtaccttcacgaatgaatgtaggacaaatatttgaatgctcgctcgggttagcaggaggtatgctagaaagacattatcgaataacaccttttgatgagagatatgaacaagaagcttcgagaaaactagtgttttctgaattatatgaagccagtaaacaaacatctaatccatggatatttgaacccgagtatccaggaaaaagcaaaatctttgatggaagaacagggaattcttttaaacagcctgctataatgggaaaaccttatattttgaaattaattcatcaagttgatgataaaatacatggacgttccagtggacattatgcacttgttacacaacaaccacttagaggaagggccaagcagggaggacaacgggtaggcgaaatggaggtttgggccttggaaggatttggtgttgctcatattttacaagagatgcttacttataaatctgatcatattaaaactcgccaagaagtactcgggactacgatcattggaggaacaatacctaaacctacagatgctccagaatcttttagattgctagttcgagaattacgatctttagctatggaactgaatcatttccttgtatccgagaagaacttccggattcataggaaggaagcttaa

SEQ ID NO: 6979 - DNA, 903 bp, Glycine max
  Peptide Sequence Number=SeqID_123757
atggctggaatgacgaacaatcaaccgtcacagtggtggtggcttgaaagccacaccaccactaatcgatccccatggcttcaatccactctctctgagctaaatgagaagacaagggcaatgttaaagttaattgaagaagatgcagattcctttgctaaacgtgcagagatgtattacaagaagcgaccagaacttgtgagcatggttgaggatttctacagggcacaccgctccctagctgagcgctatgatcaagtcaagcctgatactactggaattggacacctcattactggggggtcacctttcgcttcagcaaagtatcagttggagaagttgatgactttttcagataacggatatgatacctattctgagcattgtgatgtgtacgagtctgaggaatctgaagttgatgatcctgagcaggaggaggaggaagaagaggggaccaagtttctgcataaaagcacaaaaaaggagcaagttttgtttgtggttgcgggtgatgttgaagtgatgaagctgagggatgaaattaagagactcaatgaagagaacaaggctcaaagggatcaaatcaagcagaaggataccatttgtgatgaagtaatgatgttgagggaagaaatagaaaggcttagagatgagaatgaggcacaaaaggaacgactcaagcagaaggatgaagagaagattgaggtgataagacagctgagtttagcaatagatgtgctgaagcaggagaatgcaaagatgagaaactacattgctaaggaatccaccaagaaatggaagaacccatttgagatcaacaaacttgtggaagcattttcggtgaagttgttcagtggcactccaaagaatcagcccggtgttgagctctctagatgtggttaa

SEQ ID NO: 6980 - DNA, 1086 bp, Glycine max
  Peptide Sequence Number=SeqID_123758
atgcaggaagcgacgaaggtgataataatcggtgccggaacttctggtatcgccaccgccggttgcttaacgaagcaatcaataccttacataatgctcgagagagaagactgtttcgcttcgctgtggcagaaatacacctacgatcgtctccaccttcatttgaggaagcaagtttgcgagttaccgcacttaccgtttcccaagtcttaccctcactacgtgcctcggaagcagttcatagactacttgggaaactacgttaaccactttgagatcaagcctctgtaccagcgtgcagtggagttggtggagtatgatggatggaaagggatttggagagtgaaggctcagaatagaagatctggtgagcttgaggaatacgctggaaagtacctggtcgtggccagtggcgaaaccgccgagcctcgtctgcctcagattcaaggcttggagagtttcaatggaaaagtgattcactcaactgcctacaaaaacgggaacgagtttaagaataaacatgttctggttgtcggatctggcaattccggcatggagattgcgctagacttgtccaattttggtgccaaaccttccatcattgttcgcagcccggttcattttctttcgagggatatgatgtattatgcgtcgcttatgctgaattacttgtcgctgagtacggtggagaaggtgttggtgatggttagcaaggttgtgtatggagatctgagtgagtatgggataccgtatccgagtgaggggcctttcaccatgaagatgaagtatgccaagttcccaatcatcgatgtaggaactgtcaagaaaattaaatctcgagagatacaggatggcaaatcgtacacattcgactcaattgttttctgtacaggcttcaagagatcaactcaaaagtggcttaaggcctctccgccacagcatgcttacctgtggaagaaatattcctacaccgcctccacctccacctcaggaaacagtactgccaacttcggaagaacggtggagctggcggaggagtaccgtgggaggtttctggtggtggccactggggaaacgaacgaatga

SEQ ID NO: 6981 - DNA, 483 bp, Glycine max
  Peptide Sequence Number=SeqID_123759
atggggaagattccatctcagattggtaatctctccaatttggtgtatcttggccttggaggttattctgttgtcgaacctctgctagctgaaaatgtagaatgggtatcaagtatgtggaagcttgaatatcttcatttgagtactgtagacctatccaaagcatttcattggctacacactctccaatctcttccttctttgacccacctatatttgtcaggatgcacactccctcactataatgaaccatccttgctcaacttctcatctctgcaaactctcattctttacaatactagttattcccctgccatttcttttgtccccaagtggatattcaaattgaagaaacttgtttctcttcaattatggggtaatgaaatccaaggtccgattcctggcggaaacattccaacttctttgggtaatctctgcaacttaagggacattgatttctcaaatctcaaactcaaccaacag

SEQ ID NO: 6982 - DNA, 516 bp, Glycine max
  Peptide Sequence Number=SeqID_123760
atgggagaacggagaatggaaatgggatttgagatggaggagaacgtgatttgtatgggaggaggtcctaaaagaagagctacagagaaaactaaaagcaacgtacagggaggggggtttgaaggaagtgagattcctgaaatggagccaaggcttctccagcacggtggcttggtaactggccgtggtggatccattcttgaccttgaggaccaggcgcgtcagctttgccccagaacgcttgtcgtactcgctcaccgcgtagttcgcgatctccgccacgtggctgtcgttcacgtccttgatggggctccagccgcccagcgcagattccgaccgccgggcagcgtaggagaccaagacgagggagaggagaaggagacagtgcattggaaaaacgcggttaacgggcttgtcctgaatattctcgtttgggctagcgcatgtttgcccttctgcttcctagatattgcggctgaaacacgcgttcctgtccccgcttttttaaaacgttaa

SEQ ID NO: 6983 - DNA, 756 bp, Glycine max
  Peptide Sequence Number=SeqID_123761
atgccagcacacatgacaggctcaaacatcaaaggaaatgttcaaggatcagcaagattcaacattcgtgtattgcttcccgaatacaagctttgctatatccggcaagacagtagattctcccagccactcaaagcaaaaccaccagacctggtacgtggtcaaaggattcaccggtccaaagacaaaggggccacagagatgatggcagagacacctttctcgatcctcatcaagtttaagccagatggtaagctattgtctaaggctcttcaaataaaacattgtacttttggagcgactttcaaacacaatatctcacaaaacatttcatcgttcacacccagtggcggagccagaaaaattataaagcctgggcaaaaatttaaagatagcaaattcaccgttactgttgttagtctaatatgtagcattgttactgagttcatcacctctaatgctgctactgccacccttcttgtcccacttctttatcacatagcaggaactatgcatgtgcaccctcttattcttataatccctggaggaatagcaaccgagtttgctttctggcttccaacttcaacaccatcaaatgtagttggctttgccactggacacatagaaattaaagacatgttcaaagttggcgtaccactcaaagttgttgggattgttgtgctgtctcttctcatgccatcactgggtgaattgcctacaaattacaatctctgttctagtaaacaaatgctttga

SEQ ID NO: 6984 - DNA, 519 bp, Glycine max
  Peptide Sequence Number=SeqID_123762
gattctcatcacttctttactaatgtcaccaagtctcctctccctcgtaaccccgcgtctgcactccaagacccaaactggaaaatggctatggatgatgaatatattgctctcattaagaataagatgcataaggcccaacttttaggtgatggtgtaggacaacagattagagtggattgtggagaaacttttagcccgatagttaaaccggcaactattcaaacagtgctcagtcttgctgtctctaaagctttgcccattcatcagttggatgttaaaaatgcctttttacatagtgaactaaaagaaataatgtacatgcatcagcccttgggttttaaggatcctgatcatcctaatcatgacatgaccaagagcaagggcaaggatccacttgaaggacttggaggagcaatgacaagggctagagcaaggaaagccaaggaagctcttcaaaaagtgttgtccatactatttgaatacaagcccaagtttcaaggagaaaagtccaaagtt

SEQ ID NO: 6985 - DNA, 3024 bp, Glycine max
  Peptide Sequence Number=SeqID_123763
atgacaaacccaaaaccactcatagtcatagtttacattctcttgtcactactagcaacaacaacaacaacaacgttggtgtcgtgtctgaaccaagaaggcttatacctctaccagctgaaactctcctttgacgacccagactcgaggctctcctcatggaactcgcgagacgccactccctgcaactggttcggcgtaacctgcgacgccgtatcaaacaccaccgtaacggagttggacctctccgacaccaacatcggaggcccattcctcgccaacatcctctgccgtctccccaacctcgtttctgttaatcttttcaacaactccatcaacgaaaccctacccctcgaaatctccctctgcaaaaacctcattcacctcgacctttcccagaatctcctcactggcccactccccaacacgctccctcaacttgttaacctcaaatacctcgacctcaccggcaacaacttctccggctccatccctgattccttcggaaccttccagaacctcgaagtcctctccctcgtttcgaatcttctggaaggcacaatcccagcctccttgggtaatgtgagtactttgaagatgctgaacttaagttacaacccctttttcccgggtcggatcccgccggagattggaaacctaaccaaccttgaagtactctggctaacgcaatgcaacctcgtcggcgtcatcccagcctccctggggaggttgggaaggctccaggatctggacctcgcgctcaacgacctctacggctccatcccgagttcgctcactgagttaaccagcttgaggcagatcgagctgtacaacaactcgctctccggggagcttccgaagggaatggggaacctctctaacttgaggctcatcgacgcgtcgatgaaccacttgaccggaagtattccggaggagctctgttcacttccgttggagagtcttaacctttacgagaatcgcttcgagggcgagttgccggcgagcattgctaattcgccgaatttgtatgaattgaggcttttcggtaaccggcttaccggaaggttaccggagaatctcggcaaaaactcgcctctccggtggcttgatgtttccagcaaccagttctgggggcccattccggcgacgctgtgtgacaaggtagtgctagaggagcttctggtgatttacaatcttttctccggggagattccgtcgagcctcggcacgtgcctgagcctgacacgtgtgaggctcggcttcaaccggctctccggggaggttcccgcggggatctgggggctgccgcacgtgtatctcctcgagcttgtggataactcgttttccggttccattgcgaggaccattgctggtgctgcgaacttgtcgctgttgattttgtcgaagaacaacttcactggaacgattcccgatgaggttgggtggttggagaatcttgttgagttttcagctagtgataataaattcactggttctcttcctgatagtattgtgaatcttgggcagctcgggattcttgattttcataacaataagctctctggggagcttcctaaggggattcgttcgtggaagaagctcaacgatttgaatttggcgaacaatgagattggtgggaggattcctgatgagattgggggtttgtccgtgctgaattttctggatctttctagaaaccggttttcggggaaagtgcctcatgggttgcagaatctgaagctgaatcagctcaatttgtcttataatcggttatccggtgaattacctcctttgttggctaaggatatgtacaagtctagttttctagggaatcctgggttgtgtggggatttgaaggggttgtgtgatggtagaagtgaggagaggagtgtgggttatgtttggctgcttcgaacgattttcgttgttgccactttggttttccttgttggtgtggtttggttttactttaggtacaaaagtttccaggatgcgaagagggcgatcgataagtcaaagtggacattgatgtcgtttcataagctgggttttagtgaagatgagattttgaattgtcttgatgaggataatgtgattggaagtggatcgtctgggaaggtctacaaggttgtgcttagcagtggggagtttgtggctgtgaagaagatatggggaggggttaggaaggaggtggagagtggggatgttgagaagggtggtagggttcaggacaatgcttttgatgctgaggttgaaactttgggtaaaatcaggcacaagaatattgttaagctgtggtgttgctgcaccactagggattgcaagctcttggtttatgaatatatgcctaatggaagtcttggtgatttgcttcatagcagtaagggagggtcgttggattggccaacaaggtacaagatagctgtggatgctgcagaaggcctctcttatctgcatcatgactgtgttcccgcaattgttcatagagatgtgaaatctaacaatattttgttggatggggacttcggtgcgagggtggctgattttggagtagctaaggcggttgaaaccacaccgataggaactaaatccatgtccgtcatagctggctcttgtggctatattgcaccagaatatgcatacactcttagagtgaatgagaagagcgacatatacagttttggggttgtcatactcgagttggtcaccggaaaacacccagtggaccctgaatttggggagaaagacttggttaagtgggtgtgcacaacctgggaccagaaaggtgtggaccatttaattgactcaaggcttgatacttgtttcaaagaagagatttgcaaggtcttcaacattggactcatgtgtactagtcctcttcccatcaaccggccttcaatgagaagagtggtgaagatgttgcaagaggttagcacagaggaccaaaccaagcctgccaagaaagatagcaagttatccccttattactatgacgatgcctcggatcatggaagtgttgtttaa

SEQ ID NO: 6986 - DNA, 1008 bp, Glycine max
  Peptide Sequence Number=SeqID_123764
atgaaccatgacacgtacattgcttatgatgtggtcatggttgctctatccatatccttctttgttcttgctgttgttctctaccttgtgtgtaagaagaaaccggttaacgttgaatccgaagaaacacttgcattgaagcattgtgttcgtgcatactcattgatggacattgatgctgccactgatggcttcgaccatagcagaattgtggggaagggtcgcgtaggaaccgtgtatgccgcggtgcaagagaatggagaacttgtggctgtgaaaaggattcattctgtgcttgtgttgagcaatgcaggatttggattctcatcagtgttgaaatggctctcttcagctcaccaccccaacatagttcccatcataggattctcggaggcacctggtgagaggatcatagtgatggagtttgggcgcatggtgagtttggacttctatttgcaccaaaatgttaatggggcatcactcttggattggaacaagaggatcagaattgtggctggagcagctagagggattcagtacctgcatgaagtggcaacaccaaacattgtacatgggtgtgtcaagtcctcaaatgttttaattgatgtcaacttttgtactaggatttgtgattatggactcaacttcttggcaccccgagaaaagagagggctagtagggaatgtggatgatgagtattggaatgaagaagggggtggtgctagcaaggaaagtgacgtttatgggttgggggtggtcatgcttgagctattaagtggtagagggtgtgaggaaggattgatagcaaaatgggcaatgcctttgatcaaggaaatgagttttggtgaacttttggatgctaggttggtgattccttctgacatgaagcctcttgttaggttagctaaagttgctttagcttgtgttggtaattcaaggaagtgtaggccttccattgctcaagtgacaactattttgaacaatatagagatggaagtgtgcatatga

SEQ ID NO: 6987 - DNA, 447 bp, Glycine max
  Peptide Sequence Number=SeqID_123765
ttggtaaagcagcaaaaccagcaaaatgatccctccttggctcagagacttaaagagaatgtaaatgaaactgaagagaacaaggacaagagtgagaggaggaagaggaagaatagcgcccttagtttggaagagttgtacaagaagcagcatgaagagaaagagaaagaaagaatggagaaagaggctgtcctgagggtaaagaaggaagacagagaacaagctgaagctcagagaaaggctatgcgagaaaaaatgcttaagaagacacgaaaagggcagcctgttatgaaatacagaattgagcatcttttggagactattcaaggctcaactaaaagcagctgccagtcatggccagtgatacaccacgacgcgcctcttaggggaggagcagatgagcatgagggtgagagcaattaccagcgccatgagaagtcccatgaa

SEQ ID NO: 6988 - DNA, 177 bp, Glycine max
  Peptide Sequence Number=SeqID_123766
atggcttgcgtggagttatgtattgacttcatgggacttctcatggcgctggtaattgctctcaccctcatgctcatctgctcctcccctaagaggcgcgtcgtggtaactggggatgtgccatcttcacttcctctgcctctcagccaaatagatactctctgttcgtacaattga

SEQ ID NO: 6989 - DNA, 216 bp, Glycine max
  Peptide Sequence Number=SeqID_123767
atgaagaagaacgacaaggtacgcagcgataagcagaaacaaataatgacgaaaaagaagaacatttcgaggttgggtggaagtggcctttcgctcgacgctttcgccaacgcaaaatccaagaacaatctctataacccagccatcataacatgctatgtgccttttattattcctgctgagtacgagagtttatggagaaacggccaactctga

SEQ ID NO: 6990 - DNA, 339 bp, Glycine max
  Peptide Sequence Number=SeqID_123768
atggctgaaggcgaggggtgtattgagcttaaattccgcatatatgacggaactgatatagcacacagtacatattcttcatctaccacagttggtacccttaagcaaaagctagttgctgagtggcctcaaggcaaaacagttacaccaaagtctgtaagtgacctaaagcttatacatgccggtaaagttttggaaaacaataaaactcttgctgattacagaataacgtttggtgaaatccctgggggtgttgttacgatgcatgttgtagtacaacctccagtaactaaaaaaaaacagtcattaagtaagcaaaactggctaaagaaggcataa

SEQ ID NO: 6991 - DNA, 267 bp, Glycine max
  Peptide Sequence Number=SeqID_123769
atggagcaacactctgcttctgcatctgcgtctgagaaaagagaggatttagggaaattgcagtacggactcggtgacatcgtggactacgtctccgcagtcaagaatcaatgcgacaagatctacgacctcacgcatctggtggccagtactgcgagctgccgcttcacgacagggttcagtagagggccgattcggcggtcacaaatttcggcaaagttgccaatcttaatcaatggcaccgcccaatccaccacagaagactaa

SEQ ID NO: 6992 - DNA, 1062 bp, Glycine max
  Peptide Sequence Number=SeqID_123770
atgagtggtgctgaagcgcgaccttgtgactactgtggcaactccacagcacttctctattgcagagccgattcagcaaaactctgtttctcgtgcgatcgcgaagttcactccaccaaccagctcttctccaagcacacgcgcacgctgctctgcgacgcatgcgatgattcccctgcgaccatactctgttcaaccgacacctctgttctgtgccagaactgcgactgggagaaccacaaccctgcgctctccgattcccttcacgagcgaaggcccctcgaaggcttcactgggtgcccttccgtctccgaactcttgtccatcgtggggttttcggatatcagcaaaaaatctctgcttttttcgcctcagggaagtgtcgctgatgggttcttcggcgccagcgagattgaagggctttcggatatgttcgtgtgggatgcgccttcttttgttacgcttgatgatttgatttcttcctctccttcttctcatagctttcaggccatgaaggttcctcctctgcccaagaatcgaaaggctgcttgtgggcaacacaaagaagagattcttagtcagcttcgggaattggccaagtctgagcctttggaccttgaaccatatgtgcaatcgggtaacttgtccttgggttttgaacgtgacccggaggctgatatctttccttctcatgagctggggctgatgcctgatgatgggttatttgttttttccaaccattggcatagagaaagcagcgagcctatgcatcaagttgtgcctcctgacccatcaatgggaacttatactgaagaaattccagttaaacattctacttctgctgttggggaaaatcacacctatggtgacaatgaagggaaaccatccatttctctcaagtctgaaaccctatcaactactcccaaagctgcagcatgtgagttaacaagccaagaaagagattctgcattattacggtacaagcagaagaagaaaacaaggaggtattacaattacagcatcttttgcttgctttgtgtttgtgtgagaggtatctattaa

SEQ ID NO: 6993 - DNA, 513 bp, Glycine max
  Peptide Sequence Number=SeqID_123771
atgttattgaaattttggggtgggggggtgtgggaagaaggctgggggtgtgggaagaggctaagggggtgtggggggcgggggggaggtgcctgggccctgggcgcgaaccatggcgcctcaggcagcaacgcgttgactcgcgcctgccagctgggcgcgacccagagcgccagcctgcagggcgcgacacgtggcgccaactgtgggcacgtccaatcgcgaccctgccacgtgtcgccaatccgcggaagcgccttaagggttgtctctagaatatgtccattggatttaatgatgaaatatgtgcaatttcagttgagcttagctcatcagtgggctaagcgtgcatccaccactaagcacagcttcagcgcaacagaagaatctggcagggcatcaatatcaaggtcacgcgctaagcacgagatcagtgcactaaatgcaatagttgtcttcagtcaggctcagcgcacgactggcactaagctcaaatccacttactcgtgctaa

SEQ ID NO: 6994 - DNA, 258 bp, Glycine max
  Peptide Sequence Number=SeqID_123772
atgaaaaagggcgaagcattgttgccgtcgttaccgagaacggatcccagatatgaaaaaaggcattattgtcgttgtcaacgaggcaaaggaggagcaaggcgacggagaagaagtttccgtcgtcggagatttgaagcgggtttgaagagcaagcatcggcgacgctgttgttggagaagtcaaggcaagagaggagagcgcgaagggagtaaacacggggagagaaaaggcgagcaagaaaaaagaaaagtatag

SEQ ID NO: 6995 - DNA, 1970 bp, Glycine max
  Peptide Sequence Number=SeqID_123773
atgaaggctccatccaacggttacttgcctaattctggcgaaggggaaaggaagacaatcaattcagagttatggcacgcttgtgctggacctttggtttctttgcctcctgttggtagtcttgtggtttacttcccccaaggacacagtgaacaagttgcagcttccatgcaaaaggaggctgacttcataccaagttaccctaaccttccatccaagttgatttgcatgcttcacaatgttgcgttgcatgctgatcctgaaactgacgaggtgtatgcacagatgacccttcaacctgtaaacaaatatgagaaagaagcaatactggcatcagacatgggtctcaaacaaaaccgtcaacccactgagttcttttgcaaaactcttacagctagtgacactagcactcatggtggattttctgtgccacgtagagcagctgagaaaatattcccacctttggattattcaatgcaacctccagctcaggagcttgttgccaaggatttgcacgacaatacatgggcatttagacatatttatcggggacaaccaaagaggcatctattgactactggatggagtgtatttgtcagcactaaaagactgtttgccggagattctgttctttttatcagagatgaaaaacagcatcttcttttaggtataaggcgtgctaatagacagcaaccagcactctcttcgtcagtgatatccagtgacagcatgcatattggcattcttgctgctgctgctcatgctgctgcaaataacagcccattcactatattttacaatccaagggctagcccctctgaatttgttgttccattagccaagtataacaaagtcacgtacacccaagtttctcttggaatgagatttagaatgatgtttgaaactgaggagtctggggtacgcagatatatggggacaatcactgggatcaatgacttggatcctgtccgatggaaaagctcacagtggcgcaatattcaggttggatgggatgaatcaacagctggtgaacgccccagtagagtttcaatctgggaaattgaaccagtggtgactcctttctacatttgtccacctccattttttaggccaaagttcccccggcaaccaggaatgccagatgatgagtcagatatggaaaatgctttcaaaagagcagtgccctggcttggagatgactttggcatgaaggatgcctcaagttcaatatttcctggtttcagtttagtgcaatggatgagcatgcagcagaataaccagctcactgctgctcaatcaggatgtttcccatcaatgcttccatttaatacccttcagggtaaccttagcactgatgacccttccaagttattgagctttcaagctcctgtcctctctaccccaagtcttcaattaaacaaacctaatctaccaaatcaaatcaaccagttgcaacagtctccagtgtcatggcctcagcagcaacagttgcagcaacaacaacagctgcagcagcagcaacagcaacaacaacagcagcagcagcagctacagcagcaacaacagcagcagctacagtcattgttgcaagtaccaatgaaccatctccagcagcagagggaacaacaactgcctgaaccacaaaatctgccattgtggcagcaactgcctcagcagctaggacagcagcctcagaaacaacagtcaagtcaacatgctactattatgaataatggggtagtcgcctctaaccagattacaaatcagttttcacaacaaccaatggcatatggtcaacttcagcaacaacagttactctcaggaggtatccagtcagctactaagaatacattgccattgacatccttaccacaagactcacaatttcagcaacagatagatcagcaagctagcctcttacagaggcagcaacaacaacagcagacacaattgcaacaatctccattgca

SEQ ID NO: 6996 - DNA, 114 bp, Glycine max
  Peptide Sequence Number=SeqID_123774
atgtggtcatttgcaccctttccggagatgtcagcatcttccggtagagactattttagtctcacaccgctttctcaagaactacgtaggagaattataagcaattgggcttga

SEQ ID NO: 6997 - DNA, 387 bp, Glycine max
  Peptide Sequence Number=SeqID_123775
atgggagctctctcggtaatcctagtgcgtcaggctttgctggagtgcttcgagattgattctatcggtcagtggattattggtttctcgggctattgtggatttactacgaaccttcatgcggagctcttggcaatcttgcatggtcttcaaattgcttggagtagagatttcatccttatcactttgtcatcaacaaaattcgtcagttcaatcactttgattgggaggttgtcttcaagcacacttatagagaaggcaataaagttgcagattgccttgcgaaaaatggagcttcaatcaatcaacatttgctcctttggtcttcttgccctcattaatgttgtttgtttgagtggtgttatgggtatagttgagtttagataa

SEQ ID NO: 6998 - DNA, 1989 bp, Glycine max
  Peptide Sequence Number=SeqID_123776
atggagagcatcaaacaaacttcaacttgtgcatgtagacatatgtggacctatcaatccaatatcaagcaacaacaaaagctgactgtagcctacacacctcagcagaatagagttgctgagaggaagaacataacggttatgaatatggtgcgatctatgctggttggaaaacaagttcctaaaatattttgggtcgaagttgcaaggtggtgtgttcatattctcaacagaagtcctacaacaaatgtacaaaacaaaactctcgaagaagcatggagtggagtgaagcctactgttgattactttcaagaatatcaattatttgatcctatcaacaaaagggttttaatcagcaaagatgtggtttttgaggaacaaaagggttggaattggaagcaaaatacagaagaacatcaacaggatactctagagtggggagataatgaagagtatgtgagtgattccaaagagcagtctgaagaaaatgttgtggaaagtattggtgctcaagaaaccgaggatcaaaatgaagatgttgagaatgattctacagattatgaaagaggagaaggtctatcagatgataatggcctaaatgtaatgatggtcaccaaggatgacccaatctcatttaaggaagctattaagagtgagaagtggagaaatgcaataatgaaagagatggaatcaatagagaaaaacataacttgggagcttactgatctaccaagaggagtaaagccaattgaagtcaaatggatcttcaaaaccaaatttaaagagactggagaaatagacaagttcaaagccaggttagtagctaaagggtacgtgcaacaatatggagtggattacacagaggtatttgccccggtggccaggcttgacacaattctcttaatacttgctatagcaacacagtatagctggaatgtatttcagctagatgtgaagagtgtctttcttcatggtgaacttaaagaggagatctatgtacaacaaccaaatggttttgtgaaaaagggtgaagaaaagaaagtgtacatgttaaaaaaggcactttatggccttaaacaagcaccaagagattggtacaacaaaatagaggcctattttgttcgaaatggatttgatagatgcctttgtgaacatacactgtttacaaaatcaaaggagggaggcaaaatgaggtactttcttggtattaaagttatgcaaaattcaagtggaatctttatatgtcaaaggaaatatgctcaagaagtgttgtcatggtttgacatggaaaactgtaatgcagtcaagaatccaattgttctaggcacaagattgtcaaaaaatgatgcaggaaccaaagttgatgcaactctattcaaacaagtagttggttgtcttatgtatttgactacaactcggccaaatttaatgtacggagtatgcttgatcagtaggtttatgtccaatcccactgaacctcactggtttgcagccaaaagaatattaaggtacttgaaaggaacaactgaactaggcatctactacaagaaagggggaaacgcaaagattgtagcatattttgacagtgactttgatggggatatagatgataaaagaagtacttctggatttgtatttttatttggctctggagcagtcttatggtcctcaaagaaacaaccagtagtcacattatccaccacagaagctgagtatatagtcgctgcctcttatgcgtgtcaatgtatttggattcaaagagtgttggagaagctgagccttgaagaacaaaagaacacactgattctatgtgacaacaattccacgatacaattatcaaagaatccagtgtttcatgggaggggcaaacatatagacattaaatttcattttttaagagacttagtgaaagagagaacgatcaagttagagcaattctcaaagctgcggaggatgttaggcatgttggaagcttcagagataaactaa

SEQ ID NO: 6999 - DNA, 1041 bp, Glycine max
  Peptide Sequence Number=SeqID_123777
atggccccccaaactagcattgtccttggcacgaacaaattgcttccactactaagcgatgaaacaaaattggtctgggacatcccaaaagaatttgcagacataaaaaaggaactagaatacattcaagctttcctcaaggatgcagattcaagggcagcagaaggaggcaacgcaaatgagggaatcaaaacatgggtgaaagagttgagggaagcatcttttcgcatagaagatgccattgatgaatacatgatccatgtggaacaagagcatcatgatcctggatgtgctgctttactctgtcagattattcacttgattgaaactttgatgcctcgtcatcgaatagcatcagggattcagcagattaagtcagttattgacagaatcaagcagagaggaaaagagtataacttcctaagacaaagtgtccaatggattgaccctggatcggcttcccctcaccttgatgaagatcaaattgttggctttgaagacccaagagatgaattgatcggttggttagtaaagggaccagtggagcgcattgtcatatctgtggtaggaatgggaggacaaggaaaaaccactcttgttggcagagttttcaacaaccaggaggtgattgcacactttggtggctgtcgtgcatggatcacagtctctcaatcctacactgtggaaggattgctgagagacgtgttggagaagatgtgcaaagaaataagagaggatcctcctctaggtatttctaaaatggatctaaattcattgattgttgaagtgaaaaactatttgcaaaaaaagaggtatgttgttatttttgatgatgtgtggagtgtggaactttggggtcagattgaaaatgccatgcttgataataacaatggaagtaggatattaatcacaactaggagcaaggatgttgtggactcttttttcttgctaaattttcctctaccagctctttctctagtggacattgttagtaaacaacctattaaagaagtttacagcaggaagaagaggggtaactga

SEQ ID NO: 7000 - DNA, 1527 bp, Glycine max
  Peptide Sequence Number=SeqID_123778
atgttttcttctgcaatttctcagaagcccttccttcagtccctcgtcattgatcgttacgctcagagcacaactgctgcaaccaggtgggagtgcttggggtttaacaagtcagaaaatttcagtaccaagagagtgttgcgtgcagaggggttcaagttgaattgcttggttgaaaatagagagatggaagtggagtcatcatcatcatctttggtggatgatgctgccatgagcttaagtgaagaggatttaggggagcctagtatttcaacaatggtgatgaatttcgagagtaagtttgatccttttggagcaattagtaccccgctttaccaaacggctacttttaagcagccttctgcaatagaaaatggtccctatgactataccagaagtggaaatcctactcgtgatgctttagaaaggtttgatcatgatgtgattgcaaagcttgataaagcagatagagccctgtgcttcaccagtggaatggctgctttgagtgctgttgttcgtcttgttggaactgaatatgatagttctttgttattgactcctgacaatgtacatataggtgaggaaattgtcaccggagatgatgtatatggtggctcagataggttgctgtctcaagtagttccaaggactggaattgtggtgaaacgggtaaatacatgtgatctagatgaggttgctgctgccattggactcaggactaagcttgtgtggcttgagagtccaaccaatcctcggcttcaaatttctgatattcgaaaaatatcagagatggctcattcacatggtgctcttgtgttagtggacaatagtataatgtcacctgtgttgtctcagccattggaacttggagcagatattgtcatgcactcagctacaaaatttattgctggacatagtgacattatggctggtgtgcttgctgtgaagggagatattagtgtgactgtgacacctattgacaaaaaagagaacaaaacatctgttaagtgcattggacatgtgcaaataaggccactgaaagcattagtgaggagagtagttcgaatggcttttattcctgagaaaaggagagggagaccaaaaaggacatctgaggaattgattaaaagggatctcatggataacgcacagaagattgcagagttccttgcctcccatcctcgagtgaaggaagtgaattatgctggcttgcctggtcatcctggtcgtgatttacactattctcaggcaaagggtgcaggatctgtgcttagcttcttgactggttcattggcactttcaaagcatattgttgaaactaccaaatacttcagtataaccgtcagctttgggagtgtgaagtccctcattagcatgccatgctttatgtcacatgcaagcatacctgctgcagttcgcgaggccagaggtttaactgaagatcttgtacgaatatctgtgggaattgaggatgtgaatgatctcattgctgatcttggcaatgcacttagaactggacctctttaa

SEQ ID NO: 7001 - DNA, 294 bp, Glycine max
  Peptide Sequence Number=SeqID_123779
ccgatgatacgacaggttgttgaacgacgcgacaatcatgaacaccgtgtccgtggcgaggagcctctcgaagacgagtctgccaacaatttgtccctacggtccgaaaagggacatgacgaaggcattcgggatcaccgccagagaaccatggtggaggaaggttgcagatttggagaggatatcgaagcggccatggaaagtgacggtggcgacagtggcaccgacgggtgtgaaagaaggttaatgaagagtgacgttggtgatggttccgaaactggttataacacacag

SEQ ID NO: 7002 - DNA, 378 bp, Glycine max
  Peptide Sequence Number=SeqID_123780
atgcaaaagataccaaaaaggaggggcaaaaagggtcttttcattgagttcctagaccctaggtcacccaggctagcctctggctcgcctgggcccccaaaagacttcaaggtgaagttaccagcttgcctgggcgagccagttacttcacgggtaagtcttagctcgcctgggacagctgacattgccccaagttcccattttcctataaataggcatgctagggaggttgaggggggtttgaaggttcaatacttgagggaattgagagaattaagagagaagaagaagaaagaagagaaaacaaggccaaggcattgccgaatcgcgaccatgatcaatctctacattgttcctcgttcggtgttcttcgcgtga

SEQ ID NO: 7003 - DNA, 1120 bp, Glycine max
  Peptide Sequence Number=SeqID_123781
ggtgatggacctttctaatgttgaacaaggaaagaaaattacaaatttgagttctaggaaagatgatgaggggattgcattgccacatgagcttccgaaagtttcaaatgaacaaaggcttgaagagtcgactggggccatatggggaacctcaacacctcttggtctgtcaaagctcattgagctcgataaggaagaagttaatattgaagaggaagccaagagtgatgaagaaggcagtcctcacatttccttgcatgcaattgaaggcatggaaggaaccaccactatgagaatacaagggcaagtgggacgaaaaatgctgcaaatcctcattgacaatggcagcacccatgatttcttggactatgctttggccaagaggttgggatggaaggcgaatggggatgaattatctgctgtagaggtagctggaggaaaaagatcgaaggatgaagattttacatctgatttgagggtaatggagcttcatacatatgatatggtattgggattgaaatggcttaaaagcatcaagaatgcattttgggactatgatgcacttgtcgtggaagggcataatcatcctattgtccttcaaaggggtgctgatcccatcaacttgaagtcatacaaatatcctgctgctcaaaaggatgtgattgaaggcttagtgggggatttgttgaggataggaatgatacaagaaagttcttctccatttgaagcacccattgttctgattaagaagaaggatggaacatggagattgtgcattaattatagggaactcagcaagagaccggtaaagatccagtaccctataccagttgttgaagacttatttgacgaacttagctcagctggatggtttacaaagcttgacttaagggctgactatcatcaaatcagaatggtgccggaggatgtgtacaagacagctttcaagactcatagtggccactatgaatggttggttatgccatttggcttaaccaatgctccagcaacttttcaaggagccatgaacagtgttttcagaactcatcttagaagatttgtcccaatgttgctaatggcggatggcggttcatggcggaaagccaaaaatccatcataa

SEQ ID NO: 7004 - DNA, 162 bp, Glycine max
  Peptide Sequence Number=SeqID_123782
atggtgaagcatggtgctgcaaaggtagttggtgtcgagggttatggctacgttaatggtggtggagggagagaagctgcaatcctcgccgttgcggaaggtgggggcctcccagaagagagagagctccagggaaggacaactgacaataataatttaacg

SEQ ID NO: 7005 - DNA, 381 bp, Glycine max
  Peptide Sequence Number=SeqID_123783
atgtactctactgttgtccatttgctcccactaacaaaggttcacgatcatcacagcaactcccctcatggtgatcagcctgagtgtcaagggagttccaaactgagtgatatgcccccaagttcaagcattccccctcatgagaaactacaaagaaactacgaaagaaaggattcggagcttgttctccatcaaatccttgaggtggattctgaggattccgcttcgattaaaacattcatatctatgtggtggttcgatggcaagcaacgacggcttgtggaggtcaccggtgattgtgggtggtggaggagaagtttctatggtggtttggatggagttttgagagggaaaggtatgaaatcgtgtttttcaagctga

SEQ ID NO: 7006 - DNA, 306 bp, Glycine max
  Peptide Sequence Number=SeqID_123784
atggacggcgaaaggttgagggagatggaggagatggggtgtggtcattatgtgggtcatggctacgtgagcaattggggcatgcaatgcaacagcatgcgtcgtcgtcaccatacgggtgaagcaccactgtcgacgacggcggtttccagctacagaaaatatttgaagggaacggagtcggagatgaagaggacgcggcgcgtgggaaaggacaagtcctatgaaacggagaaaaagggttcaatgagaaggatgcattggttggtgaagaacaagtctgccaaaatgacccataattgctaa

SEQ ID NO: 7007 - DNA, 357 bp, Glycine max
  Peptide Sequence Number=SeqID_123785
atggaagtggagggctctgctaggtttagtgagtcttctaaaaaagaggatgatctttttcttcaaagtactagaaaggtcaaaaggatgtctcatggggaagaaatgttggatatggaggtcgatgatgaggggccatggatggtggcaaaccaccgtattatggtgcagagatggtggtcgttcttcttagctaacacgaaagtgggatgccgtttggcaatatggccacataatacaaagtgcgttgagaaaattacaaggcaaactcaggagcgaagaggagtaaatgaggtggatgtgcaaaacaacaccagtcctacaatggctgcactatcggagaatgtcccagggtag

SEQ ID NO: 7008 - DNA, 558 bp, Glycine max
  Peptide Sequence Number=SeqID_123786
atgagtgcattagcaaaccctattattgatgagaccaccgagggtaaagcttcttcttcttcctccccctcaccaaaagcaacgttaaaactattcggtttcctattaacccaagctggtaatattaataataatgaagacattcacatgccagcaagtagcaccaatattccttatagtagtacttacaagagattcacatgcgacttttgctaccgcaaattctcgaattctcaagctcttggtggccaccaaaatgcgcacaagagagaacgcaaaatggtcgcgctttcaccctttggatactaccatcatcatcatcatccatggtccaaagcaccttccccaatcgtggttccgcacggaggattatcaggaccgttgattcgtccacgtggggggcctcaccatgaggttgggtttgttagaccaatgggtgcaagcatgggaatagagactaatattgttgatggtgatgttgatcttaacttgagtttggctcacacaccttccaatttcagggacaataagaaaattgccaagtggaggagaacttga

SEQ ID NO: 7009 - DNA, 180 bp, Glycine max
  Peptide Sequence Number=SeqID_123787
atgtttaatagagctttgtcagggaaatgggtttggcttttctcaatgggaaaggagtgcctttggatgaaggttgtggagaagtatggacctctagtgttggaaggatcatttagagagaggatgggggaagaactacatatgcctttacaggggcaccctgtatatacacaaaaataa

SEQ ID NO: 7010 - DNA, 585 bp, Glycine max
  Peptide Sequence Number=SeqID_123788
atgaggtttcatacttttgggactaattccaccaatgaggcttcatcttcttcaattagtcctgaaccgacaacaagtagtcctctaccaacatctattgataatttaacatctcctaaaccgaaggagtcctccaatcctgtgatatcagctccagcctccctatttttatgccatccattgcaaaatctcttcctttgtcggtcagacttgatatcactcactcaatgtgtacaagaagaaagttggtgtcctataggtggaaaatgggtatttagggtcaaggagaaccttgatggtacaatcaacaaatataaagttagggttgttgccaaaggctttcatcaaaggctgggttctgattacaatgaaaccttctcacttgtaatcaaaccagttacagtcagaattcttttgactcttgttgttactaacaggtggaaacttcaacaactaggtgtcaacaatgtttttctaaatggcattcttgaagaggaagtctacatgaatcaacttcctagatttgaggactccaacaaacatacgctattcactatactgtggtttatatgttggtctatgtag

SEQ ID NO: 7011 - DNA, 141 bp, Glycine max
  Peptide Sequence Number=SeqID_123789
atggaggagaaggggataatggctagagatggaaggtttttcctatttgagaagctcaggctttggggcgatcacgcgttgagcgcggttacgtctgggcttagcaaggtgatgatgcgcttagtgtgggattcacgctaa

SEQ ID NO: 7012 - DNA, 597 bp, Glycine max
  Peptide Sequence Number=SeqID_123790
atgttagaacaactagcctcagttcgcaatacccaagaaagactccaacattttggagaaaccatctttagacaatttcatagagtattaaaggtggtacttgccctttctaaagacattataaagcctattgaccctacctttaaagatattcttgatcaaattataaaggatgatagatatcatccttttaagaattgtaccaatgctatagatggtacacatgtgcaaatcattgtacccattgaacatcaaattccttacacttgtagaaaaggatatacatcaactaatgtaatggttgtttgtgatttcaatatattagggcctagagctagaggaaggaatgaagtgtttaattatattcactctagccttcaaagtacaattgaacaatcatttggatgttgcaaagttaagtggagaatattaggcagcatgcctcaattttcattgaaggctacaactattgcttgtatgactttgcataatttcattagaaggaatgacacaagcgatgaagaattttgtttattcaatgaaaatgttgatttaaaggataatgttgatttgcatgatactgcaatgcaattgtag

SEQ ID NO: 7013 - DNA, 546 bp, Glycine max
  Peptide Sequence Number=SeqID_123791
atggatcaactccaacgtaaagctttccgcaagacatatggaaagatctgggacctggctatgatgatagaagtctctgttgaagccattgtgtccctcactcagtattacgatcagtcactaagatgcttcacgtttggggactttcagttagtaccaatcgtggaagagtttgaagaaatcttgggatgtccgctaggaggaagaaagccatatcttttttctgggttctatccctccatggcgagaatagccaaggtagtcaaaatcttggggcaagaattggatcgagtaaaacaaaatagaaatggggtggttggaataccgaggaagcacttggaggagaaagcaaaggctttggcagatcaaggtgaatgggctttgttcattgacgtcttggcgctgttggtatttggagtcgtcctttttccaaatgtggatggattagtagatctagcagtgaccaacgccttccttgcttaccgccatagcaaagaacgcccagtcgttggtgtgttggccgatgcctacgacacatttgactga

SEQ ID NO: 7014 - DNA, 993 bp, Glycine max
  Peptide Sequence Number=SeqID_123792
atgggtagatctccttgctgtgagaaagtggggttgaagaaaggaagatggactgcagaagaggataaaatcttgaccgattacattcaagaaaatggtgaaggctcgtggaaaaccttgcctaagaatgcaggtttgttgaggtgtgggaagagttgccgactgagatggatcaactatttgagagctgacgtgaagagaggtaacatcactcctgaggaagaagagatcattgtcaagttgcatgctgttcttggtaataggtggtctgtgatagctggacgtttaccgggacgaacagacaatgagataaagaactattggaactctcaccttaggagaaagatctattgcttcatgagatctctaaatgagtctcttccacccactgacatggctgctgtaaactctgccacatccaagagaagagttcgcggttcaagaaacaagccagccacagaagaagaaaagaacatggctttgagccaaaactcctttgagtcaatgcctagttgcaacagagaagaaggtgaagaaatttccatgatggatgcttgttatgaaatggagagcattacaattagtagcacatttgcatcatgccccagccttgaagccagcttgggaccatatcatcattggtctgatgatgaaatcatgaaacttagtaacatgtttgaaaatggggtgcttgtgaatccaagtggtaataatgtaacccttaaggatgagcctaatggaattgaatgtggccagatgaatgtggatataatgggaacagatcaaagcaagaataatgcatcaaatggggatagtggagaatggtaccccaattgttcatcagtgaattctgctattgattatcagtggtctgattgggacatgggaggaagtgttcaatccaataatcagtggaacctttgtgatgaccaagtgatgaattgcttgtggagtactggcattggtgaaataaattatggttttcatccataa

SEQ ID NO: 7015 - DNA, 2810 bp, Glycine max
  Peptide Sequence Number=SeqID_123793
agtctttaaaacagggaagaaaagtcgattacaatgtggcaatgacacagccctcctatctggttgatgacgatgaaattggagtaggggcaagtgttagaggaagttgtgatcatagttatgcttcatctgttactgatgatgaagcatatggaacaagagcccctagtgttgttgccaggcttatgggtttagattccttgcctacttccagtttttctgatccttattctaccccatactttgatacccgatcccttcaagactctcatgacttcaagaaaaaccttcgtcaccagcatgaccatcataccccatattctggaaagctgcttgaaaaggttgagagctcttctaggaacttcatggagccaaagccgcaaaaggccattaccaggccaattgaaaagttccaaactgaagtattgcctccaaaatcagctaaatcaattcctgttacacaccataaactcttgtcccctattaagaatcctggctttgttcctaccaataatgcggcttatataatggaggctgcggcaagaattattgagcctggatcccaagttagtaccaagttcaagacaccgctgatagcatcatcaacaccattgagagttagagatcttaaagataaggtggaggcttcacaaaaagaacctctaattgggccatcttccatgacctctagaactcgagatctgaaagagaaaagagaaattactcatagaacaaccaggacctcagaatcttctcaaagatcagtcgagtcaaatgctgccaagtatctaaagggacagtctttgaacagaagctggaatggatctgcggatacatctgtatccgtcaaatctcctacaaacgaggaagaagattcttctttgaagaataaggggaagtccatttcacttgcaatccaagcaaaagtgaatgttcaaagaagggaaggtttgagtttgactgggggcagaagtttgacaggccagaaagagcatcctgatgttaaatccaaccaaccaatgaaggcaagtgttcagaaaaatttacacaagaaatcttctggtgctcttagacagaataatctgaaacagaattattcaattgacaaagacaaattaccatcaaagccattggttaccaattcaaacagtaggaaagttctgactggggattcctcttatggacgccatagaagctctagtaataaatccaatgcaaaacctaaagttggatccagaaagtcagccatggaggtgacagatagtgaaaaggaggtcttgtataccagcacaaacagttttcctagaaagaaaaggtctacagacaaggactggaatgatagggttgtggataatttgttcattgaaaaaatgcagaagcctgctaagtctaacctagtgagtaataagcaaaatagttggactgaagaagtcaaaaagaaagacatggatgtagtttccttcacatttaccacaccattaacaagaagcaatccaggttttgagacatctggacaagctggccagaatactaatggcctttccttggatcaacgcattaaaagagtgttactcgacccagacaatacaaagtctccaataggatacaatataattggtggcggtgatgccttaggtatccttttggaacagaagttgagggaattgactaatatggaaaccacttgtcatgactcttctaaagtgaggcaacctgccattactgcaccaatttcagatgatcaagtaaccagccataatgtagttaatctcaatccgaggttgcaacagaaaaaagaccaaggtgtgttattttcagacaagttaagcagtaactatgattcaaacatcttcttcactggtcctcctgaactgtcattgaagcataactcatggtatttatcagtcaagcatgctaaatggaaagttaggcttgtttatttcgtgttgaaaatcatccttataaaagaaaacaaaagaaacagattcattgtctgtttcccaagaaaaccaattttcaaaattgatgagatggaatcacagttactcaattgccgacacccaagtccaatctctgttcttgagccttctttttcaatggaaagctgtgaatcttcattgagcacagatattactagtacagaaggaagcaagttaagctcatctgttcaagctcacgaagttcatggtttgaatttttcacggaagttctatccttgtgaatctgatactgagttatctgattcagcttcttccacatcagctgggaacccgatgaggaagcgcacaagtacatgttctgtcacgaggtttggaaggtcaagcacatgggagttggactacgtgaaagatatagtgtgtaatgttgagttgatgtatatagacttttcccttggccaagctagcgaggttataaaccctcatctattcaaacagttggaagggtgcaagggagggtttaagcgcggtgacgaatctaggatggcaaggaaagttacatttgattgtgtgagtgaatgtctggatttgagatgcaggcgttatgtagggggaggatacaaaatgtggatcaaagggtttgaaatggtgaaaagaaaagaatggttggcagaagatgtgtacaaggagatctcagattggagtggaatgggagactcaatggtagatgagcttgtggacaaggacatgagcagccaatatagaagatggctagagtatgaggttgatgcttctgaactcggatcagaggttgtggaccaaatatttaattctttggttgatgatgttgtgactgaaatgttgcaattgtaa

SEQ ID NO: 7016 - DNA, 1047 bp, Glycine max
  Peptide Sequence Number=SeqID_123794
atggaggatacccaagaaattgaggagcaagcacacaaagaagtgatttcagacaaaacatctgagaagcagcaggaaactcttgatgaaattctttcacgacacaggttagcaccttctacatttggcttctcaacaacttatgtcaattgccactttccactggcaacagctatgaagaaagagatattgcaactgcagaaaaaagaagttgagatgaaaaaagctgcagctagaggtagcaaggctgagcagaaagctaagaagaagcaagtggaagaagaggtttgtcaactttctgctaagcttaaggagaatcatgccaaagaactgactgcattaggctatatcagtggtaatggaaatgaaaagagcaatttggacagtctggtgaaggccatagctggagtatctgttactagtcaacctgaacatacaaaggtcagcaaggccaaacagaggcgagacaaaagagctcaacaagaagcagaaagggagcagagaatccaagcagagcagagtgacattataagtgatcgtgtgattgagaacgagaaattggaaaagaagttgaagcctcttggcttgactgtttgtgaaataaagcctgatgggcactgcctctatagagccattgaggatcagctggccatcctctctgggggtagatctccttatacataccaagaacttcgagaaatggtggctgcttacatgagaaatcatacatctgatttccttccatttttcctgtcagagaatttaattgaagatgattccaatgaatcatttgctcagaagtttgaaaattattgtaaagaagtggagtccacagctacatgggggggacaactagaacttggtgccttgactcactgcttgaagaagcatattatgatattttcagggtccttcccagatgtggagatgggcaaagagtataaatctgatggtggcactggcttgtctaattcgagtatcatgctttcttatcacaagcatgcttttgggctaggagagcattataattctgtggttccaacatga

SEQ ID NO: 7017 - DNA, 309 bp, Glycine max
  Peptide Sequence Number=SeqID_123795
atggacgtgatcacaagcatggtagctgaaaagccggtggtgatattcagcaagagcacatgttgcttgagccactccatgacatcactgatacgtagctttggcgcaaaccccaccgttcacgagctcgatgaaatggcgaatgggcagcagattgagagtgcattgcttcaaatggggtgccaaccaagtgttcctactgtgttcataggacaacggttcataggtggttctaagaaaattatgagcctgcatgtcaggaatgaattagttccattgctcaagaatgccggggctatatggatttaa

SEQ ID NO: 7018 - DNA, 412 bp, Glycine max
  Peptide Sequence Number=SeqID_123796
atggggctgagggactcaaaggtgagtgtgtcggagcggactcccttggcgtcacagagggtggtaatcaacgtagggaacccaagcctggaagagttggactgtgcgatctgggtgatttgggatgatatcatgttgtccagtggcctccaagcagacaaagcttggctgctatggcctggtggtctgggtaggtgtggaggaactgagaaagaagactatgcattgtttcggagagtcgtccttcgggtagtagatgttagaatagaactccttaaccaaggccacgtcaatgtcgttgtctggcagcctgaactcatcatactgtgtgggaaccagctcgacattcctcttcgaaaggatgtttcgaagatgaacgttctcaatgtatcgtatccaggcaacctcagag

SEQ ID NO: 7019 - DNA, 318 bp, Glycine max
  Peptide Sequence Number=SeqID_123797
atggatgtgttaacaacattgactgcagataagccagtggtgatcttcagcaagagcacatgttgcatgagccacaccgtgaaggctctcatatgcagctttggtgccagccctacaattattgaggttgacaaaatgccaagtggtcagcaagtagagagagcactcattcaactaggttgcaaaccaagtgtgcctgcagtgttcataggacagcaattcataggtggtgctgatgaagtcatcaaactcaacgttcaaaacaagcttgcccaattgcttctcggtgctaaagctatctttatctggagtaggtag

SEQ ID NO: 7020 - DNA, 240 bp, Glycine max
  Peptide Sequence Number=SeqID_123798
atgtactcagagattgaaacaggatctgcaacatcaccctcactaactccagaaggtcctgtagcagtatcagctccagcggtccccgggccaagctacttgctgaaggaagtccttcggtgtcataataggctggtggagcacaatagcgatctgttagaggctctacataatcagaaactggtcatggtggatgctttgcaacatgggagtcgtcggctactaaggagtggaagttga

SEQ ID NO: 7021 - DNA, 1812 bp, Glycine max
  Peptide Sequence Number=SeqID_123799
atgagtgaggagatgatgccaatatctgacgtctctagtgatcttaccatcgaagtaggagcatcaaccttcgcacttcacaagtttcctttggtttctcggagtgggagaattcggaagctgctgttagatgcaaaagattcaaaagttttacgcataagtctcccaaatgtgccaggtggtcctgaaggatttgaactagcttccaaattttgctatggaatcaatgttgagttcacactctcaaatgtggctttgctacgttgcacggcccattttcttgaaatgaccgaagagttcgcagaaaaaaacttagaggccagagctgaagcatatctaagagacacagtgctccctaacatatcaagcaccgtttatgttcttcactgttgtgaggctcttcgtcccatatcagaagaaataaaccttgtcaataagctaatcaacgcaattgcgaacaacgcgtgcaaagagcagcttacaactggtttactaaaactagatcacactttcccttctaaaaccacaccaaccatggaaccagaaacatcctcagattggtgggggaagtctttcaatgttcttagtcttgagttcttccaacgagttgtgtctgttgtgaagtcaaagggactaaaacaagacatgatcagcaagattttgataaactatgcacacggttctcttcaggggattcgtgttagagacccccaagtggtgaagggaagtcttcatgacttggaattgcaaaagaaacaaagggtggttgttgaaaccatagttagcttactcccaactcactcaaggaaaagcccggttccaatgggattcctctcaagtttgttgaaggctgcaatagcagcatctgcatcaactccttgcaaatctgatttggagaggcgaattagtctacaacttgaccaggcaattcttgaagacatcttaatcccaacaaactcacctcaaaactcccacaacacaatgtatgacacagacttaattctgaggatcttttctatttatcttaacacggacgaggaggatggcgaagatagcgataactacattgatgaaagccaaatggcgtatgattttgacagtcctggatctcctaaacaaagctcaatcataaaggtatccaaattgctggacagttatctcgctgaagtagcactagactcaaacttgttgccgtcaaaattcacagcacttgcagaactgcttccagatcatgcacgtatcgttagtgatggactctatagagctgttgacatcttccttaaggttcatccaaacatgaaggactcagagaggtaccggttatgcaaaaccattgattgtcagaaactgtctcaagaagcaagcagccatgcagcacagaatgaaagactaccggtgcagacggtggttcaagttctttacttggagcaaatgaggcttcgaaatgccatgaatggagggcacaaccaagtcttctttggtcagttccctcaccgttcaggaagcggtgcagggagtggagccatttccccaagagataactatgcatcggttagaagagagaacagagagctgaagcttgaagtagcaagaatgagaatgaggctcactgacttggagaaagaccacgtgtccatgaagcaggagcttgttaagtcacaccctgccaacaagttgttcaaatcatttaccagaaagctgagcaagctaaattctctattcaggataaacagcattaagccaattggtggcaaagctagttcagaaactcgcttcccttttccaaagcgaagacgccactccgtttcatga

SEQ ID NO: 7022 - DNA, 411 bp, Glycine max
  Peptide Sequence Number=SeqID_123800
atggaggagttcttgaagaaagtgaaaaaatacatcaattatgagaacgtgttggaggcaggaaaagtattacagaagttgtatttgaaggaggtattcaaggtaaaattcaaacaagcaggtttggataatcccaaaccgattagggtgcatgcgaacactaatctggagaagtattgtcagtatcataaggcaattggacaagaaaccgaggaatgcatacaccttgctaaagcaattgaagacctcattcaacaaggacaattggagagatttgttaaatatggtggtgtgtattcaagacgacaaggaaggcaatatagaaaaaattcggtggagaagatcccgaagccctcccaagtggaggagacacttaccttctccgagaaggtgttcacgatcttcgcctaa

SEQ ID NO: 7023 - DNA, 567 bp, Glycine max
  Peptide Sequence Number=SeqID_123801
atgtggcatcgttgcaacatctgcccattacaggcgtgttccatagctttgagcctctttttaaagtattggatctacgagtgctttccttctgttggttctgctattgttgttgaggattatgatgagaagaaaccacgtgcctgccattcaaagtctgggaaggtattatcagtgtcgacgtatcataagcatttggatagattgaggtttgattttgtgtgttggattccgtatggtgaacaccatgcattcagagagtttgaggttatctctttattttctggacatatcagatggggtccatctattttcatacaccgaccagagagggttatacgaaagtttgggtatgtgcagaccattccttcacaccctgttgctccttctatatatgttactcaacacccagtggcggcaacggctatggacgaagcacctgaagatgcacatgttgatgtagagcagcctcgacatgcaatgtgcttgaggattgcaagaggtgtcactgcgcaatggaatgtctatgttcgatcaagacgaatgcggcatatgaaagacacatga

SEQ ID NO: 7024 - DNA, 1899 bp, Glycine max
  Peptide Sequence Number=SeqID_123802
atggcggcaatggacaatggtatgatgactacggtggcggtcactagtggtgcgaatggtggtggcggaggggcagcgaagaacgaacgcaagcagaggaagaagagaggcacaagtggcgtggctccacgcgctgttgtggcatgttggcggttctcgactggtgggcccaacgtaaatgatatactttctaagaaacgaaggaggaggcaacaaggcatggtggtggttgagaaagagaaagagaatgaaactgtagctgaagcaaagaaggaggagaaagacttggagaaagggggtggtgtgggtgttgaagagagaaagtttcatagtaataataataataatgatgttaatgatcatgaagaatctcatatctcaagtttccacaggttgaaccccactaaccctttgagaattgtgattaatagctccaccagagtcgcaactcctcctcctcctgctcaatctcaacgttctcacacccacacgcgctccattccaaccccacaacaacaacaacccgaaccccaaccacaaccggtgacactgaattcgagaaaatacaccaacagaatatccttgtttctttttgttctccacatgtttttagcggttacgcttgtgttttttctcgtgttcaagggagttcaagggctaatccaggaatcagaatctaacaagaggaaagagaaaaacgtgttaaagtattttcttccccaagtggaggctgcatcttttatgagcataattcttgcatttatttggcaaggggcgattaggaaatggccaacttttatgcttcatttcatactttggtttacttttgtggtgtctctggctgctgggattctcctaatttgcttccaaaagcccgccactgatggtgttggagtgtgtttcattgcttttgcaattgggaatggcttatatgcttgttgggtattgagtttgtctcttcaacctgtctccaaattccctgatctgagcaaacccacttattatgtgcttggggctggattcttgtggatatctctatggattttagcagtaattggagcattgaacttctattttcctcctttggtcatcattgcattggtgctgagtttggcttggactactgaggtcatgaggaatgttgttaacatcactgttagtagggttattgccttgtattacctcagaggaatgcaatctagcacccaattttgctttctgagagccttgactcggaatcttggaagtgcttgtttggggtctctctttgtgcctgcaattgaagccctgagaattgtcgcccgggggctcaatttgcttgagggagaagatgagttcatgttttgttgtgctcactgttgtttaagagtcatggaatccattttcagaaatggcaatggctgggcatatgtacagattgcagcatatggaaaaggttttgtaaaggcatcccaggacacttgggccctatttgagaaagaagatatggtgtcaattgtagatgctgatataaccagctcaatttgcttcctcacaggagtttgcagcggctctctttgtgtcattgttgtggctgcttggacctacaaaactaggattgccatggcagtgcctcatgcctgtgtgagttgttattatgtatgctatgctgagactccggagaatagattgtttgataaaacaattaaggatcgtcaggccttgttaaaaactggccgtgatgtggttcctacgccaaggggaattaggaggacatggtttatgtccaaaagggttaaaattgaaatccatggtggctggctgaggtggtggtttgttgagaatgatctggcgaggttgagccattattggaatggaagaaatgtgaaggataatcaacatggccactacagaaagtga

SEQ ID NO: 7025 - DNA, 471 bp, Glycine max
  Peptide Sequence Number=SeqID_123803
atggtgaaaacatgcaatcagagagcttcatccgtggcgattcgtccaccatcgatcgtcgctaatgcaatacttgctggagcacatgatggcgaagaagcttcagtcacaccaactgaaaaacctcaaagtttgaaggacaacaatgattcttcaacggattcgagtctttatccatggaaaaggccaccacaagtgggagagccaaccgaggatgaggctattccattcaacttgtcatttcccgacaatgtcctaaggatccgagtttcaaaacagttgcaacaactcccaacgatggaattctacaatggatttaccaatcccgatgatcatttgttgggatttgaattcgccctatcatatcgaggagcgaacaatttgaaaatgtgtagagcatttcgattgtcactcaaactagcagcactgaagtggttacagtcacttctgagaggttccataagctcatag

SEQ ID NO: 7026 - DNA, 465 bp, Glycine max
  Peptide Sequence Number=SeqID_123804
atggtgggcattgtgggaggtattagggaagtagttttgacaattgggggtgcattgtttatggtggttcatcggcaagtggtggttgtgatggtggttggtttggccattaatgacaaagataaagctggtgtgaatgaagaacatgttgattgttttgatgcgttcaatacttctcaggtgtttgctactcgtgatgatgttctacattgggctcgatttgttgcttatgaaactggatttgtggtggtaattatgaggtcatacacaaataatggtattagaggaaggacctcatttgttttaattggttgtgaaaggagtggtcagtatagggccaagaagaaagatttgtcaatggtaaaaccaagaaatattcttctaatgttgaaggagcacaatgccaatagttatgcaataatcaagcaaatatacaatgcaagaaatgcttaccgtcttccataa

SEQ ID NO: 7027 - DNA, 390 bp, Glycine max
  Peptide Sequence Number=SeqID_123805
atgatgaggatgatctaaatttggttgtggagatgggtgtgggcatggtaatgaagggaaaaggtcttgtggagggtagtataaatgcaggggtgaagttgatccattttggtggacatggtgttttgagcaacaatgaggttgagttgattggagagacacagaagggaaaaggacctagcgttccagccttaggcaccctcctaagcataagaaggaagaaaagagacaaaatccctgatgtgtcttggtgtaatgatctttctcttgggtctctcattcgagcctgtggtgggattttgcagcatcttctccttcttatcagcagtgattcaaatgacaatttaatgaattgctcaaaattggctcatggtggtggcaccattgttg

SEQ ID NO: 7028 - DNA, 381 bp, Glycine max
  Peptide Sequence Number=SeqID_123806
atggggtcagattgtcgtgtggtgccagactacatggactggtttttttggatttcgcactcattcatcacatcgatcgaggagactgctgagccgagacatccgcctccccctcatgatgaggagtttgtcgaggcacctatccccgaggtttcagtcgcgtccgatctccctacgcattcagtggttgactgccaaggatgtcaagggatggctgaggatttaggaacgattgctgaggatttggagcgggtcatcaacctcaggatgatcactaaaggcactgacttatatgacatcatgactcgttgtctgaggagagctagaggtgacgccgcagatggaagtcttaggctgcgacaaagatgccgcatagattag

SEQ ID NO: 7029 - DNA, 180 bp, Glycine max
  Peptide Sequence Number=SeqID_123807
atgtctctgctggtcatcatgttcgtgctggtcatctgcatggttctgttgactgctggtgttggtgctgttgttggtcttgttgctgctggtgaagttgaggtaggaactgaaggacaattaattgaaaaacacgtatctcctcctttgattgatgtagttcctcccgcagtcgattaa

SEQ ID NO: 7030 - DNA, 360 bp, Glycine max
  Peptide Sequence Number=SeqID_123808
atggcattcttccaagtgagtgtcaggcgttggattttaacctttgctatcctttacgtttgtgtatttgggaaaaactttggaaatgctgatgaggatgagtccgaggcacagacaggtggtggtgggtacggtggtgtgggaggtggttttggtggtgctggggccggagttgttggtggtggtggtggatttggagccggtggtggtggttttggagccggtggtggtggggttggtagtggtgaccctgctcaaattgtctccaaagccttgctctgtttcaatgataagaatgtgagtgcccaaactgatttttatgtttactgcttttcaaggaggtttcaagtgtttaagtga

SEQ ID NO: 7031 - DNA, 549 bp, Glycine max
  Peptide Sequence Number=SeqID_123809
atgctcaagtttatagcagtgcaacttgttgatgatgaagatgtcgaagctatgatttatgttatttgccaaaattcacaagcatttgatgctactaaggatcaacctcacccatacttgagtacccctattgtaaagcctacctcatcaacccaaccaaatgagcctgagtttacaccagagcctggcttacctaacgaagagctcgatccctttagtgaggacagagacaaagttctacacaatcaacccaagagcaagatgatgaggaagaagttgacttggatcgtgaagaagtctaacatcaagtggggactctctttgaagggatatgttttttgtcaaaacaagaagcacaacatgctttgcaaaaatatcatggaatcatacacccttccaataaaagcatccaacttgattgaaaatgatccatcaacttcagtgctagccttgatagcatatatcaaaagcattgaaggatacaccaccatgtaccgcaaagtatggttggaaaaacaaaaggctattgaaaacatctacgacaactga

SEQ ID NO: 7032 - DNA, 240 bp, Glycine max
  Peptide Sequence Number=SeqID_123810
atgccttttcttagcttggacaattccctagaacttaacatttcacatacaacaatccatatacagatattttctaagaaaaataaattagaaacccagaatgtaagaaagagagagaaagagagacgaacctgcgacaaaggagagagagcgagagtgttgaaaggaggggaggaaggagagctgagaggaatcagaggtggtggtggtggtgaagagagagaatttaaatgggagtga

SEQ ID NO: 7033 - DNA, 711 bp, Glycine max
  Peptide Sequence Number=SeqID_123811
atgaaaagcttcgaagcaaaaggaaaagaaacagaagaactccacaaacgtttcaagaagctggagcaagagtggcaaggctttaaggattccaagccaacaacaagaacaacaagagcttcacacaaacattcccttcattcttcaaacgaaaccattcataagccacgccaatattctccaagagaactcatgtttaaccttcaacaagaagagtctccctcacccgaagaagaggcatcgaggaccaatgatagggcagtgcaagagatccttcaagagcgtaggcaggctattgagaggggaaaattaaagggtcggcgactttttcagtcagaggaggaagatgagaatagtagtcatgaagtgagatcaatgtccttcaatgaggatggtgaatttagtgaaagtgaacgggcgcatgattattgcacccacgaactttctgattcatcttcctcttcctctttgtcttgtctcgttggtggcgacaatcatgatcaagataacgagactgtggcacgtttggtggcgatgataatggcggaggtgggagttgctagtaatggtaggcgtggcaatggaggaacgaggtatgctgttttcttaggtggggttgttgctattatcttgcttgggattgcaatgtttatgcgtttggggaagagttttggtggagatgattgcgacatgcattttgttccaacatga

SEQ ID NO: 7034 - DNA, 201 bp, Glycine max
  Peptide Sequence Number=SeqID_123812
atgtctactatcaacttgttacatacgggtcctgcatgtacactcgtgatgataataagttctaggctggatattctgccaacaagagttttctcttttgtactcttacttgacacggtgtgttttctttctccgctcactataagaaaaacactgatttccgatagtcaaaacccgtcgttaaataggaattaccaatga

SEQ ID NO: 7035 - DNA, 258 bp, Glycine max
  Peptide Sequence Number=SeqID_123813
atggcgcgtaaccaactatgcccttcaattttactcttatattgcttcagtgacatgcccggcaaaatactaataggtggtgatggttgtagtggcgatagtagcagtaatagtatcgacaatgacaatgattgtaatgatgatgatggcgacaacaacaataatgataatagtaggagtgacaataataataaagatgacaataataacaatgttggtgataatgataataagaactatgcggtggagattatgtaa

SEQ ID NO: 7036 - DNA, 1359 bp, Glycine max
  Peptide Sequence Number=SeqID_123814
atgtcagtgaaggtggagaagaatgctgaaaagacaagtgggcatcaggtcctattgattgctgctgcagacagttcagaaggtctgccttcgactatcagacgctgttttagccacgaaataagcatgggggctttgactgaagagcaaagggctgaaatgctattccagtcactgcaaagtgtttccggactcctctctaatactaattcagaagctttagtaaaagaaatagttgggcagacatctggttacatgcccagggatatatgtgctttaattgctgatgctggtgccaacttatttcccagaaacaatgctaaagtagacaaagatgtacatgatgatgtaggtagttcccttagttccaagatggcagaggacaacaatcacgggaaagtttcacctcagattactggaaaagaagacttgttgaatgctttggaacgatcaaagaaaagaaatgcatcagcattgggtactccaaaggttccgaatgtgaaatgggaggatgttggtgggcttgaagatgtcaaaaaatcaattctggatactgttcagttacctctcctgcataaagatctattttcatctggattacgtaagcgatctggtgttcttttgtatggtccccctggaactggcaaaacattattagcaaaagctgttgctacagagtgctccttaaattttcttagtgtgaaaggtcctgaactgatcaacatgtacattggagagtctgaaaagaatgttcgagacattttccagaaggccagatcagcacgtccatgtgtcatcttctttgatgagcttgattctcttgcaccagctcgaggtgcctctggagattctgggggtgttatggacagagtggtttctcagatgcttgcagagattgatgggttaagtgattccacacaggatctgtttattataggtgcaagtaatagaccagatttgatagacccagcacttctgcgccctggtcgatttgacaaactgctatatgtcggagttaactccgatgcatcttacagggagcgggtcctgaaagctcttacccgaaagttcaaattgcatgaagatgtctcactttactccatagcaaaaaaatgtccaccaaacttcactggtgcagacatgtatgctttgtgtgcagatgcttggttccatgctgcaaagcgcaaagttttgagagcaaatccagagtcttccagccaagataatgaagcagattctgttgttgtggaatacaatgatttcatccaggtcttagaagagctgtcgccttccctctccatggctgagctcaacaagtacgagcaactgagagatcagtttgaaggcacctctaaatga

SEQ ID NO: 7037 - DNA, 1359 bp, Glycine max
  Peptide Sequence Number=SeqID_123815
atggaaaagagtgtttgctttggtgaaagcaatgagcaaccaaggcttgcgggaatcaagaagttgagtgtgattgataaagagcccaacccaacagaagcagcgcctcatctcatcggaacaccaacaacaatgtacgtgccttccgcttctctatccggttactctgtggccatgaatagcttaacggcgagtttcacagctcgaatatgcgccacgcgccgcgacctactccatatacgacaccgttcctttcatcctctcactactcgacgcgttgccaccaaactcactcctccaagaatcgtttgcatggcggaaccttatctgataacgaagcttgagtccgccgagaaaacgtggcaagagttatcggtcaagcttgctgatccagacgtagtttctgatccaaaggagtaccagaagttagcacaatcagttgcagaacttgatgaggttgtgtccacttataggagatttaaagactgtgagaaggttctagaagaaaccaaaggtttgctgaactctactatcttagcaaaggatgatggcaacgatgaggatatggtggaaatgatatcttttgaaattgactctttgtctaagcaacttgcagagcttgaggaaaagcttaaggtgttactgcttcccagtgatcctatggatgctaaaaacatattgcttgaagtacgagcaggcactggtggtgacgaggccggaatatgggctggtgatcttgtagcatattctgatgctgttttgatgttgaatcaggttcgaatgtatgaaagatatagtgaaaggaattcttggaagtattctcttgtctcaagctctgcggcagaaaaaggaggatacaaaacttatgtgatggagataaaaggaaatcgtgtttacagtaaattgaaatatgaatctggtgtccaccgagttcaacgtgttcccctaacagaaacacagggccgggtgcatacttcaaccgcaacagtggccatcatgccagaggctgatgaagttgaagtcataattgacccaaaagatattgaactgacaacagcacgttctgggggtgctggaggccagaatgttaacaaggttgaaacagccattgatctcttccataaaccaacgggaatccgcatcttttgtactgaagaaagaacacaacttaagaacaagaatcgtgcttttcagttgctccgagcaaaactggttactgaccacagattgaagataaactatgagctcacctcttttcttgatggtgatatagaagatgctgttcagtcttgtgttacaatggagcaaaaggaacttctggaagaacttgctgaatctgtgggtgctccggctggctga

SEQ ID NO: 7038 - DNA, 246 bp, Glycine max
  Peptide Sequence Number=SeqID_123816
gtcgactctagaggatcccacccgaataaaagtggagaatggagaattgcactaggcaatcactacgcatggctccagactcatgggtggaggatgcatgaacgacaatcaattcatggggctccgaataaaagtggagaatggagaattgcactaggcaatcactacgcgtggctccagactcatgggtggaggatactcacgggtggaggatgcatgaacgacaatcaattcatggggctctga

SEQ ID NO: 7039 - DNA, 1419 bp, Glycine max
  Peptide Sequence Number=SeqID_123817
atggtggaaaggaggagaaagcctctgatactgtgttccaccaaacatctcataaattccactgttccaaccaacaacctcttcccccatgaatctcttcccactttccgtttacccgttgggattctccgattctccaaccccgcaaacccctctctcgaccactctgcacttctcgctctctccactagtcttctcaaaaccctctccatcacttcaggctctccggttttggtcaagaatgttgatacgaatacacagaaaattgcagtggctattgctcttgatccaccaggcaccgccactaatatggactcaccctcttcttcaaattctcgaataatgcttgtttttccttcttgtgatttcccttctagtggttctgtgttagatgatcaagtagcttatatatctcctcttttagcctttaaccttaacttgcacgtgacatgcttaaaatctattcttcaccacgggcaagatgctttagcttcttatttcaaaaggggtgatgaggatgccactaaaagcactgtggattttgttatcaacgtagaattggaaccacttgctcaacctccaaaatttgcctctctcctgagggtttcttttgtgaagatacctgaatgtggcatccttgaatccattagagcaagttcgcctgttgagtcacaagagcggcaagacatgatcgacttggagttgcaaaagtactttgaagtcgataggtatttgtcgaagggagatgtttttggaattaaaataagctggaactgcaattcccccatttgcattccttgcaatcaaagatcattaaataaaaatgacaaccttgtctgcttcaaggttgttggtatggaaccttcagatgagccggttttccgtgtcaataacaccttaactgctcttgtgctggtagggagttctccatccgcactccctccagatttgttgattggtggacaagcagaaggacctgtgcctttgcaaggggacactgtgaacatcttggcttcaatacttacaccaactttttgtccgtcagtgctttcttccaagtttagagtttcagttctattgtatggcttggcagggtgtgggaaaaggactgttgttagatatgttgctcgtcaactgggcgtgcatgtggtggaatataactgtcatgatctaatggtgtctgataggcaatctgttgctttagcacaagctttcaagacagctcgaagatactcaccagcaatacttcttcttcgtcattttgatgtttttcgtgattcacaatcgcctgaggtttcaccacatgaccaaagaggaaatacatctgaagttgcatcagttattaggaaattcactgagccagtcaatgaacatggtgatagtagtgtcccagggaaatcaaacagtgaatctgtatga

SEQ ID NO: 7040 - DNA, 2112 bp, Glycine max
  Peptide Sequence Number=SeqID_123818
atggcgattctgttcgaagttggttacagcacttgtcactggtgtcatgttatggaggtcgagtctttcgaggatgaagcggttgccaagttgctgaacgattggtttgttagcattaaggtggatcgagaggagcgaccagatgttgataaggctttgtatggtggaggaggttggcccctgagtgtgtttctttcacctgacttgaaacctttaatgggtggaacttacttcccccctgatgacaagtatggacgacctggatttaagactatacttagaaagttaaaagaagcttgggatagtaagagggatatgctgattaagcgtggatcatatgcaattgaacaactttctgaggcaatgtctgctagttcagattctgataaactgcctgatggggttccagctgatgcgttacgcctatgctcggagcagctttctgggagctatgattcaaagtttggtggttttggatctgcaccaaagtttcccagaccagttgagataaacttgatgctatatcactccaaaaagttggaagatacggggaagttggatggagctaatagaattcagaaaatggttttctttagcttgcaatgcatggcaaaaggcgggatgcatgatcatattggagggggatttcacagatacagtgtggatgagtgctggcatgttccacattttgagaagatgctttatgatcaagggcagcttgctaatgtttatctagatgcgttttctatcacaaaagataccttttattcatatatatcacgggatatccttgattatttaaggagagatatgattggtccagaaggtgaaattttttcagcagaggatgctgacagtgcagagactgaaggagctgcaagaaaaaaggaaggagccttttacatatggacaggcaaagaggttgcagacatacttggagagcatgctgctcttttcgaggagcactattacatcaagcaatcaggtaactgtaacctatctggaatgagtgatcctcacgatgaattcaagggaaagaatgtcctgattgagagaaaggaaccttcagaactggcatcaaaatatggcatgtcaattgagacatatcaagaaattcttggagagtgcaggcataagttgtttgaagtaaggtcaaggcgtccaaagccacatttggatgataaggttattgtatcatggaatggactggcaatctcatcttttgctagggcttctaagattctcaagggtgaagttgaagggaccaaattctactttcctgtcgttggcactgaagcaaaggggtacttgagaattgcagaaaaagcagcattctttatttggaaacagctttacaatgtggaaactcacaggctacaccatagtttcagacattctccgtctaaagctcctgctttcttggatgattatgcttttctgatttctggattgctggatctctatgaatttggtggtggaattaactggcttctatgggccattgaattgcaggaaacccaggatgccttgtttcttgataggacaggaggtggatatttcaataatacaggagaagattcttccgttctcctccgggtaaaggaagaccatgatggtgcagaaccctcaggaaactcagtttctgctataaatcttataagattggcttccatggttgctggaactgttcttgtttatgtgctaacaatggtgggatcagggatgggggccgtttttgagagaaggttgaaagatatggctatggcagtgcctctaatgtgttgtgcagcagacatgttgcatgtaccttcacggaagcaagtggttgtggttggtgaaaggacttctggggactttgaaaacatgcttgctgcagctcatgcattatatgatcccaacagaacagttattcatatagatcccaacaacaaagaagagatgggattttgggaagtaaataacagcaatgttgctctcatggcaaaaaataactttgcagttgacaaggttgtagctcttgtatgccaaaacttcacttgtagcccccctgtcactgatcattcgtcacttgaatctttgctctccaaaaaaccttcctcttcattaacataa

SEQ ID NO: 7041 - DNA, 411 bp, Glycine max
  Peptide Sequence Number=SeqID_123819
atgggaagggaagtaaaaacacgcgccacgtcaaggtttgggtatgttgtgatactttttggacaaggttgtaagatgaggagggctgtgatttctacgggagctcgcgatcgtgtagaatttttcaaattacttgcgggggtgattggtttgggtgggtttttgattctgaggaatggatcgaagagggagtgggattttgattgggacgaagggttctcaatgcggaggtttaagttagagggaggtagggatgcaataaaggggctagggttagggttagggttaggattgggagctgggaggaaagagatggtggagtctgagcttgaggaaggtgaggcgtgctcgtttcagaaccatgaagattatgatgccaccgttgatcccgatgtttccctctcttacatt

SEQ ID NO: 7042 - DNA, 579 bp, Glycine max
  Peptide Sequence Number=SeqID_123820
atggaaaacatgaggctcatgaggaaacacaatactactcacacatgcatggccaataattcacacacaccttcttcttccctagccatgcacaaagattcccacatgatatccaaaaccaaaccaaagatccgcataatccacatatttgcacccgagatcataaaaaccgatgtggagaacttcagagagcttgtgcagaagctaactgggagaccaagtggagaaaatttgaagtgttgcaacaagaagaaggaaacaagggttgttgtggcaaaacaaagagaggaattagaatcttattcaagtgagagtggcatgtcagaggatcatcacaaaaacacagtgaaaaataataatggtgggtgttgttgggggttggatgtgacaacaaggggcaaagtcaaagaagaggttgttggggtttgtaattgcagtgatgaaagtaattcttctggtgggtacttgggggggttctctgatttggaagggttcatttctgattttggtgggtttcctttgcttcctttggatgggaatcacatcatggaagggtttgaagaatctcaacttttatag

SEQ ID NO: 7043 - DNA, 177 bp, Glycine max
  Peptide Sequence Number=SeqID_123821
atgtcacacaacttaacggggcagcttgtgagtgcagagatacatggctttcacacgttggaggctggtttttggctcctagagatgattgtgtgtgattttcaatgcaaggttggagtgaagaaagaaagtgtggttggttttggttgtggattgtttctccttgatcaagtgtaa

SEQ ID NO: 7044 - DNA, 4485 bp, Glycine max
  Peptide Sequence Number=SeqID_123822
atgacaggggcaaaatttggtggctatggatcatttttgcccacctatcagcgctctcctgtttggtctcatccaaggactccacacaaaaattatagtcaaaatacgcccagatctcccaataatttgcaaccggagggtgggcagggggatggtgtacaatgttcaactggaactcagtcatcaagacttggcccaggttctggtaactcctcgaggatggctgcaaacaagggtctctctttagatgatggaactaatcaagaaaaatacatgacagccactaaggctgacacatccacttctaagcaggagtctctaaacaaaaaaatttctagcacatcagaccagaagacactgaaggttcgaatcaaaatgggtcctgatagtttatcaacaaggaaaaatgctgcaatatacagtgaaattgggcttgatgtgtcaccatcatcatcactagatgacagcccctctgaaagtgaaggaatttctcgtggtcctcaagatgctccttttgaatctccaaccattatccttcagattatgacagacctccctcagctattgtcacctattcccgatgataccattgagttaactgtaaaggaaacacatgctagagatagcatccctggtcctgttcatatggatgacttagaaagttttgacatgtacgaatctaataatgtaaagggagacagaaagttgttaggtgggagtgggaggaaaatgaaatctctggagggttgtgaatcctcaatggaagtcaagggctctacaaagaagaatgctcggaatgatgttggagtgctgtcaagaaaggaacaaagtacagatgcattgactatggaggagctagtttcaaaaactatgaagcttccacttttatccagttcatattctttcagtgatgacttggttaaggctgtggatgggcaatgtgattcattgaaggaagccaacaaagttatagtgagggagaaaaccttctctgatcagggacaaaaggaacggatggagtcaacgtctactgaggtgaatggttttgctgagaaggcaaagggaagttcaggaagaaaagttgtgggagataaggtttctcttgatgactacccagtaaaggaaaatcaccagggagataaaaatttcaactcaatgatagttgaaaataatgtttccaaagttaggacagaaccaaacactgaagagccacctaagaaggctaatcagagaggtaacctctctgaacaagatggtgtagaacatccatttccagggggtaagaaaaagccaaagggaagtcatggcaccatggttatggagagggaaaaagaaaacttgaaggttggatcctctttggttcctaaaataaaaaagagttctgatgatagttctgcatcaagaaatgaaactgaagatgccagaatacaaaaaagtcttggaaagactagagatacttacaaagatttctttggggaattggaagatgaggaggatagactggattcattggagaccccttatggagaaaaactgaaggaatctgaggtggtcgagaggagtgcacctacgactagttatggagcaaaggagagatctggtggtaagaaagttgataagccattcacagctgaaatataccctaaaacagccacaaatatctcatgcactggaaatgccaatggcactgacctagagaatggtaaagggattcctgtaatgatacctcctgttgagatggacgataagtgggtacagtgtgatcggtgtcagaaatggcgtcttcttcccgttggaacaaatcttgacagcctacctgaaaagtggctatgtagtatgcttgattggctgcctgacatgaatcgatgtagctttagtgaggatgaaaccactaaagcacgtattgcattatatcaagggcctcctcttgatagtcaaagtaacctgcagaatgtctccggcagtgttatgctgggaggaaccatggcaatgtcccagcatccttaccaacaccaactaaataatgatatgcatgcagcacctgggggcaagaaaaagcttatgaaagagagatcaaattctataaataaagacagcttttctcaatcatcatattctattaagaaaaactggcagtcagcagtgaaaagtaggagcttaaatgatgtgaacaaatctcctgttgtgagtgaggctgatgttccagcagacaaacacaaaaataagcattggatgctggagcacaattctgatagaggtgatacgaagaatatgaaagtcaaaagcaggaaggaccctgatcaagatagttctaggccatccaagaaatctaagagtgacaaggttcattctaccaatgaagagtggattgtagaacagagtgggactactaggaaggtgggtgatcatagctcaaatagcacttttccaaatacctcagttggcaaagatcgacatagacagaaagacccctcctctttgcgggactccaaatcaggaaaagacaggctgccagtttctgctgaaacgacaaaagataaaggtcagggttccttggatgagggatccctggatctggggaattgtgattcaattggtagtgtgaaaaagaggaaactgaaggggtatcaggatgctcaaacttacagccctggtaaccctcgcctacaggagagcaaaacttctgagcacgagtttagtaattccaggaaggaaaagaaggcaaaaaattcaaaatatgaaggtaaagaatcaagtgccagtaaaggcagtggtagatctgacaaaaaagttagtcatacaaagacccagaaattcaggcaaaagcctgagagcagtttgtcacaccggagcttggatggaatggactgttcaaaaagggacttggggtctgtacatgcttctgttgctgccacttcaagctcttctaaggtttctggctctcataaaaccaaagccagcttccaggaagtgaaaggctcacctgtggaatcagtttcttcatcacctataagaatttcaaatgcagataagtttacaaacaaggaaattattgggaaagatgatcctcatgatattgctgctgtggatagtccaagaagatgctcagatcatgaggatgatggtgggagtgatcgatctggaacagctaagaaggataaatctttcaccattgcccataggtcagattttcaggacaagggtgttaatcacatgtcagatactaaacttaaagctcaaacaaccagctattgtaccaatgggggtgtggacactatagtcctagatgggacacatccaggcacagagcagattaatcatcctggtgaagacaagattgatgtttattatgctactacatctcaagcaaggaaaaatggcatagaatcaggtttggaggacaacaatgtcaatgacagctgtaagtcagagtcccatgcagataaggtcaagagtactagttctccatgtcaactgaaagatcagtctcctctacatgaggcaaaacataaggatggaaaaattaagttgcaggagaagtttgggttcaagcctgaccaaaatgagattatacatgctggcaagaaagattatacaggaaaaaatgagagcaggaataaggagaatcactcgaatcggggtcacgactttcaggatgttagtacagatgccccatgcaaacaggaggtatttcatgctcctattcagaatcagtttccggactgtgatactgaaagatccacaaagaggtctcttttggaaagaactgatcaagaagtacatggaaaagggaagccattgtcatcattgccatatgaaggatctcaagttgagatattaggtcgttgcccacgaccagttggcttacttaaaggaaatggagatatggaagttgatccttccaaagttgatgatgtgtcaaagttacaaaagaagcaattgaaaaagactgaccatcaaaatggaaatctgcaaattggttcaagaaatcccatacttaatggtcacaagtccaaggagcttgatgcccctagtccagctagaagggattcttcctcccatgctgctaacaatgctctgaaagaagctaaagatctaaaacatctggctgatcgtcttaagaatactggatccagcgttgagggcactagtctttacttcgaggcagccctcaaatttcttcatggagcctctctgttagaatctggcaacaatgataatgctaaacacaatgagatgattcaatcaatgcaaatttatagtagtacagcaaaattgtgcgagttttgtgctcatgaatacgagaaatcaaaagacatggcttcagctgctcttgcctacaaatgcatggaggtagcatatatgagggtagtatattcttcacacactagtgcaagcagagatcggcatgagttgcagacagcactgcaaatggctcctcttggtaatgaattttgttacttgattttcactccatttgcatga

SEQ ID NO: 7045 - DNA, 2136 bp, Glycine max
  Peptide Sequence Number=SeqID_123823
atggagcggaagatcattgattttgaccaaggctgggattatatgcagaaggggattaccaagctgaagagaattcttgaaggagcaccggaaactcctttcagttctgaggaatacatgatgctatacacaaccatttataatatgtgtactcagaagccaccgaatgacttttcacaacagctttatgacaaatacaaggatgcttttgatgaatacattaataccaccgttttgccatctctaagagagaagcatgatgaattcatgctgagggagcttgtccaaagatggttaaatcataaagttatggtccggtggctttcacgctttttccattatcttgatcgctacttcatttctcgacgctccctggctggacttggggcagttggcctcacttgcttccgtgattcagtttatatggaggtacgagtcaatgctaggaaagctgtgattgcacttattgataaagaacgtgagggtgaacaaattgatagatcgttgttgaaaaatgttcttgatatatttgttgagattggtatgggcgaaatggatcaatatgaacaggattttgaggctgaggattgcttgagaagggagagagatagagtgtctcattacttacactctagcactgagcagaaattggtagagaaagtgcaacaagaggtgctggtgattcatgcaaatcaattactcgagaaagagaactctggctgccatgccttacttagagatgataaggtggaagatctctcgaggatgtatagactttaccataaaatacctaaaggcttggatcctgtagccaatgtattcaagcagcatattacagctgagggtgcagcattggttcaacaagctgaagaagcttcgagcaatcaggtccttgtccgaaaatttctagagctccatgacaagtatatggcatatgttaatgattgctttatgaatcatacactgttccacaaggcattaaaggaggcatttgagatattctgcaataaaactgttggtggtagttccagtgctgaacttttatctacattctgtgacaatatccttaagaaaggtggaagtgagaagctaagtgatgaagcaattgaagatacccttgagaaggtagtcaagttgcttgcatatatcagtgataaggatctctttgcagaattttacaggaagaagcttgcccgaagattactttttgacaggagtgccaatgatgaccatgaaaagtgtattttgacaaagttaaagcagcagtgtggtggccagttcacatcaaagatggaggggatggtggtagacttgacattggctagggataatcagctgaaatttgaggagtatcttcgtgataactcacatgtaaatcctggaattgacctgacagtaactgtgcttaccacaggattttggcctagttataagtcttttgatctcaaccttccttcagagatgatcagatgcttggaagtttttaagggcttctatgaaacgaggacaaaacacagaaaacttacttggatatactcactgggaacatgccacgtcactggcaagtttgatacaaaaaacattgaactaattgtgccaacctatccggctgctgccctactgctattcaacaatgctgataggttgagctattcagagattttgactcagctgaacttgggccatgaagatgttgttagattgctccattcactgtcatgtgcaaaatataagatacttatcaaggagccaaacaataaagttatatctcaaaatgacatctttgagttcaaccacaaatttacggataaaatgagaaggatcaagatacctctaccaccagctgatgaaagaaaaaaggtaattgaagatgttgacaaagatcggagatatgccattgatgcagcaattgtgcgcattatgaagagtaggaaaattttgggtcatcaacaactagttttggagtgtgttgagcagttgggccgcatgttcaagcctgatatcaaagcaatcaagaagaggatcgaagatctcatcactcgggactacctggaaagggacaaagataacccaaacaccttcagccgattacttgattcagaagcaccaggagcgacttttttttggcatacttga

SEQ ID NO: 7046 - DNA, 378 bp, Glycine max
  Peptide Sequence Number=SeqID_123824
atggatgcgtggaacgaagatttttcggtgctggagattgggagctccgcggaatcgttccagaagtttttggtttcgcagaaagagctcttccacagccagatcgatcagtttcaggaaatcgtcgtcacacaatgcaaactcaccggcgtcaatcctctctctcaggaaatggctgctggtgctttgtcaataaaaattggaaaaagaccgagggatttattgaatccaaaggctgtaaattacatgcaatcagttttttccattaaagatgctattagcaagaaagaattgcacgagatcagtgctttacttggtgtcacagtgacacagtttgttatccttttgttggaccgaagagggtcggattcaatttaa

SEQ ID NO: 7047 - DNA, 2299 bp, Glycine max
  Peptide Sequence Number=SeqID_123825
gtttttgagcagagggggtggaatgaatttagcaacttggttgagtaaggcagctgctgaagagcaaacaagtgtccttcttcttatcttgaaggttctttgtcatttgcctttacataaagccattcccatgcacatatcagctatattgcagagtgtaaataaactacggttctacaggacatcagacatatcaaatagggcaagggttttgctgtcaaagtggagcaaactatttgcaaggaaccaactagcaatgcattttcagtttgcatgtttcttagtggtcctttcgtgttctcaggaagacattcttgctctctcaagcgaatgttcggataatttcaggaaaatgggatctccacaaggctatatctcttgtctattccttaacaccctatcagaatctagagaacgcagaaaagtgcaactggtggaacagccgggtcaaaagtcagtgagcagaagctcacaagtgacgagagcagggcctgtaagtcaaggccgtcccatgtctgttgatgatatccagaaagcaaaaatgcgtgctttatttatgcagagtaagtatgggaaatctggttcaaaagagagtaaagaaacaaagattgatagtccaaataaacaacctcagacaaaccctgccagtattgcagcttgctcttctaaagttcctactccacccaaaattgaagaaaacaagaaacctttgttacttacctctaaaaccactaataggctggaagcttcttattcaaaaccaaaaatggatgtgaaggaacctctctgggagaagtgcaagagggttcagatcccatggagaacaccagcagaagtggaacttaaagacacctggagagttggtggcggcgaaaatagcaaagaggttgaggtccagagaaatagaaaccgcagggacaaggaaattatatacaagactgtccaagagatgccacctaaccccaaggagccttgggaccttgaaatggactatgatgacactttgacgttggaaattcctattgaacagctaccagatggtgatggtgcagatatagcaatttctcccaatcaggttggaactcatactgttcaaggggtggcctccacttcttcaaccggtgtggctactgctgagcctgatttagaattgcttgctgtactgctaaaaaatccggagttggtatttgccttaacttctggacaaggtggtagcataccgaaccaagaaactgtgaagctgcttgacatgatcaagagtggaggtgtgaacttgggtttaagtgaaaatacaaatggaagttatggcacgagtgtgaagtccccggagaaggtggaagtttctctcccatccccaacccccttgagcgatccaagaacgagtggatggagctcagaagcatcaaaaaatcccttttcacggcgaagtctagcacccgatagaattacacagaaccatgctgcagtggcaactaccaacttattatctcagattcctataactggcactacagtaaggcaacagccaacagttgtggttccatcttcgaggcatcttacaagcacatcagtttctccatattctctgcctcatgcaactaatgttattcctgaaaagccatcaccactggggcaagtacaaacatcctcagatgtaggtttaaccatgaagaacttaaccaccgcaaatgcatcttcagttaactttcctggcacacattcaactctagcattgcggggtgatggcaccaattacgtaaaacctgtacctaatttgagtgtacaacatgagggtttgtctaattcattccgacaacccttcatgccaccctcaccaacgccatcacattcatccttacagcaacaaagacatcaacatttgactcaggaagtccattacactgaacctccatatcgtaaccctggccgatcctacccgccacaaatcgaaaaatcagatcatgggtctgataatatgtggagagttaggcaggatcatgtgtcatccagttatcattctcagcgaaatcataacaacaactataacacaatggttgggggatccaggcaatctggtttttgggatagaaataatcatgcaaggggagaatttgaatcatggagtccggagaatagtccaactagaaatcctaggtatgcaccaggtagaaattacccagagtccagaatgaatcatggtagaaatcctagacctgaatggtcaaggcagaggggttcttctggacactgggacccgggcaggcagggaaatagaaagtggcatgatcagagacgatga

SEQ ID NO: 7048 - DNA, 1434 bp, Glycine max
  Peptide Sequence Number=SeqID_123826
atgggtgtattttatgaaatagatcctaatgctgaagttgttgctttatcaccaaccacactaatggcaacaaatagattcgtgtgtgagatctgcaacaaagggttccagagggaccaaaaccttcagttgcaccgcagaggtcacaatcttccatggaaactgagacaaagaacaagcactgaggtgaagaagcgggtctatgtgtgccctgagccatcatgcgtccaccataacccagctcgtgcattaggggacctcactggcataaaaaaacattatagccgcaaacacggtgagaagaaatggaaatgtgacaagtgctccaaaagatacgcagtgcaatctgattggaaggctcaccagaaaacttgtggcactagggaatacaaatgtgattgtggtaccatattttccaggagagatagtttcatcacccacagagctttctgtgacgcattaactgaagaaaacaaccgagtgaacaaccagggattaacaagtggcatgccaccaaacttacaaagtcaaatacccgatctcatgtctaccatgcccctaaccactagtcccaacacagcatccaaattcggggaatatgaccctaagaaccctctaaaatcactagcccaagaacttgtcccaataccattcaagttcatgagcatgggtgggggtatgttctccaccaatgcaggtgcactctttggtggcccaaaaaccatgtctccctcttcttccagcctccagctaggctccagcacctcatcaagcttcaattacttgcaagacagcgaaaacggaggactaatcgcggcctcggctcaaatgtccgcaacagcattactacagaaagcagcacaaatgggtgccactgcaagcaatagcattaactccccaatgatgcaaaaaggctttgttagtggtactactactggtcctgatcatgtttcttccactactaggccaccatattctggtgctatgcttcagcacaacaactcctatgaccacttctctccacagcctgatctttccagcatggctgaggtgagtggtggaggagcattcatcaatcagttgtttcataaaggacaagagatttcgcaagttttcgatactaacaatcccggttctgccatgaatgatgtgggaatgttcggccaaatgccaatggggagagatcatcacaaccaagggttgatgaagagcgtggaacaagaagttagtaatagttccagtttgatgcatggaagagatgtgaatgatggtaaccacccaatgcagccatcaacaaggtttggagggagtgacatgacaactgttcatgactttttgggcattggtggttcaacttcaagagttatgaatcattttcatcaccattttccacacgaggattcaactatagaggaacccatgtgggatgtttga

SEQ ID NO: 7049 - DNA, 891 bp, Glycine max
  Peptide Sequence Number=SeqID_123827
atgaaagtagagctatcgcaccaaggaaacaacaacacgttgaaaatcgaggattattccaagacccatttccccaggtcgattttctcacgtgccttcaaacctattcccctcaagatggattctcgttgcattgatgacaacaaagaagacaatgaaatgaagtctgctgaaggatttgaagatatatttggagatccagaagttctgcctcgtgttggagaggaataccaggcagaaattccttcactaattacaacaccttatctttctcagcttgtgaagaagacaagagattcagaaatcactgtcatcgagcaagagtctatgtcactaggattgcccattcctcttaagtgggcacattgcaaatttgaaggtagttgtggttgtgggctttcagaatctttcacaagtgaagcggggccaattatttccgagaatgaatgtccagaagttgaagtgacacttcagactgtttcacatggtggagagaaaaatgtaggagggttctcaaattttgaatcatcttctaaaagtgttcagccaagagggaagtatcttctccctggattgttggatgatcaatcttggacagatattgaatacaacaattttcttcttggcctctatgtatttgggaagaaccttaaatttttaaagagatttgttgggagtagaactatgggagatatattgtttttctattacggaaagtttttcaagtctaaagaatactgccgatggtcagagtgccgaaagttgagaactaagcggtgtatatatggccagaaaatattcacaggatggaggcagcaagaattgctgtcaagattatttccccgcgtgccaggggagtctcaaactacattggtggaggtatctctctga

SEQ ID NO: 7050 - DNA, 2250 bp, Glycine max
  Peptide Sequence Number=SeqID_123828
atgtctaaccctgctccattctcaaccggaaatccaccattttggatccctatacatattgtgatcccagagaggccgactgaatgtgcagtattcaatgtcattgcagatactgatatcagtgtactatcaacacctgtgggtggatttacaatgaaagattctcctcgtgattctgtccagttcattgaatggtcccccacctgctgtccccatgcattattgatagcaaatttccatgggagagtaactatttgggctcaaccttctcaaatatgtttttcttgtttatttgtttctgatttcttgtccattccggggcaagctaatcttgcacttgatgctagctgctggctgcgagagcatgagtggcagcaagatattgcagttgttacaaagtggctatcagggtataggtggctttcatctaaaccaagtgctcctgccaattcaaggtcaacatttgaagaaaagtttctttcacgacaatgtcaaacttcaggatcggttcaacttcattggtcccagtggcctcctcagaatgcaacaacacccaaatggttttgcactagtaaaggaccattgggttgtggcccctgtggcattatggccggtgatgctatcattacagacagtggtaccatgcttgtgacaggtgtgccaattgttaatccatccaccattgttgtttgggaggttatgcctgggcctggtaatggtttccaatacatgtccccttatgatccagatgagggcccatcaatcacggggtggagagtgcaacgctgggaatcatctttacagcatgatgtcctccatccaatatttgggaatcctacttccagtatgggtggacagcctcctatgcaaactgtttggcagaccaaagtggagctgagcattccaccaacaaatgatttcaaaaatcatcaagctcctgcagttggaatgaacacagatatgcaaaagattagtgttggatctgcaattgctgctcctgctttttcttcaacaagctgctgttcagcatctgtttggcatgacacaagcaaggatcagacaattttgaaaattatccgggttcttcctcatgctattccgactagtcaagtaaaggccaactcatcaaactgggaacgtgcaattgctgaaaggaaaagtaggttttggtggagccttttggttggagttaattggtgggatgctgtgggctgtacacagagtgctgctgaggatggtattgtttcactcaacagtgttattgcagtcttggatgcagatttccattctcttccttctgctcagcacagacaacattattgtcctatccttagtcaactagtgcctgcgtcaaaaggaggtgaagaaccatccctagggcgttcgagaattggtactggaaatgctggccaaggatatacatatggagagagattaactgttaacttatggtcttactacactggtaatgctggcttgcaacacccattgccagtttctcaggtggggagtaataacattcaggttcggctgcattatattgatgggaactacactgtactgcccgaggttgtggaagcagcccttggcccccatatgcagatggctatgcagaacatgccccgtcctagaggtgctgatgctgctggtcttctactatgtgagctagaactccatcctccagccgaagagtggcatagacggaatatgtttgggggaccttggtctgatccagatgttttggattctgcaaatgatgcactaaaacttgttagtttaaatcctcttgattccagctcattggaaaattgtgatgtctactatggagccaatggcttatggccaaggaagcgcaggatgtctgaacgagatgcagcttttgggttgaacacttatgtgggcctgggagcataccttggtataatgggatctcgaagagatgctgttactgcattgtggaaaactggcattgaagggatctggtacaagtgtatgagatgtctacggcagacttgtgcttttgcctcaccagcttccactaatcttcctagtcaaaatgaccgggagatttggtggatcagcagctgggcttatggctgtccaatgtgtggtggaacatgggagaagagacatgtagattacctgacaggctctttatcaatcaaaatcgtgtatgtatcagagaaggcagagctagttgaaggcatggatgaagaattggtcacactgagaatgagaagaaatgattga

SEQ ID NO: 7051 - DNA, 195 bp, Glycine max
  Peptide Sequence Number=SeqID_123829
atggagaccaaaactgctgatccattattttctgtccaaactatgaaaggaagaaaagctccaccaagtcaatacacatttaaaatcaagtccttctcatggctttccaaggcctcggtacaaaaatgtacctccgaagagtttgaagcagggggttataaatggtatatgcatgctcttttgctaattcagtga

SEQ ID NO: 7052 - DNA, 888 bp, Glycine max
  Peptide Sequence Number=SeqID_123830
gatcattatgacttgtggctgctttggagccaaatcgataaaggcaaaacgcccttcttatgttcctggtgaaattgatggctatccgctagataatgtcaggcaattttctgataaagaactgagattggcaactgataattataatccaaacaataagataggacgaggagggaacattaagagatggaaggcatatagcagtgaagactctctcagtttggtcaaagcagggagacctagccgtacattagtctatgagtatgtggaaaatggaagccttaatagtgccctacttggcacaaggaatgaaaacatgaaactagactggagaaaaagatctgctatttgtcttggtactgctaagggtcttgcatttcttcatgaagaactttcaccacctattgtacacagagacatcaaagctagtaatgtactacttgacagagatttcaatcccaaaataggtgattttgggctggctaaattatttccagatgacatcactcacattagcacaagaattgctggaacaactggttacttagcaccagaatatgcattaggtggccagttaaccaagaaggctgatatatacagctttggggttcttatacttgaaataattagtggcagaagcagtgccagaaggacaaacgggggaggatcacacaaattcctcttggaatgggcctggcaactttatgaagagaggaaattgttggagtttgtagatcaagacatggaagaatttcctgaggaagaggcaatccaactcaatgagaaagaacttacagcaccaggattcttcacaaatgaaggagaatcctctagaaataactcaaaccctgtctcttcatttattactattactcaagtgaccccacg

SEQ ID NO: 7053 - DNA, 162 bp, Glycine max
  Peptide Sequence Number=SeqID_123831
atgactacagatgaagatgctataaatttggcaatggaagacccccttaatgatcgtcctatggttacactaattaatggagtgtttcatccatctaaggttgtggcaaaggctctcactttatccattaggcaacaatttggtcagccttggcctacatga

SEQ ID NO: 7054 - DNA, 417 bp, Glycine max
  Peptide Sequence Number=SeqID_123832
atggagacgagtatgattgatgctgccaatggtggagctcttggtgatatgacccctactgaggctaggaatttgattgagaagatgacttccaactcccaacaattcagtgcaagaaataatgctattgtccttagaggagtccatgagaaatctgcacctgttgcaagagtctatggtctatgttcttctgtagatcaccatacagatctttgtcctttgcaacaatctagagtcaatgagcaacctgaaacttatgctgcaaacatttataatagaccccctcagaagcaaacccaacaaaagcagaataattataatctttcaagcaacagatacaatccaggttggagaaatcatccaaatctgagatgggcaagtcctccacaacaacaacagttggcccctcctttctag

SEQ ID NO: 7055 - DNA, 378 bp, Glycine max
  Peptide Sequence Number=SeqID_123833
atggcaatgggaagaacgcaattgaaatatttacctcgaaggagaactcgaaagcatgaacaagaacaagcagcaaagcatgaacaagaagtagcaatgcacgaatgccaaaaaatgaagcacgaatgccgcaagaagcaatggagcaaggtgaacaacacacaggaaggcgaagaagaaacacgaagcggaaggggcatcatgaaggcgaagaagaaacacgaagtggaagaggcactaggaacacgaagaacaaacacgaagcgaaagaagcagaacacgaagaagaagcaagaaggtgaagatgaagaaatggaaacggcgcagataatgactcgtatggacgagtcactatttctttttaaatgcatagggtga

SEQ ID NO: 7056 - DNA, 363 bp, Glycine max
  Peptide Sequence Number=SeqID_123834
atggtgcacaaactaagtatgcatagcaattatcatagttccatctttactaggagtggtggtgagtatgacactggcaatgagaggaagaagagtgggaaagtggcattctttcaagagaatgaagaaaaagaaaaagaaagtgagggtgaaaaagaagtggtaacagacagtgttggagtaagcaaagctagggacctaagtgtcaaggaggaaaaattaaaagccaaaacgtccattgataaagatcttccttatccaaagaatccaactaagaaggataaggagagacaatttgcctacttccttaatatctttgaaaggcttcatattaaccttcctttcttagaagccttagaataa

SEQ ID NO: 7057 - DNA, 294 bp, Glycine max
  Peptide Sequence Number=SeqID_123835
atgatgataatgatgccccctactattgtagaggaattacacaaagagcagcaagaagcacctattgaggatcctcctactgatgttgagggttttccaagcggaccctatgacacatcaattctcagagattttgaaaatcacattgctctgagtgtctggaatggagaggaaagtcctgagctaaagctatcttcccatggaaggaagatgactaagttcggaagccctgctccagagattgaaggccttgtggctgccagtggactaaaaataaagcatgtagaatcataa

SEQ ID NO: 7058 - DNA, 231 bp, Glycine max
  Peptide Sequence Number=SeqID_123836
gtcttggagaggatcaactacaatgcttataggatagaccgcctagaggaatatggagtgagcaacacctttaacattattgatttggttccttttgcaggacaaatcctattcaagagggaagggatgatgcaatcctcccaaggaggggacccatcaccagagccatggctaggagactccaagaagattgggcctaagatgcaggagaaggccttagggttctcatga

SEQ ID NO: 7059 - DNA, 787 bp, Glycine max
  Peptide Sequence Number=SeqID_123837
ttcttcgcaatcctctccatggcccgtcgctagggttttcagttatggttcttgtttgcgagatagaagcgtaagcagcggctaccctaacctcgtcctcctctctactaatttcaggggtatgttcccggttgagcaaggggatcttcacaagcgctggaagttggttagtatggagttgagaaattttcacaagtgtgttgtgcttcccattggcagcttgtctagtgggctttgtaggcatcaaactattctttttaagagattggcagattatattggattgccctgtcgcatagctcgaggttgcaagtattgtgttgcagatcatagatcttcttgcctagtcaaaattaaagatgacaaacagctctcaagggtgtttcagaaaaccttaagttgcatacatcaatgggttttaagtgagaaaagggcccgtgatcaaagtactattaatcactgctgttggcttgcttcttgcactggacaatgtaaatttgttgggaaaagatgcaaggattcaagtgaatcatcttgtgcattatgttttcaatcctgcactggtgggtggcaatttggccgacacgatcactttttagaatgttgttttattgtggttcatgccggtcaatatcctcttgacgtttataataggctctgccttaggatggatccttatcaaattaacaagggctccctaacacttggaagtgaataccaaagagtatatagaccttctttgctacatgggttactggcattgaaaagtgtatctgagcaatcttaa

SEQ ID NO: 7060 - DNA, 285 bp, Glycine max
  Peptide Sequence Number=SeqID_123838
atgggtactgttctagttacgaacgtcgtcgtcacggtgtgtgagggaaacatgctagataggaaagggaaaagaaccacagttccaagtgatcaaaaactgtcatctctttatctcatagacaatattgttaagaatgtcgaacaagattatgtaaaatattttgcttccagactacctgaggttaagaagcttgaggagcttgggattggaaggccatcaacatatgcatccacgataaaagttttgttgttattttacaactggaacagtgtaatgccatga

SEQ ID NO: 7061 - DNA, 222 bp, Glycine max
  Peptide Sequence Number=SeqID_123839
atgagcccatggaccggtagagggttggcttgggccatgaaaatagcggctcatctcaaaattggtccaatccggctgtgtcgcaacctacccttcggcgggaaggcgacgcgagagctcatgggtgcgtcttccatgggaggaaaatgcgcggagtcgccaccaacgtttattcaaggaaaacgtcaaaataactggaaaggtgtggtctacgaactttaa

SEQ ID NO: 7062 - DNA, 207 bp, Glycine max
  Peptide Sequence Number=SeqID_123840
atggtagatttgaggggaagaggttccacattggtaagatttagtttccttcttgattactacagatttagtttcctctttggcactaattctacttatgaatttgtgggtcacttgtttgttacccatggtcacatcaaagtaaactgtgtcactgaggaccaagtggtcgtgtggagccctgccccaactacacttgagagttga

SEQ ID NO: 7063 - DNA, 563 bp, Glycine max
  Peptide Sequence Number=SeqID_123841
atggataggttgacgaccatgatgagtgcactcctgtcagcccagaactctcaagctgccgccgctgctgtagagcagcctttggtgagcacaaccccgctatctacggtgacttctccacccctctttttgcctccaggttgtacatggggaatgccacctccagtctgtggaagctcccagcccgctgtatctgaagctccacctccttttgctcagcagtcagcaccggttccgcaacccagtacctctttccctcaagctgcaatgacttattcagctccactgattcacactattcaacaagaggttgaaccaattttccaagctgaaaatgttgtagccttcgacaagatggaagaactccaagaaagatttgatggtatgcaaagggaagtcgaagccctccgaggaagagatctgttcgggaaggacgcctgtgaattatgcttggtcccaaatgttactatccctcacaagttcaaggtgccagacttcgagaagtataaagggaactcttgtccccgcagtcacttggtgatgtacgcgcggaaaatgtccat

SEQ ID NO: 7064 - DNA, 1374 bp, Glycine max
  Peptide Sequence Number=SeqID_123842
atgactcccagtgttggatatgtgtctgatagaactggaccagaaaagttacaattgcaaggttctcctgctacacccgtaaattcaaattcaagttctgcctctgatccagctgcatcttggattccatcagaagacttggattctggggtgaacagtgcttatgctgttgagcttaatgacaatttaactgccaaaagtcatgagcagaggcttcatgagattaatacacttgaatgggatgacctagtggttccaaatgtcaacacttctactacatctaatggaggcaacgtcccatattcatttcaagaaaatcaaagtttactgagtggaagatttggcaatgtatccagtaatccttcagcagaaattccttcttttggtaatttaactcagccagtttctgggagcaatagtgccccttacagtttcccagatagtgctattcttctgaaaaatagtcctatatcatcgggaggcgttgacaccttgggcactttggtcaacgaaggcttgcaaagtcaggacagctttggaacgtggatgaacatcatatcggatacaccatgttccatagatgaatcagctcttaaagcatcaatttcttctgttcatgtaccatattcatcactggtggcagataatctgcaatcttctctgccagaacaagtatttaatctcactgaggtgtcccctacatgggcatcttccactgagaaaacaaaggtcctggttggagtttaccggtgctgcgtaccaccacactcgcctggattggtcaatctctatttgagctttgatggccataagcccatcagccaagttgttaattttgagtatcgtactcctattttgcatgagccaactgcttcaatggaagagaaatacaactggaatgagtttcgacttcagatgaggcttgctcatttgctctttgcttcagacacgagccttaacattttctcaagtaaagtatcaccgaatgcactgaaagaggctagaagattttccttcaaaacatcatatatctccaaaagttggcaatacttgatgaagtcaattgatgacaatacaattccattttcaaaagtaaaagattccttgtttgaaactgcattgaaaaacaaattaaaggaatggcttttggaacgaattatcttaggcagaaagagtactgaatatgatgcgcaagggcaaggtgtaattcatttgtgtgcaatgctaggatatagttgggcaatctccttattttcttggtcgggcttgtcgctggatttccgtgacaaatttggatggacagctcttcattgggcagcatcttatggaatgtacgatacatggatactccacttgcctgaacaattagcctag

SEQ ID NO: 7065 - DNA, 342 bp, Glycine max
  Peptide Sequence Number=SeqID_123843
atgttcctctttgactggttctatggcattctcgcttccctcggtctctggcagaaagaagccaaaattctcttccttggtctcgataatgccggcaaaaccaccctccttcacatgctcaaagacgagagattagttcagcaccagccgacccagcaccccacttcggaggaattgagcattgggaagatcaagtttaaggctttcgatttggggggccatcaagttgctcgcagggtctggaaagactattatgccaaggtactccccgttggtgataggttttttgggttttgtaatgttccattgttgttggctcaattgcttttgacaaggttgtga

SEQ ID NO: 7066 - DNA, 642 bp, Glycine max
  Peptide Sequence Number=SeqID_123844
atgtggcatgatatcaaggttaccatggataagtggatgaatataatcgacatgggatatatcattgcatcaaggtataatgtcatccttgattttgaattcaaagaaattgatgaagtcttgcaatattatccccaaggacatcatggagcggacaaagatggaagacctgtgtacatagagagattaggccaaatcgatgccacaaagatgatgcaagtcacaaccatggaacgctatatcaaataccacgtaaaggaatttgagaggacatttgatataaagtttgcagcttgttcaattgttgcaaaaaagcacattgatcaaagtacaactatcctggatgtgcagggagtggggcttcaaaacttcaacaaacatgctagggaactcgttacttgccttgaaaagatatacggtgacaactatccagagaccttgaattgcatgttcatcgtcaatgcaggttctggatttgggatactttggaacatcgtaaaatcattccttgattctaagaccaccacaaaaatcaacgttcttggcaacaagtatgacaccaaattgctagaaatcattgatgcaagatggtccagaatggtgaccacaaatgttcaaaaagtgagaaggagcaaatgctga

SEQ ID NO: 7067 - DNA, 147 bp, Glycine max
  Peptide Sequence Number=SeqID_123845
atgcaggcagcacagaaagccgtagagaccatcaaggaaaccgcagccaacattggcgccgcagccaacactggcgccccagccaattctagcttggagaaaaccaagaccactatccaagaaaagcattgcttgattcattgttga

SEQ ID NO: 7068 - DNA, 210 bp, Glycine max
  Peptide Sequence Number=SeqID_123846
atgcgtaaaggagaagccgaaagagaaagaggcggaggcgagaaggagaagcacaaagaaaaagggatgagagcaagaggaagaggctataagagaagggagaattgtttcttgctgcaccaaataagaggtctctttttgttttttatcccaaacaacagcaaagccttggtgaggatggtgaggctatcggtggccatggcagaatga

SEQ ID NO: 7069 - DNA, 390 bp, Glycine max
  Peptide Sequence Number=SeqID_123847
atggtttgcattgtcaaatctggtttgagctataaactatgcactatcagctttggtgggaagattaaaattccctcgttcatgattatcctagaatttattgaaaaaggcgtactatcaaaggctgtttttgagaaggatgatgttgacactaatttcctttcacaattcatcgtcaacatatggcttctaacaatgctcagacactgcaactcaattgacgagaaaagcttaacaggaaatgtgccttggattccattccagaatatgaagcaaccgagtgccacaaagatgtatctgatcatggataggggtgggaataggccaggccaacctacaggggcctacgacctgacctacataaagcctagcttgaactggcctatttaa

SEQ ID NO: 7070 - DNA, 1458 bp, Glycine max
  Peptide Sequence Number=SeqID_123848
atggaagagcttgaggaagcagagacacaagttagaggcatgataacagactttggagatgacatgcattgccagtttcttgagattcttcgctgtctattagactcatgctcattgtctggagcacagagggatacaattattgacattttctatgagaagcatctgggtcaactgattgaagtgataacagcatcatgtctttcagaaaatgttgctcatgtgaatagtaaatcaatagatcgtggcctagttaagtatcagagtgggacaaagccagagatactatcaaacatatgtgacttgctatgcttttgtatcttacaccacccatacaggataaagtgcaactttcttcctaataaagtaattgataaaattttgttactgacacggagaagagagaaatacctcgttgttggcgctgttcgatttgttcgtactattctatcacgtcatgatgagcatctggtagatcattttgttagaagtgaccttctcaaaccaatagtagacgcctttgttgctaatggtaatcgctacaatctgctccattctgctgttcttgaacttttcgagtatattcgtaaggagaatctgaaattattgctgaagtatatagttgattctttctgggaccagttagtgaaatttgagtatttggtttccattcattcactgaaagtaaaatatgagcagtgtttggataatgatggggcaaaaggtactgctattatgattgaccttcgaagacgacttgatgagcgtgctctggagaaagaagaggaagactactttaatgacaggagattttatacaactggcatggggtctcttgacatttggtggttaatcagtgacgaggaggatacaacctctgcgtctatttcacataatcagaaagtgcagcaacaacaacccgcattatccaatggtgttgctgcaagctactcagagctaagtccaaggtctggtggactggttgactatgatgatgatgatgatgaagattacaggcctcccccaaagaagaagccagaagcttctgaagaggatgaagggacaatggagtctctcagtcggaaaagaaaattgccttctaagaaccctgagcttgcaaagaagttgtccaaaaattcaaaatcgaaagatagtgtttttgctgccttgtgttcaacattgagccaggctgtgctacctggtaagaaaccttcaatcaacgttcataccgatccttgtagagaagacaataaagaaaaggaaccaaatgtttctagaaattgctgtgagaatagcaatgcaacagctgaagcgaaccatgtagagaaagaaacttctgcctatagaaatttttctgatgggctgtacggcacttcagataatggacagttgggtggtgaggaacatacattggtttcaccgaaatcctccccagagatggccgtaaatggatcttaa

SEQ ID NO: 7071 - DNA, 306 bp, Glycine max
  Peptide Sequence Number=SeqID_123849
atggtgttgcagtgtcattattcaagaggtgtgttcattatctttttcctataccttgaagtacacacagtttatctttttccaaggaatgctgctctattggaggctttgcacaaattaaccagaaacaggacaataaagactattcattctccagctgtattgccaaaggtgctcaaagctggacagaatctgagagtgctagagtggctaggtatgggtaaccaggagcttcttaattattttagtgcatatgatgttgtgaaagctcgacactcttatggccccagggacatcgggggttga

SEQ ID NO: 7072 - DNA, 522 bp, Glycine max
  Peptide Sequence Number=SeqID_123850
atgtggagtggcatgaattgtaatatggacatataccacatcaagattagtatttattctagcacacactcagttttgtccgttttttctctagtcattggtgaacgtgtcaaggtctaccgtatgaatgatgacgggaaatgggatgacaagggcactgggcatgtcactgttgattatttggagcgattggaagagctgggtttatttgtttttgatgaagaagacaatgaaaacatactttcgcatcgcatctctcctgatgatatttataggaaacaagaagatacaattatctcatggagagatccagaatatgctgcagaactggctcttagctttcaagaatctggtggttgctcttacatatgggacaatatttgcaatgtgcaaaggagtatgcattttaatactttaaatagtgaggcatttaacagtgtaaacagtgagtcaagggagttgcccgctgttgaattgtcaacgcttcctttgattcttaagattaactgtggctattgttga

SEQ ID NO: 7073 - DNA, 318 bp, Glycine max
  Peptide Sequence Number=SeqID_123851
atggaaaactttgttgctgaagaggagaaactctgtcaaggtcataaagacaatgttgatgcaatgtgcaatgacgcgaagacactgggaggaaaaggtgcagttggaggaaagccttacaatggacttgggctatgcacaccactgtcaaacctttgctcaaacagacagcagtgtagcttttgggatgcattccatgtatctgaaaaggacaataggcttattctggaggaaattatgttaggttctaaaggctacatgaaccaatcaaccttagcagcatcctatctttggatgcaattaccacatgcagattaa

SEQ ID NO: 7074 - DNA, 453 bp, Glycine max
  Peptide Sequence Number=SeqID_123852
atgggaaatatgggtgatttagatgtgagccgggttgttggtgagattaatgacattgttcgagcagaaaatgattccagtactctggaggagatgttagagaatctgagttatgggttgaacagtgaggtttttgacatggtgttgaagaggtgcttcaagctcaaggatgagtacagtcacacaatgcggacttacaataccatgttgcacattgccagagaagctaaggaatttccattcgtgaagaacggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 7075 - DNA, 166 bp, Glycine max
  Peptide Sequence Number=SeqID_123853
atgccaacattctatgcggcatttccacaaacaccttcggtgcaagctgctcctagaatctctgtgatctcgatgaaaagtgcgcgggaagcatcgatgtctgaaggcttgttggaaagttgttttatcaagcttatcgataccgtcgacctcgagggggggcccg

SEQ ID NO: 7076 - DNA, 372 bp, Glycine max
  Peptide Sequence Number=SeqID_123854
atggaaactccattttgtgctcgctctcttctgtcatgcgcatcatggctggaaaaaaagaaagcatatattagttccagagaatcatccgaacattctgagatacggttgtcaaatgggagaagaggaacgagaggcgtccctcagctttccggctcactagtaggtgacgaggggtttgaattctcagaacctccttcgaattacagaactggagggggtctcacaggcatctatcttcgagcggcagtgcaagctcggatggtgttagcgctggcagaaggtccgaagattcatttcaaaaaacaggaatgtcagagcaatctcgagaaagaggctaagggtaacgctataggaacagcttttggttag

SEQ ID NO: 7077 - DNA, 325 bp, Glycine max
  Peptide Sequence Number=SeqID_123855
agaggaaccagggggaggtgtgccgcttcgagggaggaggtgtttgttaggggaggaaggaggagcacccttcgcgtgggaggattctttaagggaggtaggtgtcaaggttggggaaggaggtgctaattcattaagggtattagggcacactgggcccaaaattgagactgccacacacgatgccaccaagcccgaaatcgagaccttcgcaaacaaaacaattggcccagggttgacgatgctacatactcaactacatactaaaacactaggcctcatcctaagactgccacatataccactagtgggcccgggcatgtga

SEQ ID NO: 7078 - DNA, 225 bp, Glycine max
  Peptide Sequence Number=SeqID_123856
atggaaaagaagaaggcgatcgccaatagtaacgtggtggagagggtaaagggcacacattcctttgttgttggggacgaaactctgaatgtgaaagtgaaaataataaatgttagcagagttggtttacgtgttgatgtggatggtcccgtgaaggttgcgatgaattattcagaatatgtcttgcagaaaatgaaggagaagatgaagagagagaggggctag

SEQ ID NO: 7079 - DNA, 312 bp, Glycine max
  Peptide Sequence Number=SeqID_123857
atgcagaaatctagggagggtgaaacaggcgaagtctctgcgggaatgtgcatcacatactcactaggtaaaacactcgtaacattgtccataaccgaggagggtttcgcaggtcgcataaacgttgtatacattgacatctccgaggacagcggcaagggctcttttgcaaacctatacctgcgggtcacaaaaaatgaaagaagtggaggggccagtgaagcttacaaaggattatatgaatcatgtggtttcaagaatggagaggaagatgaagagttagaaggaggcaagcacggtgggtcttgttag

SEQ ID NO: 7080 - DNA, 654 bp, Glycine max
  Peptide Sequence Number=SeqID_123858
atgagtgtcgaagagggtcttcttctagcaagctccaccctaaacggaccaagaagcatgcagcgacttcccgagagaaaaaaccctatttcgcaaggtggtggggttctcaagtcctcctccttcttgtatggacgagacactgacagaaagtgccttatcgtcattttgagggaaaagagaagcgatgacgatgaagagcttccttacatgatcaccgtgaagcactattttgtggcggcgtgttgttctcatggtgtctcttttgtggcaaagattcgcagcagcgatggaggtttgagtgttgagcttgggaagccttctattcggcccaaaggatccttgttgtccatgtttgatgatgtcaaagggaaagggtggtgccctgatcccatcgagccaattcccagccaaaacaagaatcctacaattgctaatattaatcctggcctccaaaacctccccatcgccgttattggcaatggaggatactttaaaggcaatgcggtaaagttgtgccttggtgacttgttggtcatgggttcgaatccggaaacagcctctttgcatatgcagggtaaggctgcgtacaatatccctcccccataccttcgcataacgaagagcctctgggcaatggggtacgaagtttga

SEQ ID NO: 7081 - DNA, 882 bp, Glycine max
  Peptide Sequence Number=SeqID_123859
atgatcaacctttctcatcttcaagatttcaacgtttcgagtaaccaactctccggtcaaatacccgattcgctttcaggcttccccgggtccgcgttttctaacaacctttttctctgtggagttccgttacgaaaatgcaaaggccagacaaaagctatccctgccctcgcttcgccgttgaagcctcgaaacgacacagttttgaataaaagaaaaacccacggggcagcgccaaaaattggggtgatggttttggttattattgttctcggcgacgtgttggtgttggctcttgtttcatttcttctctactgctatttctggcggttattaaaagaagggaaagcagagactcattcgaagtcgaatgcggtgtacaaagggtgtgccgagaggggtgtaaacagcgacgggatggtgtttttggaaggagtgatgaggtttgagttggaggaattgctgcgtgcgtctgcggaaatgttggggaagggcgtgtttgggactgcgtataaagcggtgctcgatgatgggaccgttgctgcggtgaagagactgaaagaagtgagtgttggagggaagagggagttccagcagcgaatggaagtgcttggaaggttgagacactgcaatgttgttcctttgagggcttactatttcgccaaagatgagaagttgcttgtgtccgattacatgcccaatggtagcttgtcctggctcctccacggggtccatgttgatgcaatgaagattttgaagttggaccatgtgattatgcatctttgtttgcaacacgggatcaacaggtccttctttcttccttccaaccttcagcttttcatgcatttaccatcattcacagacaaaacaattgttaaatga

SEQ ID NO: 7082 - DNA, 447 bp, Glycine max
  Peptide Sequence Number=SeqID_123860
atggttgacagtggccggaatctggccggagaggttgttgtgggagatgtcgaggcggtagaggtgggggagggaggtgacggtggcgggaaactcgccggagaatttgttgtgggagaggaagaggagcttgagggcggtgaggttggagagggaggggaagggaccgtcaaaacggttgcgtttaaggctgaggatgcggagttgggtgagggaagtgagggggaggatggagccggtgaggttgaggtcttcgaggacgaggtgggagacgcggtggtggaggcaggagacgccgtgccagggggtggaagtcggggttgctggcggcggagtggacgacaagggagaggtaaaacgacagggagatggtggtgggaaggaggaggtaaggggaaccaggtgacgccattgctggagtgggtgaagagtgaagtgagtgagtga

SEQ ID NO: 7083 - DNA, 291 bp, Glycine max
  Peptide Sequence Number=SeqID_123861
atgaagaatatattcaatccattggagaaactagatgatcattgcgtagagcaaaagatcaacaagagaaatgatgaaggatgcgatctacggtcacaaccctacagcgcaacgccacttcctttctcctttctctctcctggcttcgagcttcttctctgcttctatggtgcctctgaatttgagctaagaggtgcaaaccaactcatccagaactctacgtttgaaccaaaggatgcaaacctaagagatatcagaacaacaccgcgaggaactaacagagagatatag

SEQ ID NO: 7084 - DNA, 423 bp, Glycine max
  Peptide Sequence Number=SeqID_123862
atggttctacaagggagaacacctagtatcggagaccggattgatggattaacacttgatgttagtgacatgcctgctttctgtgaacaagtgccttttataaatggggaagatcagactcatagcaacaccccaaggtcccctccacactcatatattccttccaaggctacgtctaggaagactagacaattgactcagctgagaaggttgatcgtcagaagtttggatcagactcggccatcagttaatgtgaatcctgttactgggagaggatcaggcccccataaaactccatgtggagcttgtaggccttggatattcttcatcaatggagtcctttgcttcttgaagatcatggcagcggaatggagaaggaagaaagatgattggagatgccacttcaaggagaatatgagttaa

SEQ ID NO: 7085 - DNA, 255 bp, Glycine max
  Peptide Sequence Number=SeqID_123863
atgagcgttgaggagttcattcagtcggtggcctggccaggagtccagccttctccttcgggaagggttattgctcaagaggatgtggcatcaccagagctcttccctcaggcagagccatctccatctccttcccctgagcctgagccatctgcaccagcacctatgcctaaccaatctacttctcaggacccatcatctacactgatgttggatctgaatgagcatgcagaggatcactcacaggatgattga

SEQ ID NO: 7086 - DNA, 144 bp, Glycine max
  Peptide Sequence Number=SeqID_123864
atgaaatggcatggtggccgtttcaaggaaatgaaagcggcatataaggtgcagtgtggtgtttccatattcatgaaagtcatggcggagccattgtggttgcggcaggtgacaatatctacaccgattctacaatcaatgtag

SEQ ID NO: 7087 - DNA, 335 bp, Glycine max
  Peptide Sequence Number=SeqID_123865
gcagcgggcccgatgacatgaggagaccaattacggtcatccacacgctcgatgagtgggaacaacaagctgagtgggtaaacgcgcagagacaaattttgcgccctttatcattcaggagcagcgagtcgagtggaacaacaagttgggtggtaaacgcgcagagacagattttgcgccctttatcattcaggagcagcgagtcgagtggaacaacaagttgggtggtaaacgcgctgatgcaatcctaccccgcaagggcattggctagaagactccaagtagattgggctagagatccaaggaaaggccctagggttctcatgagccttagg

SEQ ID NO: 7088 - DNA, 966 bp, Glycine max
  Peptide Sequence Number=SeqID_123866
tctttcgcccctatacccaagtcagacgaacgatttgcacgtcagtatcgctgcgggcctccaccagagtttcctctggcttcggcccgctcaggcatagttcaccatctttcgggtcccgacaggtatgctctcactcgaacccttcacagaagatcagggtcggtcggcggtgcaacccacagggggatcccaccaatcagcttccttgcgccttacgggccgacgccaggagcgcgcaggtgccgaggcatgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgaccaatttcaagcactctttgactctcttttcaaagtccttttcatctttccctcgcggtacttgttcgctatcggtctctccgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggag

SEQ ID NO: 7089 - DNA, 613 bp, Glycine max
  Peptide Sequence Number=SeqID_123867
ggctgcacgcctttgccttcagaggacagcacgtcctcgctttcagaggactggaattcctcgccttcagagggcttcacgtcctcgccttcggaggactgcatgtccttgccttcagaggactgcacgtcctcgccttcagaggactgcacgtcctcggcattggaggactacaccttcacgactttagagtgctgcacgtcctcgccttcagagggttgtacgtcctcaccataagagggctacacgccctggccttcaaaggactacacatcctcgccctcaccttcagaggacagcacgtcctcaccttaagagggctacacccccttgccttcaaaggattgcacgtgctcgccttcaaaggactacacttcctcgcctttagagactgcacgactacacctccttgccttcagaggaatgcacgtcctcgccttcggaggactacatgtcctcgacatttgagggctgcacgtcctcgccttcatagggctgtacctcctcgccttcagagggctacacgttttcgccttcagaggacctcgccttcagagggtgttaggtcctcgccttcagagggctgcatgcgctggccttcagaggactgcac

SEQ ID NO: 7090 - DNA, 1063 bp, Glycine max
  Peptide Sequence Number=SeqID_123868
atggtagcaacaggaaattctttggcacttaatcgagatattcaggaggaacagactgttccagcccgataccgtcaagaatttcttacgattgcatgggaacaggttcatcttcgaagtatttttcccttccaatatttttctattggagcttctctgattccttttattgaacataatgatgccaatcgagctttaatgagttctaatatgcaacgtcaagcagttccgctttctcagtccgaaaaatgcattgttggaactggattggaacgccaagtagctttagattcaggggtttccgctatagccgaacacgagggaaacatcatttataccaatactgacaggatatttttatttggtaatggagatactctaagcattccattaactatatatcaacgttccaacaaaaatacttgtatgcatcaaaaaccccaggttcgccgaggtaaatgtataaaaaagggacaaattttagcggatggtgctgctacagttgacggcgaactcgctttgggaaaaaacgtcttagtagcttatatgccatgggaaggttacaattctgaagatgctgtactcattaatgagcgtctggtctatgaagatatttatacttcttttcacatacggaaatatgaaattcagactcatatgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatagattattacgagctatacttggcattcagaaacgtgaaattaaagtaggagataaagtggctgggagacatggaaataaaggtatcgtttcaaaaattttgtctagacaggatatgccttatttgcaagatggaagacccgttgatatggtcttcaatccactaggggtaccttcacgaatgaatgtaggacaaatatttgaatgctcgctcgggttagcaggag

SEQ ID NO: 7091 - DNA, 787 bp, Glycine max
  Peptide Sequence Number=SeqID_123869
gcaaacgcgttggcctgaacaagggttcagacgtcaattatctgctggtgaaagcgctggaagatgccgggctgaactataaagatgtcacgccggtgtacctgccgccggccgatgcgcgcgccgccttccagaaaggcgcaattgatgcctgggtgatctgggatccctacctggctgaggtcgaagccaacgcaggcgcgcgtgaagtgcgcaacgccgaaggtctggtgccgcactacaccttctatcttgccagccgcccgtttgccgaaaaccacccgcaaacggctaagcaggtggttgacgagttgagcaagctgagcgactgggccaatcagcatcaggatgaagccgccgcgattctggcgaaatccaccggcgctagcggacaccttcacccgcgtcggcctgctgccggtgaagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 7092 - DNA, 423 bp, Glycine max
  Peptide Sequence Number=SeqID_123870
atgaagatgcaatttagtccgcgtaccattcaaaaattacagaactttttccttctgactaatcctcccatttttggaggggagacaaaaatacgagggagggatttgttccgtcgtttctctctctggtttcctgttcctatatctattgaattgatacagtcaaggttggagaacaattactaccgtagtttggaggcactgaagcatgatcgctgtcagcaaaaatcaaacgcctttcagaatggttcacacgggcattatcatctctatagctcttggctttctggagtcacaggccagcattatggccgaagcagcctagctgagacaccacattgtggcaaatgtataattcgcattcagaatttctggtccttgtcttatggtgtggttggggcaattacttccgatgctttataa

SEQ ID NO: 7093 - DNA, 2403 bp, Glycine max
  Peptide Sequence Number=SeqID_123871
atgaacatgtttctctttccttcctatgtgttactgcttctcttcctaatcctaaacctaccacacaccactcactctgatgacattgccatttattggggttcaaatgatggtgagggtagcttagcagaaacatgtgcaactggtttatattcctttgtaaacatagcattccttgcacattttggaaatggtcaagtccctcaagtgatccttggaaggcactgtgacccttttgggggaaactgttccgtacttggaagggacatcagaaactgccaaaagcaaggaatcaaagtgatgctatccattggaggtccaagcatgagttactctcttgtttcctctgaggatgctaagagtgtttctgattatttatggaacaatttcttaggtggtggtggtaactcatcatcatcttcaagtccactaggagatgttatattagatggtatagattttggactaggggggtcccttatgacaaaacattgggaagaccttgcacattatcttaagtcacatagaagaaatgtgtacttaagtgcagcacctcaatgcatttttcctgatagtgcacttggcaaagcacttgagactggactttttgactatgtttggatacaattctacaacaatcctctatgtcagtacaatgaaggtaatgcttctaaccttcttaatgcatggaagcaatggacaacttcattgaaatcagggaaaatgttcttggggttgcctgcttctccaacagcatctataggcggatatgttcctcccgatttgttgatttctcggatcctgagtacggtgaaaacgtcttctaactatggagggattatgctttggtcaaggctttttgataaagagagtggatatagtaaaaggattttggaaaatagtgtttgcctacagaaaagagaaactgaatgtggaaggcacaagaatggttttattgaacatttaggctacatggctaaagagggttttgtagcttctgaaagcaagagcattgacatgcagtgttgtgaggttatttgcaggaacaattgttcctgtgaggcttatgctcctctaaattttgtcaataataccggatgccagttttggggtaaaggaacaaagtttattaaagattctggtggaaatttcaaacgagtttactttgtcaaacataaagtgaacaagctgtggaaatggattgtcattggtgttggagcagctgttgcagcacttgtgtcctgctacttattctatgttttgaggagaaagtgcaaagaagaagtggacagaaaaatgaagcgaaaggaactgttagttgaggttggaggtaatgcaatgggaaattatggcaaagccaaagggtctaagaaagagggaaagacaatcaatgagattgaagtattcagtttggaaaatatcattgttgccacacacaatttctcccctgataataagctaggagagggtggttttggtcctgtctataagggaacattaattgatggacaagaaattgcaataaaaagactttctaaaagttcaggccaaggcctagtagagttcaagaatgaagctaagattatggccaaacttcagcacactaatcttgtgaggcttttggggttctgcatcgacagtgatgaaagaatacttgtatatgaatacatgtctaacaagagcttagatcattatttattcgatgcaagtagaaataatgagctagaatggaataaacgtcttaaaatcattgaaggcacggctcaaggacttgtgtatttgcacagatattcaagactaaaggtgatacatagggatttgaaggcaagcaatatattgcttgatgaagaaatgaatccaagaatctctgactttggcttagctagaatatttggattgaaaggatctgaagaaaacaccagtagagttgttggaacatatggttacatgtctccagaatatgcaatcaatggtgttgtctcagtcaaaacagatgtatacagttttggtgtgctgctacttgagattattagtgggatgaagaacaatagttgcatccactcaaatcatccattcaatctcatagcacatgcctggcagctatggaaccaagggagagctctagagctgatggatccatcactaaatgaatcattcagttctgatgaagtagaaagatgcattcagattggactcttatgcgtacaagatcatgcaatagaaagacctaccatggaagatgttgttactttcctatcaaatgataccacccaacttggtcaaccaaagcagccagcattcttcatgtatgtggttgctggagagtcaggatgtcctaataatagcaaacaagaaaattattcactaaatcatttatcaatctccactgcttatgggagataa

SEQ ID NO: 7094 - DNA, 555 bp, Glycine max
  Peptide Sequence Number=SeqID_123872
atggttagaaccaaaggattgcgtagaactttaggtagagttttaggaagagtcttagttagacaggttgctggggatgaggaagaagtccctcggtgtcgaagatcgacaacatctgcatgtagacaatggatagctgcagttgttgctaagaatgttgaccatgtggatcatgttgctgacgaggttcatgagcagcctcaggagccagttacgaatcatataggtgctaatacaaagggttttccaggcgggcctcatgatacatcagtgttaacgtcactggaaaattaccatgagagaaaatcacgtgcttgtcactggaagtctgggaaggcattgctagtgacgacatatctcatggctaggaaactccaagaagattgggccagagatgcaggagaaggccctagggatcaacaagtaatgaatgctttaaatcctcatatctatctatgccaccaagcaggaggggacccatcaccagagtcatggctaggagactccaagaagattgggttagagatgcaggaaaaagtcctagggttctcatga

SEQ ID NO: 7095 - DNA, 867 bp, Glycine max
  Peptide Sequence Number=SeqID_123873
atggaggggaaggacagacttgcgatgcaacaaggaggggaaggaggtgtcaatggtgtctggtgtcacggcaccacagggaagggaaggaagcgtcaatggcgtgggaagaaatttcctgagattttggactggtccgttgagttcacatacttgacaattaagaacagggtgttacttgttgtccatatgtttctttttcttcccacatcttcaaacaacgcccttctctcatccgcttcttgttcttcttctgcctacgccgctcttctctcatacgattcttcttcttcttcttcttcttccaccttatgcgcgttcgtgttgatttctgtgttcttccgccattcatttcttccggtggtggtggttgttgctgttccggtgttcttccgtaggtggtggttccggttgttgggtaatcatcttccagcacctgttgaagaaggtgttggtcatgttgagggttttccaggtggaccccatgacacatccgttttgagtgattttgaaaatcacattgctttcagagtgtggaatggagaggaacgtcctaagttgaagctatcttcccatggaaggaagatggttaagttcaggaggcctgccctagagattgaaggtctagtggtggccaatgaactgagtcctttgattgcttgctccctagatacaggcgatcgaggactaatctttgagcaacttcatgtcgacgacgctatcgagatgttggtggagttactcgaggtcagtgctacagaggctagagctgagaccattcagtgtcacggcatctccttggatgcacactctttgccaacaagagtgccatacacgtcacgtggtattcttggatgcattgcgtga

SEQ ID NO: 7096 - DNA, 171 bp, Glycine max
  Peptide Sequence Number=SeqID_123874
atggcggcagcggcacctactgaggcgagcattgatcaacatgatcttcggcatgcagtggttggacaggctactgaacctgaggattttttaccgaaggaacagaagcctacactgttgttgaagaatgtgtgggcatcgcaagacgctacactggccagccaactgtag

SEQ ID NO: 7097 - DNA, 114 bp, Glycine max
  Peptide Sequence Number=SeqID_123875
atgagtgctggatatgatggaagaaccatcgtgtgggatatatgggaaggcttgcctatccggacatatgagatatcacgtttcaagttggtggatggaaagttttctccgtaa

SEQ ID NO: 7098 - DNA, 342 bp, Glycine max
  Peptide Sequence Number=SeqID_123876
atgggggaggttattgattcttcatctgcaagcatatgcaacttctgtctcgaaacacaattgcttagtggcaggctttgttcatattcaaagaaaggaatatttattatttatggtatgtggcccaaatgtttgaaaaacaagaaaagaaagggaagagttattgtagtagtagctagtacctttctctttttacatgctgatgatgggggagatctcacaaatccaaaaggaggagtgaaagaagatgagaagaatatgtgtatgagatcgcttgatgacagatggaaggcgacacttccaacaatggaagacgtcacaagagtgatggataagtcctaa

SEQ ID NO: 7099 - DNA, 618 bp, Glycine max
  Peptide Sequence Number=SeqID_123877
atgtattctacagctatatttgatcgggcaggaagatatgtgattactggttccgatgaccgacttgtaaaaatttggtcaatggaaactgcatattgtttggccagttgccgtggacatgatggtgacatcactgacttggctgtgagttcaaacaatgctttagttgcatcctcatcaaatgactgtgtcattcgagtttggcgcttgccagatggcttgccaatatcagttttgcggggacatactggagctgttacagccatagcatttagtcccagaccgaatgctgtataccagcttttatctaatattgaaggtgccaattcagtcttgtcaatgcacgtgattgtgctacgatcgtggggtggcgaagcagagtggccccttgccactcctaaggcactcgctgcggcatgcttgaaaatcagggtgatttgtggacttcacagctgctccttcatttgccctgttgccaaacaagcccttgcgacctttagcgttgctgggcaaggctgtgacatttgctgtccctggaaaagcgtctgcaacctcccatcttccatccccttctcttccacaggggtggtgctagctaacctagcaactgatgggtag

SEQ ID NO: 7100 - DNA, 609 bp, Glycine max
  Peptide Sequence Number=SeqID_123878
atggctttgcagaagtatgctccttctggcaatgcaccttctgttaatatgaaacatttgagcttctccagtaaggtgcctaagaaagctgagctcgatgaagcaaatctgaatcacaacatggatgtggatattgaccttagggaaatttattttctcattatgcactttctttctgctgggccatgtcataaaactcatttacagttttggaatgagcttcttgagcatcaacttttgcctagaaggtatcatgcttggtattcaaggactggggcatgtagtggagacaaagatgatgatggtctatcattccctttaaattacaatatgttagtagagaggtattctcatattgaaaaggatcacttggtaaagcttttgaagcaattgttgttaaatacagcctccccatcactgggtatgaatcttggaaatgctccaaatgcagctgatgtacctactcttctaggaagcggttcattttcacttctgagcttgtttttggtgaaagttgggtttgtgcctaggatctccagaagatactgcctgttaattttagagattttggcgccaaaagatgctaaaaggctttggggttgttcttga

SEQ ID NO: 7101 - DNA, 219 bp, Glycine max
  Peptide Sequence Number=SeqID_123879
atgtggggagtcgcagggaaccaggacacaacagcgtacaccatcatacccgacctgaccattcagtcaacgacacaagtcatagctcaggccctccgcgctgacgagtacctccaccacgtagtgacgactgctcccctaactggcaggtgcagttctatgtgtcctcctacgcttgcacccgattggcactccgcgaactcaggcagtgtttcttga

SEQ ID NO: 7102 - DNA, 363 bp, Glycine max
  Peptide Sequence Number=SeqID_123880
atgacccatattcgtctccactgcagtggacactggcaaatggtcttcattttgcctaaggaaaacctagttgtctggttttgttctttaaataataggccagacgactaccttaagggaataattaacagtgctttgaaaggacttgatgatactccacaacctaaatccaaggctgttgttaggtggattgttgttaagtgtaatagacaaaaaggaagcactgagtgcggctattacgtcatgcactggatgtccacgataatgtcaggaactttgaggaataattggagaacgaccattggaagcagagggattcaaggtgtttcgcatccagtgaacacagtattatctaaaagttag

SEQ ID NO: 7103 - DNA, 162 bp, Glycine max
  Peptide Sequence Number=SeqID_123881
atgactcgggcctacgatgaaggaaaacggtatggccatatgactaccaaccttgctgaatggcataggtactccgaagacgtatatgtcatgatgcaagaaaatcaacacattgctacctcacattatgttcgcatgtatgttcgagacataggagtttga

SEQ ID NO: 7104 - DNA, 183 bp, Glycine max
  Peptide Sequence Number=SeqID_123882
cctgctgtggatgcccttgactttctagagggtgatgaggatccacttctcgaggtggattctcccgaggaagtcatgtcggcatctgaggcagactctacggaggatagtggcccgagggagatggcgatcagcggaggctcttcgtcctaccaccactatggacacctttgctctggatga

SEQ ID NO: 7105 - DNA, 270 bp, Glycine max
  Peptide Sequence Number=SeqID_123883
atgggtgatactgagggccctccaaagtgtttggcatgggtataccaccaactgcttgccctccagtggcatatccaaggcaaggctcgaagtcagctagattgtggtagtgaatttcatgtgtctcccccacgttgggaggcaggacatatgacgggaaggcgtgcttgttctcgcaacctactcttcggcgagagggcgacgcgtgactcgcgggatgcgtgttccacgaaaggaatacgcgcggagtcgccaccaacgtttatttga

SEQ ID NO: 7106 - DNA, 266 bp, Glycine max
  Peptide Sequence Number=SeqID_123884
atgccactgaatggcaagcagttggtggtatactcctgcaaaacactttggagggccctcaatttttcccccaaccacaacccttgcattccacagcaggtaaaatccctcctattatggaagaaatgggaaaagttggatcacatagaggaaaggctcagggccattgaaggaggcgaagattatggcttcgctaacctagaagagttgttcctagtacccaatatcatcacccctcccaagttcaaggtgccggactttgacaa

SEQ ID NO: 7107 - DNA, 1794 bp, Glycine max
  Peptide Sequence Number=SeqID_123885
gcaaagtttgatatcgcagaagctacgaaggttaagacgaaggttatgtcaacagtagcaacgagatggcggcaatttaagtccacattgactagcaaatttgtgtttgctaagagtgaaggtcaacaaatgcaggatgttgtgacaaaatatggactagatcctgaagcgtggaaacaatttgaagaaactcggctcacacataactgggagggtattaggaaacgagcacaatcaattcaaaaacacaacgactgccctcacgtactttcacgtgggggatatgatttgcttcagaagaaattgttagacgagaaacgaaaaaggatacaagaggaagcattgttgagtgataatccagcaagtcttgatgaccccccatctccaataaaaagacatgactccttagaagagcaggtaacgcaaggttcgtttgtaccccatggtcggcaagacatactgaacactgccattgggcgacctgaccatgggggtcgcattcgggcagcaggctcaggtgtgactattactcagtactacggaagggcatcaaggacatgcagcagctcgtccacatccatcagccaacaacaactagatgaagttgttgcaaggcttagggaagacatgactggtcagattagggaagaattgaggactcagctagaagaggaaaataaaatgagcttggaaataatgaccaatgcattgaaagaggctattaaaaaagagttgtcaaataaaggatccccagagtcgctccaaattcagttggacatacaacaattaggtgcgcgtgtcagcactaagggaagtaatgttgttatcaatgtccagccttcacaagaacatcatgctgatgccataccattgatgggactgtatgtgcagcgtaaggatggtacactaaggttggtggccatggggaaaataatggagggggattcaatcatacacacagtggcatatgcagatgatgttgtcagggtaagtgtggaaacaattatcgatcctgaggctgaggtcccctatgccacctcagaaatacaatatgtgaagcaagccgtcaatacatttgtagcttggcccacacaccttgtgaaagctgtattagatgaggatccagaaagtattccgcacaacgaggatgcacatgcgccaaagccggctaatgtggacgcagatgatccgttgcgtggcttgataaagtacagtttcgatatttacgacaagccagttgaaatcaactttgatgggagctgctttggaattgtagatgcaccgacatcgatattcataacatattcagatgttagtgaaataatagcaggagacaaaagtcttaacatatctgtcttacaattatggttaatgatacacgcagcgaatgccaacaatatcatgaaagatggcttaaggaatctgactgagagggcacattggcagctcgtacttttgtgtcctaggcaacatgttgtggtttggttgtgttcgttgcgtaggaaacctggtatgcatatcaaagctacaattaatagtgtaatgacgaaattgaagacgaccttgtctcctgaaactaaggtagttgcacctaagtggattgaagttaagttcatattatcatttgaccttgcttttgctttgattccgctcctaaagttcactagcagcaaaatgactagcagcacaagcattgaagagctatctgttttatatggtattggtacagagattgcagggatgccaagggaaggcgaccaggggatgaaaattatgattaaagagagttcttga

SEQ ID NO: 7108 - DNA, 765 bp, Glycine max
  Peptide Sequence Number=SeqID_123886
atggctagcaacccttccagagctcagaagaaagccaagtcctccaagaggaaacaaggagagtgctctcgatccactctcaataggcttgatacatggtttatagatgagagtaagaagaacaacttcaagatgatatacagtgtgaagaatttgagaatacccaagtatttggacttggagtggttctcccagcaaggggctgtagttggactggacatgggtggagtccacaagtttgaagaatctactgatggttacagcaagatgcaaacttacaaaggtatgctccttgacccagcaaggaatatgaggaattgcctaggtgtaggtgatttgactattgaagatagaatgcttgtgtacctcataacctacattctcacaccgaggtcttgtaattacacacaggtgactgatgatgatttacatattgtgtttggtctaaaatcaggtattaagatgatctggatacttttgattgaagatatcatgttgaagagccctcggttagtcgattatgagttttcgtatgttgtgctggccttaagattcattgattattttaatatcgatgactctaatgagatagtagacttcaccaaagcatttagtgagataaccaaaaggcatctcaaaatgcttgggatgaggtttgttgaacatgaatggatcatggctagagagccaccagcaatagcaaacatggaccaaatggaagaagaagcagaagctgaagctcagcaagagcctgcgcaacaatga

SEQ ID NO: 7109 - DNA, 711 bp, Glycine max
  Peptide Sequence Number=SeqID_123887
atggatgcaagcggtgcacttagcgggatgagctctcgcttagcgcgcatgttccctctacctaccattgacgaactcttggacaatttgggtcatgctacttggttttctaaagtggaccttacacaaggcttccatcaaattcgcatggtagaggccgacatctccaagacggcctttcgtacccatcaagggcactatgggtacgtcattatgccatttggcctctataatgccccatctacgtttcaagccacgatgaatgacttgtttcagcccttcatctacaaattcatcctggaagagttttatctcaaacttcccaagtgtgcctttggccaacgacatatacactacttgggccacattgtgtcagcaaatggggtcgaacttgagtcatcaaagatacaggcgatgctgaattggcctgtttccattttcctcaggtctctgtgttggttcctcggcctcactggtttttaccagtgcttcgttaagaactacacccaactcgcatcccatatgactcatcttctttgcaaagacaaatttaaatggtctcctgaagctctaacaactttcgataatcttaatctgcccatgacacagacactgatattgactcttcctgatttcaatatcccatttgtgtttgagactgatgcttcggtactagactgggagtcgttcttatgtaacgggatcacctaa

SEQ ID NO: 7110 - DNA, 274 bp, Glycine max
  Peptide Sequence Number=SeqID_123888
ttcatctttgaagagtgatctgtacaaaccccaatttgctgggtttgtagatgtggatttggccgcagataagaagatttttcttaggagtttgattgatcactcagttgtggagagttttggagcaggagggaagacaaacattttgtcccgggtctatcctgagctagcagtgatgaaccaagcgtacttgtttgtgttcaacaatggtactgaaccaatcgtagtggaaaacctgaaagcttggagcatgatatctgctgatataaaatga

SEQ ID NO: 7111 - DNA, 900 bp, Glycine max
  misc_feature (812)..(812): n is a, c, g, or t
  Peptide Sequence Number=SeqID_123889
aggactacacgtcctcaccttcagagggctgcatgtcctcaccttcaaagggcgacacgccctcgccttcggaggactacacatcctcgccttcaaagggctacacgccctcgcctctagagggctggacatcctcaccttcagaggactacacgtcctcaccttcagagggctacgcatcctcgccttcagaggactacacgtcctcgccttcagaggactacatgtcctcgccttcagagggctacacgccctcgccatcagaggactacacatcctccccttcagaggactacaagtcctcaccttcagagggctgcaccccctcgccttcagaggactacacgtcctcaccttcagatggctgcacgcccttgctttcaaaggagggctgcacgtcctcgcttttagagggctccacatctgcgccttcgaaggactcaagttccttggccatccccctgatctcgaaggagggccaactgtgcgagcacaaccagagagggaggctatcgtgcaactactatgcataccggggcaagatttcacccagtcgctgcaaggagacgagtggatcatgcctgcaagacacctagtggacccggagaagtccaatagggtcctggggtttccagctctgattacgggcctttatcagttctacggagtgtctgtcgcccccagcaaggtcatcaggccccctactaaccgagctttcatcaagaagtactgcgtcaccaggcaggcacaggacaaggcaccacagcaatctagggatggccggcagcgggcaatagacgcaccggcaccanctccagagcccctcagctcatctacaaaggttggagcgttgccaacgacctgtggccgatcagcaggcgaccaagtccaaagccgaag

SEQ ID NO: 7112 - DNA, 693 bp, Glycine max
  Peptide Sequence Number=SeqID_123890
tttgctgcactgctggcggcgggaatgctgctatcgggctgcgtatacaacagcaaagtttctaccaatgccgaacaactgcaacatcaccgttttgtgctgaccagcgttaacggccaggcgctaccgacaggccagacgccgccgccggaaattagcttcggcgaaaaaatgtatgtgtcaggcacgatgtgcaacggcttcagcggccagggcaagctgtctgacggcgagctaaaagttgaacagctggcgatgacgcgtaagctgtgcgcggatccgcaacggaacgcgctggataataccctcagcaaaatgctgcgcgatggcgcgcaggtcgatctgacggagaatcagctcacgctggcgaccgccgaccaatcactgcgtttaccattcggtagcgcgcacatgccaatagcgctgccatcaagctggcgggcgacggataatgaaccgccaaccatcgcgcaattcgcctggccgctgtcgctcatcgccgcgcgcatgccgggcggtacgtgtgccgcggtggcttgttgcaccggctcgttgctacaagccgacagtaataacgcagcgcaccccactaaaaacgcagctcgcatcctctccccctttcagaaacatcttagaataaacaaactcaagaataataggcagcgcagcgcctgccgtcgagaggcgaaatac

SEQ ID NO: 7113 - DNA, 368 bp, Glycine max
  Peptide Sequence Number=SeqID_123891
gcggtgttgtccttgctgaggtgttgttggctgatcacgatcactcgaccggatatgggtttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttagttag

SEQ ID NO: 7114 - DNA, 599 bp, Glycine max
  Peptide Sequence Number=SeqID_123892
atgaacacctcgatcgctcgtaaaaaggaaatgcaatggatgcagcgtgtgggtattaaaggaataaaggtcgacttttttggaggcgataaacaagaaacattgaagctttacgaagatattctttcggatgcaaacgactatggattgactgttatatttcatggatgtaccttaccgaggggatgggagcgtatgtatccgaattttgttggcagtgaggctgtattggcgtctgagaacttaatttttacgcagcatgcaaatgatactgaatcttttaatgctacgttgcatccatttatccgaaatgctgtggccgccatggattttggtcccgtgttgcttaacaaacggcacaatcgcgaaaataatggagggaccatccgtaaaacgacggaaacatttcaattggcgacggcaattttatttcagactccggtgcaaaatttcggtctaacaccgaacaatttaaaggatatgccggcccatgtgatcgattttatgaaacaggtgcctacaacctgggatgagactacttttattgaggggtatcccggtaaatatgtcattcttgccagaagaaaaggcgatacctg

SEQ ID NO: 7115 - DNA, 396 bp, Glycine max
  Peptide Sequence Number=SeqID_123893
atgtcccacgcagttaaagataatcaagggaagtgggcctcgaactacgagaggcctttcattgtgaaaaggactttttccggaggggccctggggcagaatcatcttaggtcgtggtcagatgccgggactaagctgaaggcagaaaccaatcaaggtatgccacccacaagacacccaatggacccagagaagtccaacagggccctagggtttccagctctgattacgggcctctatccgacctacaaggtgcccgttccccccagcaagatcatgccatcggatcacgcccgcaggacacccaatggacccaaagaagtccaacagggtcctgggatttccagctctgattacgggcctctgtcagttctatggagtgcccgtcatccctag

SEQ ID NO: 7116 - DNA, 336 bp, Glycine max
  Peptide Sequence Number=SeqID_123894
atggcatgcaacctttgtttgaccgcttcgaggtacttggcaccctttgttgcacaatacgtgaagttccgtgacatgccggagatcaaaaggaagcaatgttatgcaatccgtgagccaaaaaggagtaattacgtgacccgtaaggttacggaaccttacggaaagaaaacaagtatcgttacgaaattcgtaaagtttcgtaacgttacggaaaaagaatcaccaaaaaagcaaggggtgtatttagtaaaaaagggggtgcaaatagcaaacatgcccacttgggccttccaagatgttcctccagaaggaggttgcttatggaggaagtaa

SEQ ID NO: 7117 - DNA, 303 bp, Glycine max
  Peptide Sequence Number=SeqID_123895
atgcctgcgacacttggaaaaacaggtaataaggagccgttattccgtggagctcattatctcgctgatcgaacgcgcgcagagccactattcattggtattactgattgttttcctgctgaccttcatatcggtcatttcttgctaatgtggctaagcgccagcctcggcgcaatcggcggattctggctctcatggcaaattggccgtcgctatcagcatcatctgcagcgtctgcgctggctcggcgccgaacgagtgctgcgcagccagctattcctgcgccgtcacggcggttgggcg

SEQ ID NO: 7118 - DNA, 564 bp, Glycine max
  Peptide Sequence Number=SeqID_123896
atgaagggtaaatataaagccgctcttgcgctgttattagctctaattttgctgccgttggccctgctggccacattaacgcattgggttccgacgctggcgggtatctggctgccggttggcacgcggatctcgcttggcgaaagtccgcgcctgacgcgctcctcgttggttatccccgatttacgctacctggtgggcgattgtgaaattgctcgcgtcagcaacgcgcgtcttacccgtcccagccgctggcggttacacctgagtgaactggatatcaatagcgcctgcctggctaagatccccgccagcgagccgctctccggcgcgccgcgaaccctcgccgagtggcaatcgatgctgccgtatagctggttaactatcgacaatctgcgcctgtcgccgtgggaaaaatggcagggaaaactggtgatgtcgttgacgcctgggcagcaggatatcggttattcaggcaaagaggtcacactacaggcgaaactgcgcggccagaccttaacggtcagcaatttcagcgcgcggctggtggaagatcaggcgccg

SEQ ID NO: 7119 - DNA, 282 bp, Glycine max
  Peptide Sequence Number=SeqID_123897
gggaaggatcatcttgagctaccttatggagtggggacaaaacgtggacagcagaaaccaatcaaggtacttaggaacgaatgcaagtggggatggggtcacgaccgactgatcgttgcccttctctgcgctagacaagcagagaacgttagctcgcctgggcgagccacccctgcaccaaattataagaatgacgaaagggggcgcgtttttgcattcaaaaacttctttttccccctttcaaaagccatacccacgggatttacgagtttgcagccctag

SEQ ID NO: 7120 - DNA, 237 bp, Glycine max
  Peptide Sequence Number=SeqID_123898
atggcctactcgctaagcgcgtcatattcaatggctaagcgcggcatgtcagaactaaccccaattctttgcggcctaaactgggagaaacctgctccagaacaaaatgtttgcttacaggtaatggaagtgggtaaggaggttctcgaaatgaatggcagcggaatgaagaaggaagagagagaggagacgccacttcaaggagaaaatgagtctagaagaagctcaccaccatag

SEQ ID NO: 7121 - DNA, 144 bp, Glycine max
  Peptide Sequence Number=SeqID_123899
atgtcggagattgagcagccgccgcggtcggagtcagagaactcaaactgtggcgtggcgaaggaacaagactcacgccgccgcggtggtggtggtgctcttggtggtacctcggagagtccatggttgacggggagatattaa

SEQ ID NO: 7122 - DNA, 1232 bp, Glycine max
  Peptide Sequence Number=SeqID_123900
atggtgcgccagcgccaggtgcgcgtgatcaacatgtcgtcggtggcgggcaaggcctattgcgacatcgtcgccgcgcactacgccgccaccaaggcggcgctgctgggcctgacgcgccactgggccgcggaactgggcgagcacgacgtcaccgtcaacggcctggcgccggggcgcatcagcacgccgctgctgaaaagcgtgcccaaggagatcaacgacgcggtggccgaggtcaccgcgctgcgccggctcggcacgcccgaggaagtggcggacgcctgccttttcttcgcgtcggaccaggcgcgaccgccggggcgttgcctttcctggcctgcgcggcgcccgcctggcggcggacacccgcgctcagaagtccatgctggcgctcagcgagaacgtgcgcgggccgcccagcaccaggtagccgttgcccgggtagccgcccaccgacgaccagtagttgcggttggcgatgttctcgacgcgggcgcgcagcgtcaccacgtggccgtcgacgtccatcatgtagcgcaggccggcgtcgaagcgggtccagccgggcaccttgagggtgttggcgtcgtccgcataggaggcgccggtgtagaccacgcgcccgtccaccgtcaggccctgcacgccgggaatgtcccattccgcgcccaggttggcctggaagcgcggcacgccgatgacgcggttgccgtcgatggcgctgttgccagtggagcgctgcttggcgtccaggaaggtcatgccgcccagcacgcgcacgcggttgacgggttcgccgaacaccgtcagttcgatgccctggtggcggtccttgccggaggcggtgaatgcgttgctggcgttgtaggccgcgcgcggcttgtcggtggagaacagcgccaggccggcgcccaggccgccgccgtcgtacttgacgccgatctccttctgcttggacacgtagggctgcaggctctggccggcgttgggcacgggcttgccgttggccgtctgcggcgccgtatcgccggccaccagggcttcgatgtagttggcgtacagcgacacgctcggcgccaccttgaagacgatgccggtggccggcgagttgcggctggcgtcgtaggcgctttgctccttgccggtgttgtaggcgtagtcacgctgcgacaggcgctggtggcggatgccccagcgtcagcagcaccttgtcgtccaggaacgacatg

SEQ ID NO: 7123 - DNA, 943 bp, Glycine max
  Peptide Sequence Number=SeqID_123901
gccatacatccttgaccatccgcctcagcccgcccgtcgcccgcccgttcgaacccgagggcgacatctgttcgtaccggcattttcggcattccgatttcccccagggcatgtcgccgctggtgctggtggaccacttcatcatgaccgggccggcggtcgcgccgcaccctcacgccggcatatcgacggtgacgctgctgctggaagacacccaaggcggcctgcgcatccgcgacagcctggacaacgaacacgaagcccgggcgggcgacctgcactggacagtggccggccgcggcatcgtgcacggccacgaattggtgggcgcggcgcggctcaatggcctgcggttgtacgtcaacctgccggcgcgactgaaatcgatgccaccatcggcaacgctggtgcggggctgggaaatgccggtgctgcaaagcgatgcgggccgggtgcgggtggtgtcgggccgctacgacggctgggacgcgccgctggcgacgcccgagccgctgctcatcctggacggctggctgcggccgggagcgtcgcgcctggtgccgctgccggcgggctggaacgcctggttaccacgccgccgccgcgaccgccggtagaagcggcgccggtcattccggcggcacggttccgccccgccgggcgcgcggcgacgaccggtcggcgcgcggccgatcccgatttcgccgtcctgcccccgggcgcggcgctgaccgccacggcggaccgcgacggctttcttcaactcctggcggcgggcgcgccggcgcacttcatcctggtggccggagcggccatcgacgagccggtgatccagcgcggccccttcgtcatgacggacgcgcgcgccctggcgcaggccgtcgcggcctacgaagcgggcgacttcggccagctgcgccaggagagcggcgtgcccggctga

SEQ ID NO: 7124 - DNA, 190 bp, Glycine max
  Peptide Sequence Number=SeqID_123902
atggccttaattgaggtccatgacgctaagcaccagtcatggcagctaagcgagattctttgcggcaatatgagcgctaagcgagtcttgctaagcggacaactcgctaagcgcgcttaccgtgctaagcgagttcatcctttgaggatgaacactcatcctcttgctgaactacttgtggctaagcaag

SEQ ID NO: 7125 - DNA, 909 bp, Glycine max
  Peptide Sequence Number=SeqID_123903
atgaaggcatcttcagaggagttaaaagtctttatcgctgtggtggaaagcggcagttttagccgtgcagcggagcagttacagatggccaattcggcggtgagccgcaccgtgaagaagctggagaacaagcttggcgtgtcgctgctgacgcgtaccacccgtcagctggcgctgacttatgaaggcgaactctatttccggcgcgtgcagaagctgatccttgagatggcgacagcagagaatgagctgattgagcgccagcaggcgccacagggtgtgctgcgcatcgacgcggcaacaccggtgatccttaacctgctgatgccgatgattaaaccctttcgcgagcgctatccggcggtcacgctatcgctaatctcctctgaaagctttatcaacctgatcgatcgtaaagtggatgtcgctattcgtgccggggatttaaccgactccacgctgcgtgcccggctgctgttcatcagctatcgtaaaatggtcgctacgccagcttatctggcgaaatatggtacgccggcgtcggtggaggcgctggcacagcatcagtgcctcggctttgtcgagacgcctcgtctcaatcgctggcccgtgtcggccaatggcagcgatctgtatgaaattgacgcggcgatgtcatcaaacagcggagagacgatcaagcagctgtgccttaacgatcagggtatcgcctgcctgtcggactttatggtgaatgcagaaattgcggcgggcacttttgttgaggtgctcgcgcaccaatcggtaccggttgagatgccttttaatgcggtgtattacagcgatttaggtgtgagccagcgcgtgcgggcctttattgattttctcagcgagtgggtcagagatcagccctggcgcgtgcagggctga

SEQ ID NO: 7126 - DNA, 255 bp, Glycine max
  Peptide Sequence Number=SeqID_123904
atgaacatcaaacatcagcaaacaaccaacaccaagcactcaacaaaacaactagagaatgcacagaaaaccataacagactcacaactcactggccgaaaggttcgacctgctctgataccactaaatgtaacgacccgcctcgtcgctacgggaactgtgctgagtttgtcgagaccacccggttgtgcacgtaacagcccccctcccataggtgatcagcctgggagcccaaaggtgttccctaccaagtga

SEQ ID NO: 7127 - DNA, 561 bp, Glycine max
  Peptide Sequence Number=SeqID_123905
atggccttaaggcataggaatttgaggaaacatataactgattcaaaagctaagcagggtagcaatagattccagaagacctcgactcaaccaaccaattttatggcaacccctacaaagccaactgagtcaatggcaatgcttggtgtgaccccaaaccaaccaactaggtcaatgaaaatatttggtgtgacccttacccaaccaactgagtctatggcagcgcctaatgtgacccatatccaaccaattgaccaatctatggaaattccttgcgtgacccatattcaaccaattgagcctatggaaatgcctggtttgatcccaatccaaccaactagttctatgaccatgcctggtgtcacccctacccaacaaactttgactatcgaaaagcctagtgagacacctccttctcttgagtttatgaagcagaggttggagatgatggcatcaaccatggagacttcagggcatacactttcccctcaaatgagagcccaactggattctggaattaaaaatcttctgagaagggtgaatgccaggctaaatgcctga

SEQ ID NO: 7128 - DNA, 297 bp, Glycine max
  Peptide Sequence Number=SeqID_123906
atggcttataatgattatgagtttaaagaagaaagggagttgatgcatcaaaaagaaactcttgagtacaatgctttcaaaaaattgaagctcttaacaagcaagatgttcaatacttgcataatcatagaggacattgcgcttatagctctcaattcagcaaggaaacactcattgtcatactgcaggggatttttgctttggcgatgcattccacttgctatagcattgtcgatgaaggggtactcaatagaagaaagtgacaatgtgctgggcaatggccattctgaagattga

SEQ ID NO: 7129 - DNA, 351 bp, Glycine max
  Peptide Sequence Number=SeqID_123907
atgcttccgagacgtttccgtgagcgatttcgtgaagattcttcatcgttcttcatcgttcttcgtcgttctttgttcttcaaccgactttggagagcaaaaaatcaacatatgcgtggggtgctaataccttccccgtgcgtaaaaacaactcccaaacctttcacacttaaagttcgtagaccacaccttttccggtttttccgacattttcctcaaataaacgttggtggcgactctgcgcattttcctcccatggaagacgcacccgtgaacctcgcgtcgccctcccgccgaagggtaggttgcgacaattggcgactccactggggacggtttttagagagttag

SEQ ID NO: 7130 - DNA, 558 bp, Glycine max
  Peptide Sequence Number=SeqID_123908
atggccttgcataggaatttgaggaaacatagaactgattcaaaagctaagcagggtagcaatagattccagaagacctcgactcagccaaccaattttatggcaacccctacaaagccaactgagtcaatggcaatgcttggtgtgaccccaaaccaaccaactaggtcaatgaaaatatttggcgtgacccttacccaaccaactgagtctatggcagcgcctagtgtgacccatatccaaccaattgaccaatctatggaaattccttgcgtgacccatattcaaccaattgagcctatggaaatgcctggtttgatcccaatccagccaactagttctatgaccatgcctggtgtcacccctacccaacaaactttgactatcgaaatgcctagtgagacacctccttctcttgagtttatgaagcagaggttggagatgatggcatcaaccatggagacttcagggcatacactttcccctcaaatgagagcccaactggattctggaattaaaaatcttctgagaatggtgaatgccaggctaaatgcctga

SEQ ID NO: 7131 - DNA, 282 bp, Glycine max
  Peptide Sequence Number=SeqID_123909
atgacaaaacctaggcttcaatgcacaagcttctccccttttctgcttctagggctcttttccccaaataggcctatggctgctctggaattctgtgccctggtcgttctgtacaagtgtgtagaagctgtcataaaaggtgtgtaccctaattctgcacaagacaggctgaaggcatctgtctcgagcttagtgccaccttcccgcttagcgcgagtaagtgaaattgggcttagcgccagtctcgagcttaccctggctgaaggcacctgctgcgcttag

SEQ ID NO: 7132 - DNA, 272 bp, Glycine max
  Peptide Sequence Number=SeqID_123910
atggcggacctcccttctcaaattgccgccatggtggtgccttggccgctgtttaacaacactggacatgactggataaataactgtacagtgatattgacgataaactggaacgaacaaggaaattctgatggttcatccaatgcaaaggggagtggggttggagtcatcctagaaatccctgatgaagtaatcctagagcaattcttgacattcaagtttgaaacgacgaacaatcaagccgagtatgaggcacttctagccgacttaag

SEQ ID NO: 7133 - DNA, 1059 bp, Glycine max
  Peptide Sequence Number=SeqID_123911
gcacaacagattaaagcgaaagaacaacagcaactgcaaatgcagcagttgcaattaatgcgtcaagctcaaatgcaaaggagggattctaatcatcctccccttggaggtcctgtaaatgctatcactacagaaggagtgcttgggcaatctactgccagtgctttggccgcaaaaatgtatgaggagcggatgaagcactctaaccccatggatacagagacatcccaaccacttttagatgctagaatggctcttttgaaatcaacaaatcatcctggtcagatggttcaaggaaattcaggaagtgtgacggcagctttgcagcaaatccagactcgaactcagcaaacacctgatatcaaacctgaagtcaacatgggtaccatgcagagatccttgcctatggatccttcatcaatttatgggcagggaggaatgcagtctaagcctggaattgtaaatgcaggattctcttgtgcactaggagaatctaaatctggttcacttggttcagccatttggatttcagctagagcagtaggtgctactggattattggtaggtggtgctgctggttcagtggtaggtgctgagttaatcttgattgtctccatctctccaatttccaaaagattgaatccgggagttggtagtctcacattgaaaggatggcctttaactggcattgatcaaattcgtcctggttttggagcaccagttcagaagcctctccttcagagtgcaaatcagtttcagcttttgccacagcaacaacaacaacagctcctcgcacaggttcaggcacaaggaaatattggcaattcaccagtttatggagatatggatccacaacggttaaggggattagctaggggaagtttgaatgctaaagacggtcaatcaattgcaaatgatggatcaataggctctccaatgcaatctacttcatctaagaatgtagaactgatcctagtttctgtctttttgatatgctctagcccagtgttgtcaatagcagatcgcggaaaaacgcgaaaagctgaaaatccgctatag

SEQ ID NO: 7134 - DNA, 1302 bp, Glycine max
  Peptide Sequence Number=SeqID_123912
atgaaccctaaacgcaatagccgtggtgcaatttctctccagagtccagattcaaccttgtcggaaatcgacgatgcaacagccatggcgcaatttctcttcaaagtccagattcaaccttatcaacatgccacagatccaacaatccacctcccatcaacaacaggatcctttgcatccacaacaattggtgcaggaccggccaacagtactggtaccggaaatacacttggcccttctaattctcagccatcaactccatcaactcatactcctggtgatggagttgctatggcgggtaacttgcagaatgttgctggtatatccaaaggtttgatcatgtatggtactgatggagtgggcggtcttgcatcttcgacaaatcagctggatgacatggaacattttggagatgttggctccttagaggataatgtggaatcatttctctcacaggatgatggtgatggaagggacttgtttggcacattgaaacggaacccttctgagcatgctacggatgcttcaaaaggcttttccttcagtgaagttggttctatacgcaaaagcaacagcaaagttgtttgctgtcatttctcttcagatgggaaattattagctagtgctggacatgacaagaaggttgttctgtggaatatggagacattgcaaacagaaagcactccggaggaacacagtcttattattactgatgttcgcttcagaccaaattcaactcagctggcaacatcttcatttgatacaactgtgcggctgtgggatgctgcagatccaaccttccctttacatacatatagtggtcatacttcacatgtggtgtcccttgatttccacccaaagaaaactgaacttttctgttcttgtgacaataacaatgagattcgcttctggagtattagtcaatattcttccactcgtgtttttaagggaggatctacacaggtgaggtttcagccaaggcttggtcaccttctggccgcagcaagtggcagtgttgtgtctctctttgatgttgagactgacaggcagatgcacacgttacagggacactctgccgaggtacactgtgtctgttgggatacaaatggagattacttagcatctgtgagtcaagaatctgtcaaagtgtggtcacttgcctctggggagtgcattcatgaacttaattctagtggaaacatgtttcattcttgtgtttttcaccctagctactccactcttttggttattggaggataccagaaactcttaggtagacataaactaacacatcattcttag

SEQ ID NO: 7135 - DNA, 231 bp, Glycine max
  Peptide Sequence Number=SeqID_123913
atggcgcagagtaattgggaagcagataagatgcttgatgtttatatttatgattatttggtgaagaaaaagttgcacaacactgctaaagcattcatgacagaagggaaggtttctcctgatccattgtttttggaataccccaattctaacggttttgtgccatgttcgtgtacatctactgggtgggagatttttgaggtagttatacttgcaactgattatagttaa

SEQ ID NO: 7136 - DNA, 372 bp, Glycine max
  Peptide Sequence Number=SeqID_123914
atggaggagatgaatgtgcacataataacaaggggaaacccctatgggtacatagatcacattcaaaccttgaagaaaagaaaagcaaaaccaaccaactgttgcacgaagaacacggaacaagaaaacgacgcagggaatgatcacggtggtgattcggcaaaaggccaccttggggcggttgcagctcgaccgggtgagctgaaacttaaccctaaagcagtgagctcgcccaggcgagctagtcccttagccttgaatatttttggtggcccaggcgagccaaatgctggcctaggcgagttggggcctatgaaaaacaaggaaaagacctttttgcactccttttctgggtatcttttgtcttcctga

SEQ ID NO: 7137 - DNA, 660 bp, Glycine max
  Peptide Sequence Number=SeqID_123915
atgaagcggctgcacgccctcgccttcagaggacagcataccctcgccttcagaggactacacggcctcgccttcagacggctacacaccctcaccttcagaggactacttgccctcgccttcagaggactacgcgtcctcgccttcagagggctacacgtcctcaccttcaaaggactacacgccctcgccttcagagggctgcacgccttcgccttcagagggctgcacgccctcgccttcagtggactacccgtcctcgccttcaaagggctgcatgtcctcgccttcagagggctgcacgtcctcgccttcagagggttgcacgtcctttcctttagaggactacacatcctcgcctttagagggttacacatccttgccttcagtgggctacacgtcctcacctttagaggactgaacgtcctcgccttcagagtgctacacgtcctcaccttcaaaggactacacgtcctccccttcagagggctacacatcgtcacctttagagggctgcacaccgtcgccttcataaggctacacatcctcgccttcagaggagtacacgtcctcgcctttagagggctgcacatcctcgcattcaaagggctccacatctgcccctttggagaacttcaggtcctctgccttaatgcttaa

SEQ ID NO: 7138 - DNA, 951 bp, Glycine max
  Peptide Sequence Number=SeqID_123916
atgatctctcttttctctctcttcttcctcctcctcttcgctctcacactaacacctctctccgccacacgcttcttcccattccctatctccaccgccaccactcctcctcctccctaccccttcgtcgagtccaagctttttcctctcccaatcccacccccctcccctctcccgccgcgcctcgcctacctcatctccggctcctccgccgacgcctccgccatcctccgcacgctctccgccctctaccacccccgcaaccgctacgtcctccacctcgaccgcgactcctccccggaagaccgccgccttttaacccaccaagtcgaccgccatctcaccttccagaagttccgcaacgtcagggtcgtcaccaaggccaacctcgtcacctaccgcggccccaccatggtcgccaacactctccacgccgccgctattgcgctcacggagagcgatgactgggattggttcattaatctcagtgcctccgattaccccctcgttacccaagacgatctgctgcacgcgttctcacatttgccacgcgatctcaacttcattgatcatactagtgacattggttggaaagatcatcaacgggcgaggcctataattattgatccggggttgtatatgaccaagaagcaagatgtgttctggattacgcagaggagaagtaggccaacggccttcaaacttttcacagtatgtgtagagggactggggaagtctctttatacttgttggatgaattgtaaaaagctaactaacaactttagttttaggatcactcacatataccatgaagacaacgcttgtgctgacaagcttgcttcatatggtgcacaatcttttcggggttggggtggcaacatggttggggatgccaacctcttctgctccttatcctctgccctttcttttgccaaaaaaaagaaagtgtag

SEQ ID NO: 7139 - DNA, 567 bp, Glycine max
  Peptide Sequence Number=SeqID_123917
atgaggacaacccactcaaggtccttgttgggatcagctcccagagtgccaggttcggcttggatggttctttcaagatctttcattgattattgcatatggggatgggacaatttacctcggactgttctcatgtactacacaaatttcatatcttcccctgaagggtactttcacactgttgtttgtaatgctcaagagttcaagaacacaactgttaacagtgatcttcacttcattgcttgggacaatcctcccaggcaacacccccactacctttctctcgatgacatgaaaaggatggttgacagcaacgcccccttcgcgagaaagttccatggagatgatccggtattggacaaaatcgacgcagagctattatctagaggtcctgggatggttgttcctggtggctggtgcataggaagcaggctgaatgggagtgatccttgttctgtagttggtaatactactgtcctcaggcctggcccaggttcaaagaggctagaaactttgatcaaatcattgttgtctgatgaaaattttcgacctaaacaatgtgtatga

SEQ ID NO: 7140 - DNA, 1500 bp, Glycine max
  Peptide Sequence Number=SeqID_123918
atggggtcagaatggtctatattagggacattcaccgcaaccattatgatagcctacactgtgattgacaagttcgtcccaacccatatccgttcctatgccctaatatatgtccacaaactaataggctttctgtctccttatattcacatcactttccctgaattctcaggcgaacgtctccaacgcagtgagcttttcaccgccatccaaacctacctcatccaaaactcttctcagagagccagaaaactcaaagccgaacccgccaacgacagccacaacaagttccttctctccatggatgacaacgaagagattacggagactttccaaggagttaaggtctggtgggtttctaacaaaaccatgaacaaatcacagtcgatttccttttaccctagctccgacgagaagaggttctacacgctcacctttcacaagcgccacagagaccttatcgcaagctcttacatcacacatgtattggaacaaggaaagtcgttgaaattaaagaaccggcagctgaagctgtacaccaacagctgtcacaccagttggggcggatacagaaaatccaagtggagccatgttgtcttcgagcaccctgcgaggttcgaaaccctagccatggataaaaaagctaaagaagagattatagacgatcttgacacgttccagaacggaaaagagtattataaaaagattggaaaagcttggaagcgtggttatttgctgtatggccctccgggtactgggaaatctaccatgatagctgctatggcgaatttcatgtactatgatgtgtatgatcttgagttgacggcggtgaaggataacacgcagttgagaactttgttgattgagacaacaagtaagtctattattgtgattgaggacattgattgttctcttgatcttactgggaagagggtggttaaaaaggggaaggaaaagagtgaggatgcgaaagatcctgtgaagaagactgaacaagaagagaataataatgagagtaaggtgactttgtcgggtttgttgaattgcattgatgggatttggtcgggttgtgctggagagaggatcattgttttcacaacaaactatttggacaagcttgatcctgctcttattaggagtgggaggatggacaagaaaattgagttgtcttattgttgttatgaggcttttaaggttcttgctaagaattatttggatgttgatcatcatgatttgtttcatgatgttgaggggttgttggaaaagaccaatatgacacctgctgatgttgccgagaatatgatgcctaagtcgaagggtgataatgttgagacatgcttgaagaagttgattgaatctcttgagaaggccaagaagaagcaagaggaagaagcacgaaagaaggaagaggaggagaaggaacagctagcaatggaagaggcgaaagagagtgatgagaaagctgggaaagaggtgaaggagaatggtttcgtccattga

SEQ ID NO: 7141 - DNA, 742 bp, Glycine max
  Peptide Sequence Number=SeqID_123919
atgggctcattgatggccacaatcatgtttgtgtatgccatggttgagcgtttcttcccggcggcgcttcgcgacactcttcaaatccacactcagaaagtggtgaacctcttgtacccttatgtccaaatcaccttccctgagttctcaggggagagactcaagcgtagcgaagcctacactgccatccaaacctaccttagtgagaattcttcacaactagccaaaagactgaaagctgaagtagtgaaagatagccagaaccctttggtgcttagcatggatgacgacgaagaggtcaccgatgagttccaaggagtgaagctttggtgggctgctagcaaaactgcctctaaccctcatgcatattccttctcttattattctccccctgatggaaagagatacttcaagctcactttccacaaaaagcatagggatctcatcaccatttcttacatcaaacatgttttggaagaggggaaggaaattgccctgagaaacaggcagaggaagttgtacaccaacaatccaagtagtggttggtatggctacaaacagtcaaaatggagccacatcgtgttcgagcaccctgccacgttcgagactcttgcaatggatcataggaagaaggaagagatcatcaatgaccttgtcaagttcaggaatgggaaggattactatgcaaagattggaaaggcttggaagcgtggctacttactctatggtcctcctgggaccg

SEQ ID NO: 7142 - DNA, 264 bp, Glycine max
  Peptide Sequence Number=SeqID_123920
atgaagccacacttgagacaagtgggtcatggaagcaagcacctcaatggtacccgaaaacccgaagtcattctaattgttgagccacatattccaaatcgcaaatccaacaaaggatttggactagtgagtccctggaagcaaccatcagggatggaggtgaagttgttgctactaaggaaaacgctttcgaacatggagaggttcgagagtgaaggcaatgtgccgaagagtgcattgttttggagagagaaagcggggtga

SEQ ID NO: 7143 - DNA, 468 bp, Glycine max
  Peptide Sequence Number=SeqID_123921
atgggggaatcagagagagcaacaacttctccagatgctgactctgtagagtcttcagagatgataacaataggtgaagatgggggagctacttcaagtttgggacaagatggatctgccactagagaatatggactagttggcattggttcaacctgcacaggtcaggccatctgctcaaggaactgctccactaatagaatggaccctggagaagctaccatctgtaggctttgcataataataacttgtccctggaataagctttgcagcatagtggttgtgatttgggagctctgggcatctggtcctgttgatgcagacggaggcgctggagtagatggtgaagggatgtgcagatggtggagatggctgtggggtctaagctggagtggtgatgatgatggtgctggtgctggtgatgatgatgctgctgctgctggtggctccttaatcataggctcctag

SEQ ID NO: 7144 - DNA, 888 bp, Glycine max
  Peptide Sequence Number=SeqID_123922
atggcttcctcttcaagctcaattctcagccagtcttcgcatagcgaaagctctcgatactctctggaacggggacctcgcatgtgtccagctcatccttcttccagattcttcctcgcactcagcggatggctcgctaagccggcagattcgcttagcgagaagctaaaattcaatgatcgcactaagcatgaccatgtcgcgttaagcgcgttcatccttctgatgagtttcaatgatgagctcgctaagcgcatctatgcactaagcgagagcccctgcctcaggatctcaggccgatttgaccgatcaatattcacatctcaggaggcctctgatcgctattctgatattgtgattggcagaaagattcttcatgagagaaatgtcatgatatatcacacagaatttgatgagttcaagaaaaggaattggcacaaggagctgaccaatttcatggatgggagcatcgatgttgccattcttaaagagttctatgcgaatttctattttcctaaggataaatcacccaagcaggcgagggtgaaaggacacttaattaagtttgatgaagacgccctcaacaccttcttgaagatgattgtgatcattgaggagagggagagcctacctgcctactccagattctgtcgtctgaggccaaatccacaagaactggcagcccgattatccatccctgagaggggatttgagctaaatgaagatgggctactcttgaagatcttgaggaagaatctgaccactctcactcagacatggagcattctttcattctccaacttggcccctacttctcacacttctgacataacactggacagggccaggttgatctacggcatcatccagaagatggacatgaactag

SEQ ID NO: 7145 - DNA, 231 bp, Glycine max
  Peptide Sequence Number=SeqID_123923
atggggatgtatgcctgtccctgttgcatactgattttcatgaaaaataatgttttaactaatgggatacttgtgtcgtctgaagacctagggagtgtgaatctcaggcatgaactatatataagcaaagcttcgaagattattttgatgatgccaaagatttttaaaaagatacattcaaacaagattaaagaaatcaagaagattcaagagaagactcaagatatgtaa

SEQ ID NO: 7146 - DNA, 474 bp, Glycine max
  Peptide Sequence Number=SeqID_123924
atgtcgaagaacagggtgttgaaagagcataacaagactttcctaaattggtttaaagatacaatctttggtgacgataatggttgtgaaacattaagaaaactatcaaatgatcctaaaagaaattttataacttggcaaggatatgatataaacaactattccttttatacaaaagcacaacacgagaaaattacaatgcaaaacagtggggtaacccaaagggctgaatctcaacacttcgctagtgtacatgatggcaatccccgtgtagcttccatcccttactttggttttgtcgcaacctaccctatgacaggtgtgcagacgaaaagcaaagggaagggggctgcccttgctcctatgcatcctcagcttctcaaagaagcctctcaaggaagcttctcaaagaagcctcatgaggaagcttctcaaggaagcctcacaagaaagtttctcaaggaagctgtctga

SEQ ID NO: 7147 - DNA, 298 bp, Glycine max
  Peptide Sequence Number=SeqID_123925
taagaaaagatgcaaagacaagctgaatctaacaaggaacaagcgtagaatcacggttacctcgaagaaaatcgtgaaggtcagattgggcttcattctctaccgaaaccgcgagacaagcttagaagattccgctccgattgaagggttcctctcagtgtggggtttcaacggagaactacgacggttcgtggtggctattggtggttgtgggtggcgaagaagaagcttgggacgttggggaagggttttggaagaaagaaggagaaaggaatggttgttttccaaggctacatga

SEQ ID NO: 7148 - DNA, 687 bp, Glycine max
  Peptide Sequence Number=SeqID_123926
atggaagatcgcttagaggatatgatttgtgatcttggacaagagtcttttcagcaagcacgtgcctgtatgtatgatacattgcaaactgattcaaagaagcctttgtatccgaggtgcaacaatttcttgatgttgttgtcaacggtgttaagtctcgttaatgtgaaggccaaatatggatggagtgacaaaagctttagttcactgcttcaaatagtacatgatatgcttccagatgaaaacatgttgccaaaaagttactatcaggccaagaagatattgtgtccaatgggtatagagtataagaagattcatgcttgccccaatgattgcatactgtacagacatgagtttgaagaaaagcgcaaatgtcctaggtgtggggtatcacggtacaaagtgaaggataataacgtgtgtagtagtgaggaaaactcaaagaagggcccccagcgaaggtgttgtgcgaaagtacatgatgttatctatgatgaagacttgaaaaagttgtgggacaaggggatttcaatatttgatgggtttcgaaatgagacttttgatttacgtgcaatgcttttttgtaccattaatgactttctagtatatgagaatttgagtgggtatagtgttaagggcatcgtgcatgccccatttgtgaagaagacacaagctacatacaactga

SEQ ID NO: 7149 - DNA, 255 bp, Glycine max
  Peptide Sequence Number=SeqID_123927
atgggtgagaaagatgatgagtttgggttgagtttgagtttgagtttggggggagtgaatcaacaacaacaacccccttctttgaatcatatgcaccagcctcaacaacaacaacctgttcccatgaatcacaataagactctctttggtgatttgtttcagttaccaggtacgagtcattttttctcgcatttatatgcaattcattacgataagaaggatgaagaacatattgtaatggcaactgcaatataa

SEQ ID NO: 7150 - DNA, 411 bp, Glycine max
  Peptide Sequence Number=SeqID_123928
atgggagtagatgtggcaaatggtacattggtagtcgaaacgtgttactgttgttactttgggctattcatgttgttgactaagctgaagcaaactgaagtggattgtgaatacttaaagaaatgctgtgagaatttaactgaagagaatagaaggttgcacaaggaggttcaagagcttagggcactgaaattatccccacaaatgtacatgcatatgaaccctcccaccactcttacaatgtgcccttcttgtgagcgtactcactcctctgcatcctcctcccctgctaccatccactcaacagtggcggcagccacctctagcaattgcaaactgcttggtgcaaacatccggcggccggtgcccgtcaacacttggccatttgaaggcccaattccccggccataa

SEQ ID NO: 7151 - DNA, 1557 bp, Glycine max
  Peptide Sequence Number=SeqID_123929
cgatccgtccaccggcctgaccagccgctacccgttccgcgccggctggagctggggcgatgacaaccgcggcctggacgcgcgcccggacaaggtcaagctgggcctggacaagaccggctacaaggccggcgacaccctcgaggtgacggtgaccccgccgcacgccggcaagggcatcctgatggtcgagaccgaccgcatgctgtacgtgcaggacatcgaggccaagccgggttcgaccttcaagatcccggtcaccgccgactgggagcgccacgacgtctacatcaccgcgctggtgttccgtggcggcagtgcgccgagcaagatcaccccggcccgtgccgtgggtgtggtgcatgtgccgatggaccgcaagggccgcaccgtggccgtcggcctggtcgcgcccaagcagatgcggccggagcaggacctgccggtgacggtcagtgcgccgcagctggccggaaagaccgcgcacgtgaccgtctcggcggtggacgtgggcatcctcaacatcacccgtttcccggtgcccgacgccggtgcgcacttcttcgcccagcgtcgcctcggcatcgatgcctatgacatctacagccgggtgatcgagagcttcgatggtggcagcggcaagctgaagttcggtggcgacatggcgctgcaggcattgccgcaggccaagcgcccgacggcacgcgtgcagaccgtggacctgttctccggcccggtgcagctcgatgccaagggcaatgcccgcatccgcctgaaggtgccggacttcaacggcaccctgcgcgtgtcggcgctggtctacagcgatgaccagtacggcaagcgcgacgtggaaaccatcgtgcgcgcaccgatcctggccgaagccagcatgccgcgcgtgctggccccgggcgaccgcagcacggtgaccctggacgtgcagaacttcaccggcaagccggggcagttcaacgtgaaggtggagagcgaaggcccgctgaacctgggcgagggcagccgcagcgtgcagttgaatgccgatgccaagaccacgctgagcttcccgctgtcggctcgcgagggccacagcgtggccaaggtgcgcgtgcgggtggacggcaacggcttcaaggccgatcgccgctacgacctgccggtgcgtgcggcgtggccgcaggtgctgcgttcgcaggtgcgtacgctcgatccactggcggcggtcagcctcgacaacagcctgaccgatggcctgatggccgagtcggtcaatgcccgcctgctggtcagcccgctgccgccgattccgttcgccagtgcactgcagggcgcgctgaactatccatatggctgtgccgagcagaccaccagcaagggttacgcggcgctgatcctggaccaggcgacgtcgtcgatgctcggtgccgacggcctggatgccaagacccgtcgcgagcgcatggaaggtgcgttcggtcgcctggcgtcgatgcacgttgccaacggcaacttctcgatgtggggtgacgacggctacgtgaacccgtggctgacccc

SEQ ID NO: 7152 - DNA, 525 bp, Glycine max
  Peptide Sequence Number=SeqID_123930
atgtcaagtggtagtgaagcctctgttgagccaaccattctaaagattgacacgaccatcatgcatacagaaaataagcctaccatctacattaagcactacttcgacattctctatctagagagcattggtttagatacacatgaaacatttctaagttgttgcataagagtttttagaaagaaggtccctctatcagtgccaaccatttctcaagttactggtttcttgaggaaagctgaagaagaagccttctctcggtttggcattgccaataggatcatacaggaacaagaaaacaagaagaaaaaagaacgcaataagcatccaaagactactcctaccaagaaagaagtgctaagaaaaaagaaaaggaccaagaagaaacatgagccaattccatcgtccaattctcccaataagcatccaaagactactcctaccaagaaaagtcctaagaaacctactgagaagaagaccaccaatcagaggctgagggacttgagtgaaaaagtaagaggctag

SEQ ID NO: 7153 - DNA, 291 bp, Glycine max
  Peptide Sequence Number=SeqID_123931
atgcaggatcatgagtccataaaagatatgttccccagattcactactatagtgaatgatttgaatactctaggagaaaagtacacaacacatcaagggatcaagaagattttaagaagtctgcccaacatctggagaccaaaagtcatttccataacaaaagccaaagatttgaaaattttggctatggatgaagttattggcttactaaacgttcatgaacaagagctgataggtgagctacaactacctaatggaaaagcaataacactcaaggcctctcaaagctaa

SEQ ID NO: 7154 - DNA, 141 bp, Glycine max
  Peptide Sequence Number=SeqID_123932
atggagaattggcgaacagcgctacccaataactttgcggggctccagactcgaaggagaatggagaattggcgaaaagcgctacgcaataacttcgcggagctccagactcgaaggtggaggatgcatgaacagcgctag

SEQ ID NO: 7155 - DNA, 742 bp, Glycine max
  Peptide Sequence Number=SeqID_123933
atgttgactagaagaaccttggatcagccgcgacctattgtcaccgttgatgctgcaactgggcgaggatcgggcccccataaagagaaattccacaactatttaggtgatgtagctagagaaaaagttccaattgtacataacagttggaaggatgtaccggacacactaaaggagctattatggaatgagattttggccaagtttgatatcccagaagccctacatgcaaagaaaaaggaccaacataaagaagatccttccgtcaaatatggctttgatgcacagatatgggaggaatttgcggcaacccgcaaagtccctaattggcagggaattaggaagaagatgcaggaaatccaaaagaataatgactgtccccatttgctttcccgcgggggatatgatttgctagaaaagaagctgttagacgagaaaatgaagaaaaggcaacatgacacattgatgactgaaaatccagccctcattgaggaccccttatctcccattcaaagacatgtcaagtggaagatggcccgcacgaatcaatatgggaagatgacatctgaggccgcaagacaaattgctgataaaattgtcaattccaacttcaatttggattacaacaatttcaattttggattaaatgactcgttggaagaacaagtgacacagggtgagtttgtcccccagggtcgtcaagatatacttaacatggccataggaagaccagatcatggag

SEQ ID NO: 7156 - DNA, 247 bp, Glycine max
  Peptide Sequence Number=SeqID_123934
atgggaacaaatcaaaccggaaaaagattctatcaagtcaagattaagggcctagatgtcaccagccttaaggagttggggcggttgatgggacccctccagatgcaagccttccacaaggcgtacggaaagattttagatttgaccatagcggaggtattcacggaagccgttgtatccctcacccaatactatgaccagccattgagatgcttcacgtttgggggacttccaaatagtaccgact

SEQ ID NO: 7157 - DNA, 2742 bp, Glycine max
  Peptide Sequence Number=SeqID_123935
atggcagattcaagcccttacaccaaaccccatttcccactttccgaccacagctcccggatccaaccaaaacccactaaccaaggtaagtcttgctcaggtttcatccttaaagctctgttattggcactgtttgtcgttgttcttccactttttccctcccaagcccctgactttatgagccaaaccatactcaaaaagttctgggagcttctccaccttctcttcattggcattgctgtcacctatggtttatttagtagaagaaattcagaacttgacaccacacacatagaattagaaactgctcactctagtgctgatgattccactgctgcacctagttatgtgtccaaagtgtttcctgcttcttccactatttttgatgatgatgggtgtgaaaatgaaaatggaaatccatgtggggttgatgagaagaggatgatgatgatgacgcattgttggaataatcagtactttgatgggaggccaggggggatgtgctccaatgggggtgatactgttggtgtttttgatgaacagtacaaaacccatttgtcaatttctgaagatagttttggttattcttttagatgcgatgggaatggaattggaaccaatgaggttcaggcttggaattctgagtactatcacagtgagccagtggtggttgttgctcaaccaaactacaatgctggtgaatgtggtgaggttgttggttataaacctctagggctaccggttcgcagtttgagatcagtttctagagatgtagatagtcctaaatatgccaatgaaagtgattccagttcaggttcgaggggttcttctaggggatcgggtaagagtggagatagggaatttggggatctggatccttccaatttggagaaaaaatttaacgatgctggtggtggtggtggatcagcttccccaattccctggcattcaaggaatagaaggacagaaagggagaaaagacatggcaatgttacccgtccttcacattttaggccactttcagctgatgaaactaaatttgaagcactcagttctgggtcttggcagtcaacaacatctttctcttctcttaacaacatgtattcttccttggattcgattttgttggataatatgaactttcaagaggaagagatgaggcaaaaggaagcttcctatgtttctgcctcggagaagatgaattttcaagaggaagacgtagggcaaaggaagacttcctttgtgcctgtttcagaaattatgaatttccaagagaaagatatgggatcttcctatgtgcctgcttctgaaaatacaagttttcaagagagacatttggggaagaagattttccaggggtcttcatcaagaaatagaaagatggcaactaaaggaaaatatggtgctgcttcttttccttcacatttcaggccaatgtcagttgatgaaactcaatttgactcactcggttcaaattcaaacacttttgaggctgtgagatccttctcttccaatgcaagaatgcattcttccttggattcaatttcatcagatatggacttccaagaggaagacatgggacaaaagaagacttcccatatgcatacttcagaaaatatgaattttcaggaggacatcggacccaagaagacttcctatgtgcatgattcagaaattgtgaatttcccagaggaggaaatggaacaaaagaagacttcctatgtgcctgcttcaggaaacatgaatttccaagaggtggatttgggaaagaagatttccgaggtgtcttcttctagaaatggaatgattgaatctaaaggaaaatttggtgctgattcacctccttctcatttcaggccaatgtcagttgatgaaactcaacttgaatcactcaactcacggtctttccagtctatgggatctttctcatctcagtcaagtttatgttctttgcttgattctgctttgtcagagaatatgaattcgccgaaggaagacttaggggaaaagaagagctcacatggatcttcttcaagttcaccatcacctttggctaggagaaatggtgaagcttcattgcaagcatttcaagctcgtggatatactaatggttcctcactcctggatgacataaagagcagtttgaatggtgacttgaggggtttaaatgagattgaaggtgaggatccctctggcaaaaaagagttgcggatgcaggttttgcagtcggactcagaaaagcccgcaagagtagcaaaagctccatcacggggaaaatcagtcagaacaagaagagccagtggcctgacttcagggacaatgagaataggagaaacatctagcaagcaaactgatgaaaaggttgaaaagaacaataaagatgttgagtcagtattgagaaaagataaaatgaagagcggagaatcagaccttccattgaaaggagtcagtaagaaaactctggattcttattgtcctaagcctgagattagtttttccaatcatcgtaggagagataagctagagccatccaaaaatttatccaagcaagattcagatatcgagcttgacaatactcgggtgagctcagatgaaaacagggtgcctgaatgtgtcaatgattcagatctggattctgaggtggataagaaagctagcgagtttatagccaagttcaaagctcaaatcaggcttcagaaaatgggatctattgaaagatcaaaagagcaaaagatcacttaa

SEQ ID NO: 7158 - DNA, 615 bp, Glycine max
  Peptide Sequence Number=SeqID_123936
atggcgtatatttcaagtcctgctaaatgggagcggcgaagacccacaacatctgcatgtaggcaacgggaagctgcacctattgctgaggatgttgagcatgtggatcatgcaactgatgaggtctatgaacagcctgaaaaggtaggtgttgatgatttagttgttgatgcaaagggttttccaggcgggccccatagtacatcattttttatggactatatttatcaagtggcactgacagtttggaatgaaaagaagtgtctagagttgaagttattctcccattggaggaaggtagagaaatttgacaagcttgctccagagattgaaggcttagtggctgccataagattaagtcttctgatcgcattaggagaagtgaccatcaccctggatgatgtggcatcgttgctacatttgcccattataggcgcattccatagctttgaggattttcttgtggatgaagtcgttttcctgttagtggaatttcttgaagttagttcagaagaagctagagctgagacagtacaatgtcatgggacatatgttaggatatcctgggttgagacatttatcgtagcaaatgtggcgcaggacagtggattgtag

SEQ ID NO: 7159 - DNA, 2114 bp, Glycine max
  Peptide Sequence Number=SeqID_123937
atgggtttaatctattttttggcatctggggttggattgttttgtgctgtggggtttcagggtggtgttatcttttccaatggttgttggatttatttttctgaggctgttgtatgggtgaattgtttcagtggtttggagatttgggacatgaatcgtagagtgaggaggaagctggcgaggaaaagcaaagggaatgtggtgcagtctagtttccctgaagttcaagatgaggttttggatttggaaactcaaaggcaaggggttgttgattggaagtgtttgcctgatgatacagtaattcagctattgtcatgtttgagttatcgagatcgagctagcttgtcgtcaacttgtaagacatggaggtctcttggtagcttgccgtgtttgtggagttctctggatcttcgttcgcacaggtttgatgctggcatggcttcgtcgcttgctcccaggtgtgtgcatcttcagaagcttaggtttcgcggggcagagtctgctgatgcaataattcatcttcaagctaggaacttgcgtgagttgagcggtgactattgcaggaagattactgatgcaactctttcggtgattgtggctcggcatgagtttcttgagagccttcagctcggaccggatttctgtgagagaataagtagtgatgctattaaagcaatagctcattgctgtcctaaattgaataaacttagactatcaggcatcagggacgtaaatgctgatgctattaatgctttggctaagcattgttcaaagttgactgatattgggttcattgattgtctgaatgttgatgaggttgcgctgggaaatgtgttatcagttcgtttcctttctgttgcggggacatcgagtatgaagtggggtgtggtttcccatctctggcataaacttcctaacctgattgggttagatgtttcaagaactgatattggtccatctgctcttttaagaatgttatccttatcacagaatttgagggttttaattgctctgagttgtcctatccttgaagaagacaccagcttctctgctagcaaatataaaagcaagacctcaaagaataatgataaggacctcaatgaaattataccctggcttgagtggatgctatcccatacacttttgcgttctgctgagaatccccaacagggtcttgatagtttctgggttgaacaaggtggagcgcttttgcttagtctaatgcagagttctcaagaggatgttcaagagagggcagccacaggtcttgcaacttttgttgtaattgatgacgaaaatgctagcatagattgtggaagggctgaagcagttatgcgagatggaggcatacgccttctacttggcctcgcaaaatcttggagagaagggcttcaatctgaggcagccaaggccattgcaaatttgtccgtcaatgccaatgtggccaaagctgttgcagaagagggtgggattgagattcttgctgggttggccaggtcaatgaacaagctagtggctgaagaggctgctggaggattatggaatctctctgttggagaagagcacaagggtgccattgctgaagctggtggaatacaagctttagtggatcttatattcaagtggtcctctagtggagatggagttttagtaagtttatctgattttatggaacgtgcggctggtgcattggctaatttggcagctgatgacaagtgtagtacagaggttgcaacggcaggaggtgtacatgctctagtgatgcttgctcgtaactgcaaatttgagggagtgcaagagcaggctgctcgtgcattggctaacttagctgcccatggagatagtaacagtaacaatgccgctgttggacaagaagcaggtgctcttgatgctctcgttcaacttactcgctctccccatgagggtgtcaggcaagaggctgctggtgcactttggaatttgtcatttgacgatagaaatcgagaggccattgctgcagctggaggagttcaggccttggttgctcttgcccaagcttgtgctaatgcctcccctggacttcaagagagggctgctggtgctctgtggggattgtcagtctcggaaactaatag

SEQ ID NO: 7160 - DNA, 1368 bp, Glycine max
  Peptide Sequence Number=SeqID_123938
atgagaattggttctccttcttcttcttcctcttcctccggttgttcgcgtttctggtcctcggcgctccgatcaaagcgccttatgtcgccggcggagaaggccgcccgcgaaagctccgacctcggcctctcccgccgcctcggcgtcctcgacctcgtactcctcggaatcggcgcctccatcggcgccggcatcttcgtcgtcaccggcaccgtcgcccgcgacgccggacccggagtaacaataagttttatacttgcgggagcatcgtgcgttataaatgctctctgttatgctgaactagctacccgatttcctgctgttgttggaggagcatatctgtatgcgtacacagcttttaatgaacttacagcttttcttgtttttggacaattgatgcttgactatcacattggggcagctagtatagcgagaagcctagccagttatctaataaatattctagaactcttccctgttttcaaagataacattccaaaatggattgggcatggtgaagacattggagatgtgctatccatcaatgtcttggctccaattctgctagttcttctgacttttattctctgtcggggtgttcaagaatcgtctgttgtgaattctcttatgacagtgaccaagataatcatagttatcattgtcatttttgctggagcatttgaggttgacgtttccaactggtctccctttgctccaaatggtttaaaagccatatttacgggagctactgtagtcttctttgcttatgttggatttgatgcagttgcaaattctgctgaagaatctaagaggcctcagcgggatttgccaataggcataataggaagcctcttaatatgtattgcattgtacattggagtttgcctggtgattactggaatggttccatataatcttctaggagaagatgctcctttggctgaagctttttcgtctaagggattaaaatttgtttctattctgattagtgttggtgctgttgctggacttacaacaacactccttgttggtctatacgttcagtctcggctatatcttgggcttggcagggatggcttactacccttagtatttgctaaagtccactccaaataccacacccctgttcattctcagatctgggttggcttggttgccagtgttttggctgggctatttaatgttcatgtgctctctcacattctttccgttggtacactgggaaaccacatggtgtgccttgacagaagtatacttagtgtttgcatattcttagttagcgcctctcacatgataaattcacttatttcagactggctattcggttgtctcagcatgtgttgtcgttcttcgctggaaggataa

SEQ ID NO: 7161 - DNA, 740 bp, Glycine max
  Peptide Sequence Number=SeqID_123939
gttctgttactaacatgtttacttccattgtcggaaatgtatttgggttcaaggccctgcgtgctctacgtctggaggatttgcgaatccctactgcttatattaaaactttccaagccatttttaaatcacaggctgaaacaggtgaaatcaaagggcattacttgaatgcaactgcgggtacatgcgaagaaatgatgaaaagagctgtatttgccagagaattaggcgttcctatcgtaatgcatgattatttaacggggggattcactgcaaatactagcttggctcattattgccgagataatggtctacttcttcatatacaccgtgcaatgcatgcagttatcgacagacaaaagaatcatggtatgcactttcgtgtactagctaaagcattacgtttgtctggtggagatcatgttcacgccggtaccgtagtaggtaaacttgaaggggaaagagaaatcactttaggtgttttgcctgtagcttcgggaggtattcacgtttggcatatgcctgctctgaccgagatctttggggatgattctgtactccaatttggcggaggaactttaggacacccttggggaaatgcaccaggtgctgtagctaatcgagtagctcttgaagcatgtgtgcaggctcgaaatgaaggacgcgatcttgctcgtgaaggtaatgaaattatccgtgaggctagcaaatggagtcctgaattagctgctgcttgtgaa

SEQ ID NO: 7162 - DNA, 333 bp, Glycine max
  Peptide Sequence Number=SeqID_123940
atggatccctttaaaggacaaggaggcattcagatgctgctaattgctgaacaagaagcccaacatattgtttctaacgcaagaaatttaaggacccaaaggttaaagcaggcaaaggatgaggtagagagggaggcagcacagtatagatctcacatggaagatgagtatcaaaagttaatttcagagaacacggggagttctggatctaatgtaaaaaggcttgaggaggagacagatgctaagattaaaaatttaaagaaatcaacttcaaagatctcatcagaggtggttgacatgctactcaagtatgttacaaatatcaaaacataa

SEQ ID NO: 7163 - DNA, 234 bp, Glycine max
  Peptide Sequence Number=SeqID_123941
atggaatcttctgaagattcagaaaatgaagaaataaacctctgccttatggcaaaaagttatgaaagtgatgaagaggaatccttgaggaaaaagtggtacatagatagcggatgctcaaaacatatgatgggagacgaatcaaaattcacacatatctctcccaagaaaaaccgaacatgtaacttatgggtgacaacaacaaaggtagaattcttggagttggaaaaatag

SEQ ID NO: 7164 - DNA, 377 bp, Glycine max
  Peptide Sequence Number=SeqID_123942
gtattggagatgcatgcaaacattcgggcattagaaactttattaaggaactaagcaagtggtctggttcaccaggatactgcttagaaattggaaatggatcctgggattcttggactaagcctctattaaaacaggtaaagaagatgagtgatctaggtcagggttacaacattgtgggactttctcagggaaacttgattggtagaggaataattgaattttgtgatggagcacctcctgttaagaattttatatcgctgggaggtccacatgctggtaccgcttctattccattatgtggagtatgtgcttgttctactactgcgcttagaaagtctctgcaattcctctatattctatttgtcttttgttaa

SEQ ID NO: 7165 - DNA, 165 bp, Glycine max
  Peptide Sequence Number=SeqID_123943
atggagcccttcatcccgttgtaccagttcaacagctgctttgctgctgcctgtgaatccataattctctcacctccctcctccatgagatatgagtgtatgacaactgactgtgaatcacctctggtacatcggcctccattggaagagagaccacctcaatga

SEQ ID NO: 7166 - DNA, 1062 bp, Glycine max
  Peptide Sequence Number=SeqID_123944
atggcaagacacaaggtcacacgcacacacacacacacacactcacgcaggcacaagggggaggaggggcttggtcgggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgatgccccctactgctggtcggcaaacggacggcgggcgcacgcgtcgcttctagcccggattctgacttagaggcgttcagtcataatccaacgcacggtagcttcgcgccacttggcttttcaaccaagcgcgatgaccaattgtgcgaatcaacgggtaaaactaacctgtctcacgacggtctaaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccatccaaactccccacctgacaatgtcttccgcccagatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggttttgctagatagtagacagggacagtgggaatctcgttaa

SEQ ID NO: 7167 - DNA, 447 bp, Glycine max
  Peptide Sequence Number=SeqID_123945
atgtctttgttgattgaggattcagctctagagaactatcttgtagctaatatacagaggcttatattgaaggatatacttaatacacattcttcctggctacaaactcaagaagctgactcaagtaagaagtaccctagtggcaaaccaactttggacaagtttgacgataaaaggatccatagttcatggatctttgttatggtgagcacccgaaacaaaaaagcttcaacgacaacaacaacttcttcacctgtgattgaagccacaaattctccaaggatggaggagaatgtagcattcatgagcgcgcaattgactgagcttgttgagatgctcaaacaacaaaaagtagtgcttgaagaacaacataaagtgattgcagatctacgaatagaaaatgatgatgtacaaaatgaacactcaaagtcagtagaagacaaatga

SEQ ID NO: 7168 - DNA, 240 bp, Glycine max
  Peptide Sequence Number=SeqID_123946
atgaatggaacagattgtgctccggcgaagaatagcgcaagcgcgaacagtagtctgaccacaagtctgggcccaccaacgtggaacttgccaattgccattcttttttaccacgctcacgctggactctgcactcctttccttccttttggaaactatcgctccctcaaaattaaaaacggatattctgtttgcttccttggaaactatcctcacgccgtcaatctgaatcgaagataa

SEQ ID NO: 7169 - DNA, 282 bp, Glycine max
  Peptide Sequence Number=SeqID_123947
atgattatgaggggccaagacatttatagtagccaagatgaggctactacttcaccttcctctagtaaaagtgaagaagcaaaaggggaagaatctagtgaagagatctacccccaagaagaaggacaacctttaatggttaaggaggagtgtaaggaggtaagtgtctcctccaagagggttcccatgaaccctaagagaataaaggtcattcctgagtggcccgctccaacaagtgtgttaagggaaggagcccagagtatcaagaacctcaggatttga

SEQ ID NO: 7170 - DNA, 174 bp, Glycine max
  Peptide Sequence Number=SeqID_123948
atggatgcaagcacctcacaaggaccaaagaatggtcgcatgtcatcaagcaaagaaaactatcccaacttccctttttctctaagacacacgcccttaaaaggtcctccagtgactgtatggtccgtgcagtttggccatcagtttaaggatggtaggctaaacttagtctaa

SEQ ID NO: 7171 - DNA, 126 bp, Glycine max
  Peptide Sequence Number=SeqID_123949
atggttgatcttgctgcaatttatatgggtatgagaaaaagattactacatagcaagcagataaaactctatggactatggtgtgtgataaacagtcgatggcgtttatttgctttgctggcaaag

SEQ ID NO: 7172 - DNA, 429 bp, Glycine max
  Peptide Sequence Number=SeqID_123950
atggccaagagggaactaccctccatgccctttggcaaaggagtaggtcaagggagcaaggaatggccaactcggtttggcgtgttgttgaatcagatttggattcgtagaaataactttattttcgatggagtactgtggggtgatgattccaagtgtagtatcttattagcagaaaagctgatgcaggaaattgaattgctttctcttgccaaagacttcaggaaaatttcggtagaatcgaactctaagaatgttgtcgagctagtgaagagaggagtggcttcgaatcgtagtcgaggccaactagtcctcatggttcatcggttaaaggaggagattgaagattttcgtttgtctcgtgtcatgtgcgaaggcaatgttgtggctgctagtttggcaaagcatgacctactgttcctctcctag

SEQ ID NO: 7173 - DNA, 342 bp, Glycine max
  Peptide Sequence Number=SeqID_123951
atgtatcaattacctaggcaactagctgaaatagtcaaacctatggtgctgaatgagatgcaacaaactaaagaattggaagtgagaagggtgaatgctagcgaaaattatgcttcttcaatgcttataaatcacgaagtgcaaatcagcttttacttggtacttgaacttgcctttgaactcaatacaaaactagtcaacattgacgatgagagtggtgaaagttatgaaaaggaagctgaaatcatggcatccaaaatcctgcggagtaaaacttactcacgtccaacattaaagcatggtgaaatatcaaagatcaaactagaagtgggggttgaataa

SEQ ID NO: 7174 - DNA, 495 bp, Glycine max
  Peptide Sequence Number=SeqID_123952
atgaagcagcgtgccctcaccagtggccacacgcgtcgcgcaacccttcacgagcgcggtgaaggtgtacccatcgggcgtaaaaggtggtgcttggcggcgaaggtctcggaagagggtgaagggttgcgaaaactggcgagcggcgaagtgggcggcgatcatggagttgcagaggaaggtgtcgcgggtgtgggtggcattgaagaagcggcgcgcgtggttaatgattgcgagagggcgcttggcggaggcggcgagggaggcacaagttgtgacgaaagcggtgaggaggttgaggttgctgtggagagagtgtcggaggatgaaggcgtggatttggagaagcgtggggatgctctttgttctgcattggagaatgtgtcctccaatcttgtgttggacatgaaccatatccaggattcaagacaaatggtaaatgccgatatcaagcaatggcatgacaagaagcaaaaagaaaaattcttagcttga

SEQ ID NO: 7175 - DNA, 1368 bp, Glycine max
  Peptide Sequence Number=SeqID_123953
atgagggagagaaatgtggtttcttggactagtatggtttctgggtattgtgggaatggtgatgttgagaatgctaagttgatgtttgatcttatgccggagaagaatgtgtttacttggaatgccatgattggggggtattgccagaatagaaggtctcatgacgcgttggagttgtttcgtgagatgcagacagcatcggtggagccaaatgaggtgactgttgtgtgtgttcttcctgctgtggctgatttgggtgctttggatttggggagatggattcacaggtttgccctaaggaagaagcttgataggtctgctcgcattgggactgctttgatcgatatgtatgcgaaatgtggtgaaatcacaaaagcaaaattggcttttgaggggatgactgagagggaaacagcttcgtggaatgctttgataaatggttttgcagttaatggctgtgcgaaggaagcgttggaggtgtttgcgaggatgattgaggaagggtttggaccaaatgaggtgactatgattggcgtgttatctgcttgcaaccattgtggtctggtagaggaaggaagaagatggttcaatgcaatggagagatttggaattgcgcctcaggttgagcattatggttgcatggttgaccttcttggaagggctggatgcttggatgaggctgaaaatttgattcagaccatgccttatgatgctaatgggataatattgagttcttttctgtttgcttgtggttactttaatgatgttttgcgggcagagagagtgctgaaagaggtggtgaaaatggatgaagacgttgcaggaaactatgtgatgttgagaaatctgtatgcgaccaggcaaaggtggacagatgtggaagatgttaaacaaatgatgaagaaaagaggaacaagtaaagaagttgcttgcagtgttattgagattggtggaagttttatagagtttgcggctggggattacttgcattcacatctggaggttattcagttaaccttggggcagttaaaattatggctcttccctaaggttttaaacaatgatttgcaactgcaatgtcaagatttgtggggtttatatgactgcatcgtggccacatcaatcgcatttgcttgtacttttgcgatatcaaggattgcaaccaagttgcaactacgacaatttaaaaccgtcctcttcgctctgtgcaatgttgcatctacacctcaccagcgtgaagcctttctacatatattgttaaagttctctcattctagttcccatgattactccactcagcttttttgcactgcgaaggaaattttgccgagaaatagcacgacatatcaattgtgggatgctatttaa

SEQ ID NO: 7176 - DNA, 258 bp, Glycine max
  Peptide Sequence Number=SeqID_123954
atggtgttgactgtcactgtccctcagcttctctcgtgtactgctgggagtattgaaaaggaagaagaggattgtttggaattgcctatgcacatagatgatgtgacagtcttcaacgatggtaatgggaaaggagtgagagaaagcgtcaaagctctaatgaggtccctgtcgccaccatcatgtagatcagtggataacgatgctggtgatgagatcaccagacaaaaaggtcgccaaaggttcgatggtggatga

SEQ ID NO: 7177 - DNA, 222 bp, Glycine max
  Peptide Sequence Number=SeqID_123955
atggacggatacattgttgtgtacatgggaccaaccaatatggttgcatccttaccagattgggatatgttggtcacattcatgaaggagtttcaagagagactatatcatctgaaggtggagccttataggtctctgatggtgtatgctgataatcatacctcgttcattcagatggatgctgctaagatggagaggatggtcgaagcccctgtggaatga

SEQ ID NO: 7178 - DNA, 834 bp, Glycine max
  Peptide Sequence Number=SeqID_123956
atggcttctacaaaggtcaacaatcgaggttcgcctggatcaaaaaggtttcgaaacgacgcttcacgtaaagatggagattggacctgtcctaattgtgggaacttaaacttttcttttagaactgtttgcaaccagggacgctgtggtgccccaagaccacccctaactccacctgccccaattataagcccgtatagaaacagtcatcccttctactatggtggtgtcggcattcctcctccatcatatggaatgccaagtcagtttggatccccaatacctcatcctggcatacagtatgattatggtttgtatgctagggctcgtgctccttacagtccattgcccatgttcccacctgcaagctttggaggtattaattatggtccaaggcctagaattgatggctatggctatggctatggttttcaaagtcctcctcctccatgggttgaaggattaatagctgataattttgcatctcgaaaacgcagaggaggaccagatggtttatttgaaggggactggatttgtccgaagtgtgacaatgttaacttttcctttagaaccacttgcaacatcaaacactgtggagttgtcaaacctgaaatgatgaatttagggggcaaccaggggtctcagcgccctacacccttctcccctctcctcctctgcctccctccctccctcaagatgaacacaaacaaaccaaatgcagcagttgttcctgaaggtagttggacttgtgaaaaatgcagtaacctcaactatccctttcgaaatgtatgcaaccgcaaagactgtagaactgagaaaacagtttctgcctag

SEQ ID NO: 7179 - DNA, 860 bp, Glycine max
  Peptide Sequence Number=SeqID_123957
atgggaaaggaggcttccctttattccccgaacgagaccacgcctcttaagtgtttggaaatgcaaggagaagtgaacactcttttcatgttgtcctatgtcattctcattactcatgcttctccacacaagctcacctcactcttcatccttcgaacaaaaacgctcacccacatcacatcaccatcttgtgtgcagtccactgtaacacgcgtgtgctcactggtatacgattcttaccaccaccactacaaccacgcgagattttcccctccaaccctccacctcgacgtggaccccaattccctaactcacgatcaagccgtcaccatcgtcgcttccctcgcctccgacgccggttcaatggtggcattgagtttcttcaactgggccattgcctcctccaagttccgccacttcacgcgcctctacatcgcgtgcgcagcatctctcatttcaaacaaaaatttcgagaaggcccacgaagtcatgcagtgcatggtgaagagtttcgccgaaatcgggagggtcaaagaagctattgaaatggtcatcgaaatgcacaaccaggggttggctcccagtaccaaaactctgaactgggtcgttaagattgtgactgaaatggggttggttgagtatgcagagaatctgtttgatgaaatgtgtgcgagaggggtgcaaccgaattgtgtcagctacagggtcatggttgttggttattgtaaattgggtaatgttttggagtcggataggtggttgggtggtatgattgagagagggtttgtggttgataatgcgactttgagtttgatagtgagggagttctgtgagaagggttttgtgacgagggcattgtg

SEQ ID NO: 7180 - DNA, 765 bp, Glycine max
  Peptide Sequence Number=SeqID_123958
atggccttacccggcaagcattatgttgcaccatcatataaggatgtaaaggacttgttcgaaaaatggaaagaaaccaataaggaagaccaaaagaagatgttcactaaattcatcaatgagaatgtgaatctcaacaaagcagatgaatctatgttaatcactgcaatagtggcaccaccagcagccatgatggctaagaaagcaggacaagtagtgcctcaacttgcacttatgaatgccatacctgatgttgtgtttgtgccctctgctacacttttggctctcattgctattaagatcataaaattaaccttcattggaaatacaacatccaaggatacagagtcaaatgttcaacctacacctaaacaaaaacttccaactacaacagcatttgaaaaagaacctcaaattgcaactgcacctacaactgaacaagaacctcagcctacaactgcaattgaagcagaacctcaaattgcaactaaacaagaacctcagactacaactacaattgaagaacctcgaattgcaactgaacaagaacctcagactacaacagcacctgctattgaagaagaacctcaaactacagctttagctgcaactcctgttgaagaagaacctcaaactacaaccgcaccttcatatatacctcgacatgtccacaaggacaacatcatttgccccttatgtgaagagctaattgctaaggctaagaaggaagcaaaaaggtctgatgctgtagcattgaagacttaa

SEQ ID NO: 7181 - DNA, 549 bp, Glycine max
  Peptide Sequence Number=SeqID_123959
atggggttggggcctaatttgattaacttcacgtgtatgattgaggggttgtgcaagaggggtagcatgaaacaggcgtttgagatgttggaggagatggttgggagagggtggaagccgaatgtgtacactcatacggctttgattgatggtctgtgtaagaaaaggtggaccgacaaggcgtttagattgtttcttatgcttgttcgaagcgagaatcataaaccaaatgtgcttatgtatactgccatgattagtgggtattgcagggatgagaaaatgaaccgtgctgaaatgctgctgagccggatgaaggagcagggattagtgccaaacacgaacacatacacgactctcgttgatgggcactgcaaagcggggaattttgaaagggtgtatgagttgatgaatgaggaaggttccagtcccaatgtttgtacctataatgctattgtcgacggcctttgtaataagaggcttacaaggtgcttaagagtgggtttggtaatgggttgcaagctgataaagttacttatactattctcataa

SEQ ID NO: 7182 - DNA, 454 bp, Glycine max
  Peptide Sequence Number=SeqID_123960
atggataattattacgatgctactactgctactactgaatccgacatgacactttcggaccttattcaacattacatgcatgatgatgaagccaatgctttgaacaataatgtggaaggtgctaaagcacaaaaagaagttccgaaatggacgaggtacaaaggagtgaggcgtagggcacatggaaagtttgctgctgagataacagacccaaacaaaaatggtagggtttggcttgggacttatgacactgaagaggaagctgctttggcctatgacaatgctgctttcaagatcagaggctccaaatccaagctcaattttcctcacctcattccacccaagctgccattggatgcttcaattgcaagtagccagatgagtgaccctccttcttcatcatccacatttgaggatggtttagaaggatccaagaaaacgaaggggatagctg

SEQ ID NO: 7183 - DNA, 204 bp, Glycine max
  Peptide Sequence Number=SeqID_123961
atgacaatctcagactcattcatcgttggattttcgtgcaatttgagcaccaggaagaaaaataaatcgtatgaagataatacaaatggaggcttcaatcccttctccgtctctctgacgtttgagaactctatcggagcagtcgaaggaaaaaaactggaggaatctcaaggaaccgctagagatgctgctatcgctggctga

SEQ ID NO: 7184 - DNA, 812 bp, Glycine max
  Peptide Sequence Number=SeqID_123962
gactacacgtcctcgccatcaaagggctacaggtcctcaacttcggaggactacacgccctcacctttagaggactacacgtcctcgcctttagaggactacacgtcctcgccttcagagggctacaagtcctcgccttcagaggactacacgccctcaccttaagaggactacaggccctcgccgtcagaggactacagctacaaacccttagcggaccacacgtcctcaccttgagaaggcttcacgcccttgccttcagaggactacacgtcctcgccttcagagggctacacgccctcgccttcagaggactacacgtcctcgccttcagagggctacacgtcctcgcctttagagggctacacgtcctcaacttcagagaactacacgtcctcgccttcagaggactacacgtccacgcctttagaggactacacatcctccccttcagaggattacatgtcctcgccgtcagagggctacatgtcctcgcctttagagggctacacgtcctcaacttcagaggacaacacatcctcgccttcagaagactacacgtccacgccattagtggactatacattctctccttcagaggattacacttcctcgacatcagagggctacacgtcctcgccttcagagggctacacgtcctcgccttcagaggactacgcgtcctccccgtcagagggctacacgtcctcgccttcatagggctacacactcttactctaagggctacatgccctcctcttaagcggactacatgccctcgccgtcagaggactacacctacaaacccttag

SEQ ID NO: 7185 - DNA, 293 bp, Glycine max
  Peptide Sequence Number=SeqID_123963
gtttggatagggaggagaagctgatggatattggatcgagaaacttttttctgtgtccgaggaagtgtggtggtaatggggacgagggtagtggaacgacgccgtttggttcgtgttcaagagaggctgacaaaacgaacaagggtggcgcgtttggccctgtgcctggggatgtcaaggactgcacctcctctgtggaggtgtctctcttttgttacattgtcaagaagaaactacaaggaatagaggcttcctttacaccttcttataagcttaggcaacaacttacttga

SEQ ID NO: 7186 - DNA, 366 bp, Glycine max
  Peptide Sequence Number=SeqID_123964
atgttcgaggtggtggggtcgaggattcggtcggtggagcagtatgaggtggggagggaccagtgggtgccaatggaaaatctccctgggtttcgtgctgagtgcgtggggtttgtcgaagaagaggggagggagttctgggtgatgggagggtatggcgaatcgaagaccatatcgggggtgttttcgatggatgagtattataaggatgcggtagtgatgggagtggagagtggcgcttggagagaggttggggatatgggggggaatggggagagggtcagggttgggaagattgtggtggttgaatataatggatgtcccatgattttcatgcttgatggaaatgagattttgagctcttga

SEQ ID NO: 7187 - DNA, 1107 bp, Glycine max
  Peptide Sequence Number=SeqID_123965
atggaagccaaggtcgcagttctagagaatgaggtcacgagcatcaaggatgctctccaagcgctcaacctcgaggttgatgtgaatcaggataagttgattgcattgttgactaaaagaatagaggatgttggaggagacacgttcggggtgaagaccatgtcagagatagtgaccaaaaactccgaaatagcgagattgaagaaacatcaaggcgagtccttggatgagttctaccaattggttaagaaggtggaattatcgttgttcaacggcgatgaccccgctgggtggataacacgagtagagctcaaagtggagttgattgagcgctatggaggaatcaaagagggtgacgtgtttaagcagcttgcgagcctgcaacaactgggctcagtggaggagtacattcaggagttcgaacgcttgacctctcagcatgcgagctttgggaccactattgaggtcgaggttattgaatgtggcacacgcagtggagtacgagctacaagaacgatgaggaagtacaccgtggagcaatgggacccgaaaccattttggattgggttcctctcatcgggcaaagaaatgcatgacaaggggcacagtgggcctaggcatgaggaccaaaaagaggggggcacacagggattgagggatgctaaagatgagggcgaggttaagatgctggctgagagtgaaggaaagaaagcaaaggcagatggggtacccattctgattcttctggatagtggggcgacccataacttcatttccaagacgatgatgtcgaccatgggggcgatggtgcaagggcaatgtcgaggattggaggtagtcatgggtgatgtttctgtcaaggtagatgccttattgttcaaattggagggaattgatatggtccttggtatggcatggttggcttctttgggaggaatgtgggttaactggaaagagcaagtcataaagctccagttggctaagaaatgtgtggaactgagaagggaactttcatggaacataacccaagatgctttgcaaatttttttcagtgaaccaaaacgagcaggagaaatgcaagcacctaaatctgagaaaggatgctga

SEQ ID NO: 7188 - DNA, 384 bp, Glycine max
  Peptide Sequence Number=SeqID_123966
tgttacattgtatacttgggagctcattctcatggtcctagccctacctctcttgacctcgaaatcgcttcccattctcattatgatttactagcttcagtcttgggaagtgaggagaaagcgaaagaagcaattatttactcatataataaacacatcaatggcttggctgcgctacttgaggaggaagaagcagcagatattgcaaaaaacccaaatgtggtgtctgtgttcttgagcaaagaacataaactgctcacaactcggtcttgggaatttcttggactagacagtaataataaggactctgcatggcaaaaggggagatttggtgaaaatacaataattggtaacatcgacacagataacattctgtaccagtga

SEQ ID NO: 7189 - DNA, 225 bp, Glycine max
  Peptide Sequence Number=SeqID_123967
atgacggtggcacctgccagctcactgcaggggatgttgtctggtgaaaaagctgtttggcaaagaaaacgtggtggctcccacacagcaccaactgttaaagtcacattatactctaggcctgtgtggggatgtccatgtgaaagaaatatgaacatagtgtgtattgtttctgcttttcaacacatacggtttttctatgctttgcattgctttaaacactga

SEQ ID NO: 7190 - DNA, 504 bp, Glycine max
  Peptide Sequence Number=SeqID_123968
atggatgggatggtatataaggagaactatagaggcaaagaagagagtagtgatgagcgcgaaattgaaacgctaaagatggagaagaagcaatcggaggtgatggagcagttggtgaagcaagcctctgcttcccccaacgctaacgcactcacttccatcctcgtccaagccacttctcaccccaacgtcttctctttctctcaatttctcgccctccctaaccttctacagtatttagtttcggcgatttctgttgccgatttttttgagcttgaagcaactgagaattctacttatcttgatatgcttcggttgtttgcacacggaacatggagtgattacaagagtaatgctgattgctttcctcaattgatacctgatcagatcctcaagcttaagcaactcactgttcttacactggctgagacatacaaggattgtttggtcgaagtcattttaatcaataacacactaaagtttcttcctggtattgccgtttga

SEQ ID NO: 7191 - DNA, 2933 bp, Glycine max
  Peptide Sequence Number=SeqID_123969
ctgcagctgaagacagtgaagcaaatgctttgttgaaatggaaacaaagctttgacaactacagccaaggtctcttgtcaacttggagaggtaatagtccatgcagatggcaaggaattcagtgtgacaaatccaactctgtctccaacattgatcttccattttatggacttaaaggtacactccacactctcaacttctcctcattcccaaacctcctcggcctgaatatctacaacaattccttttctggaaccatacccccacaaattggtagcaacaatttttcaagccacattcctccggggattggaaagttgcacaagttagagtttctaggtattgcaggtagtaagctttctggttccattcctcaagaaattggaatgttggcaaaccttacgtatattgatttgtctcgaaactctctctctggtactattcctgaaacaataggtaacatgagtaatttaaatatacttgtgctttctaataactccctatctgggccaatcccaccctccatatggaacatgtctaacttgaccttgctctaccttgatgccaataaactttctggatcaatccctgcttccatagaaaacttggccaatatagagcatcttgcacttgatcgcaaccacctttccggatccattccttccaccattggaaacttgacaaagctcattgagttgtatttattatttaacaatctttctggatcaattcctccctcaataggaaatttgatcaatttgaatgtccttagtctccaagcaaacaatctctccggaacaattcctcccacatttggaaatttgaaaatgctcaccattttggaattgtccaccaacaaacttaatggtagcattccacaaggcttgaataacattaccaactggtactccttgttactagctgagaatgatttcacaggccatttaccacctcaagtttgctctgctgggacactagtgtactttaatgcttttggcaaccgtttcacgggttctgtgccaaaaagcttaaagaattgctctagtattgaaagaatcaggctggaaggaaaccaattggaaggagatatagcacaagactttggagtatatccaaatttggaatacattgatttgagtgacaataaatttcatggtcacatctcaccaaactgggggaagtgccacattcttgaaaccttgaagatatccaacaataatatttctggtggtataccaatagaacttgttgaggcaaccaagctaggcgtgcttcacctttcttctaaccacttgaatggaaagcttccaaatgaattagggaatatgaaatcgttatttcaactcaagattagcaataaccaactttctggaaacattccaacagaaattggattactgcaaaatcttgaagatttggatctgggaaataacgagttgagtggcacaataccaaaagaagttggggaattacacaagttacggaatttgaatttgagcaagaacaaaattgaaggaagcattccctctaagtttagccaatctttagaatctcttgatcttagtggcaatttgttgagtggaacaataccaacaaatcttggaggtttgcaaagcttgttcatgttgaatctctcacataatagtctttctggtaccattccttccacttttagcagaatgttgagtattgtcaatatatcagacaaccaattagaagggccacttccaaatattcctgcttttcttgatgcttcaattgaatcattgaaaaataacaaaggcttatgtggtaatgtcacgggtttggttctttgtccaaccagccataatcgaaagagcaacaaagtcatcctagtggtattccttagtttaggagctctactgctagtgttgtgtggggttggactttcaatgtatattttgtgtcgcagtaaaagaaagggaaaaagtcattctaattctgaagaagcacaaaaggatgtactcttttccatatggagctatgatgggaaaatcatgtttgaaaacatcattaaagctacagagagttttgatgacaaatatctcattggagcgggaagtcaaggatatgtttacaaggtggtgttgccttcaggtttggttgttgctgtgaagaaacttcattcggtgatagacgaggaaatgtcagattttagttcaaaggcttttgcaagtgagattcaagccttgacagaaatcaaacaccgcaacatcataaagttgcatggattttgctcacattcacaggtctcatttttggtttatgagttcatgcaagggggaagcttggatcaaatgctgaagaatgacacacaagcaattgcatttgattgggaaaagagagtgaatgttgttaaaggtgtggccaatgctttatcttacttgcatcatgattgctcatctcctattgttcatcgtgacatatcaagtaagaatgttcttctggatcttgaatatgaagctcatgtctctgactttgggactgctaagtttttgaagcctagttcagatagttggactcaatttgcaggcacctttgggtatgctgctccagagttggcccagacaatggaagtgaacgagaaatgtgatgtttttagttttggagtacttgctttggaaatcattatgggaaaacatccaagagatatcatttctcaacttatgtcaccatctatggcaccaactattaatgatttgctgttatctgaggttttagatcaacggccacctcaacctacgaaagtaattgatggggaggtgatcttaattgtaaggttagcacttgcttgcttgagtgaaaatccacgttctcgcccaaccatggatcaagtatctaaggcttttggaacagggaaatcacctttggatgaccaatttcctatgatcagactaggacaactccgttga

SEQ ID NO: 7192 - DNA, 291 bp, Glycine max
  Peptide Sequence Number=SeqID_123970
atggagagacatgggaaagtgggaatggtggaaagtaggaaaggagaagggagagtgctagtttattttagaaggtggatcccttgtaggatctacaaaagtggctcaaaatttttatttagcctttgggttttcctttcggaagagaaaacaatcaagcaagagcctctgggtttttcggccaaaccaagcaaatggaaaacgaaaatacagaagaatcgtttggaaaagaacccaaaaatcaatggagaaagaaccaagcatatgaaaaaccaaaacgcagaaggataa

SEQ ID NO: 7193 - DNA, 630 bp, Glycine max
  Peptide Sequence Number=SeqID_123971
acaccttcgcactactctcacaagacacagcaacgcaccaatacccaaatccacgacaccgattccgagagatctgaatacgatttcttcgacggaaaacacgagaccgagaatgagaaaactgattctcatcatcttccagaggagtatactgaaactgagagggaagaggttcagtgtagtgagtggggggatcattacagtaccacgagttcctctgatgatgatggggtggagggggatgtggaatcgcgctccgagatcggaacccggtcgaatttcgggtcgtcggtgcgggcagagtcggtggttggcgttggcggtggcggtggcgcgaagcgattcgatgcggcgtcgtcggtggcggcggcggagatgaagatggtggtgagacatagggacttgagggaaatcgtggaggctattaaggagaatttcgataacgcggcttccgctggggatcaggtttctgagatgcttgagatcagtagggcgcagcttgatcggagcttcaagcaattgaggagtatgttttcaaccaaattcccctttttgaaatttctcaacacacttgtttttgctgctagtgttcttctatcagaatctgagttttatcttatcttgatatag

SEQ ID NO: 7194 - DNA, 390 bp, Glycine max
  Peptide Sequence Number=SeqID_123972
atgaataaagcaagcttgttgggtggcactatgattgaaactaagcaagtggatagcataatgattaaagcaaagaccactcttccctcggctgagtttgtgacaggatcaacagcatggcttggcagaggtctgtcctgtgtctgtgcacagagaagagaaagcgatgccagaccctcttttgatttaactccggcccaggaggagtgcttgcagaggctacagaatcgcattgatattccatatgatggttctatccctgagcaccaggatgccctaagagctttatggagtgctgcatttcctgaagaagaactccatggtttgatttctgagcagtggaagaacatgggctggcaagggaaggatccatcaacagattttaggtag

SEQ ID NO: 7195 - DNA, 150 bp, Glycine max
  Peptide Sequence Number=SeqID_123973
atgaaggtagacacaatcactccccttgcgacgactcaaattcatccgagaatgaatgctttacctctttctagtaagagttcagtgtgcttcaaagatgaactcagtcatgtcattattcagaactctcagtatcgatatgcttgttaa

SEQ ID NO: 7196 - DNA, 282 bp, Glycine max
  Peptide Sequence Number=SeqID_123974
atggctcttcctcttcacagatcgatccggttgccgacggtggtgctgcatcgacgagcagagacagcatcagatttcactccattatctcgcaacctcaaaaagggcaagagagctgaagttgacaagctggctgcactggaagctgctgagctgctatcctcgaatcggagtcaggtgaactcgcaagccgtggaggcaaaatcaagtgcagtgaaggagcaggatagttacgaggaggtggcaaaccttttgaagacaaaggggacctttgtttgttaa

SEQ ID NO: 7197 - DNA, 345 bp, Glycine max
  Peptide Sequence Number=SeqID_123975
atgttatctgttactaatgctttccttcacagtcaaacctcggacactggtgggagcaactttcctaaaatttcttgcagtttggatgggaagcagggaggtaggaacttaaccataacaaaatggaaaaatgttacaaaagtattggaaaatgattcagcttttgatcttctctattgcataacattcaagatgatggatcaacaatggctttctatgcgtgcttcatatatggattttaatacagtaatgaagtctactcgccgtcagctggagaaagagcttctgcttgaagacataatgcggctagaagatgtaccctcatacaaacttctcacacgatag

SEQ ID NO: 7198 - DNA, 582 bp, Glycine max
  Peptide Sequence Number=SeqID_123976
atggacatgaatggacacgaacgggcctcaattgaaagtggaaagttccacccagcacatggcatgtgtggaagaatagatatgtgcaagttgcaaaatgcaaattgtaccttggtgacttgttggtcatgggttcgaatccggaaacagcctctttgcatatgcaagggtaaggctgcgtacaacatccctctcccataccttcgcataacgaagagcctccgggcaatgggggaaatgggaaatgggaaattttatcccacgcgaaggacaagtgatagaagaagcgcgaaaaataacacccaggagcaattgattgggcgagtcacatacagacaattgatactgcattgcaatgggatgtgtgtactgggatatgcaatgggagagttaaagacctgtgcattatcaagcttaaattcagtatgtgcagtttatttcatgaattttgaggaaggtttatggcgtgcttacattctgagagaactgatgacgaatatatacacgcatggggtagtgttatgtcccttcctctacctaaatggccaaccccttcctaccttgaatgcagccaagctctga

SEQ ID NO: 7199 - DNA, 171 bp, Glycine max
  Peptide Sequence Number=SeqID_123977
atgaaccagagtcaactatgtggtaaatttggtcacagtgcagataatttttggtatagatttgatggtgacttcaatggtcctattcgatcaagccagcaacaaataaggagatcatcctccaaggtacacttaaggatggaatccgattttcttcggtttcggtcttag

SEQ ID NO: 7200 - DNA, 795 bp, Glycine max
  Peptide Sequence Number=SeqID_123978
atgaatggtggtttgaatggactgggttttgtctaccgcaaagctcaaaaaggaattgtattcacgttctattcccgtgcttctttcttcaggggcaactttttatctgtgaatgcaaatttcggtccttgttcccaagaaccagcagtatggccactgccaaattttggtgattctaataatggaggaattattctgcctcatgccccatatcattcctcaattgcacacccacaagttacttctcatatgcaaaactgggaacctggtgctactgtcttacaacatccatttcctcctcaacaagtgcatccacatgtggcttcaatgcctttggggtcaattcaagctcccaaattgtcttctcagccatttattactgaggttccaagacaatcacatccagcagattcatcagttcaaaatatagagcagcagcttagttcacagctgccttctcagaccgaaagcaaccctagtacagttactggcattaccctgccggatatgcctacaagtccccaagatgaagattttccagagtgtgactggagtgaacactactgccccgatggcgataagtactactacaactgtataacttgtgaaagcagatgggataagcctgaggagtatgccttgtacgagaaagaatctcagaagcagcaggagcgggaggataattgctgtagtctctcacaattgtcgttatcttcctctcaactagttggtcaaaaacaacaggagacagatcatgaccacaagcaatcagaaacaattcctgttgttggatag

SEQ ID NO: 7201 - DNA, 510 bp, Glycine max
  Peptide Sequence Number=SeqID_123979
atggagaataacccgaaggagcaagcggagcagcaaagggtcaatttcaacggagaccctcacattcacgacaatggcaacgtattccaccacttccaacccacacccgccgtcgattctgatcaagtggacgtttcgtgtaaagtttatgttgcacctgttccaagaacggccacggaggatgagatttgcactgtattcgaagaacatggaactattgttgagattgttcttttaaaacataagaaaactggtacacggcaaggaagttgttttgtaaaatatgcaacatttgatgaagctgacagggctattaaggctttaaacaataaatatacatttgctggggaatcatatcctgttgttgtcaaatttgctgaccgagaacttgaacgccttggggttcgagggttctgccgtaacatggaaaagaaagatcccttagaaggcaagcttctcatctttttccaggatagatgttgcctactatttgattatatgattgtctaa

SEQ ID NO: 7202 - DNA, 1131 bp, Glycine max
  Peptide Sequence Number=SeqID_123980
atggctaatagaccggatccggatattgatgatgattttcgtgagctttataaggagtacactggccccctggggactgctactacaaacatgcaagagagggcaaaatcaaataagaggtctaatgcagggtctgacgaggaggaggaagcccgggaccctaatgctgttccaactgatttcaccagccgagaagctaaggtttgggaggctaagtcaaaggctacggaaaggaattggaagaaaaggaaagaggaggaaatgatctgcaagctttgtggagaatcagggcatttcactcagggctgtccatctactctcggagcaaatcgaaagtctcaagatttctttgaaaggatacctgccagagacaaaaatgtacgggcacttttcacagagaaagttttaagcaagattgaaaaggatgttggctgcaaaattaagatggatgagaagtttattattgtcagtggtaaggatagattaattttggccaaaggtgttgatgctgtgcacaagattcgagaggagggtgatcaaaggggatcatctagttctcaaatgacccaatcaagatcacctgaaagaagtcctgttagtgctcggtttcaacgctctgagccccaaaggtctcattctggaccacgaaatacatctcagtttcaacaaaggtttggtaggcaagagagggctgttgaagaccgtatcagggatgatgttcaaaagttttctagaggttctccacaaggtagggacagcataggatatgtttacagcatccttagaaagccgcaagagtgcttaacatactcttcatttcctgaagcttatggaaatagtggagctagaggtcgttcaagccagtcaagatctccaaggcatgccccttatacaggaaactcatataattcatttgatgatcgtaatcaaaacatgggtgcttataggaatgaaggatgggattctcatagaagagaatctggtatccagcctggtcatcagtttgattacaacgcctccccacagactttagaagaattagagttggagtataagaacgaggcaacagagctaatgaaaattcgtgacagagaagaagatgaagaaaatttcaagcatcgtgaggtatga

SEQ ID NO: 7203 - DNA, 984 bp, Glycine max
  Peptide Sequence Number=SeqID_123981
atggagagtggcttctctttaaaatctgaaacaagagggagatgtcaaaacaatcctatttattatataattgaattgacaaatatcttttatgctgcagaggtcctgttggcacttgaatatcttcacatgcttggagtcgtgtatcgagaccttaaacctgaaaatgtactggtccgagatgatggtcacataatgctctcagatttcgatctttctctcagatgtgctgtttcacctacccttattagaaattttgacagcgacccctcaaaacgaggtggtggtgcattctgtgtccagccggcatgtatcgagccttcatcagtatgcatccagccttcatgttttatgcctcgcctctttgctcagaaaaataagaagtcacgaaagcctaaaggcgatcctggcttgccatccagcacgcttcctgagcttgttgcagaaccaacaacagctcggtcgatgtcttttgttggcactcacgaataccttgcccctgaaatcatcaaaggagaaggtcatggaagtgcagttgattggtggacatttggaattttcttgcatgagctattatatggtaaaactcctttcaaaggatcaggaaaccgtgcaacactgttcaatgtagtgggccagcagctcagatttcctgaatcgccggccacaagttatgccagccgtgatctgatccggggcttgctggtgaaggagccgcagcaccgtctcggggtgaagagaggcgcgactgagatcaaacaacaccccttctttgaaggcgtgaactgggcattgattaggtgcagcacaccacccgaagttccaagaccagttgaatttgatccaccggcaaagtttgaaccagttgatactgttggggttggcaacaacaacatcaacaacaacaatagtagtaagaggatggtgggtaataataatgacatgaagtctgggggtaaatatctggactttgagttcttttaa

SEQ ID NO: 7204 - DNA, 549 bp, Glycine max
  Peptide Sequence Number=SeqID_123982
atggatagagctaggttaatctttggcctagtctctcagctggacatgaatgtaggagctctcatatctggccagatcacatctatggcccagtctaactcctctagacttggattccctgctcttatcacagctctatgtaggtccagaggggttgcttctgacagcctagtcttcgaacgcttgatcccagtcattaacttagcctatatcaggaaaaactattggaaccctactgatctgacagttactattagaggggctaggagagcgagggcaaggccagtcgaggctccttccacatttgcagctcctcctccagcaccctggcccgagactcagcccccccttcatagggaagacgaaggtctcaccgctcaggtaccacagcagagggaggatgagtcatcagagacttccatgccaaagcccctaatcagaaggaagagggtagttgaaacacaagaagctgcagccacgtctaaaaaatctcttgaggacactgctgagccttcagaacctgtggcaaatacgacttcaattcagtag

SEQ ID NO: 7205 - DNA, 2676 bp, Glycine max
  Peptide Sequence Number=SeqID_123983
atgccacttcgtggggaagaaatacacttggttgcaatgtattcacggaacaatgatagaccatgtttctggggatttattgttgcctctggactttacaattcatgcctaacaatgttaaatctgagatgtttgggtatagtgtttgatctggatgaaacccttgtagttgcaaacacaatgcgttcttttgaggataaaattgaggtactccatagaaaaatgaactctgaggtcaatccgcaacgaatttctactatgcaggcggagataaagcgatacttagatgacaagaatatattgaaggaatatgctgaaaatgatcaagttgttgataatgggaaagtgataaaaattcaatctgagattgttccagcattgtctgatagtcatcagcctatagttcgaccactgatccgattacaagaaaagaatattattttgacacgcatcaatccacagtttcttgtaattaaaacatgtagacttttcagaatcattggtctaacaatgacttgtgtctttggaaagattcgtgatactagtgttcttgtgaggttaagacctgcatgggaagatcttcggagctacctgactgcaagagggcgcaagcgttttgaggtttttgtttgcacaatggctgagagggactatgcactagaaatgtggaggcttcttgatccagaattgaatttgataaattcgaaagaactgttagatcgtattgtttgtgtcaagtctggtttaaagaaatcgttgtttaatgtattccaaaatggcttatgccatctgaagatggcattggtaattgatgatcgcctgaaagtgtgggatgagaaagaccagccgcaggtgcatgttgtccctgcatttgctccatactatgctcctcaagctgaagcaagcaatgcagtccctaccttgtgtcttgcaagaagtgttgcttgcaatgttaggggtggcttcttcaaggattttgatgatggtcttttacagaagatccctctaattgcttatgaagatgatatcaaagatataccttctcctcccgatgtgagcaattatctagtttcggaggatgatgcatctgcttccaatggaaataaaaatttgcttctatttgatggcatggcagatgctgaggtagaaagaagattaaaggatgcaatatcagcttcttcaactgtccctgcaatgaccactaatcttgatcctaggcttgctttcaattcttctcttcaatacacgatggtgtcttcttctggaactgtcccacccccaacagcacaagcatctatagtgcaatttggcaatgttcagtttcctcaacctaatactctagttaagccaatatgtcaagttacccctccaggaccgagcttgcatagttctccggccagagaagagggtgaagtgcctgaatcagaattagacctagataccaggcgtaggcttctcatattgcaacatgggcaagatacaagggagcacacgtcaagtgaacccccacttcccgtcagacaccccacacaagtttctgctcccagtgtcccatcacgtaggggatggttttctgtagaagaggagatgggtccacaacaactaaatcagttagtacccaaagaatttcctgtaggttctgaaccattgcatattgagaagcgctggccccgtcatccatcccttttctctaaggttgacgattctgtttcctctgatagagttttccatgagagccaccaaagattgccaaaggaggtgcatcatagggatgatcactcaagattaagccaatcactctctagttatcattctttcccaggtgatgacattcccttgagtggttcatcttacagcaacagggattttgactctgaatctggacgttctctatttcatgctgatattacagctggagtattacaggaaattgcactgaagtgtggaactaaagtggaatttttgtcttcgttagtggctagcacagcactgcaattctccattgaggcatggtttgctggaaaaaaagttggtgaaggatttggtagaactagaagggaagcccaaaataaggctgctgagtgttcaatcaaacaattggctgatatatatatgtctcatgctaaggatgactctggttccacttatggtgatgttagtgggtttcatggttcaaacaacaatggttttgtgagtagtggtaattctcttggtaatcagctattgcctaaagagtcagtctcattttcaacttcatctgactcatctagggtttcagatcctaggttggaagtctctaaaaggtcaacagattcaatttctgccctcaaagaattttgcatgatggagggtcttgctgccaattttcaatcttcaccagctccagcatcaacacattttgctcagaaagatgaagtgcacgcacaggttgaaatagatggtcagatctttggtaaagggtttggattaacatgggaagaggctaaaatgcaggctgccaagaaggcacttgaaagtctaagaacaatgtttaatcaaggcactcggaagaggcatggttctcccaggtcaatgcaaggattggcaaataaacgtctaaagcaagaatatcctcgaactctgcagcggattccctattctgctagatatcccaggaatgctcctcttgttccttga

SEQ ID NO: 7206 - DNA, 246 bp, Glycine max
  Peptide Sequence Number=SeqID_123984
atgtattactttgctcttataggagtgtggcccaagtacttcaattctgagtggtcagttgctcagtttcacttacaagagggctctcattacacagttgcatttggtctccaaaagaatacagtcattattcttggcatggatggaagcttctatagatgccaatttgatccagtacgtggaggggagatgactcagctggaacatcgcaactttttaaagccagaaccagaaacagccttgtaa

SEQ ID NO: 7207 - DNA, 735 bp, Glycine max
  Peptide Sequence Number=SeqID_123985
atgttctcccactttctcccatatccccaaccacaaccaccctctccaactccaagttctcttcttccatcaattcaccactcttcaagacccccccacttgccccttcttcaaaactccactgaaaggttttccttttccagtattcagaggcctagaagagtgaagaagcacaagcgtggcctcagaagcatgcgttcggaacctctcttcccagttccacttttccattccagactcaaagcattcttcaaaaattcttcttcttcttcttcttgcaaggtgaggttcttcatgacttggatttctcccttgaaagcatttggtgagaggaagttattctctatagagatcttgttcgggtctcaccctgaagcatgtttggtcatagtgtcaaagtcccttgactctgacgctggaactcagattctgaaactatttgtgagcaattgtttcaaattcatggctgttgctccagattttggttacatattcaagaacacacatgctgaaacatggttccgtttgaaggaagggaatgtggatcctggtgaagtctctctggggcaaaacctctccaatttgcttaggcttgcactcttgtacaagtttggaggcacatacatagacttagatgtcgtggtcttgaagagtttctccaagctgaggaacaccattggggggcacagaactttgatgtcaaaaccggctagtgggagcagcttgaacaatgcg

SEQ ID NO: 7208 - DNA, 231 bp, Glycine max
  Peptide Sequence Number=SeqID_123986
atggatcataaattcacactagatgtaccttacagaattccaagttccaactacctaattggactaggtagaatttacaacgaagcaacagcggtagaaaaatcgcattatgtcctgagtttaacgagtgcttacaattggatggaggcacactcagatggtttcattacgaatgtttacaattggatgggtgtgcttcacatggtttcaagcacacccatccaattgtaa

SEQ ID NO: 7209 - DNA, 996 bp, Glycine max
  Peptide Sequence Number=SeqID_123987
atgtcttccttcgatgccttcgccgacgacttgaacgtcaactcttcttccactcaccaccacgacgaagacgaggacaacttctccggttacggcggctactcctccttcaccggaggattctccgccgacggcgatgtcgccgtcgaccactccgccgccgcgtcgccggagatctacggcttcactgatccgaatcccgcttactctcagtctcccttcgaatcggccaccgtagagaacggaaacgaaaacggaaacggctatggccaaggcgacggcgacggcgacggcgtttttatctccgatggtccggtgcttccgcctcctacggaaatggagcccgaggaaggttacgctcttcgcgagtggcgccgttacaattattgtgcggtgagggctaccataaaaactcatttttacccctgtcagaatgccattcagctagaggagaaggagaaaagggaaaaagaaatgagattgaagattattgaagaagctgaggagtataaggtggctttctatgagaagaggaagcttaatgttgagactaacaagttattcttggctaatcaagagaagtttcacaaagaggcagacaaagcttattggaaaacaattgcagagctcattcctcgtgaggttcccaacattgaaaagaaaagaagcaaaaaggatcaggacaagaagccatcaattacggtcatccaaggcccgaagcctggcaaacccacggatctgtctaggttgcggcaaatactgttaaagctgaagcatacaccaccacctcacatgattcctccaccacctgctcctgctaaagacgccaaagacggtaaggacagtaaggatggaaaagagaaagcagcatcaaaagcaactgggtctgcagcagaaggtgcacctggttcacaaccaaaggatgccacctctaatggctcctcagaagaaccccagaaagaagctcctgccactgaggagcagcctgctgcatga

SEQ ID NO: 7210 - DNA, 1551 bp, Glycine max
  Peptide Sequence Number=SeqID_123988
atggggttagttgaggtccaagaaaacgggaacggtaatggagatggaatctctgagattccgttggggaccaaaacaaaatacatcaagatgacctctgatccagttgaggaagatgaagttttgcaaagcaggaagtatgagaccaagaaatatatctttgcatgtgccgtttttgcttctctcaattccgtgcttctcggctatgatgtgggtgttatgagtggagcaattatattcattcaggaggatctgaagataagtgaggttcagcaagaagtactagttggaattttgagcataatatcactgttgggtagtttagctggtggaaagacatctgatgcgattggccgaaaatggacaattggtttggcagcagttatcttccaaacaggtggagctgttatggctcttgctccatccttcaaagtgttgatgataggcagactcatggctggggtgggtataggttttggtgtcatgattgcacccgtctatattgctgaaatttctcctgccattgctaggggatctcttacctctttccctgagatatttataaattttggaatccttctcggctacatatcaaactatgcattttcgaggcttccatcacatataaattggaggataatgcttggtgtgggacttatcccttcacttgttattgctattgcactgtttgtcatacctgaatccccaagatggctagtggtgcagaataggattgaagaagctagagcagtgttgttgaagataaatgagagcgagaaggaggctgaagaaaagttgcaagaaattcaggtagctgctgggtcagctaatgctgacaaatatgaaccgaaagctgtctggaaagaaatattgtgccctactcctcctgttagaagaatgcttataactggttgtggaattcagtgtttccagcagattacaggcatagatacaactgtatattatagccccacaatttttaagaatgctgggatcactggtaactctgagcttcttgcagcaacagttgctgttgggttcaccaaaactctgttcatcttgatagccatatttcttattgacaaattggggagaaagcctttgctttacgcgagcacaattgggatgacagtatgtttatttagcctgagcttgtctctagcttttctgagtcatgcaaaagttggaatcgcattagcaattcttgcagtgtgtggaaatgtagcttcattctcagtgggacttggccccatatgctgggttttgtcatctgagatatttcctttgagactaagagctcaagcatcagcccttggagcagtgggaagtagggtcagtagtggtgcaatctccatgtcgttcctctcagtctctcgcgcaatcaccgtagcaggaacattctttgtttttggcattgtttcatgttgtgccgttgcctttgttcattattgtgttccagaaacaagagggaagactttggaggaaattgaagtactctttaaagacgaggatgatttgcaagaaagtgaggtagaaaatggggagatgtag

SEQ ID NO: 7211 - DNA, 3070 bp, Glycine max
  Peptide Sequence Number=SeqID_123989
atggcatctatctctcctctatccttcgtgcccacagtcaataatgtctcttccaactccatcgctcccccttctccgttgcatccattttcacgattccaatccattaaaaatagaaagccaaaaccccatcatattcctagaatcacatgcagtggaaaccaaaacaatccaacaccaaaccctaattcccagggagaacctccacatattgtaggacataggaggaacgttctacttggcctaggagggctttgtggtgctgttactcttaacaacaacaacccttttgcctttgcagctccaatatctcctcctgacctaaacacgtgcggtccaccagacctacccgcaggtgtaaaacccaccaattgttgccccccatcttccaaaatcatagatttcaagttctctccctctaaccaacccttgagggtaagaccagccgcacatttggtcaacgatgagtatctagccaaatacaaaaaagcccttgacctcatgaaaaaactcccctctgatgacccgcgtaatttcacccaacaagccaacgttcattgtgcttattgtgatggtgcatatcaccaagttgggttccctgacctcgatctccaagtccacaactcctggctcttcttccctttccatcgttggtatctttatttctatgaaaggatcttggggagcttgatcaatgatccaacctttgcccttccattttggaactgggatgctcctaagggcatgcaacttccttccatttacgcagaccctaaatcacccctttatgacactctccgcaatgccaatcatcaacccccaacactcgtagacctcgacttcaatctcgaggatcctatttccaatggcaaaatttccaacaacctcaccataatgtataggcaagttgtgtctaacgggaagactcctacattgttccttggaaatccttaccgtgctggggatgagcctgacccgggttttggatcagtagagaatgttccacatggccctgttcatctttggaccggtgatatcaaccaacctaacattgagaacatgggaactttctattcagctgcaagagaccccattttttattctcatcattcaaacattgataggatgtggtccatatggaaaacacttggtgggaaaagaagggattttactgattcagattggttagaatctgcgtttctcttctacgatgagaacaagaaccttgtgcgtgtgaaggtcaaggattctcttgacactagaaaactagggtatgtttaccaagatgttgacattccatggttaaattctaagcccacgccgcgtaggtcaagggttcagaaggtagcattagcacaaaattttggtgttggtgcagcacatgctgctgagacttcaaggaatgtgaagttcccactagtgttggattcagttgtgagcacaatggttaaaaggccaaacaagtcgaggagcaagaaggagaaggaagaggaggaagaggttttggtgattgaagggattgagtttgagagaaacacacctgtgaaatttgatgtgtttatcaatgatgaagatgataagcagattcgaccagataatacagaatttgcaggaagctttgtgagtgtgcctcattcacatatgcacaaaaacaaggacatcattacttgtttgaggctgggacttacggatttgttggaagaattggaagcggaagatgatgacagtgttagggtgacgctggttccgagatatgggaaagggcttaaattcgtccatgcatctgctctcaagtctgatcataagagggttttcgacgatatcgcgtacttgggcgttgtgtgtaaaccttcattgacatacagtggaaaccaaaacaatcccacaccaaaccctaaatccgaaggagaacctccacatattgtagtacataggaggaacgttctacttggcctaggaggactttgtggagctgcaactcttaacaacaataacaacaacaatccttttgcctttgctgcaccactatccccgaacataaccacatgcgatccaccaaacctacctgcggccaaatacgaaagagcccttaacctcatgaaaaacctcccatctgattatccacgtaatttcgccgaactagccaacgctcattgtgcttattgtgaaggtgcatataagctagtcggattccatgatcttgatcttcaagtgcacaactcttggatcttcttccctttccaccgatggtatctttatttctataaaaggatcttggggagtttgatcaatgacccaaccttcgccattccattttggaactgggattctcgtcagggcatgcaatttccttccatttatgcaaaccctacatcacccctttatgaaactctccgcgatgccaatcatcaacccccaacacttgtagaccctaacttcaatgacaatcctaatgttgacggaaacatctccaccaacctcaccataatgtatatgcaagttgtgtctaatggaagaactcccaacgaccaacctaactttgaggacatggttagtttctattcggctgcaagagaccccattttctattctcaccattctaatgttgataggatatggtccatatggaagaagacacttggtggaagagatttcactgactcggattggttgaatccggatgtagacattccatggtcaaactctaggcctacaccgctaggatctagggttcgaaaggttgcactagcacaaaattttggtgttggtgcagcacatgctgttgagacttcaaggaataatgtgaagttcccagtgatgttgaattcggttgtgacagacagtggtgaagaggccaaagaggtctatgagcaagaagaagaaggaagtggaggaggagattctagtgatctcctgatatcaatttgccgtcatgtgcctcactcgcagaagcacataaacaagaacatcattacttctttgaagctcggactaacggatttgttgcaagatttgggagcagaagatgatgatagtgttatggtgacgcgtgttccaaagtttgggaaag

SEQ ID NO: 7212 - DNA, 189 bp, Glycine max
  Peptide Sequence Number=SeqID_123990
atgaatgacttgttttacatcaataaacgaatgattagatatggcaatggggcgggtatgagtattgtctcccacccatactcgtactcgatacccgacgagtttgagtttattgtctcatcctcatacccgtcgggtatcggatataaaaattggaggtgtaacaagcaaaaagggcagaaaaattaa

SEQ ID NO: 7213 - DNA, 1113 bp, Glycine max
  Peptide Sequence Number=SeqID_123991
atgggtttgagttctaagcaggtttctaatagaggacttgattggaaccaaaccttgttgcaggctcaaaacttggaactcccaaatcctcctcctatgaggaaacaacaacaaactcagccatcagagcctttgaagtgtccaagatgtgattctattaacaccaaattttgttactacaacaactacaacaagtctcaacctcgacattactgcagagcttgcaagaggcattggactaaaggtggaactctacgcaatgttcctgttggtggtggaaggaagaataagcgagtcaagaaatcaaccactccagcgatagccaccacttctattagtaccagcacctcaaatgccaacatggatggtgagttgaataaccccatcaccattccttctctagcagtggatgatcacaaaaccacaccttcctctctctatcaatatgtgtgcctgccccaacagaatctgatgagtaccaaagactcagaagaaggcaaagactttggtattggtaatggcatcttcctgagttcaactgtgccttttcctcaaagccaaagccttctgttccccttcacaacatcaaactcctttgacccaaacctatgtgcaatatcatcctcttttcgatcctccagtgtgtataactatggtgaagagtttaaaataatggaggagccaaccctcaacagcataatgcccaacactagtggaagcaccaacacacaaccatgggagatagctgcaacaagttctggcatggaaatgtcaaattattggacttgggaggacattgattcgtttgtgtcaactgatccaaatggatttgtggtgctgctgaacaagaaagcttttgcttttgcctctcctgctctagccacgaccaccatgttccctctggtgttggattcagctgtgagcgcggtggttgttcttctgatcgactttgagggaaacgcacatccaaagtttgatgtcatcatcaacgcccaagattataacctgattcgccccgatcacactgatttcttgcaagacgatgatgatgatgacactgttgtcgtcacgctcgttcccagagacatcaagacgcagcttcttccagactga

SEQ ID NO: 7214 - DNA, 330 bp, Glycine max
  Peptide Sequence Number=SeqID_123992
atggttggaagtggaaaggtagagaatattgcaagacaatatatagatgaaagatcattacttgaggattttgaggactatggccacctttaccatttcaaagtacatgatttggtacatgatcttgcattgtatgttgcgaaagaggagctactagtggtaaattcccagactcgcaacatacctgagcaagtaaggcatttttccgtggttgaaaatgattcactaagtcatgctttgttccccaagtccacaagtgtgagaactatattagttcgcatcgaaggaatgggtgttaacaatgaaactcttttggatatatggatataa

SEQ ID NO: 7215 - DNA, 1461 bp, Glycine max
  Peptide Sequence Number=SeqID_123993
atgaagttcctaaatattgatcttctctgtgggaacaatacccaaaaacaaacaatatcaaaagtaactatactagccttcataatcttacttatattttcactcaccacactgtcttgttccatgtttagttactattcactcttgaagatcaacaaatataagcaatcaaacattgcaattgatgatttgagtgagccacaaagctcgccctcaacacctgtgaagaagtgtaacattttcagtggggaatgggtgccaaatccagaggcaccatattacacaaacacaacatgttgggcaattcatgagcaccaaaattgcatgaagcatgggaggcctgattctgagttcatgaagtggaggtggaagccaaatgagtgtgaactccccatattcaaccccctccagttcctagaaattatgaggggaaaatctatggcttttattggagactccacaagcagaaatcacatgcagtctatgatttgcctcctttcaagggtggagtggcccatagatgtatcccaagtgaatgatctttccttcaagcgatggaagtacttaagctataacttcactatagctaatttttggacacctcatctagttagagctaaaaaaacggattcaaatagtgtcctcttcaatgtttaccttgatgagtttgatgaaacatggacaactcaaattaaagagtttgactatgtcattatcaatggaggacagtggttcttggggcccatggtgttctatgagaaacaaaaaattgttggatgtcaatactgtgacatagaaaatgtcactcatttaaacttaaactatggcattaggaaggtttttaggacggcatttaaagccatcatcagtttagagaattttaagggtataacatttcttagaacattttcaccatctcactttgaaaatgggttatggaataaaggtggaaattgcgtgagaactaagccatttaggaataacgaaacaaagttagaaggccataatttagaattacacatgattcaattggaggagttcaaaattgcaaagaaagaaggcataaagaaaggattgaagttcatgttactagacacgacgcaagctatgttattgagaccagatggtcaccccaatagatatgggtattggccaaatgagaacatgacactatataatgattgtgttcattggtgcttaccaggggcaatagacatatggagtgattttttactagaaatgttgaaaatggaaggccaaaaatggctgatccgaccaaaatcgaccacttttaatttctatccgttaccgaccgtgggagcttttgggtttgtcggatgcgttgtgtcgggtgttcaagcaaggatgaagtcaaagagtgcaaaagcatgtcgcggagatgaaaccagatcaacaccgagcaaccatgactacatgagtttcgaacagaacaaaacataa

SEQ ID NO: 7216 - DNA, 279 bp, Glycine max
  Peptide Sequence Number=SeqID_123994
atgagtgacaatggtgaagaagctggagaaaattgtcaagttccccgtttgaatgaaaggattctttcatcattgtcaaggagatcagtaactgcccatccttggcatggtctagaaattggacctgaggctcctcagatcttctgttttggaagaatagttgtggagatcactaaaggaagcaaggttaagtatgaacctaacacaaagactagattgaataaggtacaaaccaattgcctggttactggaatggaagcccctactgctgtagcttga

SEQ ID NO: 7217 - DNA, 756 bp, Glycine max
  Peptide Sequence Number=SeqID_123995
atggccaccgtaatcgacggcaaagccgttgcgcaaatcatccgatctgaaatcgccgacgaggtgcgcctgctctctcaaaaatacggcaaggttccgggactagcagttgtgatagtagggaacagaaaggattcacaaagctacgtgggaatgaagagaaaggcatgcgccgaattgggaatcaaatccttcgatgtggaccttcccgaacaagtctcccaagctgaactaataaaacaagttcacgagttgaatgttaaccctgatgtacatggtatattggttcagcttccgttgcctaagcacataaatgaagagaaagttctgactgaaatcagccttgagaaggatggaaagaaagcagttgtggttggcagaagcaacatagttggactaccagcttcattgctgcttttgaaagcagatgctacagttactattgttcattcacacacaagtcaaccggaaagtatcatacatgaagcagatattgttattgcagcagcaggacagccgatgatgggaaattggatcaaaccaggagctgcagtcatagatgttggcacaaatgctgttgatgacccaacaaagaagtcgggttacaggcttgttggagatgtagattttgaggaagcatctaaagttgctggttggattactcctgttcctggtggtgtaggtccaatgacagtgacaatgttgctgaagaatactgtggagggagccaagcgctacattgagcaaaataattga

SEQ ID NO: 7218 - DNA, 1146 bp, Glycine max
  Peptide Sequence Number=SeqID_123996
atggctgtggttgcagtgcagcaattccagtgcttcacagaatcaaattggagaaatataacaaggccatgcattccccctcacagttcacttcttctacgttcacgcaacaagattcaaatttctctgatttcatgctcttcatcacagaccccagaagctgatacacaaactgctgaatcttgcgtcaatttgggtcttgagctcttctccaaaggacgggttaaagatgctttaaccctgtttgaaacagcactttccttgaaccctaatccagtggaggcccaagctgcgtactacaacaaagcttgctgccatgcatacaggggagaaggaaagaaagcagctgattgtctccgcactgctttgagggaatacgatctaaaatttggtacaattctcaatgatcctgacttggcctccttcagagttttgcctgaattcaaagaactacaagaagaggctaggctgggtggggaagatatcggctacagttttcggcgagatctaaaacttattagtgaagtccaagcaccatttcgtggggttaggagattcttttatgtagcatttactgcagctgcaggaatatcattgttttttactgtgcccaggctattgcgtgcaattaatggtggtgatggtgctcctgatctcttggcaactgctgggaatgctgccattaatattggagcaggaaaaaaggaaacagtttctttggctatgcaaagagcagagagatttcaaactgagctccttagacgtggtgttctgttagttcctgttatttggggagaaggtcaggaaacaaaactagagaaaaaaggttttggcctaaagccaaaggctgctgaagctcttccatctattggggaagattttgagaagagagcacagtccataactgcaaaatcaaagttgaaatctgaaattaggttcaaggctgaggttgtatcaccagtggaatgggaacggtggataagagatcagcagaagtctgaaggagtttcacttggtgaagacgtgtacataatacttcgcttagatggacgggttcgaagatcagggaagggtatgcctgattggcagcaaattgtgaaggagctaccaccaaaggaagcatttttaagcaagatagaaagatga

SEQ ID NO: 7219 - DNA, 257 bp, Glycine max
  Peptide Sequence Number=SeqID_123997
attggttcattcagacaaaaaggagcttaagatttagaatagagagaaaagcaacccatgccaaacaaggcttaatgaaatcagcagcgatgggattgacagggcgaaagaagcgcatgcagccaaacagggtcagaaacaagccaagccgtgttgccccagagcaccgtgaagtaaagcaacagagccgtggggtttctgtggaaacctccatctgcccacaccatccaagcagagagacccatcaagaagcttga

SEQ ID NO: 7220 - DNA, 303 bp, Glycine max
  Peptide Sequence Number=SeqID_123998
atggcttccagtgaatcacacccgatccagacaccaccaacgacttcaagaggaggaggcaaacgggacaagcgaagaatggctcctccaatgcccatgaatatgatgctgctgtcgcttagaaggcccttctggttcccaccctcgtgggccctacacttgacgtgtccagcttcaagcttcttgatgggtctctctgcttggatggtgtgggcagatggaggtttccacagaaaccccacggctctgttgctttacttcacggtgctctggggcaacacggcttggcttgtttctgaccct

SEQ ID NO: 7221 - DNA, 918 bp, Glycine max
  Peptide Sequence Number=SeqID_123999
atggaaatcggaggcagaaaactgaaaagcggagaaacgatggccgctgaatcggtgacgcagtcggcacctccgacgagatcaagaggaagaatcactttactcgaaaacccgaaaatacccttcgcacttgctcttctctttgccgacgccgtcctcgtctctctcataatcgcattcgtcccctatacaaagatagattgggacgcttacatgtcacagattaccgggtttctcggtggagaacgagattaccgcaacctcaaaggcgacactggtcctctcgtctaccctgctggctttctttacatttactctgcattcaagtatcttaccggtggacaagtttaccctgctcagattctcttcggagtgttgtatatcgttaacttagctatcgttctcgccatctatgtcaaaaccgatgtggttccgtggtgggcactttgcttgctttctctgtcgaaaagggtgcattctatcttcgtgcttcgtttatttaatgattgtgtggccatgacacttcttcatgctgcgttgctcttgttcgtgcaccgaaggtggaatctggggttgattttgtttagtggagctgtttcggtgaagatgaatgttcttctttatgctcctcctttgttactcctcatgctgaaggctatggatatcagcggcgtgttattggcattatctggcgcagcactggttcagatattattggggcttcctttcctggtttcatatccagttgcatacatatcaagagccttcaatcttggccgtgtcttcatccatttctggtccgttaacttcaaattcatccctgaaccagtatttgtgtccaggggatttgcaatccttttgttggctgctcacctcatattacttgcttcattcgcacattatagttggtgcaagtag

SEQ ID NO: 7222 - DNA, 765 bp, Glycine max
  Peptide Sequence Number=SeqID_124000
atggctctcctcgacgctgaaatggcagggttttgggcgaagcttcctctgataaggaagcttcttttgtcgcaccctgaggtggagttctatggtggatggataaggtacaaagactccaacttggtgatgcatgggtggaatgagatggtttacgatgacaagaattggattgggttgaacactgggagttttttgttgaggaattgtcagtggtcgttggatattcttgatgcttgggctccaatggggcccaaagggaaggttagagatgaagctgggaaagtactcacgcgtgagcttaaggataggcctgtttttgaagctgatgatcaatctgcgatggtttatttgctggctaaggagagggagaagtggggtgggaaggtttatcttgagaatggttattacttgcatggctattgggggattttggttgataggtatgaggagatgattgagaattatcaccctggttttggtgaccataggtggccattggtgactcattttgtggggtgcaagccttgtgggaagtttggggattaccccgttgagagatgcttgaagcagatggatagggctttcaattttggggataatcaaatactgcatatttatgggttcacgcacaagtcgttgggtagtaggggagttaagagaatacggaatgagactagcaatcctctggaggtcaaagatgaacttggattgcttcatccagcgtttaaagcagttgagattattcctatccgtgaattgtaa

SEQ ID NO: 7223 - DNA, 417 bp, Glycine max
  Peptide Sequence Number=SeqID_124001
cattatggcccgttgctgccacggccctatgccgatacggttaacggatcacgcttccacaacatgaaagaactgagaatacagtacgctggtcagccaattcgggcgctatacgcattcgacacgcaacgcaaagcgagtgagtttactgaagctgagcaagctgacattcagctgatggcagatgagctgattctcgaaaccggcctgcaactgctgcgggaagagttagcgttatcgcagagaaccgttgcggaagcgatgggcgttaagcagccacgtatcacgcaaattgagcagggcggcgccgatcagcgtctgatcaccattaagcgctacattgaagcgatgggcggcaagctaagcctgctgattgaaatgccggacggctcgggtggaagaattctgcgcgtttaa

SEQ ID NO: 7224 - DNA, 967 bp, Glycine max
  Peptide Sequence Number=SeqID_124002
atggattcaatcaggacagaagtacttgacttctatgcaaagctgggaactaagataattgatgagtctcatgatcaggacaccacagatttacacaaatgtgtggcatacatacgtgacctcaccccaaatattgatggagcagaactatgcattcttgttgctggagcacttggtgggagatttgaccatgagattggaaatattaacgtgctgtgccgattttccaacacacgaattatccttctatctgatgattgcctcattcaccttcttccaaagaatcattgtcataaaatctttgttcaatcttctgttgagggtccgcattgtggtgtcattcccattgggatgccgtctggaagctctacaaccacaggactcaaatgggacctcaggtggaagggaattagggagttattctttaatataggaagttcagttttcaaagaggttacttacattccttggatcagttgcattagcaatggactgttagttgccgctctactctgtggttcgggaccattaccacaacagcttcctctttcccttctcaagactgcccaaggccaccctatgttggtggaactgaaaaatggggagacatataacgggcatttggttaattgcgatacatggatgaacatccatctccgagaagtcatttgtacatctaaagacggagatagattttggaggatgcctgaatgctatatacgaggcaatacaatcaagtaccttcgagttcctgatgaggttattgacaaagttcaagaagaaaccaagagccgtgcagatcgcaaaccacctggagtgggacgtggaaggggaagaggcagagaggatggtcctggtgggcgcccagcaaaaggaattgggcgtggtcttgatgatggtggtgccaagggagctggaggaggccgaggcaggggtggtcccagtggaaagcctggtggaaacagag

SEQ ID NO: 7225 - DNA, 501 bp, Glycine max
  Peptide Sequence Number=SeqID_124003
atgatccccaacgggattttcgcacggtttcggcgacgacccagttacgagaagcacgcggggcttgttgggtcgaaggaaattcgagaaattgggattctcgcgaagccagcgagatctctgttcgtcccagatcgatattttggggccgagacgatacgcctcgtgtgggttaactttctcgcggttctcgtcttctgtttcgtcgaccaagatggtgttgatgtcgaaggcgttgtaattggtggtggaagtggaactttcaaacggcgtcgttgtggaatggagctcggcgaggaggcgatggggttcggggagcttgcgggtgtagaagcggttgcgaatgtcaaccaagtcctgctccggcgtgccgaattttccggcgccgatggtgccgcgcaggacaacgatggtgaggacgaggcagaggatcgtgaccttgcaatgcctgagagctcggtggaatcttcgcgccctttgagctcccaaacacttttctaa

SEQ ID NO: 7226 - DNA, 858 bp, Glycine max
  Peptide Sequence Number=SeqID_124004
atgtatttcgagatttgggtacccgatgttctattattaggtcgtcatcccgaggttaagtgggctcagagacttgacaaggtctatatcacggtgcaattggctgattcaaaaaatgccaaggtggatcttacaccagatggtatttttaccttctctggtagtgctggtgctgaagaccatcagtatgagctaaaactggagctctttgacaaggttaatgtagaggagagcaaaattaatgtaggagtgcgaagcatattctgtgtagtgcagaaggcagaggatggatggtggaaaaggttactgcgtggagaaggcaagcctccacattatgtgaaagtagattgggataaatgggtggatgaggatgaagatgatggtaataatggtgaagtggacttgggagggatggatttctcgaaatttggggggatgggtgctgatgcaatgggagcaatgggagggatgggtgctggtgcaatgggagggatggatttctctaaatttggtggaatgggtgatgcaatggatgacattgatgagagtgatgatgaagtgttaaggatttttgtttccatgagttatatgggttttgatggatatgatgatgggtatggtggtagagtttggacattggaggagagtgctgatttagtaggggggagcagttttgtaagcaagaagtgtcaaagcctcttgaacaggatgctggcgaggcatcaacagagaaaaaagaggctgctccaagcacatgatgccgttgcagttcaaggcgctaccctagaagatgtgtatgaaaattctcgagtgaaattttctctatctgtagcttggattggtagttgttttaagtag

SEQ ID NO: 7227 - DNA, 615 bp, Glycine max
  Peptide Sequence Number=SeqID_124005
atggcggtgtcactgtcaacgaacgcagtgaaactgtattcacctgtggcgggtcagtattatggagaatgcaagggtcactctgaaaccatcaatcagattttgttttcgggtccttcaaatccccatgttttgtgttcctgttcttctgatggcaccattagagcttgggacataaggacttttcagcaggtttcttccatcaatgccggtccttctcaagaggttttcagcttctgtattggagggactggtggaaatttagtagccgccgggtgtaaatcgcagtggtatgtaagctttgtcctcaagtatgattttgttcagatactgttctgggattggagaaatatgaagcaagttgcatgcctggaggactctcatgtggatgatgtcactcaggttcattttgtccctaatgaacaaggcaagctgatttctgcttcagtagatgggttgatctgcacatttgatgctactggagatatcaatgatgatgatcatctagaatcagtgattaacatggggacttcaattgcaaaggtggggatttttggagagaattatcagaagctttggtgcttaacacatattgaaaccctggggtacagttaa

SEQ ID NO: 7228 - DNA, 339 bp, Glycine max
  Peptide Sequence Number=SeqID_124006
atgcattcatttccattgacaaatatatatagagaaagaccctttttcccattctctggaggaattgcactgctcaataacaaaagaggggtcaaaaacttttcacaaattactccttcacaagaatcaaacaacaagcaagtgatgggtctgggaagattgatggtgactctgaaatctaagataaggtctttgaagattatgaagaagcctgattatgataaggtggagaagagtgagagcatgagaatggagattaggagcaggaaggccagaaagctcattgaagagaccctcaaagtggctgattcaccaaagtccaaagcttttgctttctga

SEQ ID NO: 7229 - DNA, 255 bp, Glycine max
  Peptide Sequence Number=SeqID_124007
atgctagctttatcgtcggagaagggtttgggaggagttgaagaggctagagaagggtttgtcaggggattccctaacttaccctttcacgtcaagtatgcaagtcataaaccaactcttcgatggaaaaactgcgactcagcactgacaacgacgcgtcgcactccttataatcagacttcatcagaggactgcaatgctgaaactgaatcttctggttcttcaacagagccagtcgtggtttatgtagtgtga

SEQ ID NO: 7230 - DNA, 267 bp, Glycine max
  Peptide Sequence Number=SeqID_124008
atgaaactttactatttcgcatcgagtttgagcataaattcacagcttaaacggggaattaaaataacgtgcgtactttgggacgatttggaaaacatagtcgtcgccgaagttgtacatgtagaggcccgtatcagtagtaacgttgtacagcatgaggtagtggaagtgaggacaatctggacaacgaagactagcaaggaggcgatggagggaaaagtggcgaggggtcatgacgcgtgtaagaaaggcacttcagcgaggtga

SEQ ID NO: 7231 - DNA, 1489 bp, Glycine max
  Peptide Sequence Number=SeqID_124009
atggaggtacagaggtacagtggggtgaatgtgatctgtttgaggaagaagggtaatgttgaaatattagaaattatggaggtgcagcactgtgaaagtgccatggaagcagaagaacaatttgaacttcctcatcaatctcacgttgcagattctccggttcaaggcatggaacgagtggtggctacggtgagcggctaccatggctccgagcgattcaatctcatcaagctgatttcacaggctggcggcaattacgttggtgctatgtcgaaatctataactcatctggtgtgttggaaatttgaaggaaagaaatatgatattgcgctgaagtttagaatacatgtagttaaccaccgatgggttgaggactgcataaaggaaggaaggcgtgttccagaagattcttataccttgcaaagtggacatgaagtagggccattgctactggaagttccccttgttcgagccagtagcctgacaaagaaaaaattggtcggtgacaagttacatgctactgggtctgaaaggaaaaattccgacttcagttctggagcctctggaacttatgttttggaagattcttgtttaatgaaaaaggaaaacactactgtggctagaccttctcgtaaaggaagaagacttgcgagtgatcttgttgacaaagtagtgttgggtccttcgattttggatttaaccacagatgaccacctttttagaatggatagccaacaaactgatgccgaagctacctctagcctttctgttggtgtcaataataacattattctacaaaatagtgaaggacctaacgcaggattaagtaatcaaagtagaactatcattggtggttcaaatgatattgaacagatcaaagattcaagtcatatatctaaacctagaaattcaacttcatttattgaagatcccctacctgtgccacaaacatcaattgatttatgttccagtgatgatgaaaagttcacagatggtgatcaggctgataatgttgctggtttacctacttcaacagagatgtcatgtgtaatatgtctcacagaattcagctcaacacgggggattctgccatgtggacatcgattttgttttccatgcatccagaattgggctgatcatacgacttcaatgagaaaaacatcaacatgccctttgtgcaaggcaagttttatgatgattaagaaagttgagcatgcagccaccgctgatcaaaaaatatactcccagacaatcccatgtgacaattcagcctcagttatttttatccccgtggatcaaaatttaccagataatatctttgagtctgcacagtcaaatgcttgtgtagtttgccgtggtcgggaaccagaggatctccttgagagttgcgatgtttgccacattcgaaagatccattcctattgcatggaccctcctctacggccatggatatgcactcactgcaaggaacttcggatgcattatcgta

SEQ ID NO: 7232 - DNA, 351 bp, Glycine max
  Peptide Sequence Number=SeqID_124010
atgaggtcagagcctattcgtgcatacatttatatcaatggtgaaatcattcaaagttcaagtacaaatgcaattttcaaaggtgacaagacaaaatcgttactcttgaatccaacaatgacgctgccaaatataatcaccgcaatacagtcatttattacagataatggtgttacgcctataattaatgccctttggtattgttgtcctgtatatgaactcaatggtgaagttcaatatagggcaattcaaattattgacgaagaagtaataatagtctacacatgcatgattttagagatgcggagcaatgtcagagctaaccctcacatgcaccaacaaccccattaa

SEQ ID NO: 7233 - DNA, 2898 bp, Glycine max
  Peptide Sequence Number=SeqID_124011
atgagagggttgggagacaattcaaagagaaagaggttggccaaaatcatcaattcagctttgccttcgtctggtttgtcgggtggtttgttaatgatgtggaaaaggggattatgggtggttaagtctaatttttctgatcatggcttcataggtgtttgtgttgagtttaagtcgaaattattcttcttcgttaatgtttatgctccatgtaatactgctggtagaagagtattgtgggagactttatataatctcaaatatggtagctctgcgggagagtggtgtctggtgggggatttcaatgcggtatctaatagggaggaaaggacgggcagaagcgaaaagtgggggtatattgatatggtggattttaatgcttttgtgaatgaaatgaatcttattgatcctcctttgcatgggaataaatttacttatttctgctctgatggtattgctgctagtagactggacaggtttcttgtttcggatggcatcatgaatctatggcaagtaaaggggcagagggttggtaaacgagacatttctgatcattgtcccatatggttggaatgttctaatcttaattggggtcctaagccttttcgttttaataactgttggcttgaacatgatggtttcaagtcttttattgttgaggagtggaagaagattcagattactggaagaaaggcatatgtcataaaggagaagctaaaaattattagagagagtttgaaaaagtggaataaggaggtgtttgggtggctagaccttaatatagaaaatatagtggctgatatgaatgagttggacagaggcatagaggaggggtgtaatcttaatgtggtggtgaagaagaaagaagcaaatgcattattttggcaacaactaatgatgaaggagagcttgttgaaacagaaatctaggttgcgttggattaaagaaggagattctaacacaaaattctttcattcttgtcttcaagataggaggagaaagaatcaaatcttatccttacaagtggaggggcgttgtgtggaacaagttggggaagtgaagatggaaatcacaggtgtgcttcctaaagctattacggcttccttcttggctttgattccaaaggtgttggcgtctagattaaagaaggtaatagctaaacttatatctccttgtcagtcagctttcatttcaggaagacaaattttagatggtgtcttgatgattaatgaggtagttgatctcgccaaacgtagaaaggatgaatgtttgttgtttaaggtagactttgagaaggcatatgactcggtttcctggagttttttgacttacatgttgaacagaatgggttttgataagagatggattgggtggatacaggcgtgtgttttttctagttctatgtcagtcttggttaatgggagccccacggatgaattcacagctcataaaggtttaagacaaggagatccactatctccatttttatttctcattgtggcacaaggactttctggtttggtacaaaaggcaattcaggttggaaattttgttggttatcaggtggtagatggtttaaacttgtctctattacaatttgttgatgacacaattttattgggtaaggggtcttggaagaatttgtggagcatcaaaactattttcagaagctttgagttagtatctggtcttcaggtcaatttccacaaaagtaagttgattggtttgaatatcaatgaaggttttctagagtcagcatcaatctttctctcttgttgtatgactttaataccttttaagttcatgggtgttccggttggtgccaacccgcggcgaagatcgacttggaaaccggtggtggattctataagggctaaattgtcttgttggaggggacgtaatctatccatcggaggaaaggtaacacttattaattcggttctctcgagtttacctctatatcttttctcctttttcaaagctcctaaagtggttattaaggaactaacacaaattcaaagagattttttgtggggatcacatgaggaggaaaggaagatttgttgggtgtcatgggaagacatttgcaaatcgaagaaagagggagggttgggtgtgaagaatttagaggttttcaacatatctttgcttgctaaatggaagtggaggtgtattcatgatcataatgcactttggagggatttgctagcttttagatatggtaatttaatagcaaagcaaacttgtagtcttgatcgatcatggggcacaaaagattcaatatggtggagggatttgatgttgttggagaaagatttgtcacaaaaccagaatttttttcaaagagcagtgagttgtgatgtaggagatggacaatcaattctattttggtataataaatggttagggtccgagccgttgaaggatgcttttccggagctgtttgcaatttcatctcagcagttggtgtctgtaggaaacgcaggttcatggaggagagaccaatggacgtggggcttgacttggaagagacagttaaatccgaatgaggaagagtcgcttcactctttggagaccattctggttgatgtgcatctagtggcagaatctcatgacaggtggaagtggtccttacacaactccaaattattcactgtgcgcaataatagcatcttcaaggcggaggaaaaagtcattcccaagactatcaatcaaattaagcacatatgttgggcctggttcatgggaaaggtaggagggcggcacgtgtgcacatctcgttttttgaaattcggtcacgtgacatggcatcgcccaatgcggtgcgtttcgtggaatgatgcgccgttggtatcactttcaagtgtcaaccgtgaaaagtgcgtgttagacggatag

SEQ ID NO: 7234 - DNA, 921 bp, Glycine max
  Peptide Sequence Number=SeqID_124012
atgaaggttgggaaagcatactttgagctagttgattatttagaagctgatcgtgcctttagtcatgctcgtcagattacaccttatagtttggaaggaatggatatacactcaacagtcctttatcatttaaaggaagatatgaagctaagttacctggcacaggaattgatttcaactgatcgcttagctcctcaatcttggtgtgccatgggtaattgctacagtctacagaaagatcatgaaacggcactgaagaattttcaacgggctgttcaactgaatcccagatttgcatatgcacacaccctatgcggacatgagtatgttgcactagaagattttgaaaatgggattaagtgctaccatagtgcactcagggttgattcaaggcactataatgcatggtatggacttggaatgctatatcttcgccaagagaagtatgagttctctgaacatcatttccatatggcctaccaaatcaacccacgatcttctgtcatattgtcataccttggaactgctttgcatgctttaaaggttaataatctcttgcctcactggttgtactggtacaatagaagcggggaagcattggccataatggagaaggctattttggaagataagaaaaatccacttcccatgtatcaaaaagccagcatactcgtaagcttagaaagatttgacgaggctttggatgtcctagaggagctgaaagaggcacaacctcgtgaaagtagtgtctatgctttgatgggcaatatctatagaaggcgtcacatgcatgagagagcaatgtttcattatggtgttgctttggatttgaaaccatctgtaacagatgctgctaccattaaggctgccgttgagaaattgattatacctgatgagttccaagacgaagacgactcgtag

SEQ ID NO: 7235 - DNA, 564 bp, Glycine max
  Peptide Sequence Number=SeqID_124013
atggcaccagaggatatggaaaagacaaccttcgtcaccctatggggaactttctactacaaggtgatgtcctttgggctcaagaacactagggcaacttaccagcaggctatggtgacattattccatgatatgatgcataaagagatcgaagtttacgtggatgacatgatcgctaaatcaaagatcgaggacgaacaccttgtcaacttgcgaaagttattcgagcggctgcacaaatacagattaaggttgaatcccgcgaagtgtactttccgggtcaaatccggaaagttgctcagttttattgtgtgtcagaaaggaatagaggtagacctagacaaggtcaagctgatcgccacttgcgagcctctcttcaagctattgcataagaatcagtctgtccaatgggatgatgattgtcaagtggcatttgaaaggattaaacggtgcctcatgaatcctcctcatgacgagtcaggaaaaaaggaatgggctgtctattacttgagcaagaagttcacaacatgcgaaatgaactactctttgctagaaaggatgtga

SEQ ID NO: 7236 - DNA, 264 bp, Glycine max
  Peptide Sequence Number=SeqID_124014
gtcgactctagaggatcccacgcccattcgaattatcaagatccggctacccaagattttgaataacaaagaggagagcggtctacaagatggaaaaccaaaagatgctatgctgcctacccctacaaaagaacggtgggcgagcaagcgaagccccaggaagagcgctatcctagtcaagaagagaagttctcgagatatctatggtgaaccgatgttgcttagggcgggtgaccatcttatgattgaagataagcaccgaaa

SEQ ID NO: 7237 - DNA, 327 bp, Glycine max
  Peptide Sequence Number=SeqID_124015
atgcaaaaacatgtcggagctaagagaaatacccctcgcactgtagctttctcttttcccgcaaaaacccaaaacagtttcagtaaaactacaatccccgatttcgtcaaccgttggattttcatgaaagttggatatgttctacgaaatgcaattgcgcacactttcactgttgggatttgcgagataatattcgtggagggagaaaaggaatcgcatgaagacagtacaagtggaggtttcaatcccttctccgtctctctgacgtttgggaactctatcggagcagtcggaggaaaaattggaggaatctcaagaaagcgctag

SEQ ID NO: 7238 - DNA, 212 bp, Glycine max
  Peptide Sequence Number=SeqID_124016
ggatcgtgcccgcaagacacccagtggacccggagaagtccaatagggtcttggggtttctagctctgattacgggcctttgtcagttctacgaagtgcccgtcgcccccaacaaggtcattaggccccccattaaccgggctttcatcaagaagtactgcgccctcaggcaggcgcagggcgagataccacaacagcctggcgatggctga

SEQ ID NO: 7239 - DNA, 612 bp, Glycine max
  Peptide Sequence Number=SeqID_124017
atgtgctgctctaaatcagttggaatatttgtctctttgctaaaagcatgtttgcattttagtggagaaaacaccgagactttttcaagtctcacaagttatccagaactacgtaggtctgaattcctcattggaggatacgtaggagcaagagcctcgcttttgtcgaccataccgccttttgttgccatgactcaagagctggtagcccgcggagacaccttacggttatccgcacctcagaccaagtttggtcattctgcacccatgatacgcggagataccttacggttatccgcacccttttgtcatccagaggcggcgggcccgatgacaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatccgcacccttttgtcatccagaggcggcgggcccgatgacaagcagagaccaagtttggtcattctgcacccaagatacgcggagataccttacggttatctgcaccccttgctag

SEQ ID NO: 7240 - DNA, 616 bp, Glycine max
  Peptide Sequence Number=SeqID_124018
tgacatccttggccagagtggatttgattgggatggcactaagtacatgatcacagttgagaatgaaaatgcttggaatgaatattgcactttgcataaatcggctaaaccgtttcgattcaaggtgcttcaaaattgggatgatatagtgaatttgtgtgctaaagataaaggcaccgattatggagctaaaactgctatggatgttgatgaagcggtgagtagagaaacaaatgaagtggaattcatggggttaggtgctacggccatagatttagaagaaccaagctctaatacaaaaggaaaaagacaaggttcgacttcttctggcacacatcctcacaagagaaagatgggagaaaaagaaggaatagtagcttctttggataaaatggcgaactcttttaaccgaatggtggaaaaaatggatggtaaagttgatgatgaagatattcaagaagtattacgtgaggcagctttgataccagattttaatagacaacaatgggctaaagctattaaatggttagctgacgatccaaagcagttagctattgtgaaaacccttccaattcaccaaaagacagattatgttttaacacatcttggagaatga

SEQ ID NO: 7241 - DNA, 165 bp, Glycine max
  Peptide Sequence Number=SeqID_124019
atgctcaagattcaaggttcaatcaaacaatcatactttcagctcaaaataggcgcaagggataaatcaatcatgcacaagagaaataaaaatcctatcagtgatcttggtcctgtggtggtggtgggtcctgatccatggcctcctcggtcaagtccaatgtag

SEQ ID NO: 7242 - DNA, 99 bp, Glycine max
  Peptide Sequence Number=SeqID_124020
atggctcaggtggagtgggagtggcttcagaagagtcatcctcctggtatgattgaagttcctgggctgcggaggcttcaccctctcccaaaggagaag

SEQ ID NO: 7243 - DNA, 129 bp, Glycine max
  Peptide Sequence Number=SeqID_124021
atggcgcgaaaaccttgttcacaaccggcaagtgtaccggatcccacaagtagtataaaacagtatttaaactatctaggcaaaaagaaagaaaatcacgcaagagaattactgtgtaaaaacaagtag

SEQ ID NO: 7244 - DNA, 502 bp, Glycine max
  Peptide Sequence Number=SeqID_124022
atggccaccactgacgaggaggttccaactcaattcccagcacgtcttagggtccttgcgattgataatgattcgactgttcttgaaaccgttaagcaaatgtgtaatgaatgtcatcatcaagttatcacatactctaatgctctacatgcattggatcgtgtgcgggaagacagatattgtgttgatgtgatactcattgatgttaatatgccaaacatggatggccatgaattccttcaacgtatccgcatggaaattgacgttcctgttaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagg

SEQ ID NO: 7245 - DNA, 1222 bp, Glycine max
  Peptide Sequence Number=SeqID_124023
atgggtgataaagcctacgcgcggcgcgccaggccggttgcccggtttcacggcggtcacggtggcatgctgatcaatcaccacatcctgcagaccgagatcgcgcagctcctgcgccagcagttccgccatggcgtgttgcgacggcgtactgggcagcgtgctggatttggcatcgctctggctggagaccgccagataacggtaaaaacgctgggtcagctgacgggcaagttggtctgtcatcacaattccttattagctttgcgccactggagatacgccagacggctaaatcatgttatttatgaaataaataccgatgctggctcatggaagtcaataaaaagcgagaagacgatgaaaaagatgataggaaaactggcgcttagcgcactggggttagcggttgcaggcggcgtctcggcgaagacgctggtttactgttctgaaggctcgccggagaacttcaacccgcagctctacacctccggtaccagcgtggacgccagcgccgtgccgatttttaaccgcctggtggatttcaaaccgggcaccaccgagctggtgcccagcctggcggagcgctgggagatcagcccggacggcaaggtgtataccttccatctgcgcaaaggggttaagttccagagcaataaacagtttacgccgtcgcgcgatctcaacgctgacgacgtgatcttctcgtttatgcgccagctcgatacgaaaaacccgtatcacaccgtttcgggcggtaactatgccaactttgaaagcctcgagctggcaaaactgatcacccgtatcgataaggtggatgatctgacagtgcggattacgctggcccatgccgaagcgccgtttctcgccgatctggcgtggtatttcgcctcgattcactcggcggaatatgccgaccagatgctgaaagccggtacgccggaaaaagtggacatgcagccgattggcaccggaccgtttgagctggtgcagtatcaaaaagattcccgcattctctacaaagccttcccgcagtactggcagggcaaggctaaaatcgatcggctggtgttttccatcaccccggacgcctcggtgcgctatgccaaactggagaaaaacgagtgccaggtgatgccgttccctaatccggccgatctcgacaacatgcgccacaacccgaacatcacgctggaacagaaatctggcctcaacaccg

SEQ ID NO: 7246 - DNA, 423 bp, Glycine max
  Peptide Sequence Number=SeqID_124024
atgcaggccaatgccagccaggcggtattgaaagcgtcgattcgcgatttcgatttaaaaggttttgatgcgaagaagcagcagctggtggaagtcgccgatcaaatcgccgcgcactatccgaccggtcatgtcgcgctgaagatcaatgatatctatagcaacatcagtaacgcgataggtgaggaccggcgggcaatcgatctgatttttgctgctctgcagcaggtgggcgtggaacctaaagtgattccgatgcgcggcggcaccgatgggtctgcgctgtcggccaaagggttactgacgccgaatttcttcaccggcgcgcacaatttccattcgcgttttgaattcctgccgatcccgtcatttgtgaagtcgtatcaggtggcggaagcgctctgttatctggcagcccgataa

SEQ ID NO: 7247 - DNA, 1869 bp, Glycine max
  Peptide Sequence Number=SeqID_124025
atgaccctgaacagcagcgtgaagctctcctccaaacagccggacgtcggcaccaccatttttagcgtgatcggccagctgtccgcacagcaccaggccgttaatctctctcagggcgcacccaatttcccgtgtgacccgcagctggttgagctggtcagccaggcgatgcgcgacggccataatcagtacgccgccatgaccggtttaccggcgctgcgtgaagcgctggcggagaaggtgcaccgcctgtatggccagcagtacgatgccgccagcgaagtcctgatcaccggcagtgccagtcagggcatctacatggcgatttcggcgctggtgcatccgggtgatgaagtgatcttctttgagccagcctttgacagctacgcgccggtggtgcggttacagggcgcgacgccgatcggcctcaagctgcaggtgccggattttgcgattgactgggacgcactgcgtgccgcgatcacgccgcgtacgcgcatgattatcatcaatacgccacataacccgagcggacaggtactgaatgccgccgatctcgaccagctggcggccctgacgcgtaataccgacatcgtggtgttgtctgatgaagtctacgaacacatcgtgtttgacggccagacgcactgcggcatggccacgcacgcggaactggcacagcgcagcgtggtggtgtcctccttcggtaaaaccttccacgtcaccggctggcgcgtcggctatgcgctggcgcctgctgcgctgatggcggagatcgtcaaggtgcatcagttcatgatgtacgccgccgatacgccaatgcaggttggcttcgcgcagtatctgcagaacccgcaaaactatctgcagctgtcgtcgttttatcaggcgaagcgcgatcggctgcagacgctgctgcaggattcaccgttcaggctgttaccgagcgccggttcgttctttatgttggccagctacggacatttcagtgacgaaagcgacagtgaaatggtaaaacgtctcatcgtcgatcacggtgtggccaccattccgctgtcggcgttttatatggatggcactgacaataaattaatccgcctttcttttgctaaagacgacgcaacgctcgaagccggcgcgcaggcgctgtgccgggagagcctgcgctacggtctggagtcgcaatatccgccatttgaaagccgcaacgcgcagggcgagctggagggttttgacatcgaactgggcaaagccatctgccaggtcggccattttgactgcaaatgggttgagagcagctttgatgcgctgatcccggcgctgcaggcgaaaaaattcgatgcgattaactcggcgatgaacatcaccgaggcgcgggcgaaaagtatcgacttcaccaacccgatctaccgcattcctaccatgctgattgtgaagcagggcgagaaactcgagccgacggcggcgtcgctgaaaggaaaaaatatcggcgtgctgcagggctcgattcaggaaacctacgctaaaaagcactgggaatcccagggcgtgacggtgacgtcgtatcaggatcagaaccaggtgtacaacgacatggtcgctggccgtcttgacggtacgctggtgatgtccgccgccggtcagtctggtttcctcgataagccgcagggcaaaggtttcgccttcgccggtaagccggtggaagacgacaccattctcggttccggcattggtttcggtctgcgcaaaggcgatagcaagctgaaaggggaactggatgcggccatcgccaaagtccaggccgacggcaccgtgactaaactggcggcgaaattcttccctggcattgacgtcagcgtcagcaagtaa

SEQ ID NO: 7248 - DNA, 2107 bp, Glycine max
  Peptide Sequence Number=SeqID_124026
atggtatggctgcacggcggcggcttcagcattggtgccggcagccttgatccctatcgcggcaaagcgctggcagcgcagggcgtggtggtggtgacactcaattaccgccttggccatttcggcttttttgcgcatccggcgctcgacgcccagtatctgccgggcaaggtggtcaataattttgcgctgctggatcagattgccgcgctgcagtggattcagcgcaacatcccggcatttggcggcgatcgccataacgtcacgctgtttggcgaatcgtccggcgcgcgcagcgtgctgtcgctgtgctgctcgccgctggccgaagggctgtttcataagggcatcgtgcaaagtgcctacagtctgccggacgtgccgcataagcaggcgcagcaaacaggcctgcaggtggcagcgcatttcaatctggccgcggatgccagtgcggagcagctgcgcgcactgccggccgacagtttctggccgctggagcgaccgctggcgctggggccggtggccatcagcggcgatgcggtgctacccagaccgatgctcgacacctttatggcgggtaaacagcatcgcgtgccgttgatgattggcagcaacagcgacgaagccagcgtgctggactacttcggcgtggatgcccgcagcgtgttacaacagctgcgcagcaaaagtcgcctgagttatcgcctgctgaagtggctgtacgatatccatgatgacagcctgctgggacgcgcggtggcgcgcgacatggcgtttaccgtcatgccgttgctggtggcacagtcgcagcacagcatcggcatgcctgcatggcgttactggtttgattatgtgtcagaaaacgcgcgtcatctctacccgcacggcacctggcacggcaacgaaattccttatgtcttcaatacgctcgcgacgctgccgccgccgggtgactggtattacagcgccagcgatatcgcctttgccggccgcgtcagcgcctggtgggtggcctttgcacgggatgccagtgagttcagccatcggctgcggctcgacggggaacctgactggccggtatggcggccaggtgaagatttgactctcgcctttggccacgacgggctgttcagcgtccactcgctgaatgcgctcggcgagggtaacgagattgatcgtcagctggtaaaccagatgacggcgctcagcaaaggcaacgatcaatatttccgcgtggtcacgcgtctgtcgcgggtaatggaaggccgcaccgccggtaacgcgccgaccgcagaagcgttcgcgccggtgcagcaggcactggataacatgaaacagcagttaacccagttcaaagccatggcgccgggtccgatggacagtgagacggtgaacaatgtgatcagcagctggcagaaactgctggatgagggtatcgcgccacaggtggcgctggcgcagcaggcttcactggatgcatggcgcgcgcaggccaacaatgtcacgccgccgctgagccgggcgtttggtgccagcgcagaagcgtttaatcaggccgccagcagcaagctggatgagacccgcgtgaccgtggacacgcttaccagcatgaccaaagtgattattgtgtcggcggtggtgttcggcttattgattctgctgttcactgaccgttacctggtgacgatgctggtgaaaccactggatcgcattcgtaaccattttaccgttattgcgcagggcgatctcagccagccggtggaagaatttggccgcaactgcgtcggcaaactggtgccactgctgcgggcgatgcaggacagcctgcgtgaagcagtcagcgccatccgcagcggcacggagaacatctaccgcggcgcggcagaaatttcagccggcaataacgatctttcatcgcgcaccgaagagcaggcggccgcgctggaacagaccgcagccagcatggagcaactgaccgccacggtgaaattcaacgccgacaacgcacgtcaggccagcgcgctggcggagaccgccaccggcaccgcgcagcagggcggccgtctggttggcgaagtggtgaccaccatgcagggcatttccggca

SEQ ID NO: 7249 - DNA, 537 bp, Glycine max
  Peptide Sequence Number=SeqID_124027
atggtatggggggacactttggctaaatttgatatcccagaagctgaaaaggccaagaaaaaagtaatgtccacggtggccactagatggaggcaatttaagtcttcactaaccactaaatttgtctatgctgacacacaagccggacaggaagaaaatccttcagtaaaatatggtatagataaacaaacttgggacaaacttgttgcaagtggcaagaccccagattggcaggaaattcagaaaaaggcacaggacagtcaaaaatacaatgacagcccccacgtactgtctcgtgggggttatgacttgcttgagaaaaaattgttagatgagaaaacaaagcaaagacaacagcagacacttttgactgagaatccattgtttgatctggaggagccgccatctcccattaaaaggcacgtgaagtggaaaatggctcgaaccaaacgatatggccagatgacatcaaaggcggcaaaagaaatttcggacagaattatgagttgtagcatgattatatcaatttggaactaa

SEQ ID NO: 7250 - DNA, 466 bp, Glycine max
  Peptide Sequence Number=SeqID_124028
atgcgtggatggcggttacgccgcctgcagcaacccgcgttcgatcaaccacgcccgcgcatcctcggcgtcctgttcaaaccacgccttggtggatcccagccgatacgtatacccccaggcatccatgtcggccatcagccgcgcagtgccaacacccggcagctgcccggccagcacgatctgcaggtagcaggtggcatcttcctcggccaccgagtcggtggcgtcggtatgcacctgcgcacgccgctccggcggcagcacgatcaggtggcaggcttcgtgcagcatcgaatgtacgggagtgtcgtcgcgcacatacacgttgctggcgatgatgccggcctcgggctcgccccagtagctgccgggaatcggttcaccggccgcgacttgatgcagccgcaggccatgcgcggcgagcaggcgctgcgcatcggcgaaggcgatgtcgcccacgcag

SEQ ID NO: 7251 - DNA, 864 bp, Glycine max
  misc_feature (29)..(29): n is a, c, g, or t
  Peptide Sequence Number=SeqID_124029
atgtacttgactgtgttagaagatctatngggctgtgtgctcggacaacaggatgagaccggaaggaaagagcatgccgtctactacttgagcaagaagtttacagattgtgagtccaggtactccctacttgagaaaacttgttgtgcactagcctgggctgccaagcgtcttcgtcactacatgattaaccacaccacctggctaatatccaagatggacccgatcaagtatatctttgagaaacccgctctgacaggaagaattgctcgttggcagatgttgttatccgagtatgatatcgaataccgcacccagaaagcaattaagggaagtgttcttgctgatcatttggctcaccaaccaattgaggactatcaacccatcaagtttgactttcctgatgaagagattatgcacttgaagatgaaggattgtgatgaaccattgctgggagaaggtccagatcccgagtctagatggggtttgatctttgatggagccgtgaatgtctttggcaatggaattggggcagttattatcactccggaaggtaatcatctccctttcgctgcaaggttacagtttgattgcaccaacaatatggcagaatatgaagcatgtatcctgggcattgaaaaagccatcgacttgagaatcaagaaccttgacatttacggggattcagctctcgtaatcaaccaaatcacaggagaatgggaaactcgccaccccggcttgattccatacaaagattatgcgaagcatttgctaaccttcttcaacaaagtggagcttcaccacatccctcgtgatgagaaccagatggcagatgcgttagcaactttatcctccatgtacgaa

SEQ ID NO: 7252 - DNA, 519 bp, Glycine max
  Peptide Sequence Number=SeqID_124030
atggcggctgataccagcagcagcgcgggttccaaaatcgatagttctatgaaaaaagtcgatggctttatggatgacagcggcatcaccgccaaagccaaagctgcgctggtggacgatgaagcgattaaaagtacggatatctccgtcaaaacgcagcagggtgtggtgacgctgagcggttttgtcacttcgcaggaccaggccgagaaggctgtggcgctggtgcagaaggtggaaggggttaaatccgtcagcgacaaactacacgtcagagacagcaaacagagttcattgaaaggttatgcaggtgatgcagcaaccaccagtgaaattaaagctaaacttttagcagatgacattgtgccatcgcgcaacgtgaaggtggaaaccaccgatggcgtggtacagctgtccggggaagtggcgaatcaggcccagtccgatcgggctgagaagatcgccaaagccattgaaggcgtgaaaagcgtgaagaatgacctcaaggtgaaatcttaa

SEQ ID NO: 7253 - DNA, 336 bp, Glycine max
  Peptide Sequence Number=SeqID_124031
atgtatacagagcgtaggcttgctttgagcactctaatttcttcaaagagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcaggctccctctccggaatcgaaccctaa

SEQ ID NO: 7254 - DNA, 243 bp, Glycine max
  Peptide Sequence Number=SeqID_124032
atgggttttcacccaacaaaactcaatttcgtgcctagcgatgcggatgaggcgccactcgatgtttccatttgcctgcatgcctttggtattgtggggtgtggttcgtttagtggtgtcaagtcttgcgaactgaacgtgggtggtctagtgcccccacattgttccttaaaatcggttgtctcggatgacgcttgccctggcgcttgctttgttcaacgcgatgctactactcttagttag

SEQ ID NO: 7255 - DNA, 420 bp, Glycine max
  Peptide Sequence Number=SeqID_124033
atgacaatgatagtagacacattaccagtattctactatggaaaatggtgggctacgcaccttcaaagctttgaggatttggtctttgccagtgaaaggatcgatgtgggtctgaaaaaaggaaaatttagtcatcctgcttggacgaatgagaaaactggggcaaatgaagagggtgagaaagagggagaaacccatgctgtgactgccattcctatacggccaagtttcccaccaacccaacaatgtcattactcagccaataacaaacctcctccttacccaccgcccagttatccacaaaggccatccctaaatcaaccacaaagcctgtctaccgcacttccaatgacgaagaccacctttagcacaaaccaagaaacaccaacaaaaaggaattttgcagcaaaaagcctgtag

SEQ ID NO: 7256 - DNA, 257 bp, Glycine max
  Peptide Sequence Number=SeqID_124034
tgacttcttttggataccgtaaggatcggaatggtcaatggctgaagaaagatgcacttcctcctcagcgagatgattctgccctcatgactgaagttcttttcgagttacggggtcttcgtacttatgttggcgaacattttgattctctggatactcgctttgccggcatggatatccgtctcacacagcttgaagaagatgtgggttatattcatcagagcctcgaccttccaccaccacctccaccttcttag

SEQ ID NO: 7257 - DNA, 862 bp, Glycine max
  Peptide Sequence Number=SeqID_124035
atggtagcaacaggaaattctttggcacttaatcgagatattcaggaggaacagactgttccagcccgataccgtcaagaatttcttacgattgcatgggaacaggttcatcttcgaagtatttttcccttccaatatttttctattggagcttctctgattccttttattgaacataatgatgccaatcgagctttaatgagttctaatatgcaacgtcaagcagttccgctttctcagtccgaaaaatgcattgttggaactggattggaacgccaagtagctttagattcaggggtttccgctatagccgaacacgagggaaacatcatttataccaatactgacaggatatttttatttggtaatggagatactctaagcattccattaactatatatcaacgttccaacaaaaatacttgtatgcatcaaaaaccccagttgacggcgaactcgctttgggaaaaaacgtctttagtagcttatatgccatgggaaggttacaattctgaagatgctgtactcattaatgagcgtctggtctatgaagatatttatacttcttttcacatacggaaatatgaaattcagactcatatgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatagattattacgagctatacttggcattcagaaacgtgaaattaaagtaggagataaagtggctgggagacatggaaataaag

SEQ ID NO: 7258 - DNA, 159 bp, Glycine max
  Peptide Sequence Number=SeqID_124036
atgcatatgacacagatgcaatttacgaatacgggagcccgagaaactgtctccttcttagatacaacgtctaggggtagcaaagtgccccaacaggggatcaagacagaacccatgtgcgatgcatatgcgaaaggcgcaacacgggaatgtacatag

SEQ ID NO: 7259 - DNA, 237 bp, Glycine max
  Peptide Sequence Number=SeqID_124037
atgcacgtggcacaactggtttctgatgccatctactgtttgcagggatcgcgcctgcaagacacccagtggacccaaagaagttcaacagggtcctggggttctagctctgattacgggcctctatcggttctacggagtggccgtcgccctcaacagggtcatcaggcccttattaacagggctttcatcgagaagtactacgcccccaggcaagcgcagggtgaggcatcatag

SEQ ID NO: 7260 - DNA, 489 bp, Glycine max
  Peptide Sequence Number=SeqID_124038
atgtggagccctctgaaagcgaggacgtgtagtcctctgaaggtgaggacgtgtaatcctctgaaggtgagggcgtgtatccctatgaaggcaaggatgtgcagccctctgaaggtgagggcgtgtagccctctgaaggcgaggacgtgtagtcctctaaaggcgagggcgtgtagccctctgaaggcgaggacgtgcagttctctgaaggtgaggatgtgcagtcctctggtggcgaggaagtgcagtcctctgaaggtgaggatgtgtagtcctctgaaggcgaggacttatagccctctgaaggcgaaggcgtgtagccctctgaagatgagggcatctagccctctgaaggcgaggacatatagccctctgaatgcgagggcgtgtagtcctctgaaggcgaggacgtgtagtcctttgaaggcaaggacgtgcaaccctatgaaaggcaagggcgtgcaaccctctgaaggtgagggcatgtag

SEQ ID NO: 7261 - DNA, 492 bp, Glycine max
  Peptide Sequence Number=SeqID_124039
gcatacaaagctgcatcacgtctaacaagtgccacaccacctcctgctcacgtgctaagccgtggtattggttggcaaggaattggaatcttgctgaatagcctttttggaacactcactggttctacagtttctgttaatacaattttatataaaaaggagataggcatatcaaagtatttttctgtaggggtctctctatttttctcaacgggaagcatctatatatatagtgctgaaagtgacaatgtgcagcgcacagaaaaactaacttccatcaaccagcagccacattgtgctcagacggtttccaacattatatatttggattcccctgctagtgttgggctctcttactccgagaacacaagcaaatatgccactggggatctgtgccactggggatcccctattcctatttctctcagctttgtcattttactcatttatggatataccaaggttctaatttctaaatggtcacaatgttaa

SEQ ID NO: 7262 - DNA, 2475 bp, Glycine max
  Peptide Sequence Number=SeqID_124040
atgggtccaaacattgattttgatacactttggggtaatatcggatatgagaaacttgaatacaacaccaacaaagaagtcatgaggttgatacttcaaagccaacaacaagttgacaacacggtttggtgcaaacatagaagaaaagtgaagattgtgcatgcaaaggcatgtgtttcttcgagttgtaacggccctagcaatcatgacgagtatttcccaattaaggtagatgcaatgtgtagaaatggcctatcacctttggagaagtgtattgttgctcttcgtatattggcttatggctcacctgctaacaatgtggacgagtatattcatattgttgaaaccactatagtagactgcttacaaagattggaaggtgaaaaggtattggatccgcagctatggcacgcgtgtgcaggtggcatggttcagatgccgcaaatgaactccaaagtcttctacttcccacagggtcacgccgaacacgcccacaccaacattcatctgaggcttccaccattcattttatgcaacgttgaagcagttaagttcatggcgaacccagaaaccgacgaagtgttcgcgaagctgagtttgcttcctctcagaaactcggaactcggtgctgactcggacggtgctggtggtgatgacgtggcagaaccttcttgttgtgaaaagcctgcgtctttcgctaagactctgactcagagcgacgccaacaatggtggggggttttcggttccgcggtactgcgcggagacaattttcccgcgtctggactacacggcggagccgccggtgcagacggtggtggcgaaagacgtgcacggcgagacctggaggttccggcacatctaccgagggacgccacgtaggcacttgctgaccacagggtggagcagtttcgtgaaccagaagaaactcgtggctggggattccgttgtgtttctgagggctgagaatggtgatttgtgtgttgggattcggagggcaaaaaagggaattagcgagggttcaggttcaggttcatcatctgtgtggagttcagcttctgggtctggaaatggaaattgtgggattgggccttatgggcctttttcttttttcttgaaagaagaaaacaaaatgttaaggaatggttgtggtgggaatttgagtggaagggtgaaagtgagggctgaggatgttgttgaagctgtgactcttgctgctagtaataagccttttgaggttgtgtattacccaagagctagtactcctgagttttgtgttaaggcttctgctgtgagggctgctatgaggattcagtggtgttctgggatgaggttcaagatggcctttgagactgaggatgcttcaaggataagttggttcatgggaaccattgcttctgttcaggttgttgaccccatccgctggcctaattccccttggaggcttcttcaggttacttgggatgagccagatttactacaaaatgtgaagcgtgttagcccgtggcttgttgagttggtatctaacattccactcattaatttcacacccttctctccaccaagaaagaagctgcggccacaacacccagacttcccccttgatgttcaatttccaataccaatgttttcaggcaaccagcttgggcctaacagccccttgtgtggtttttcggataatgctcctgcagggatacagggagccaggcatgctcaatttggaaaatctctatcagatctccaccttaacaataaactgcagttggggatgcttccaactaatatccatcaacttggagtgtataatgagatttcaaatggtaacatgatgaccaaccatgataagagcaaagaaagtttatcatgctttctgaccatggggaaatctaccaagagtttggagaaatctgatgatgttaagaaacaccagtttttgctttttggtcaaccaattctcactgagcaacaaatttctagctgttctggagatgtgttgtctcaccgaaaaagatcggtaagtgatgataaggacaaagcgaagtgccttatggatgactcgcaatctacactctcacagcagttttcaccaggaaaagcatcttctgctgagttctcttggcaacttggcttggatactggtcattgcaaagttttcttggagtcggaagatgtaggaaggaccctagacctatcgctgtttggttcttatgaagatctgtataggagacttgccatcatgtttgggattgaaaggtctgagattttgaaccatgtgctctaccatgatgcagctggtgctgctaagaaaaccggagaagaacccttcagtgacttcatgaagacagcaaaaagattgacaattctgacggattcaagcagcaaaaacattaaaagggcctttattacaggaactcgtaatggtgaacatggactagatgcatcaaacaaaacaggccctctgagcatatttgcttaa

SEQ ID NO: 7263 - DNA, 2598 bp, Glycine max
  Peptide Sequence Number=SeqID_124041
atgttctggaagctcgcctctatctcttcctcctctcccgtggaggtaatattggacaaggagaacttcactttagaagaacttctagatgaagaggaaataatccaagaatgcaaggccttaaacagtcgtcttatcaactttctgagggatagagctcaggttgagcaattgctacgctacatcatagaagaaccaccggaggatgctgaaaacaaacgggtcttcaagtttccattcattgcctgtgagatctttacatgtgaaattgatgtaattttgaagaccttggtggatgaagaagagctcatgaacttattattctccttcttggagtctgatcgttctcatagtaccttactggctgggtactttagcaaggttgtcatttgcctaatgatacgaaagacagtaccacttatgaattatgttcaagcccatcagcatgtttttcgtcaactggtagatttgataggcattacatccattatggaggttttggttcgattagtaggtgctgatgaccatgtatatcccaattttatagatgtgatgcaatggttagctgagagcaacctgcttgagatgattgtcgataaattaagtccatctagtcctcctgaagttcatgccaatgtagctgaaactttgtgtaccataactcgagttgcatcatctactctagctattaagctttcaagtccaagttttgttgcaaaaattttgggttatgcattggaagattcacaatcaaagtctagccttgtcaactcactttcagtgtgtatttctttgttggatcccaaaaaatcagctatttcatctccactttttcattcattccgaagtcaaaacatgtatgagccaccaattcctgtaaatccagatactattggtgcaatgctacctaaacttggtgaattccttgtgcttttggatttgtcatctgataataaggtactgcctacaacatatggtgaattgagacctccgcttggcaagcatcgattaaagatcgtggagtttattgcagtacttctaaaaactggaaatgaagtggcagaaaaagaattggccaactcaggaaccattcaacgagtcattgatcttttctttgagtatccatacaataactcattgcaccatcatgtagaaagtatcatatcatcatgtctggagagcaaatctaatgccatcattgatcatcttcttcgagattgtgatttagttggaatgtttctccaaacagataaacattgtattctttctgccgaaagcagtcagcccacagtacctgctgctggaaaacagggaacacgggtaggaaacattggacatattactcgaattatcaataaacttcttcacttgtctcataaccaaagccacattctggcatgtctccaggagaatagtgagtggaatgagtggcaagctacagttcttcagcagcgtaatgtggtcgagaatgttcaccgttgggcttgtggacgtccaactgcattacaagataggatgagggatagtgatgatgaagaccttcatgacagagactatgatgttgcagctttagcaaataatttaagccaggcttttagatacaaaatttatggaaatgacaataatgaagaggaacatggtggtcttgatcgagatgatgagaaaatagggagaaaccctcatttcaaagatctgaatcacaagttcatcactgatgtctactttgacgatgattctgctgaagtagtcatatcatcccttagacttggtgatgatcaagggagtaatttgtttacaaattccaactggtttgccttccaagatgacagaattggtgatgcacctgggggcacatcatcctctgagatgatggatgagataaaattgaatgcagttgcaaatagtggtagcaacagtagtgatgatgaggtagtggttggagaggatgaagaattggctgacagcaaaaatactgtgaatggtacatctagcttaagtgcagacttctttagtggattgactgccagtgattccatgaatgggggcactttaaactttgaaagtgagaagacaagtccttcaaatgatatgggattcttcaggtttgaggcaccagacaacgaggacttgtttggagataggcctttacctgattgggttggatggggtgaaccatcagaaatgcaagatgctggctcaagtatgaacccctttctggataatgacgagtctggtaggcctcaagtaggcagccctaatcttagttctccttcaaatggggaatccgtaccttcaaatgggttgccaactactagcgattctatcaatgggaacagtgactcaagtccaacatctgtagcggtaccctcgctatttgaagaggatgtggaatttgtaggtgtagaattagaaggtacagagaaggcaatggaccaggctctcaaagaagggatagttggggaagcaggaccattgaaaagaaacgtagtctcaaaagttccagataaggaaaattctgaagaaggcagtcctggtgtgaaggagttcaacgatgcaaattactggagggttgacaacgaggttgctgttctagagtga

SEQ ID NO: 7264 - DNA, 249 bp, Glycine max
  Peptide Sequence Number=SeqID_124042
atggagtttttggatttgccccttgactttgaggatgtggaaactgatgctgtggaggaacaagattgggatgctcagttcaacaaattccttgaagacccacccccaccacttggatcatttccactacaatcctctgagttctgtggacaaactcaacatgagaatgtgaaactcggcaagagctttcgtgcttctgatctgtacttttcaatgaatgtaaccttcactctagacctacttagatag

SEQ ID NO: 7265 - DNA, 273 bp, Glycine max
  Peptide Sequence Number=SeqID_124043
atggtctcaaagaagctgaggaaaaaggatattcccatgctagctaacagaattgagatgaagagatcctcgtcacaggagtcagttgcactcaggaaatgcttacattgtgaggtgacaaagacgccgcaatggagagagggaccaatgggtcctaagaccctatgcaacgcctgtggggttcgataccgatctggccggctatttgctgaataccggcctgcagctagccccacttttgtatcatcattgcactcagactctcacaagaag

SEQ ID NO: 7266 - DNA, 704 bp, Glycine max
  Peptide Sequence Number=SeqID_124044
gcactcatggcttaccactatgacccccaagtctctctccctgagctctcctccatctccctctacactccaaaacttgttgaagttgtcaaagagaggccaaaatggaatgccacagaattcttcaaacacatccacccctacacaccgtaccgtcatcaactaccttgcagctggggggcagtgttcttccccaagcattggagagagttctatgtgtacatgaacatgaggttcactgaggatgccaaggccaacccagttcaaattccaaagtctagaacaaatggatggcaagcttcatggaagaagttcctcatagacatgatgtaccttagagggtatgttagtctctacccaaatttcccacaacaagcaagcttttcaaccaaccatatggaaccaggggcacacattagtgcaaaagacaatgtggttaagcacaacaaacgagactttgaggtgccactaatgaaagaagactttagaaactttttgccagcaatgaaaatgcctccagcaccaaggcttccatctctgaacctcttcaatcaaccagtttctctaaagggtctcaaagctgctggagctaagttgggacaagatgtgcttagatgtgacaatgccactgaggttgttgctgttgacaaagatactgtgggaaattgggtcagcgattttgctgtcatgggaataggaatgag

SEQ ID NO: 7267 - DNA, 2343 bp, Glycine max
  Peptide Sequence Number=SeqID_124045
atgatgtatgtcctctttgtgtgtgaaggtggctatgggactcttgaggagcttctagaggtgataacttgggctcagcttggcatccatgataaaccggtggggttgctgaatgtagatggatactacaattccttgttgtgtttcattgacaaagctgtggaagaaggcttcattagccccaaagctcgccacataattgtatctgccccatcaacaaaagagcttgtcaaaaagatggaggaatattttccacaacatgaaagagttgcctctaagctaagctgggaaactgagcagatagattactcctcaaattgtggcatgtctagagctgacttcaatctagctgtgaagcctaactactcttctgctcaatgtgaattctggttagaggacattgaatcatctactcagctttgtaaaatgggatttggtcgaaattcgacctcgagaagcggtgattacttggaagggatgctcaatgactatgttgggggaaggaacaaactgaaggctcagaaaagtgctgccacaactaagtttgtggcagcactcacgtgccttcaatttttctttgcagtctatgcaacattcctattgtattacatgggcccttccatcgatttaagaaccaagccagagttcacatgggctacaaaaattgcccaacaatggaagcaactcatgatcacaccccatgttattggtcactaccaagaagctgcttcctctctcatcaaggaggatcttcttcccacaactccttcccaagtgtgtgagaatgagaaaatagacttcatgcaaaagaagtccaatgatgtccaaatgataaagataaagagagagctctacgatgaggtgttgaacttccaaagcaaaaccattggcaccgagactctccaagagctaatggcaatgaaatccaaatgggacttaaagggtccaaagaggccaaaaatcacagtgttgctaaaccacttcaagcgaaagacactttgtgcacagcttgattctttgctccaacaaaccctcccttttcatcatgtttgggtgctctcatttgggagccccaatgaggtctcattgaagagaattgtggacacctataacgactcgagaatcagcttcataagctcaagctatgatttcaagtactatggaaggttccaaatggctcttcagactgaggctgatcttgtttatgttgttgatgatgacatgattcctggaaggaagatgctgcagattttggcacacgtggctgggacagacaagtacaagaattctgttttggggagtattggaaggatattgccctttagacagaaggatttcactttcccaagttacagaaaatttcggtctaaggaggcagggttgtatttgcccgatcctgcttatgatatcactgttgataaaattgtgcaggtggattttctttctagttcatggtttctctcagctgatcttgtcaagacactcttcattgagacaccttttaccttctcaactggtgaagatcttcacctcagctatcagcttcaaaagtacaaaaatgctggctcatttgttcttccagtggatcctaaggacaaggaaacttggggtgatagtgaacacaggcttgcatatgtgtctgaaaccacagtgattttcaaggatgtggttcaagtcagagatgatcaatggtggaaagcactttccacaggttatgtgactcagtgggctgcaatgtaccctcaaaaaattgatgcactcttctatgctcactcagttgatgaagtgaaagtccttgcaccacttcttgaaaagttcaggtccacagttggcaagaaggcctacattgttgtctctggaggcaattactgcccttgtgaagatgctgcaagagctctcaaatggcctgcattggtctgcaaggaacgccggtttaagatttttgatttggccgtcgaagccctttcaggggtgtcagattctgaggcaccagtgatacatgcagtgtacaccagcttgaagggtttgatcaaaattcacaatcccagtttagtgatcagtgtggctgaaattgaccctcatgtgagaaaagctctcaagatggcctcagaaaccaactcaaatggcaccacatttgttcttttaccaagttcttcagtttctcaagttctttggatggctgatctgcgttcaacagcattaccaaattggaatcggatgaggatctctgtgaacatcatcacacaaaatagagtcaattcactagcaaggcttctcaaatctctcagcaatgcctactatcttggagatgaaatccccattacttttaacatggatagcaag

SEQ ID NO: 7268 - DNA, 222 bp, Glycine max
  Peptide Sequence Number=SeqID_124046
atgaggggcaccgttcatgagcctcaagtgaacataggggccgatcaaaagttctcacccatcgaggtttttaacaaaaaaaagggggacaagccctggaatttcaatagattgattaattatcaaacgactccattcccgtcactccaaaacggtcaagtgactaaatcaaaaagaacatacactctgagggagttcccgaagagatttgcaaaaagatag

SEQ ID NO: 7269 - DNA, 1958 bp, Glycine max
  Peptide Sequence Number=SeqID_124047
atgatgctgaattagcaaaattgccaacaacaaatggcggcaatggaatcaagcctaatgaaacacaagtagctgagactagcggcgaaaagggtctgaagaaggacacaaggaagttcctgaaggctagagtattgtcaagagtattctcagaggattatgagaaagttagaaaaagaacattattagatccccgggcacaaaccattcaccgttggaacaagattctcttggtagcatgtttagtttctttgtttgtggatcctctattcttttatttaccactagttcgagatgaagtatgcatcgatattgggacaacacttgaagttttcctcacaatgataagatcaatggcagatgtgttttacatgattcagattctcttgaagtttcgtacagcttatgttgctccttcttctcgggtatttgggaggggagatcttgttatagactcttctaagatagctactaggtacctgatcaagggtttttggttagactttgttgctgcattgcctcttcctcaggcgttaatttggattgtcatccccaatcttggaggttcaaccatggcaaacacaaagaatgtgcttcgctttatcatcattttccaatatttgccaaggctgtttctgatttttccactttcatcccaaattataaaagctacaggggttgtgacagaaacagcttgggcaggggctgcttacaacttggtgctttacatgttagctagccatgagctagctggtaccttctatcaattgaaagacaagaagcatgctggaggagtgtctgcgatatggaggagccatcttgtcaatatggattctttgactgcaaaagggttgaagattcgctcagggcgtcctgtgacatcccaagttacaacctcgtcattctttcataagtacttcttttgtctttggtggggcctaaggaatctgagttctttgggacaaggtcttcttactagcacttttgttggagaaataatgttcgccattgttgttgcaacccttggattggttcttttcggattgctgattggtaatatgcagacatacctgcaatcaacaactgttcgcttagaagagtggagggttagaagaactgatacagaacaatggatgcatcacaggcagcttcctccagaactaagacaatctgttcgcaaatataaccaatataagtggctggctacacgaggggtagatgaagaagctcttctcaaaggacttccagctgatctgaggagagacatcaagcgccacctttgtctggaactagttcgacgagtcccattgtttgatcaaatggacgagagaatgctggacgcaatctgcgagagactaaaacctgcactgtgcacagaaaacacataccttgttcgcgagggagatccggtgaacgagaccctcttcataatcagaggccaccttgattcctacaccaccaacggaggccgcaccggtttcttcaactcctgccacatcggccccggcgatttctgcggcgaggagctcctaacatgggccttagggtcccgtccaagcttcattctcccctcctctactcgcaccgtcaaggccatctcagaagtcgaagccttcgctctcatggccgaagacctcaagttcgttgcgtcgcagttccgaagactgcacagcaaacaactcagacacaagttcaggttttactcgcaccagtggagaacgtgggctgcatgtttcgtacaagctgcatggaggcgatacaagaagcgaaaggaagctgcggaactgagagcgagggagaatgttcatgagggtgagacagcagcgtatagatcagggttggtggttgtgtatgctacgaggatggctaggaagggtgtgcatcatgtgcgttctggaacagattctggagtttctttgcagaagccagaagaaccggacttttctgttgatgagtga

SEQ ID NO: 7270 - DNA, 681 bp, Glycine max
  Peptide Sequence Number=SeqID_124048
atgcgctgtctgagcaagcgagggatagtccttctccgccgactcagtatacagtctcttcacatctggcggtactgtctccgtaaacagctggaaatagccgccgctcagcagcggcgtggcagcctcatcgtcgtcgctctcctctatcgaatcgtgagccagttgcttctcaatcagggccagcagcgcatcaagcagcgcattgctgagattgaaattgacccggaattgctggtcgttgagggcgtgatgccccatttcgtcgcccgccagcaacagcgcccagccgtgaaggcgtgccgggtcgtccgtcaccagcacatcatgctcctgcccggacaagcgttcgtccgaggtcaggcaatttgccccccagttctcgaggtggcggcagacaattttgtgtacgtcctcgaccgcgatatccaccagcgccgtcacgccttccagcagtttctcttcctgctcgctctgctgctccagcgccagcggcagctgaatgttgtagcgcgtgccgatatccggtttggcgataatctccagctggccgcccatctgtttgcacagctgcttacacaggaaaaatgccatgccagacgcctgaccgtaacggtcctgcgtggtttcgccaaggtaagggaaatcgacgttggccagctcgtcgccggtcaggcctga

SEQ ID NO: 7271 - DNA, 132 bp, Glycine max
  Peptide Sequence Number=SeqID_124049
atggcattaggggtcatggcaactcgcccaggcgagttgttgcttcaacctgaaggaagtaaagataaggacactaatttcattcgagcgaccttgctattcgaccgagcaactggtgaaccaaggaagtga

SEQ ID NO: 7272 - DNA, 1161 bp, Glycine max
  Peptide Sequence Number=SeqID_124050
gtgatggatatccaagccgcatacagttgccttttgggtaggccatggatccatgaagctggggccgtgacatccaccttgcatcaaaagctgaagtttgtcagaaatgggaaattgatcactgtgagtggagaggaagccttgttggttagtcatttgtcagctttttcctttattggtgctgatgaaacagaaggaacctctttccaaggcctgactttagagggtaaaaagccagagagaaatgaagtatcttttgctacttggaagagcgcacagaaagtggtgcaggaaggaacaggtgtaggatggggaaaagttgtgcagttgctggagagtaaaaaccgtgaaggactaggatttgcttcttctgcaggatccgcaacgaacagtgttggatcaagctccattactagcaccttttgtagcgccgggttcatcaacaactcgccagaagccaatgctgtcttggaagatgctcctgaagagatagtgcttgcatttgtcacacctggaaaacttgttcgcaactgggacgcggttgacatcccttcagtggttcatgcatcaaaactaggcatttatgagcccgttgaacataataaccctgcactctctcccaactacgaatctcctgtctacgaggctgaagaggaggaggatgatgaaatcccgaaggaacttgctcgattattggaatatgaaaagaaaaccattcggcctcatgaggaggtagtagaggtgattaacttgggaaccgaggaagataagaaggaagtcaagattggggcatcgcttgaggcaactgtcaaacgaagggtgattgaattactcaaagaatacgtcgatgtgttcgcatggtcgtaccaagatatgcccggcttggatccccgtattgtggagcaccgtttgcctttgaagcccgaatgcccaccggtcaaacagaaactgagaagaactcgccctgacatggctctcaagatcaaagaggaagtacagaagcagatcgatgcaggttttcttgtcacatcagagtatccccaatggttagccaacatagtgcctgttccaaagagggacggcaaggtcaggatgtgcgttgactaccgggatttgaacaaggctagtccgaaagatgactttcctctacctcacatcgat

SEQ ID NO: 7273 - DNA, 411 bp, Glycine max
  Peptide Sequence Number=SeqID_124051
atgctatgtgcagagcctgcacaaggacaggtgatcatcatgaagcacttacagagctcaggcctgcagcctatgatgagcgtaaaggagttccttagccaggtggcttggcctggagtccagccttctccttcgggaggggataaggcctccgcagcccaagagcctgtgctagaggatgacgagcccgtccctcctgagccatttgtttatgagactgatccaactagtgctcaggaagaggtagcatcaccagagcccgttcctcacccatcaccagcaccagtccttgatgattcccagccatttgccccagcaccagtgcctgatcagcctcttgctcaggaccctccagctgcaccagtgttggaccttaacgagcatgcagaggatcatttgcagaatgattga

SEQ ID NO: 7274 - DNA, 1214 bp, Glycine max
  Peptide Sequence Number=SeqID_124052
atggtagctgtattcaacaaagagcttttgagctgtgaagatgctgcaaaatttcaagaggaaccaaactcaccaacatctgaatgggtggtaaccatcagggaaaaactagatgaagcaggtcaagatgatgtggcaagttcatggtccaagctatcaatctacaaaatccctcactaccttagagatggtagtggagatgacaaatcttttgcaccccagattgtgtccataggtccttaccatcatggcaagaagcgccttcgcccaatggattgccataaatggcgttcccttaaccatgtcctcaagcgtaccaagcatgacattgagctctacctcaattccatgaaggagattgaagaaagagctcgctcctgttatgaaggaccaatcagtttaagcagcaatgagtttgtggaaatgcttgttcttgatggttgttttgtgctggagctattcaggggagccacagaggggttcaagcaacttggatattcaaggaacgatcctgttttcgcaatgcgtggatcaatgcattctattcagagagacatgatcatgctagaaaaccagcttcccttgttctttgaccctttaatgccaacagatgaacccttgacgaaaagtgacagaaacaaattggaatcatcacttggaggcactaacacctttgaccctttatctgatcaagaaggtcttcactgcttggatgtgttcaggagaagtcttttgcggtcaggacctcaaccagatggtaaactgcaaataccgcggctcttgatccacgacggtactaagtctttgttcctcaatctcattgcctttgagcagtgtcatcttgattgcagcaatgacattacatcctatgttatcttcatggacaacttgattaactccccagaggatgtggggtaccttcattaccgtggcattattgagcattggcttggtagtgatgctgaagttgcagacctttttaaccgcttatgccaagaggttgtgtttgacatcaataacagttacctttccctattgtctgaggaggtgaatcggtattacaaccatagatggaatacttggtgtgcaagcttgagacacaattacttcagtaatccttgggccattatatctttggttgctgctgttgtcttgttgctacttactcttgcacatacctactacagtatatatggatattatagaccagccag

SEQ ID NO: 7275 - DNA, 231 bp, Glycine max
  Peptide Sequence Number=SeqID_124053
atggatgaggaagagccagaaaggggtgtcaaagtccaaccaaagaagctatctggctggagacagagagaaaaagacatgaaaaacgttgtgggggcacctgacagcaagctctttttcgactctgatttgggatcctatttcaacctttccagttaccgcaagtggtattcagctagcatggtattttctttggtttcttcaaatgcatattcttttgaaggtaactag

SEQ ID NO: 7276 - DNA, 786 bp, Glycine max
  Peptide Sequence Number=SeqID_124054
atggcacgcagagacaaattatggtcattctgcgcccttttatcatccagaggtggcgggtccgatgacatgcggagacaaattatggtcattccgcacaccccttttgccattcagacacagtcgtgtccgatggcacgcagagacaaattatggtcattctgcacccttttgtcatctagaggcggtgggcccgatgacatgcggagacaaattatggtcattacgcacatccttttgccattcagacacagtcgtgtccgatggcacgcagagacaaattatggtcattctgcgcccttttatcatccagaggtggctggtccgatgacatgcggagacaaattatggtcattccgcacaccccttttgccattcagacacagtcgtgtccaatggcacgcagagacaaattatggtcattctgcacccttctgtcatccagaggcggcgggctcgatgacatgcggagaaaaattatggtcattccgcacaccccttttgccattcagacacagttgtgtccgatggcacgcagagacaaattatggtcattctgcgcccttttatcatccagaggtggcgggtccgatgacatgcggagacaaattatggtcattccgcacaccccttttgccattcagacacagtcgtgtccgatggcacgcagagacaaattatggtcattctgcacccttttgtcatctagaggcggtgggcccgatgacatgcggagacaaattatggtcattccgcactcacttggtcagtcatacacagtcgtga

SEQ ID NO: 7277 - DNA, 210 bp, Glycine max
  Peptide Sequence Number=SeqID_124055
atggagaagaggacagagagaaggagaagacagcgcgaaggagacgaaacatacctaggtatggtggcgaaggagaagaagcagagacttgtgacgatgctcgagtgcgatgaagacgatgctcgagtgcgacaaacacgatgctcagatgcagacaaggaccttgaaggtagacagagattagaagaagaagagagcgcgaaagcttag

SEQ ID NO: 7278 - DNA, 186 bp, Glycine max
  Peptide Sequence Number=SeqID_124056
atggctactcctatgagtattgcttgctatctggataaaaatgaaactggtcagtcaatagacataaagaaatatagaggatactctgattctgattttgtcggatgtaaaactgatagaaaaagcactagtggaacctatcatttcactggctctgctctagtttcatggcatagtaaaaaatag

SEQ ID NO: 7279 - DNA, 282 bp, Glycine max
  Peptide Sequence Number=SeqID_124057
atggcgagggcgtgtagccctctgaaggtgaggacgtgtggtcctctaaaggtgagggcgtgtagccctacgaaggtgaggacatgcagtcctctgatggcgagggcgtgtagccctctgaaggtgaggacttgtggtcctctgaaggtgagggcgtgtagccctacgaagattgactgtccttttgaaagaggtgatagtccatgcaaccttatcctatcttttgcaaatctctccgagaactccctcagagtgtgtgttctgtttgatttagtcatttga

SEQ ID NO: 7280 - DNA, 673 bp, Glycine max
  Peptide Sequence Number=SeqID_124058
ctggtttcagtatgagcctgaatccggccagctcctgatcaggaacatcaaagcggtgctgatcgaggcgtcggacaaaatcgagctgaataccgctcactttgtcgtgaacgctgaccagacgtggcttaacagcccgaccgtgatcaccggtgataccgcgattcacggcggtacggtgctgaacggcggcgcaaagattaacggcgacgtaacgcaggccggtgggcaaatgagttcaaacggcgtggtagttgacgaccataaccacggcggcgtccagcgaggcggcagcagaacggacgtaattgacctttcacagctgccggcaccggagattgttgaggtgccggactttgagacgctgctggctgagcgaaaagcggcgctgatcgcgctttatccggcagagcagcaggcggccgtgcgccgcgtgctggcgctggaatccgacccgatggtgaaaatgctgcaggaaagcgtgtaccgcgaaatcctgctgcgccagcgcattaacgaggcggcgcaggcggttatggtggcctatgcgctgggcagcgatctggaccagctggccgccctgaataatgtggaacgcctgaccgtgacgccggccaaccctgacgcggtgccgccggttgatgcagtgatggaagccgacgacgccctgcgc

SEQ ID NO: 7281 - DNA, 726 bp, Glycine max
  Peptide Sequence Number=SeqID_124059
gcatggttaagtgatcctactcacattaggcctagtgctcagatttggagagcatctggaataactagtgaattacaactctattgtaccgcaattggtgcattggtctttgcagccttaatgctttttgctgggtggtttcattatcacaaagctgctccaaaattggcttggttccaagatatccccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggaggtctatggctgaccgatattatacaccatcatttagctattgcaattcttttcttgatagcgggtcacatgtataggactaactggggtattggtcacagtataaaagacattttagaggcacataaaggtccatttacgggccagggtcataaaggtctatatgagatcctaacaacgtcatggcatgctcaattatctattaacctagctatgttaggttctttgaccattgttgtagctcaccatatgtattctatgcccccttatccatacctagctactgactatggtacacaactgtcattgtttacacatcatatgtggattggtggatttctcatagtcggtgctgctgcgcatgcagctatttttatg

SEQ ID NO: 7282 - DNA, 288 bp, Glycine max
  Peptide Sequence Number=SeqID_124060
atgactcacacaaagaaaactggtcaaatgacatctgaggctgcaaaggaaattgcagacacgattaccaatattgtttctcctgttgactacaagattccttggaggagcaggcctcatagggaagctttatcgcccatggacatcaggatgtatagactgcttccattgggcgaccaaagcaccctggtcgtgcccatgctgctgagtcgtgtgacaataaaacactactttggatggcttcaaggggctcctgcacctcttcgtccatggctgctaaagacctag

SEQ ID NO: 7283 - DNA, 138 bp, Glycine max
  Peptide Sequence Number=SeqID_124061
atgggggcatgccacattgtccccatcctcttgcaatttatgtccaaacatgcgctcaccaagtgctcggtgaaatgccccaatgatgtacagcataggagattcaaaataggtgcccaaatgcaattccaagcttag

SEQ ID NO: 7284 - DNA, 169 bp, Glycine max
  Peptide Sequence Number=SeqID_124062
tgctttgaaaggattcaacgacagccaaggaagtaaatccaaggctgctactagatggattgtagttaaatattttactgatcaaataccattagaaccaaagagaatgaaggcaatttgcattcagtgggcaagatattatttgaaagttaaaaatcaaacactatga

SEQ ID NO: 7285 - DNA, 1077 bp, Glycine max
  Peptide Sequence Number=SeqID_124063
atgtcctcaccttcagagggctacacgccctccccttcaaaggaccacacatcctccccttcagaggactacacgtcctcgccatcagagggctacacgtcctcaccctcagagggctacacgcccttacctttagaggactacacctacacgtcctcaccttcagaggactacacgtcctccccttcagaggactacacgtcctcgccatcagagggctacatgtcctcaccttcagagggctacacgccctcgccttcggaggactacacgtcctctccttcagaactacacgtcctcaccttcagaggactgcacatcctcacctttagagggctacacgttctcaccttcaggggactacatgtcctcacagtcagagggctacacgccctcgccttcagaggactacacatcctcgccttcaaaggactacacgtgctccctttcagaggactacacgtcctcgccatcagaaggctacacgtcctgaccatcagagggatacacgccctcaccgttagaggactacacgtcctccccttcatgggactacacgtcctcaccttcagagggctacacgcccttacctttagaggactacacgtcctcgccatcaaagggctacacgccctcaccttcagagggctatatgccttcaccttcagagggctacacgtcctcaccttcagagaactacatgtcctcgccttcagagggctgcactccctcgccttcagaggactacaggtcctcaccttcaaaggtctacacgtcctccccttcagaagactacacgtcctcgccatcagagggctacaggtcctcaccatcggagggctacacgccctcgccttcagaggactacatgccctcgccttcagaggactacacgttctccccttcagaggactacacgtcctcgccatcagagggctacatgcccttaactttagaggactgcacgtccttggcttcagaggactacatgtgctaacctttagagggctgcacatcttcgctttcagagggctccacatctgcgcctttagaggacttaaggtcctctgcccttaa

SEQ ID NO: 7286 - DNA, 765 bp, Glycine max
  Peptide Sequence Number=SeqID_124064
atgggtggggggggggggggaattgttggctttggtgctgagcaagtaattttggtacgagatgattctgctcgtaaggaagttttagactatgtggagaagcaggctcttgttttaaccattttagagtgcaaaggccttgagtttcaggatgtattgctgtacaacttttttggctcttcacctttgaaaaatcgatggagagtgatatatgagtatatgaaggaacaagaaatgttggaacctacagaacttaagtcgtatccaaatttcagtgattccaaacacaatctcttgtgctctaaacttaagcagttatatgtggctataactcgtacaagacaaagattgtggatatgtgagaatacagaagagtactctagacctctgtttgattattggagaaagaaaggtcttgtgcaatttaaagaactggatgattcacttgctcaagcaatgaaagttgcaagtagtcctgaagaatggaggtcacgtggcaaaaagctatactatcaaaataactatgagatggcaacgatgtgttttgaaagagcaggagactcttactgggagagaaagtctaaggcttctggtcttagggcaaatgcaaaccgtttgcatgatttgaatcctgaggattcaaatgcaatgcttagggaagctgctgaaatttttgaaggcataggaatggctgaatctgttgcccagtgtttttctgatttaggggattataaaagagttggttgcagatcagaacttgcttaa

SEQ ID NO: 7287 - DNA, 169 bp, Glycine max
  Peptide Sequence Number=SeqID_124065
ggtgagctcatcctctccctctgctgctgctgctactggctgctctgatttaggttcctgggctgcggaggccccaccccttccagaaggagaaggttgggctcctggccaggccacctgcacatcaaactcatccatgctcatgatggatggcaagcccgagccctga

SEQ ID NO: 7288 - DNA, 792 bp, Glycine max
  Peptide Sequence Number=SeqID_124066
atggagttttggggtgttgaggttaaggttggtcagaccgtgacagttgacccaatggatcctgtggattcatacatacacatatctcaggttgcgctcggagaggcgaaaaaggagaaacctaatgagtctgtggttttgtatttgaaagttggtgaacagaagattgtcttgggaaccctttctagggatggcattcctcatctatcgttggatttggttctggactccgattccgagctttcccacacttcaaaaaatagtgaagaggatgaggaacttgcattggagggtcaagataatgatgaaggtgcaaaggttaccaaaccttctaaacctgttcccaagattggtgccccagcaaaaacagctgatcctaagaaagacgagggtgatgattctgatgatgaatcggatgatgatcttgctggtgaagatgaatttggaagttccgatgagatggatgatgacagcgatagtgatgaggagagtgatgaagagacccctgctaagaaggtggatcagggcaagaagagaccaaatgagtctgcagcaaaaactcctgtttctgccaagaaagctaaaactgctactcctgaaaagactaatggtaagaaaaatgtacatgtagcaactccccatccttcgaagaaaggtggaaagacacccaacagtacaaaaggccagtctcccagttctgctggacaactatcttgcgcaagttgtaaaaagtctttcaccaacgaagtcggtctgcaacaacataagaaggctaagcatggtggtcagtga

SEQ ID NO: 7289 - DNA, 531 bp, Glycine max
  Peptide Sequence Number=SeqID_124067
atgggaacaaatcaaatcggcaagaggttctaccaagtcaaggttaaaagcctagataccaccagcatcaaggaattagggcggttgatggaacctctccaaatgcaagccttccgcaagacttacggaaagatcttagagttgaccatagcggaggtatccatagaagccattgcatcactcacccaatactacgaccagcctttgagatgcttcacgttcggagacttccaattagtaccaaccattgaagaatatgaggaaattctagggtgtcctctcgggggaagaaaaccatatctttcctccgggtgtctcccctctttgagtagaattgcaactgtggtcaaagattcagcgagaggtttggaccgcgtgaaacagactcgaaacggcatagcgggcctaccacggaggtacctagaagacaaggcaaggggtatggccaatctgatgcaatcctactccgcaagggcattggatagaaaaactccaagtagattgggccagagatgcaagagaaggccctag

SEQ ID NO: 7290 - DNA, 1194 bp, Glycine max
  Peptide Sequence Number=SeqID_124068
gaagccgccgatatcttcaaccaaggagagcgtgtagccattctcgtgggagcgggcgccctggcggcgacagacgaggttatcgccgttgccgaccgactgaacgccggtgtagcaaaggccctgctaggtaaggctgcattgccagacaatttgccgtgggtcaccggatccattggcctattggggacggagccctcctgggatttgatgcgtgactgcgacacgcttttgatgatcggctccggctttccctactcagagttcttgcccgaggagggcagcgtgaaagcggtacagatcgatatcacccccagcatgctttcattgcgctacccgatggacaccaatctgcagggggacgctgcgcaaaccctcaaagcacttctaccacatctcagacagaaggagggagagtggcgcaagagtattgaggcgaaggtcgcgaaatggtggaagacgcttgaggagcgggcacatgcagatgccaacccggtcaaccctcagcgtgtcacctgggaactttcaccccggttgcctgatggcgccatcatcaccagcgactccggatcgtgtgccaattggtatgcgcgggatttgaagattcgccgcggcatgatggcctctttgtcgggagggctcgcatcgatgggagcagctgtgccatatgccctcgctgcgaaatttgcacatcccgaccggcccgttatcgggctggtgggggacggcgcgatgcagatgaacaacatgtccgaactcatcaccattgcgaaatattggtcgagctgggacgaccctcggtgtgtgatttgcgttttcaacaacgaagacctcaatcaggtgacgtgggagcagagggtcatggagggtgaccctaaattcgaagcgtcccaaagcattccaaacgtcccgtatcatcgctttgcggaaatgattggactaaaggggatctatgtcgaccgcccagaaaatgtcgggccggcctgggatgaggcgctgtcgtctgaccggccggtgctgctcgaggtcaagacggacccggaggtcccaccgctgcccccacatttaaccttcgagcaaatgaagaagatcactgaaacactcgcaaagggtgatagccgggaggctgggatcgtcatgggcaccatgcgacaactgctttcttccttctggcccggcagtcttgagagctga

SEQ ID NO: 7291 - DNA, 547 bp, Glycine max
  Peptide Sequence Number=SeqID_124069
gcatctcactgaaacatgtatgcgagcggggaattctgatatctatggattcctcgagcctcagtccattcagaggtctgggcaatcgcagtttgaatctgaaagttacataaagagttggatgcagagttcacaacgcgatgtgtatcttggagcctacctaaatgggttccactgcagcggacattggcagatggtggtcatcctgcccaaggaacacttagttgtctggttttgttcattgcataacaggccagacaactaccttaaggggattattaatagtgctatcaagggtcttgatgatgctccacaacctaaatcaaaggctcctgctaggtggattgtcgtcaagtgtaatagacaaaaaggaactattgagtgcagcaactatgtcatgcactggatgtccaccatcattttaggaagttttagaaataattgggaagcgtattttaacgaccctagaccattggagcctgagagattaaaagcattgcggattcagtgggcacagttttatctccgagttagagatcaggcctag

SEQ ID NO: 7292 - DNA, 782 bp, Glycine max
  Peptide Sequence Number=SeqID_124070
gggttgttttgaatgctgaaggccatcctgggaagatgctcgagaaaagattaacaactcttgctcaggtgtggagtgttctctcgtactccaacctggctcctacttcccacacctcggacctgacagtagatcgagctaggcagatctttggcctagtctctcagatggatatgaatgtgggagctctcatctccggggttgcttctgacagcctggtcttcgaacgcctgagcccggtcattaacttagcctatatcaggaaaaactgttggaaccctgatgatctgacagttactatcagaggggctaggagagcgaggacaaggccaactgaggccccttccacatctacagctcctcctccaacacgtaccctagcagctccttctacctcagctcctgtagattttcggcgtttagaagccatgcttcaaagcatccatcaggggcagattatcttattacaaaatttacaaatggtggcacctccagactctattccttcggtagagcagtttaatgagtcggtagcctggcctggaactcagtcttttcttcatagggaagatgaaggttccacagcccaggtaccacaacagatggaggatgagtcatccgagactaccactccagagcccttggcaacagacccatccactcctgaggatcagactacactagtcctgtccctgaacacctctcctacagatacacttgtgcttcacttaacagacgaggaggatgttcagacacaggatactcaagaccgatcacaggat

SEQ ID NO: 7293 - DNA, 333 bp, Glycine max
  Peptide Sequence Number=SeqID_124071
atgggtattgtcatcatcaaaaagggggagattgtagaacaaaggatcaagctgaatgttttgatgatgccaaaggattacatgaatcatatgcttctcaaagatttactcaagacaaagcaattagagatattcaagatggatgatcaagacagttctagagtcttagaaaggatattaaataggaagggaattccaattggattagcaaaaggtttggccaagaattttaagttaaaaaagtgtttttcaacaaatttactctctggtaatcgattaccagaggatgtaatcgattaccagtggccaaaactgatttacaacagctattaa

SEQ ID NO: 7294 - DNA, 330 bp, Glycine max
  Peptide Sequence Number=SeqID_124072
atgtatgaatctggcgtgaaatcaggttgcaaaagcgttaacgggcggcgattcaaccgatcgacgatccagtcgctgcaaggcgtcatcagcacccagctggcgccaaccagcaccactgacagcgagccgacggcgatatcgggcgacggcgaaggcgcggcggccgaaatagcgcagcataaagcaggaaaaaataatcagcatcatgccgtggtcgccggggaagctgtcgctggaagcgtccttggtggggatgccggtcagctcgctgacgcgatagatattgtcgaaggtcagggtggggctcggatgcttcaccggcagcag

SEQ ID NO: 7295 - DNA, 234 bp, Glycine max
  Peptide Sequence Number=SeqID_124073
atgccctcctttcgcgatttggagcagaaatgggcactaaaggctgaagctttgttgggaaacaatggtggatgggagaaaaggagaagaaggctacttcctcacgtttctctgcgtctgtcgaggccagttttcgaaagtaatcaatatatatatcaaaacgctcagaataagaccccaagcgtggttcagaggttggtttcgttaaattttaagtcgcacgcaaaacaatga

SEQ ID NO: 7296 - DNA, 443 bp, Glycine max
  Peptide Sequence Number=SeqID_124074
atggttattgaccaatccctcttctatgatttgacccaattgtccagtgacggtgtaccatttgaaggtgcactggacgatgattggaagtttgatttttctgtgcatgatgcccgccggttggtttgcaccaaccaagcggatatgaccgaaaggcttcttgccggttcattggctcttgaaagccgcatccttcactatcttattgctcgtattttacttccaagattttcaaaccttgcacaagtttctgaggaagatcttatagtcattgctgctgtggttgcgtcctttggttaccgcaaagagcgtaatggctcttgggcaaaaaagggtgctcaaccaaatgatgatgaaggacaaataccagttgaaggagactcttctctccttcaaagtattttggacaggtttgatggactccaaacctatgttggtgagag

SEQ ID NO: 7297 - DNA, 181 bp, Glycine max
  Peptide Sequence Number=SeqID_124075
atggtggttgtagaggatgaaccctttctcttctttgatgtttctgccattagagaccattatgcatattctgatcagatagggcgccgtcaaggaggaagggaggaagaaggagctgcgcaaggagagagaaggtgcagtatatataggcagggacaagctatatcgattacagctcatg

SEQ ID NO: 7298 - DNA, 363 bp, Glycine max
  Peptide Sequence Number=SeqID_124076
atgggaacatctatagattccgctatcgggaaagtcaggcatggaatcacgctaagaatatttgaggatataggagtagggctattcttcgcaccgagaaaatcttttgttaatctcgttatctccacgggcgctgggttaagggcagaatcagaccttggggaaccgggtagagtcacttatttcattccctgggctttccatcctattatggggcttgaatgcgggtctttggctagagacggagactttcccagtgaaagcgctggcgttcagtttggttgcgtgctttccgatctctttcccttcctttctgtggtagcatggttaacggtagcatgtttgctagtcttgtcggactag

SEQ ID NO: 7299 - DNA, 540 bp, Glycine max
  Peptide Sequence Number=SeqID_124077
atgaattgtctatcagtgttcaccatcctctgcgcaatttgtgtgcactccatcaccgtcacctttgtggcatatccttccatcctcggcatgaaaaccagagagtgctccctctgcggcatcggcgtcggcaacggtgttctagtccctccgcggtatgtccccgagatgccggtgggggactcaacggaggggctcaggcaccacttcctgtggctcgaaaagagcatgaagaatggctcgcgcgctaataactccaacatgaagctcggtgttcacaccggcacccatgttgacgcgcccgatcacttttatgacaattactacgacgccagcttcgatgttgactcgctcgacctaacactcctcaatggccttgcacttttggttgatgttccacaggataaaaacattactgctgaggttatgaaatccttgaatatccctagaggtgtaagccgcgttcttttcagaactttaaacactgacaggttgttagagaatggagagggggtggccactggtggagtttatacttag

SEQ ID NO: 7300 - DNA, 980 bp, Glycine max
  Peptide Sequence Number=SeqID_124078
gtgcttccctggttgttctgttggtctatgcagatgacattttgcttgcttgcccaagtgctgcatgtgctcattctattcaggccaagcttcaagctttgttcagactgaagatccttggttccttacaatattttttgggcctggaagttgcaaagtctagtaagagcattgtcttgactcagcgaaaatatgccctttctctattagaggatattggttttcttggctgcaaaccatcctcccttccaatggatccaaatttaaagttcaacatgctcagtggtgatttattgcccgatccctcaatgtacaagcgtttacttggtcgcctcatgtacctaactatttcaaggtcgaatattacatttgctgttaacaagctaagccagtacatgcagcatccaaggacacctcatctagatgttgtgcatcatctcctacaatatatcaagggcactcctggtcagggtcttcattttccagcaagaaactccttcaacttatctgcctatgcagatgctgattggggaggatgtttggacacacgcagatcgacatctaattcctgtgtgtttctaggagatgctttaatatcatggaaatcaaaaaagcaacccactgtgtctaaatcttcagcagaggcagaatatcgggccctctcctcagtctctagtgaagtaatttggctaagacgattgctattgcactttgagattaccatcccatctgccatgcttttctgtgatagcaaacctgcaattgatctagcatccaatccagctcatcatgaacgatctaaacacattgatattgattatcacttcattcgtgagttagtgcagtccaacatccttaagcttgttcatgtgaaatctcaacaccaagttgttgatgtcttcacaaagcccttaatgcttctagctttctcttcctttatccgcaagttgggactcattaacatttactctccaacttaa

SEQ ID NO: 7301 - DNA, 168 bp, Glycine max
  Peptide Sequence Number=SeqID_124079
atgcaggtgaaactccaacctaaattgacaaagatgaatacttcatcagtacaacatagatcaattgccaaccttacaagccctgatggtttgctcgagttcaatgaattagatggcaacaggatcgagaagtacttcatcaaaactccaacatatcatattgattga

SEQ ID NO: 7302 - DNA, 1464 bp, Glycine max
  Peptide Sequence Number=SeqID_124080
atggatgattctaatccatttcttatacaaaccagtgataatcctggtttgagcctcgtcacttgtcctttatctggagagaattataattcttggaagaaagccatcaagatggcacttcttggcaaaaataaattcgattttgtggatggttccattcttggacctccattagagtactccagtcatgctttatggcagccaaatgacaacattgttgcttcttggcttctcaactctcttacaaaggagatacaacttgcacattcatgcacctgcaatggcatccatccttggcatgactatgcacaggtggagtatgccatacatttcttgatgggactcaatgaatcctatagttcaattcggggtcagattctttctatggatcctttcccttcccttaatcgaattttttctctagtggttcaagaagaaaaacaaagagagattggtacttttgtttctgctctccactccacaaatgatgcttcacaatctcatgcttttgttgttaaagattccagatatcagtctgatcacaagggtagtgctacttccagaaatcgacctctttgtgcacattgtggccgacttggccatactcaagataagtgtttcaagttacatggtttttctcccaattacaagaagaataaaccttcttcttcttatactaaaagcaaaacagtgaatcaagtctcaacatccacttctgttcctgactttcatctcactgctcagcaatatagccaacttatgagtttgcttcaagcacacacttcaaatgttgttactcccgatattgaatcttctaacactagtatggtcttgtctgcttctttaactaagtttcctcaaaattgttggattgttgattcgggtgcaagcactcacattgatctctttgattcctatcactatgtctcaaatcgaattgttaaattgcctaataatgcagttgtcccagttattgcagttggcaatgtgcatttatctccttctctaactctctataatgtgtcttttattcccaactttacctttaatctcctttcagttagtgccctccttactaattcagcttattctatttgtttttcttccaaccaatttgtcatacaggaaatgcctaattgcaagaagattggtagaggggatctccttcatggactttatgtcttgaacctcaaggatactcattccacttgcaatgtttctgatcataattcctatataaatgttgtttccaacacttgtattcaagccattaattggcataatcgatttggccatactatcttcgcttctgttaatcatgtttctgctcagccctttgacttgattcactgtgacatttggggaccttataagcattcaacttatgctaactatcgatacttcctaacaattgtggatgactgttcacaatttacatggatttttctgctcaaacaaatctga

SEQ ID NO: 7303 - DNA, 186 bp, Glycine max
  Peptide Sequence Number=SeqID_124081
atggcggtttctgaccatagagtgcttggaaaagtgtcatcccgatgcattgtggagcatagtattataccagtactcaacccaatggtgataagctgtggaaaatttaagttgcgtgccttggtgacggaaaagttcatgccagaattggttgatgaagatatgatcacactcaaagactattga

SEQ ID NO: 7304 - DNA, 655 bp, Glycine max
  Peptide Sequence Number=SeqID_124082
ggagattgaggctgccctatgcataccaggccgagggttcatcttgaatgctaagggccatcctgggaggatcctgaggaaggacctgacaactttagcccaggtgtggagtgttctctcatactccaacctggcccccacatcttacacatctgacctgacagtggacagagctaggttgatcttttgtctagtctctcatatggacatgaacataggagctctcatttctggccagatgacttctatagcccaatctaactcttctagacttgggtttcctactctgattatcgccctatgtagagccagaggggttgtctctgacagcctcacttttgagcgcctgtgcccgatcattaacttggcctacatcaggaagaactgctggaatccttatgatctgacagtttttatccgaggggctagaagggcgagcgcgaggccagttgagcttccttccacatctacagctcctactccagcatccacttcaatagctccttcagttccagctcagactgattctcagtgctttgaagccatacttcagagcattcatcagggacagatcattttacttcagagtttacaggtggtggcacctctaggatccattccttctgttgagcagtttctggagaaggtagcctag

SEQ ID NO: 7305 - DNA, 1050 bp, Glycine max
  Peptide Sequence Number=SeqID_124083
atgccattggcccagttacccgcaacactgggcattgctgtcagctaccgggacttttttcaatccctgtacaccggcccgcaggcttttcaggcatggaaaggggaagtatggaatcgccaccagcaaggacatgattacctggtcgaattggaactgtcaccggtactcggtcaggcgggtgagtttcaatattatgtcgggttattttccgacatcacgcatgccaaagcgcagcaaaacatgctggagcacctggcataccacgatgcactcacgcaactgccaaaccgcgtgctgttctccagccgcttgcagcaggccttactggaagcggagcgccagcaatcactggtcgcgatttgttatattgatctcgacgacttcaaaattgtgaatgaccaatatggccatgattatggtgacaggttgcttttgcaactggcaaccaggctgctgggcatactcaaaccgcaggacacactggctcgaataggtggtgatgaatttgccatgttgctttgcggcggtcgcacacaggctgaatacacgcgtttgctcaaaaaattgctggctgcgattgaaaagccgtttacagtcgataaattcaaattctcgatttctgccagtattggctacaccctgtatccgatcgatcacaatccgccagacaccttgctgcgtcacgccgaccatgccatgtatcacgccaaaacacatggtggtcaccaataccacctgtttgacctggcatcggcacaacagtcgcaacaacagcaagtgcttctgcgagacttactcaatgcgatcaaaaacaatcatatcaagctggtttatcagccacagatatgcatgcaaacaggcaagctgttttgctttgaagctttgctccgttggcaacacccgatacgtggcctgcttttccccaaagactttctggacgccgttgagcacaccagcctgattattgatatcggaaactgggtgattgaagaaagtcttcgccagttaaccgaatggcaagatcatgggctgcgcacacaagtctcg

SEQ ID NO: 7306 - DNA, 237 bp, Glycine max
  Peptide Sequence Number=SeqID_124084
atggatatgcggggttaccatatggttacccgcacctttggtcaaccaggggcagacgtgcccgttggcgcgcggagactaacatcatcttttgcaccttttgtcgtcctgacccgtgaaggttaccttatggttacccgcacatttcgtcaaccaggggcaaacgagcttgttgacgcgcggggactaacatcgtcttctgcaccttttgtcgtcctgccccgtgaagtcaaatga

SEQ ID NO: 7307 - DNA, 405 bp, Glycine max
  Peptide Sequence Number=SeqID_124085
acttatcaaggtaatccttgtggcgtctacccagacttatcttccttcattggaagtggcgtctacccagacttatcttccttaaccggaagtggcgtctacccagacttatcttccttcactggaagtggcgtctaccctgacttatcttccttcactggaagtggcgtcatccaaacattcgtagtctgtatcaaacgatccgctcatactcaggtttaccatcgaggtcgcctttggtatttcgtgggaactcaaccgccgttgtgtttcggtcgacattggcctgcgctgccgacatcggccaagaaagattactggtcgctgtatcccaaaaagaatcaccggatgaagccaatcgaacatttccttatcgacatcatccaaaaattattcagggattga

SEQ ID NO: 7308 - DNA, 282 bp, Glycine max
  Peptide Sequence Number=SeqID_124086
atggtgaagaatctggtggggaagctagggaggtgggaggctatagcggcgacattcaggggaaggcacaaagtgaaaagtgtgataaagaaagcgaaggaattgagggagaagaaagtggatgattcaaacatggctaattccttatcgagcctgtatgctcaccagccttctgaatgtgatttaggtggtaaagagggtaagaatgttggtcgaacaaataggggaagaaggtatatactacttgcaaaggcactcaaacatcgatatgtgagccagtag

SEQ ID NO: 7309 - DNA, 228 bp, Glycine max
  Peptide Sequence Number=SeqID_124087
atggaagcccgacggcctggtggtcggcgacccgctgaccctggacggccaggaccagcccaaccgcaagcgtgcgcagggcttcgcccgccagctgcgggaacgtttcaaactgccggtggtgatgatcgacgagcgctccagctcggtcgagggccgcccgccgcttcgccgtcgagcgcgccgaaagggcgcaagcgccgccgtgatgcggccgccctctatgcc

SEQ ID NO: 7310 - DNA, 729 bp, Glycine max
  Peptide Sequence Number=SeqID_124088
atggctacaccgatacggcgcgagccgacatcgaaacccagaacggtgccatcacggcggatcgccgggccagcaggaaccggtgcgggcgcgaccggctcagacatggccgctgtaatccgtcagccggaacaggtccacgccgatacgcgaggcagctccctgccagcgctgctccagcggcagctggaacaccagctcggcatcggccggcacggtcagccagctgttctcggacagctcgctttccagctgccctgcgccccaaccggcacagccgagggtgaccacagcattggccgggccttcgccgcgcgccatcgcttcgaggatgtcgcgcgaggtggtcaggtacaggccgtcgcccacggtcaggctggaatcccacgcccgcgcgtcgtcatggatgacgaagccgcgctccggatgcaccgggccgccgttgagcaccatgcgcgcctgcaggtcgccatcaccggtggtgatgtccatctgtgcaagcacttcacccagcgtgtactcggaaggctggttgaccagcacgcccatcgccccgttctcgtcgtgctggcagatcagcgcgacgctgcgggcaaaggtcgcgtcgagcagcgacggcagcgcgacgagcaggtgatcggcaagggaggtcggcgttacaggcatggccccattctacctgctggggccgatatggtcgcgcgatgggcgcgtgcagcgatgggctag

SEQ ID NO: 7311 - DNA, 153 bp, Glycine max
  Peptide Sequence Number=SeqID_124089
atgtcaccacccgccattggcggtggtgacaacaatggcagcgaaaatcactttggtggtggtcatgatgataacaatggtggtgatcatgatggtgactgtgatggttatgatagtggtgacagtcgcgatgaactttcaatccaacagtga

SEQ ID NO: 7312 - DNA, 135 bp, Glycine max
  Peptide Sequence Number=SeqID_124090
atgatttatgagactcgagggggatttctatttttggctgggagtggctatttctggttcttggcagcttttatcgcagagattgttcaatcgttcatcttagctgacttctgttactattacataaagaggtag

SEQ ID NO: 7313 - DNA, 135 bp, Glycine max
  Peptide Sequence Number=SeqID_124091
atggacatggggatctcttgtatcgatagtctttgtggaacggtggagagcatgatgatgcaattaagggggaggctatcatgtatgtggaaaaaactcacaattaagggggagattgttggattacgaatgtaa

SEQ ID NO: 7314 - DNA, 417 bp, Glycine max
  Peptide Sequence Number=SeqID_124092
atgtcaaacttcacctcacacttatactccaacagtctcccccttaagtgtgagtatcttccacatagtagtctcccccttgagcgaaagctatttttaattcacgagtatccaatggtagagtccttagagcttaactgtgactttctgaatcacctagtcattgacgccaacatgcgcgctctagtaccttgcactaccatgctctcgttgtttcacagccacaagacacaccgccctagccctccattcatggactcacccgcaagaagactttcgatacaagaagtccccatgcccatggatctaccaccaccatcttactcgtctgagccattcaccaagttgaatctggctctgataccaattgttgtgaaatcgagagggctaaacaccggtaaaatattcaccaattga

SEQ ID NO: 7315 - DNA, 192 bp, Glycine max
  Peptide Sequence Number=SeqID_124093
atgtcagtgaaaaacctcgtcaggcgcttagaagtacatgacaagacaaatcacgcaatagtaagtcaggtcactctcactagacttaaaggagcactcaaaccgggtgtacttacctctaaggcttacactccgaagagttcatcagggcctctccctcctgattcaagtccaaccagaaaaatattttag

SEQ ID NO: 7316 - DNA, 444 bp, Glycine max
  Peptide Sequence Number=SeqID_124094
gggtttccagcattgatcacgggcctctgccagtcatttggggttcccgtcacacctagtaaggtgatccaaccgccgatcacccaggccttcattgagaagtattgcacgcctaggcaggcgcacggtgatgcaccacaggccgcagacgcatcaccaccaccgcatcaagctgatcctgctgggtcattaggcatggagcggtatctacagcacttggttcgccagcaggcggccaaccaccgggagcagggccagagtttcactccttttgtgtgccctactccatatcagtttagggctgaggtcgcattgcccggagatgggcccgaggcccaggcaggggaggcacctgtaggagctcccggcaatgcagaggaggcctgcatggatgaggagatgacgaacttgctcggtttcttgggaggaagcggagccacgtga

SEQ ID NO: 7317 - DNA, 330 bp, Glycine max
  Peptide Sequence Number=SeqID_124095
atgcaaaggctagatatgggtggaatgataaaagcttcacttcactgcttcaggtgtgaggtatcatggtacaaagtgaaggatgatgatgagtgcagcagtgatgaaagtgcaaagaaagacccccagcaaagatgttatgacaacgcaaaagaccttacatggcatgtagatgggagaaactgcaatggaatgttccgccattcggttgattcctccaagtggaagaagaataatcgtttgtatccagattttggcaaagaggcaagaaatattaagcttggacttgctactgatggaatgaatccctatgacagtttaagcacttag

SEQ ID NO: 7318 - DNA, 225 bp, Glycine max
  Peptide Sequence Number=SeqID_124096
atgactggcgctaagctcaaatccacttactcgcgaattagggtagaccctgggtacagattttacacacccaaaacgagaagatttgcacagaattctagagcacaccacagtgcctatttcgggaaaagagctctggaggcagcaagaagagcagcttttgcagagataccaaggttttgtaatctcgttattgttaggggtttttctgtaatggcttgctaa

SEQ ID NO: 7319 - DNA, 970 bp, Glycine max
  Peptide Sequence Number=SeqID_124097
tgctgctgggcaaacgccgggcgcgctggataacgaactgatgagcagcaaagcgctgccggcgttgccgaagctggtggcggtgggcattccctcgacgctggcgcgtcgtcgtccggatatccgccaggctgaagcgaatctgcatgcgcagaccgccaatatcggcgtatcagtcgcgaacctgttccccagcctgtcgctcaccgggcagctgggcgtgcgtaacaccgatgccagctaccttgacgactggagcagccacttcttcagcgtcggcccggcgctgtcgatcccgatttttcagggcggacgtctggtttccagcgtgaaactggcgcgcgcgcagcaggcgagcgcggcgctcgattatcgccagacggtattgacggcgctgcaggatgtggaaaatgcgctggtcagctaccgcgccgatcagcaacaggttactgcgctggatgagaccactggcgcactgcagcgcgcctttgacctcgccagtgacagttacaaacagggcatctctaccttccttgaggtgctggatgctcagcgtcagctggcacagtcgcaggcgcaatccacccaggcgcgcatgcaaagcgcgctggacctggtagcgctgtataaagcgctgggtggcggctgggagccgtatcagcaggtgacgctgccggactatgacgtttttggaaaggagttggttatgtcccgcgaaacctggatgacgcctaatccggcatcagggccaaacagcagcacgcgcaccgagccttttgtgaaagtcattgcgctgattgccaccctcggtggtttgctgtttggctacgacaccggcgtgatctccggcgcactgttattcatgggcgacgatctgcatctcaccccatttaccaccgggctggtgaccagcagtctgctgtttggcgcggcgtttggcgcactggcttccggtcactttgccgccgcg

SEQ ID NO: 7320 - DNA, 216 bp, Glycine max
  Peptide Sequence Number=SeqID_124098
atgaagaagatcctaggcctacaagctccaatggagcttgcatcaggaagtggccgaaccaagtttatgattgttgagaaatatatgaatggtgaattagtaaggattgacgatgttaagggtgctatgaaggcactcatcttagtgttggtggttatcagtggtggctacaagaatgagcctatagaattgatgattgggcaaatccctagatag

SEQ ID NO: 7321 - DNA, 357 bp, Glycine max
  Peptide Sequence Number=SeqID_124099
atggtcataacttataactcagcggtccgatcaggcgcatcatatatcgagacgcccgaaattgaacaacggaagctcatgagatattcaaatggtcataacttttcactcggaggtccgattcaggcacatcacatatcgagacgcccgaaattgaacaacggaagctctgagaaattcaaatggtcattacttttcactcggaggtccgattcgagcgcatcacatatagagacgctcgcagttgaacaacggaagctctcgagatattcaaatggtcataacttttacctcggaggtccgattcaggcacataatatatcgagacgccggaaattgaacaacggaagctcttga

SEQ ID NO: 7322 - DNA, 285 bp, Glycine max
  Peptide Sequence Number=SeqID_124100
ggcaagaaagtcgctagcgcacaggattttggttggcaatcaaagggagaggaccacttcaagtcgtggcgaggatgggcattctcaccctgggtcaaggtttctggtgagttgggattttggctcagggcttgtagaacggctggacatgatatatgtcagagtgttggtttggccagcggttcagggataaaggggatgcttgctcttgggactaagtctattttggtgttctatttccctaggaggaggaattgtagcaatgctaagggaggtttcccttga

SEQ ID NO: 7323 - DNA, 399 bp, Glycine max
  Peptide Sequence Number=SeqID_124101
atggctaagtttgaccctgaggtagtcctggagttttacgctaatgcttggcccacagaggagggagtgcgagacatgcagtcatgggtgaggggtcaatggattccttttgacgttgatgccctcagccagttcctgggtgacccgctagtgttggaggaaggccaggagtgtgagttcagtcagaggaggaatcgggccgacaggttcgacgaggaggccattgcccaactgttatgcacaccggggcaggatttcgcccggatcgctgcagggaggcgggtgcggatcatgcacactagcatgaccaccttgacccagatgtggatgacattgctactcagcaatgtcttgcctagtgatcataactccgatctccctctgctgaagtgtcagctg

SEQ ID NO: 7324 - DNA, 1344 bp, Glycine max
  Peptide Sequence Number=SeqID_124102
atgccgctccgcgtcgcggttgatgtagcccagatcgccgtccgccttcaccccgatcaggtaatcgtaaggcgaaaccagcgtgcgggcggtcgccgccaccgagcgcccgccgccggcgacgaacgcctccgacagcagctgcagctgataagtggcgtcggcgtaggatttcagatcgagcgggatatcggccgcgccgtgctcatcggtggtgcgatcttccagctcggtttcgaacccgtcgctgttttgccgattttcatagaacgcataatccgggaagcgatcgaagctcggatacatcggccgcagcgtcagcctggtgctcacgcggcgatcctgcgccggagtaccgaacaggttctgcacattgatgctggccttcagctcggacggtttgacccagccttgctgacggttcggcgtcagcgccagcttcactttcagctgatccggttcgaactccttcacattgaccgcggtatggccgagcagcgtggaggtatcgttgtttttgccgatcagatacagatagacgttccactcgccggtaggcgagttttcatcggtggtatagctcagctcattgaaaccgctggcgcccagcgtcagcggcacggtggtcatcagcttgtcgcgcggatcgcggatttcggcgcgcaccggcacgccggccaggccaacgccccagtcggcggcgcgggtgatcaggccgatgttaaaggtatcccccggccgataaacgccgcgatcggagaacaggtaactgctgagcgtgcgcggatcggtcggcgtttgttcaccggcgacgtcgaagcgcgagaagtccagcccgcgatcgttatagctgccggtcggcaggaaggagacatccccctccttttccaccaggaacatcaccggctggcgctcgttggtgtacacgtcgagcgccgggaaacgcacgtggccgtcggccccggtggtttggctgagcagcgtcacgccatttttggccaccaccgacacgttggcgccgctgaccggcgcgccgctttgaatcgactgcacaaagacgtcgcgcgtcttatcctgcgagctcttggcgacgatgcccagatcggtcaccaccacaaagcgcgaatcgccgacgtcgggctgatcttccccagtgctctcgtccggttcctgttctggctcggcgcccgcctcttccgccgccggtttccggttcggctgccattcggacagcgtcagcaggaatactccgcgatgggaactggcgttggtggagagatagcgggagagatcgatgccctgatagttcacttcccccggccgctcgttgttgagcgccgtctg

SEQ ID NO: 7325 - DNA, 837 bp, Glycine max
  Peptide Sequence Number=SeqID_124103
ctgcgccagcagacgcagcaactggtgcagcgcgatacccgcgtcgacaccacgctggacgccgggttgcagcggctggttgagcggcaggtcaatgcctttatcgcccgcaaccgcagccgcggcatccaaaacgccgcggtgctgctggtggacagccgcgatatgggggtgcgcgcgctggtgggatcggcggattattacaatcggccgatccaggggcaggtgaacggcaccaacgccaaacgctcgccgggttcgacgctcaaacctttcatctacgcgctgggcatggagcagggcgtgctgcatccgatgaccatcctgaaggacgtgccttcgtcgttcggcgcctatgcgccggaaaatttcgaccggcgctttctcggcccggtgaccgccaccgacgcgctgaatttcagccgcaacatcccggcggtgtatgttgcctcgcagctgcgccagccgaccttttatcagtttttgcgcctgaccggcgtcgccaatatggccaacgaaagccactacgggctgtcgctggtactgggcggcggcgaggtgacggcgcaggaattggcgaagctgtatgcgttgctggcgaaccgcggcgagctgcggccgcttcgtatgcaactgaacgaggccgaatcgacgccggtgcggctgctgagcgaggaggccagtttcatcacgctggatatgctgcgccagcaccggcggccgggcgatacgctggcgcagcgttcttcttcgctgccggtgtactggaagaccggcacttcctggggctttcgcgacgcctggagcgtcgggattttcggcccttacgtgctggtg

SEQ ID NO: 7326 - DNA, 722 bp, Glycine max
  Peptide Sequence Number=SeqID_124104
atggccggacggggtgctggagccggtcgcacccacgttgcgctgcaggatgttggagaactcttcgatgaaggtttcctgctggctggccacgcggtcgatctggtgggcgtagcggttgtaggccgtgacggccgggatggcggcgaacaggcccatggccgtggccaccagcgcctcggcaatgccgggggccacggtggccagcgtgatctgctccatgttggcaaagccggtgaaggcgtgcatcacgccccagacggtgccgaacaggcccacgtagggagagaccgagcccacggtgcccaggaaggacaggcccgattcgacctcgtccatctcgcgctggaagctggcgcgcatggcgcggcgggtgccgtccatcaattggttcacatcggcgatgcggcgctcgcgcagcttctggtactcgcgcatgccgctggcgaagatgcgttccatggggccgccctgcttggcgtggtgggccgccgaggcatagaggtcgttgaggctggtgcccgaccagaagtcctgctcgaagccgtcgttgagcgtgcgcacgcgcttcaaggtctgcgacttgcggaagatggtggcccagctggccaccgaggcgcccacaaggatcagcatgaccagctgcacgacccagctggcctgcagcacgaggctgagtatggacatgtcatgggagttcatgagagttgctccaggatgcg

SEQ ID NO: 7327 - DNA, 159 bp, Glycine max
  Peptide Sequence Number=SeqID_124105
atggagtcagagtttgttgctctagaaatagctaatactgctaaaagatggaacaatttccatagattatgtaaagttagacggaaacttagcagatcctttgacgaaacccttagggaggaatatgatattagaaacatcaagtggagtgggacttaa

SEQ ID NO: 7328 - DNA, 258 bp, Glycine max
  Peptide Sequence Number=SeqID_124106
gcggccaaccaccgggcgcatgcacagacccatgattgtctttaccagttgagcctcagcctgcagagccagggttttacttcttttccgtgccctactccggatcagttcagggtagaggtcgcatggcccggagattggcctgaggcccgggtaggagaggcaccagcagaggctcccgacgatgcggatgaggcccgcgaggacgaggagatgactgatttgcttgatttcttgggagggagcggagccacatga

SEQ ID NO: 7329 - DNA, 237 bp, Glycine max
  Peptide Sequence Number=SeqID_124107
atggtgttgggtggttgtggcagtggtgtttgggttgacgatgggattgagtggaggccatacttgcttgggagaaacatggatatttgtgtttgtgcatatcttttggggtacaagaagaaagaaaaaaaggaggtacaagaaataaaaggcaagtatgataagaggaaagggacagtaatcttttggacaagcccaacccacctcataatccttcccaaaagcttaaaggtctaa

SEQ ID NO: 7330 - DNA, 780 bp, Glycine max
  Peptide Sequence Number=SeqID_124108
atggacaaggcgaggttggtatacgggttggtgatgaagatcgacatggacttgggctccatcatctctggacagatctcacagatggcccagtcctactcctctcgactaggcttccctgcactcattacagccctatgcatcgccagaggagtggtccctgactcactcacttttgagtccttgagccctgtcattaatttggcgtatatccgaaagaactgctggaacctggacgatcccacaatcactttaccggggactcgcaagattcgggctcaaggacctgatgcttcttcttctgctccccctgcttcagctccagcaccaccaattcccactcctgcacctccaacacctttcggcacctccgctcaaagcacaggcgccgtggtgccaatactacatagccttcaccatggcttatgcatgcatcgatcagcatggaggatttcatggcctaggtggcctggccaggagtccagccttctcttgtggggggaggtgaggctcctacaacccaggagctgtagccaaagccggaggcaacgcccgaggctactccggaggagaccccagaggtcacccctgctgctacaccacttgtggaggctactgaggaagaggatggcactgcagacacagattatgcagctaatatggcggaggcatagagcacctgggatcccatggcctactccagcactagatacatccttgccagctcaggatgcccccttcatacctcaggatgatcctacacaggcgcaggatgattga

SEQ ID NO: 7331 - DNA, 210 bp, Glycine max
  Peptide Sequence Number=SeqID_124109
atggggaaaggtaacctgcaaatgggaatagatgatcagaagatcacatttgatttgtttgatgcagagaagcactcactaaagccaagattgctccagacccttaagggtgagcgagtcatcacgctaagcgcaacatatagtctcgctaagctcatctatgcgcttagcgagatggtctcgctcagtgcaatgccagccgcgtcatga

SEQ ID NO: 7332 - DNA, 219 bp, Glycine max
  Peptide Sequence Number=SeqID_124110
atgcacgaaacacaatgtggaccactacgggtacatagaatgaatcgaaaagcttggttcgagcaaaataggggaggtggttgccgcccagctcgcccaggcgagctcagctcgcccaggcgagccaggttgcttcctccagaagcaacagccttctggaggaatattctggagggcccaagtgggcctgggtgctatttgcacccccatttttactaa

SEQ ID NO: 7333 - DNA, 207 bp, Glycine max
  Peptide Sequence Number=SeqID_124111
atggagccatgtataagtgaatatggtgttatgggtatggatgatcaaagaggttccctttttggcagtcctattcatattggtgcattatatatctttaaggaagatgtttatggctttggtgtcattctacttgaattggttactgctcattttgggtccattcagcctaattggtggttggatttctatggcttcattggatga

SEQ ID NO: 7334 - DNA, 183 bp, Glycine max
  Peptide Sequence Number=SeqID_124112
atggaggctacatgggaggagcttcttatcataccagaacggctggggtgtcaagcaagagaaaggtggaccagcatcatattcatgtccttccttctgcctattccactaagagtgattttcgccagtgttgatcctgcggtcattgctgtttccaaaagtgctcttgcgctgattatataa

SEQ ID NO: 7335 - DNA, 297 bp, Glycine max
  Peptide Sequence Number=SeqID_124113
atggccctatcaataagccccccattcatcctatactcattgaaaagcttgacacaggagaagttgatgttgaacacattgcagtttaacatgtctgtgccaacaacatatgtttttatgaaaaggttcctaaaggcagctcaagcagacagaaaggaacatgctgcttcagcagttctcaacttcagtgaggactgcacacctcatatgttaacgccatacttggatggaatagttagcaaactacttgcacatttgccgagattttcccatttgtgtttacttgcaggaacctga

SEQ ID NO: 7336 - DNA, 418 bp, Glycine max
  Peptide Sequence Number=SeqID_124114
atggtgttttctaccatcgtcgttgttgaagaacatggtaattacaaaaatgtcaccgataaagcaacaacgacgggttttgaacaccgatgtagaaggtgcgtcgatcctactcaagcaaccaaacaggcaagctctacctcaaaacttcacttaattttcttatttccgcttcttaatattgaaaatgtctacaaatttctcatgacgtcatatattgtatacttaggatctcattcttttcgtccaaatccttcctccattgatgttgaatctgtcacgatgtctcattatgatttacttgaatcatacgttggaagcactgaaaaggcccaagaagcaatcttttattcttacaagagatatattaatggttttgctgcaatacttaatgaagatgaagcagcgaatgtttcaa

SEQ ID NO: 7337 - DNA, 330 bp, Glycine max
  Peptide Sequence Number=SeqID_124115
atggttggtgtgttctctaaagttggtttggttgatgaattggtgaaactcttacaagacaagaaagcagaaggaacaagactagatcagaggctgtaccaatctgctttgaatgcttttaaagatgccaggttgcaaattcaggaaaggcacttaaggtgtacaaaaatatctatcatagatatatatcatagtaagggaactacagtgataaaatgtatttgccctggagatacactcaggaggaacctcccttatatctattccaataccccagacgatagcctccagctgaacatgaggcaaaatgctgcaaagtggaacctgtga

SEQ ID NO: 7338 - DNA, 390 bp, Glycine max
  Peptide Sequence Number=SeqID_124116
atgaccgaagtcgttgttgtcgacatacaccgacatctggaacaacgacggtgtggggcccgttgtagataccggttttcaaccgatgtagaagcttctttttgtagttgtgatagtttccacagaaaagagctagcagatggcgtgtgccactccgcagtgaagccagtgatgaacggttgccgtcgtggtcaaacattctgcagagatgcgtcggctgctcctccgtgtagggagtcttcgccgccggcaaaagctccggaaccaccgccgatgacatcaccttcgacggcgatggcgacgttaagattgtatttggattttgaacttctgatggggagaaagagaagaagagatagagaagaaaattggtttgatggaactatataa

SEQ ID NO: 7339 - DNA, 426 bp, Glycine max
  Peptide Sequence Number=SeqID_124117
atgcccccgcttctcacgacgtgcatccacttctcacggacctccgtcaaactgtcaaccctctttcattggttagtggtggggtccacttctcacgacgtgcatccacttctcatcggaccaaatgccagcgatgcagccgcgaaggacgtagatcttgccgtggaggactcctgcggtggcgaattcacggctgacgcacatggagggacagcggagccaacggttgaagtggcagtcaatgagccagatgttgggggaggggaggttgtggatggagccgctaaggacgtagatggtggggctgaggatggcgtaggcggagccgacggcgggggaggggatcgggggaaggggagcgaggagggggttattagggtttgtggggtggagcgtgaagcattggaggagaaaggagtcgcgtga

SEQ ID NO: 7340 - DNA, 277 bp, Glycine max
  Peptide Sequence Number=SeqID_124118
ggcgagccctagtgcagcggtaaagttgtgccttggtgacttattggtcatgggttcgaatccggaaacagcctctttgcatatgcaaggcaaggagtggggagtattggctaacgactttgctattgagggaagtgctggcggacttcacgagggagttgcagtcagagagctcgactcgaatggccatgacggtgagaagatccacagccttgatggcaaccttgtggagggtgttgacagggaggtggccttggtccctcttgtgacggtgtga

SEQ ID NO: 7341 - DNA, 228 bp, Glycine max
  Peptide Sequence Number=SeqID_124119
atgagtagtgcaacgttggagggagttgaggtggtgttccacatggctgctccaaactcttccattaacaactaccagcttcatcattccgtcaatgtgcaagagcgttgtgtcccgacgtccttcagcacaatattccttaaagcaattcacctagtcatctgctcccccgaacacaaggttcaagatcatcacaggatcaaaacacaaacaacaaactgggagtga

SEQ ID NO: 7342 - DNA, 468 bp, Glycine max
  Peptide Sequence Number=SeqID_124120
atggcatcaaatggtattaatttgtttaaggaattgaggcatggccccatatatcaaaagacaattcctagcaaaacagaactctacattgaggattggataggcttaagaactctagatgaaactggaaaagttcacttcattagtgttctaggaaatcatcttggaatctccaaagaggatatgaaaaagcatgtagtgccatatttgaaggatcacatattcgtacaagatagtatcaataaggctaggttcaggatgcaaggagttaatcagaaagttattcaaagtaatatgatggagcaatctcaaaaggaggaggtggaaccatcatcctccccattacttgatggatcattgtcatactggtggcctacaccatggaaactgctgcaaatacagcataatgtggtgaaggaaggttgtgctaaagggtttctactcggggctgggattcagtcattctaa

SEQ ID NO: 7343 - DNA, 276 bp, Glycine max
  Peptide Sequence Number=SeqID_124121
atggcacggtgttttctatttccgatatggcggtccctttgcctccagcgagagacccacacaaggtggcccctttgtctctggcgcacttgtgcttcaggggttgagagagagttgagcgtgagagagaatgatttcgtggccgagggtggggtgcaggcaagagcatggagtgggaaaacatatgggcatttcatgactaaccaaacttccccggcatttgctctcagcaaccgtggcatcaacgctcctagggcgtggaattccccgaggtaa

SEQ ID NO: 7344 - DNA, 402 bp, Glycine max
  Peptide Sequence Number=SeqID_124122
atgtcgcactgctttccatttccaccacgaggatatacaaacaagggatatgaaaagaaggctacaacagaggacatggaattactgacaaagagttgggcagcattggtggagaaagttagattggtgctcaatgagtatccacaactcaggctaacccaagggagaaaagtgatagagatctgtctaaccatcaaatgggacaagggcaaggctcttgaatttttgttagaatcattagggtacgagaattcgaatgatgtatttccaatctatattggtgatgatcaaactgatgaggatgcttttaggttaacaaatgctgccacgcctagtcagttagttagaggtgttcatgttaaacatatacccacagttaaagatgataaatacatattatag

SEQ ID NO: 7345 - DNA, 286 bp, Glycine max
  Peptide Sequence Number=SeqID_124123
atgtctcttgcaaatctttttggaaagcttcaggaacacgaaatggaacttatgatactaaaccaacaagaagaaaatgacaagaaaaagaaaggaattgcacttaaagccgcatcttctattcaagaagaaagtgacaaagaggacttgaatgaaacagaagaagatgatgatttcagtttcttcgtaaagagattcaataagtttctaaggaatcaaggagatcgaagaagaacaaacttcaatccaaagaaaagacgagaagattcatcttctgttccaaagt

SEQ ID NO: 7346 - DNA, 366 bp, Glycine max
  Peptide Sequence Number=SeqID_124124
atgaccaaaacaactaccaatcctaaagggaaactacccctagccaaaatggaacatgaattttgggacaaaaacccatttaagaaaacagccaaggctttcccgtcaagatttcgctacaaaccaactaccatcctgaagtcaaggactttttatgaattgattttggtggactcaaattcagtgtctatcaagcatttcaaagacccaaaagatcaaacattgaacacccactcaacaatccaaatactaaaagttcttcaaccaagacattttggttcagacttaaatagaggaaagagattttcagtaccatttgacccagtagggtatacctattgggattatattgatgtttggactaag

SEQ ID NO: 7347 - DNA, 1138 bp, Glycine max
  Peptide Sequence Number=SeqID_124125
aaatgggaaattgatcactgtgagtggagaggaagccttgttggttagtcatttgtcagctttttcctttattggtgctgatgaaacagaaggaacctctttccaaggcctgactttagagggtaaaaagccagagagaaatgaagtatcttttgctacttggaagagcgcacagaaagtggtgcaggaaggaacaggtgtaggatggggaaaagttgtgcagttgctggagagtaaaaaccgtgaaggactaggatttgcttcttctgcaggatccgcaacgaacagtgttggatcaagctccattactagcaccttttgtagcgccgggttcatcaacaactcgccagaagccaatgctgtcttggaagatgctcctgaagagatagtgcttgcatttgtcacacctggaaaacttgttcgcaactgggacgcggttgacatcccttcagtggttcatgcatcaaaactaggcatttatgagcccgttgaacataataaccctgcactctctcccaacttcgaatctcctgtctacgaggctgaagaggaggaggatgatgaaatcccggaggaacttgctcggttattggaatatgaaaagaaaaccattcggcctcatgaggaggtagtagaggtgattaacttgggaaccgaggaagataagaaggaagtcaagattggggcatcgcttgaggcaactgtcaaacgaagggtgattgaattactcaaagaatacgtcgatgtgttcgcatggtcgtaccaagatatgcccggcttggatccccgtattgtggagcaccgtttgcctttgaagcccgaatgcccaccagtcaaacagaaactgagaagaactcgccctgacatggctcttaagatcaaagaggaagtacagaagcagatcgatgcaggttttcttgtcacatcagagtatccccaatggttagccaacatagtgcctgttccaaagagggacggcaaggtcaggatgtgcgttgactaccgggatttgaacaaggctagtccgaaagatgactttcctctacctcacatcgatgtattggttgacagcgctgcaaagtccaaggtcttctccttcatggacggtttctctgggtacaatcagatcaagatggca

SEQ ID NO: 7348 - DNA, 490 bp, Glycine max
  Peptide Sequence Number=SeqID_124126
gatgagagattccaagagggcgattgtcattcatatgttgaaaattttcaagatttatgttgtgcttgtgatgggtcacttctcattaaggaagctaagggcgattctaattcatgttgtgaaaagaagcgatttcaaccttagggttattaggaacataccaacaaatgaggactataacataagtcttcaaatggttttgtcggaaaatgaaaaggttgtgattgttgagatatcgaatttgaaaattggggacaaggaggagtttaagaggttaggttccgacagaatgttaccaccaaaggatgtagatcttagggattcgagttcatcatctgcttcttctacaaatttgttgccacaaacttttaaagcttcttttaattatggtagttcttcgagtttggactcatctccccttgatcaaggtgtcaaaatgagaaagatagctaagaacgtggttgatatcgaggcttccaaggaaccttag

SEQ ID NO: 7349 - DNA, 297 bp, Glycine max
  Peptide Sequence Number=SeqID_124127
atggaagccgaatttaccgttgtagctagaggagcagtattatggaagagtgcaaagcaatcagttgttgttgcatctaccatggaagctaaatttgtagcatgttttaaggctacaattcagcctaattggctatggaactatactttagggcttggaattattaacaatattgctaggctgctaaaaatgtattgtgataactgtgcaacattatttttctctaagaacgataagtactctaagggtgataagcatatggaattgaagtactttttcatgaaggaaaaagtttag

SEQ ID NO: 7350 - DNA, 999 bp, Glycine max
  Peptide Sequence Number=SeqID_124128
atgacgacgatgagttccctctccctctctcttgactggcacaatgaatcctaccctgcctatcatgatttctaccttctccccattttcgctctcttcttcccctcccttcgcttctttctcgaccgattcatattcgagaaagtggctagacgattgatttttggaaaggggcatgcggcgctggactaccagactgacgagagaagaaaaaagattagcaaatttaaggaatcagcctggaaatgtgtttattatctttccgccgagattcttgctttgtctgtaacatacgatgaaccatggtttacaaatactataaacttttgggtgggaccagggacccaggtctggccagatcaaaagatcaagttgaaattaaaggcagtctatatgtacgctgctggattttactcatactccatttttgctttaatattttgggaaacgaggcgctccgattttggagtgtccatgagtcatcatgttgctactgtaattcttattgttctgtcttacatttttaggtttgctcgtgttggatcagttgttttagcacttcatgatgctagcgatgtgtttctagagatagggaaaatgtccaaatacagtggtgctgaaacaatggctagctttgcttttattctatttgttttatcttggatcatattgcgcctcatttactacccattctggattctttggagtacaagggcaacaacaatgattcagtgcctaataatttgtagagcagttacaaacactgacaacaatgagactcaggtgttgactgcagaggagacggaagaacccgagctggatgggatttgtcaaaggagtcctattctcatactcgtcgatagtggcgccaatcatactttcatttctaagaggttagtcacagctttgggtataccaattaaagcaacgtgcctgatgcgaattaaaatgggagatggttacaaggtgattgctccacaacggcatgatccaccatag

SEQ ID NO: 7351 - DNA, 327 bp, Glycine max
  Peptide Sequence Number=SeqID_124129
atggggagatgttggggagtcggagtcggggattggggagacaatacccgttcctgccctacctcattgccatgtctactcacagccacacttacccttgaagataaccaatcagttcatgtggttatggagctgtgtgctggtggtgaactttttgacaggattattgccaagggccactacagtgaaagggctactgcttcaatatgtagccaggttgttaagcttgttaacacctgccattttatgggtgtcattcatgggatctcaagccagagaatttcttgctatctagtaaggatgataagggacttctcaaggccatag

SEQ ID NO: 7352 - DNA, 177 bp, Glycine max
  Peptide Sequence Number=SeqID_124130
atgaaggatgagatgaaatctatgcaagataatgatgtttggaatcttgtcgaattgcctaaaggtgtgaaacctattggttgcaaatggatatttaaaaccaaaagggattcaaaaggcaatgtcgagagatataaggctcatctagtcgctaaagctacatcaaatggatgttaa

SEQ ID NO: 7353 - DNA, 108 bp, Glycine max
  Peptide Sequence Number=SeqID_124131
atgaagaattgggaacgagggtttcgcgagagcaatggaggagtaaggacgcgttttaatcgattacaacatttggtaatcgattacactcttcctgacttgttgtaa

SEQ ID NO: 7354 - DNA, 255 bp, Glycine max
  Peptide Sequence Number=SeqID_124132
atgcctaaatatgaccctgaagttatcatggagttttatgcaaatgcttggcctattgaggaaggtgttatggataagcgctccaaagtgaggggccaatggattccttatgacacagatgccatcaaccaatttttagggaatccattgatcttagaaaaggggaaacaatgtgaatacacgacaagaagaggtcagactacaggttttgatgaagaggctattgggtcagctgctttgcttcccaggacgtga

SEQ ID NO: 7355 - DNA, 408 bp, Glycine max
  Peptide Sequence Number=SeqID_124133
atgaccgaccctctcgatgagtcgatctcttgctttctcataagggtgaacccttgggtactagtacctatcaccttcagagggcttcacgccttcaccttcagagaactacacctcctcgccatcaaagggctacgcgccctcgccttcgtagggctacacgccctcaccttccaaggactacatgtcctcatcttcagaggactacatgtcctcaccttcagagggctacacgccctcgccttcataggaggactacacgtcctcgccttcagaggacaacatgtcctcgccctcaccttccgaggactacatgtcctcacctttagaggactacacgttctcaccttcaaaggactgcacgtcctcactttcagtgggctacacgccctcgccttcaaagggtga

SEQ ID NO: 7356 - DNA, 258 bp, Glycine max
  Peptide Sequence Number=SeqID_124134
atggtgcttccttccctgaacatgagtgatgcaatactccttaggaagggaccagtcactagagccatgagcaagaggctccaagaggattgggctagagctactgaagaaggctctagggttctcatgaacctcggcgtagattttttagcccatgggccaaggttgggtccaattatctttgtacatattagactaggatggaattatatttggtccttgtatttagggctccataatgtaggtagggcaccctag

SEQ ID NO: 7357 - DNA, 521 bp, Glycine max
  Peptide Sequence Number=SeqID_124135
atgggaacaaatcaaactggcaagaggttctaccaagtcaaggttaaaagcttagataccaccagcatcaaggaattagggcggttgatggaacctctccaaatgcaagctttccgcaagacttacggaaagatcttagagttgaccttagcagaggtatccatagaagccgttgcatcactcacccaatactacgaccagcctttgagatgcttcacattcggagacttccaattagtaccaaccattgaagaatttgaggaaattctaggatgtcctctcgggggaagaaaaccatatctttcatccgggtgtctcccctctttgagcagaattgcaactgtggtcaaggaaggtttggaccacataaaacagactcggaacggcatagcgggcctaccacggaggtacctagaagacaaggcaaggggtatggccaatcaaggagattgggtcccgtttatggatgtgttagctttgctaatttttgggtcgtcctctttccaaacgtggatggtttg

SEQ ID NO: 7358 - DNA, 672 bp, Glycine max
  Peptide Sequence Number=SeqID_124136
atgacagagataggaaagttggatcatctagaggaaaggctcagggtcattgaaggaggcgaagattatgcccttgctaacctagaagagttgttcctagtacccaatatcatcacccctcccaagttcaaggtgtcggactttgacaagtataaggggactacttgccccaagaaccatctaaagatgtattgtcggaagatgggggcatacggaaaagatgaggaactgctgatacatttcttccaagaaagtcttattgggtacaattctgatatggctcctgataggatgcaactacagaacatgtgcaaaaaggggaacgaatctttcaaagaatacacccaaaggtggagagacctggcagctcaagtggcacctccaatgacggagaaagagatgatcacaatattagtagacacattaccagtgttttactatgaaaaaaatggtgagaaaactggggcaaatgaagaggatgaggatgaggaaggaacccatgttgaggctgttattcctacatggccaaactttccaccagcccaacaatgtcattactcagccaatatcagctcttctcattacccaccacccaatcatccacaaaagtcatccctaaaatcaaccacgaagcctatctgccgcacttccaataacgaacaccacctttag

SEQ ID NO: 7359 - DNA, 664 bp, Glycine max
  Peptide Sequence Number=SeqID_124137
ggtgagaggtcatttgattaagtttgatgaggatactcttaacacatttttgaagacccctgttgttgtggaagagggggaaacactttgtgcttactctagatttgcactcctgaggcctaatcctcaagacttagctgctaagctctgtatcccagggaggggattcgagcttaatgctgatgggcagcctttgaagattctgaggaagaacatgaccactcttgctcagacttggagcgttctttccttttctaacctcatccacacttcccacacttattatgtcactcttgacagagccaaactcatttatggcatcatcatgaagatggacatgaatgtggggtacctcatctcccaccagatctccctcatagcacagcatgacacatccagactaggattccctgccttgaacacagctttatgtaaggctaggggagttcagtcagattcgaggaaggccaggggtaagagatctgaggtccccaccacttcagcaccagagacaccagctccttcttcttccacaactccattacctcccactcagattccaagccttcagggcttgggcttaccctccattatgagcatggaggagtttgatgctcagtcattagaagagaatgagcatgtgattggaaatatgtctgaaaat

SEQ ID NO: 7360 - DNA, 417 bp, Glycine max
  Peptide Sequence Number=SeqID_124138
atgacagaagccgtttgtatggataaccgcttgggtatcttcgcacgtcacttgacttcacggttcaggatgacagaaaccgtttgtacggataaccgcttgggtatctccatacgttacctgacttcacgggtcaggatgacagagaccgtttgtaaggataaccgcttcggtatctccatacgtcacctgacttcacgggtcaggatgacagaaaccgtttgtacggataactgcttgggtatctctgtacgtcacttgacttcacgggtcaggatgacagaaagggaggaagacgatggtgcagaagacgacgttagtctctgcatgctaccagactttgagtctaacatataccgaaagagtgtttatatggataaccacttgggtatctccgcctaccacctaacttcacgg

SEQ ID NO: 7361 - DNA, 354 bp, Glycine max
  Peptide Sequence Number=SeqID_124139
atggcttccattcgccattggcctattcatcaattggataataaaaatgctttcttacatggtgacctagaagggatatacatggagcaaacccctgggtttgatgctcagggggaatgggggaatgatgctgctacaatttatcgactgaaaaagcacctatttagccacttacagacaaatgaccttgggtgtctaaaataccttcttggtattgaggtgactcaatcaaacggatgcattgttatttctcaaagaaagtatgctttgaatatcttgaaagaagcaggcatgattaagtgtaggcttattgacagtcccattgacccaaatcaaaagttgatggcagaatag

SEQ ID NO: 7362 - DNA, 222 bp, Glycine max
  Peptide Sequence Number=SeqID_124140
atgagtggatctaatgaagaaaaagaaactaagttgcgtgtagaaataaaagagcttttgaaggaggcaagctcactgtcgcagccatcaaccttcgcacaagcagcaaaactcaagagactggcagctgcaaaggagagagaactagcaaagtggtcacatagggatcatgcagtagtcacaactcacaaggtaagacaggtgacaagtgaagcatgctag

SEQ ID NO: 7363 - DNA, 4206 bp, Glycine max
  Peptide Sequence Number=SeqID_124141
atgaagatgaatcttggtctaatgtcaattcatcctactccactgatgcggccaataagcaaatgcaggaccagagtcgctgtggtcgtccaagagtttggaggggaatggatcaatgataaaggggagcatgggagagatgcgggtaacagagggaatcaagggtatttcagctataagcttgggggtggaggggtgcaagatgttcaccaggttgaaaagaagctagacagtatggtatttggagggctaaagatgtatgtcaacactcctaaatttgggagaccaagttcaaaaatagctgtcaggggaagagctgaaggcaaacaatatctagaagggagtagaaatatgtacctaagcatgaaaccaggaacaaaggcgagcgttcatcaagggtcgtacacggaggcagtgaggaggcagatgccaaaaacagaacagaggagaataccacacaaggaggagctcatttgccttagctcgaggtcatcactgatccttgacatactggtgacatggcaacaatggctcaaaggggcttgggtagggagactaaaaaacctggccctctttgataggctagagaatggcatgttgtgggatatcggagaaaacatatctccgaagtacatcggggatgatatggtgttgctccttggtctcacagaagaaaaggctaagcgagtgatggaggaagaagatggaggatggggagaaatgtttaattcattacaaaaatgggattcacagttaaggcttgcctatagactgacatgggtgcattgttggggaataccgctgatagcgtgggacatacatcacatcaaacagatagtgtcttctatcggcaatatggtggacgctaatgatgatgtagaggaacaaagaaagttggatatggcaaggatcttaatcaaaacgccatggaagccactcatacaacacatggtgaatgtacagattcaaggagaagtatatgtggtacacatagtggaggaaagcgggaaatcatgtgtcaattgtcggcgccagcaatggaatgaccatagctcatcggaggagatttgtttggaggaaagcgaagctagaatgacatggggagacagcccgccaacgtggtggaaatgcatgctactgcaaaatagaatggcggcttcaggggaatcgagcagaggtgtcactgcgtcgggggaagagaacgatgaagaacacctggccggagcgaaggaagtgcggacggcggcggcagaaaacaattcagtttacggcaagtggcaagccatgtcggcaagccctgcacaaggcaaagagacgactatggagggaaaggaggcacaaagcagatggaacgacgcaacacaagcattgacggaaagaccatcagaggacggtgcatcagtgaatatcgatgtcaatcagcagaagtgggagaccactccggtgcaacggtcgccgaaaaagctagttaacagctcaaaccgggcctcggaggaagcggattcatggaaggggaccattggatcgggcgatggactggatctggcggatatggctattacccgctgggtacatgcacaaaatgatagtgaccagtccactgaggatgatgcgcagtcgtaccatagggaggaggcagtgctagcacaaacagatttgcaccaaaagggggataaagggcacaaggggagaggtgcttctgaggatagcagagagaaatttcatggaagtggaaagatgggggcagacttgaacgttgaagacataggcaatttcaaatttgatagggatgagccacgtgacagacagttgaaaaatcaataccctggaggatattggtgcctattaggggatttcaataacatcaggacaacttcagagagaatgggaacctgtcagagggggctagtggatggaagtatcaaggaattcaatgaatggattgaggaattgaaggttgaagaagtgtcttgggtgggtaagcaatttacatggttcagaccaaatggtaccgctgataggttcttggtctctccaaaatggctctccaaatgccctgggtcctctcaattcacgctccgtaggaacttttcagatcattgccctgtaatgcttagatccaattgtgttgattggggtccaaagcctttcagaatactagattgttggcttccagacaattccttcaagaaagtgaaaattaaagccctcaaagacaagatcaaggtgtggaacagggaacaattcggggacacctacaagaaaattgaggaggatttaaataagatggaagaggagacaactaataggcagttaaagaatcatgagagaaaagtcagaaaccagcttcaacaggagttgtgggaggcagctcaggcatacgagtcattactgagacaaaaggcgagatccaagcacagatctaattgcttgaatggtgtgctgactgatggttcgtggaaggatgagccaacaatcgtcaaagaggaaaccattgacatgcagcaaaatgacatgttggtggagcgttttcaagaagaggaggtcaaaagggcggtatggagttgtggtagtgataagagcccgggcccagatggacttaactttaaattcattaagcaattttgggatatcatcaaatctgacttcctaagatttcttgatgaatttcacctcaacgaagttttcccaaggggtctcaacgcatcttttatagcattaatcccgaaggtagcggatcctcaagtattgaatgagtacaggactatctcactgatagaatgcacttataagatacttgctaagattctggctaacagattgaagaaggttatgcatttcctcataaatgaacgacaatcaacattcatagaaggcagacacatgcttcatagtgtgatgattgcaaatgaagtggttgaagaagctaacagatgtcaaaatccatgttttatattcaaggttgattacgagaaggcgtacggttctgtgtcttgggagttcttgagttatatgatgagaaaaatgggtttttgctcaaaatggattcagtggattgaatggtgtctaaaatcagcatcagtcttggtgttggttaatggaagcccttcatatgagttcataccccaaaaagggcttaggcagggagatctactttcacctatgatgtttaatattgttgctgaaggtcttaatggcttaatgaccaatgctatatacaaaaggttatataggggattcctatcaggtacaaacaaagtggaaatcagcctcctccagtatgcagatgacacaatattctttggggaggcatctatggagaatgttagagcaatcaaggctatcttgagggcttttgagcttgcatcgggcttaaaaattaatttttctaaaagtagttgtggggatttcggagtgtcggaacaggttcctaaaaaggtggaggacaagctagtgaggctacaaagaaatttcctttggggaggtgcatctgaacaaaacaaaattgcttggatcagatgggaaatgatgtgcttgccaaaagaagaagaaggtttgggggttaaagacatccgctccttcaatacatcactgctgggcaaatggaagtggaagctatttcagaatcagggagaaatggatttgaagattctatctcaatacccacagcaggggcagcggttgaacatatcgatagtatggaaggttggacgtggggataagttcaaattttgggaagacacttggacagggggacacattcaactatcagagaagtatcctagaccattgttcaatagtgagatagacatggcggtctcatttatacaagaagtggaggggttcagaattcggtctcacattggagaccactggatgtgggaggcatattcaagtggacagtattcagttaggagtgcatacagtttgcttagacaacaagtagtagaggaggcccagattaatggaggagacagctggccatttgttctttcactgcaacaaagttcttctggtttgatgggaatcgttgtcctagtggaacgacccctatccgcgacgggcacctcagtagcggagcagttttgtgtcgcggctggagcggtcgctattgtgacggaagccggagttgcaatctgggcagaggagaacgacgtcgttttgtggaaccctaacgatgcggttgcaacggtagcaccagaatga

SEQ ID NO: 7364 - DNA, 219 bp, Glycine max
  Peptide Sequence Number=SeqID_124142
atggcgacacccactgcaaaggtgatggagtacttgtacttcacaacatcgtccctcacccactcaaagtcggcaatggcaaggaagaacgacgaagcagaagagaggaaaaccactgtgattgagataggctccctggtgggggaatcaacagaaggttctcccatggaggctagaggttcctccactagtacaatgcaaaaccctcaacctctctga

SEQ ID NO: 7365 - DNA, 273 bp, Glycine max
  Peptide Sequence Number=SeqID_124143
atgtctaggtttaagaatgaagttagaaaagccaaacaaaagcgtgacaagcgagaaggaagcaccaaggctgattcacacaagtcggacaagctccagcttctcctaaaaggacccaagtacgagtgttactcacctttgacggtcaatcgcactacaatccaacattctccactaagtgtgcttaggtgtcatgaggcatggctgaaaaatcctgcattactagggtaccttaaacttatggggtacactccctacactatggagacttaa

SEQ ID NO: 7366 - DNA, 690 bp, Glycine max
  Peptide Sequence Number=SeqID_124144
atgaaattgactggcaagataggctgggtttccttgaacaacatgtccaagaagctatttgagtttgactcaaatggctttcatcgcttcaaggaccgtttcttcaaggtcctaggtactgatgtcgtggatgatggtttaacacttatgtttaacagggatagggagccccgcttcccgtctaccgaaaatctgatcccactagacccattggccattctgtctctttccttcatgagcgatcctcttactgccttggatgataagtattttactttgtcttatttctttgtggttgaactgcatttgagactggacccgttggtgggattgcatcaccgtctactatcccccccgctgttggagaaggggggccaacttgctggtgagattggccttgttgttggtgttgctgaggtcgcccctagccgtaaaaagtcgagggcctttttgagccttcaagccttgaggcaagcagcaaggttaactcccagtttggttttgcatgatgtgcctccggctccaatgatcgtcaaggctcttgcttctattgttgttgttgttgttactcctacttctccatctccttctattgtatctgctcaggaggtcttgtcaacaattcttgtggtagctcgccttgtggaacctggacctttgattgcgatcgtcgtgcttattaaggagtaa

SEQ ID NO: 7367 - DNA, 2403 bp, Glycine max
  Peptide Sequence Number=SeqID_124145
atggtggcatcgttgcacttgcacataagaagaatcgtctttgggaacgcacatcccagacttcactcaacactcactaaaccccagctcaaggccctcgttctcgaccactactcccatggcaagttctccaaccttatccaaaacatcgtcgcttcgccccctgtcctccacaccgcatgccaaaacctctccccctcctttcccccccctgactgcttcagcattccggccacgtgccgggagctcctcgaaaaccgcttcgacgtggcatcatgctgcctcacactaactccctctttcgttttgcccaacttgaagctcaaggtcgtcattgaggccattcgaatggttcttgaaatcgtctacgacgaccgcttcgtcaccttttgctatggtggccgcgtcggaatgggacgacacaccgccataaggtacttaaaaaactccctcgagaaccctacttggtggttcactgtcaggttcaagcctcacaggtttcagcatttccatgtcgagaagctctgttctgttattgaaagcaaagtcaaggattccattttcattgatttgataaagaggttgtttcaatgtaaggctttggtcattgaattgggtgcggattggttaggaaggggacttcctcatgaatgtggcttgtgctccattttgatcaatgtttattttgatgcctttgataaagagattcaagagatgcgtcttcgggagaatcgagagaaccgggaattggatccgaagattattgcttcgggtttgtattctgatgtgttttacaagccggtgaaggtgtatgcggtgaggtacttggatgagatactccttgccacatcagggtccaagatgttggccttggagttgaggatgggggttgtcaagactttggaacttggattgggtttgcgtgttgataaggtgaataccgctattcatagcgcggtgtcggagaagattgagtttcttgggatggaattgcaggctgttccgccttccattttgcgcccgccaatgtcggagaaagcaattagggcacggaagaagtacctcaggcagaaggaagtcagggctcttgaattgagaaatgctagagcaaggaacagaaggaaactggggttgaagatatttagtcatgtttataaaaagatcaagcaaagtgatgggtttaaatttgactttagtattgaaaaccaggtccgagaaatttttagatcttgggctgatgaagtagtgcaagagttcttggggaatatagatgagtgtcaagaatggcatcgaagtctatcagctggcgatttcctacagttgagacacattagaaatcaattaccacctgagcttgttgatgcttatgataagttccaagagcaggtagataaacatttgaatcctatagaagctaggaaggcgatagaggaagaagaaagaagagtaaaggaagaagaggaacaaaattattcaaaaggaacagttgaggatttaacaaagctctgtatgaaagttgaggcacccgaaatactcatacgaaaggctgtgaagttggttgggtttacaaatcatatgggtcgtccaaggccaattgaatttcttgttgcacttgaggatgccgatattatcaagtggtatgctggcatagcaagaaggtggcttgattatttctgctgttgccacaacttcaagacagtcaaaactattgtaacttatcatttaaggttctcctgtatcttgacattagcagagaagcatgaatccaccaagcgtgaagtgataaagcatttcagcaaagatttgagagtctatgatatgaatggaaatcatgaagtgtattttcctacagaaagagaggttaagatgatgggagatagaaatctttctgatccaaaaccagtagatggagctttatctttggctgtagtaaggttggcatctgatgagcctccatgtcattgcattgcccatttctgtgacaagacaactaccgtcttttatcgggtccatttgctgcaaaacagattgaatgtcagcccattggacaaagaaaaatgggtacaagggatgggtgtaattcatgaaagcctaaaccggtcggtcataggcgttgcagctggattggctaggaacattatgacaggaatggtggaaggaactgtaatgatggttggtgcatgtgaaggtgcgatgagtggagtaggatttgtggggaaaattgaggttgcgggttgcattgtctactgctgcaaatatgtgcaagaagcttccttagatgcagctgattttgtgatggaagttgtttctcttctgacaaaccttcagtaccatgattccaaggttctggagcacgcctctgtctgtttgactcgaatagctgaagcttttgcgtcaaattag

SEQ ID NO: 7368 - DNA, 321 bp, Glycine max
  Peptide Sequence Number=SeqID_124146
atggtgtggcgtctccaatcacctatcctccttctcgaatctgtttccattgatcttcaagaagcaaatgactctattgatgaagaagatccaaggcctacaagctctacatggagctacatcacattatctacaaggttcaatttgaagaaaggaaacaaaattaaaaatgaatggagcaaatctgtcagaagaaacattgcattcttgttcaaggttcacgatggccctttaacgagaatagcaacaccccctacagtagcaaaaccatcatcaccacataatacacttaatataatcataacttgcattcctttataa

SEQ ID NO: 7369 - DNA, 303 bp, Glycine max
  Peptide Sequence Number=SeqID_124147
atggtactagagtctattctagatccatcgttgggtcacctgcatttgacacactccagattgaaagtcctgggagtgagcccaccaaacctgtctcagaagaaccacgatctggaacttattcaccgttggatcgtcgtgaaatttgattaccacgttcgaaacccaattctgagcattctcaccattgggaattgcaaaaacatgtcggagctaagagaaatacccttcacaccgtacctttctcttttcccgcaaaaacccagaatggtctcagtaaagctacaatcccggtttcgataa

SEQ ID NO: 7370 - DNA, 389 bp, Glycine max
  Peptide Sequence Number=SeqID_124148
aagcgttaggtgtggcaaagccttcagtagctagttaccttagccaggagatactggcagagcaagaagctgatagagtgcatggatttcctgcgcagcctcaagttcaagaatatggtggttatatcactgtcaatgaaactcaaggcacaacactgttctatggtttttcgaggccactcgcaaaccagaacaaaaacccgttctcttatggctcaatggaggcagtggctggattaactcagcctaacaatgcaaagcctattgttgattccagtttttccaaggctaaaccagaagattctttggacccacaattcaaaccgccacaagcttcacaactagtttctgtcttcactattttattcttgtttggttgctcaaattaa

SEQ ID NO: 7371 - DNA, 703 bp, Glycine max
  Peptide Sequence Number=SeqID_124149
aggactacacgtcctcgccttcagaggattgcacgccctccccagcaggggaggactacacgtcctcccctgcagaggactacacatcctccacttcagaggactacacgtcctcgccttcagaggagtggacgtcctgaccttaagagggctacacgccctcactttcagaagactatacgtcctccctttcagagggctacacgccctcacctttagagggctacacgccctcgccttcagaggactacacgtcctcaccttcagaggacgacacgtgctcaccatcagagggttacacgccctcgccttcagaggactacccgtcctcaccttcagaggactacacgtcctcttattcagaggactacacgtcctattattcagaggactacacaccctcgccttcagaggaatggacattttcaccttcagagggctacacgccctcaccttcagaggactacatgtcctcgcctttagaggactacatgtcctcaccatcaaaggacaacacgtcctcgtcattagagggttgcacgccctcgtcttcagagagttgcacgcccacgccttcaaagggatacatttcctcacctttagaggactacacgtcctcgccttcagaggattgcacgccctccccttcagaggaggactacacgtcctcccctgcagaggactggacgtcctcctcttctga

SEQ ID NO: 7372 - DNA, 339 bp, Glycine max
  Peptide Sequence Number=SeqID_124150
atgtattgtactcctttaccttttcatcaaacttttggccagacttgtgagtcagtcggcgtaactagccatgaatggatgaccaatttattttgtatcgatttgaatacaccaaattccatgccatcatatttaaattctttacaacaattcaatgcaccacattcatttagagaacaaggacaaggttcttcagctgcaacaacctacactaaatacactaacatagaacaacaacatcatcatcatgtgagagaaccagtcatacagaaaagaagaaatctgcaacgtaatcaacgtccaccaccctataggactggtcatcgtcttgatcattga

SEQ ID NO: 7373 - DNA, 468 bp, Glycine max
  Peptide Sequence Number=SeqID_124151
atgaactcccctgctttacctacttcaacacggctgtttattggtctgatgtccggcaccagcctggatggggtagatgcagtgatcgtctcacaacacggtgaacaggttacgcaaccagggcactattttgtgccttatccagcggacctcaagcagtcattacttgatttgcacaccccagcgctggatgaaatacaccaggcagctgtgatctccaaccgcctggctgagctatacgcacaagcagtaaaaggcttactcgccgagtcttcactccgcgctagcgaggtgactgcaattggctgtcacggtcaaaccatacgccattgccctgatttgccaaacggacaggcctataccttgcaattaggcaaccatgcgcgcctggtagaattaacgggaatcaccgtagtaggcgatttccgtagccgggatattgccgcaggcggccaaggcgccccttta

SEQ ID NO: 7374 - DNA, 312 bp, Glycine max
  Peptide Sequence Number=SeqID_124152
atggccaatcaaggagactgggtcccgtttatggatgtgttagctttgctaatttttggggtcgtcctctttccaaacgtggatggtttggtagacctagcagcaatcgacgctttccttgcctaccaccatagcaaggaaagtccggtggtagctgtcttggcagatctattggacacatttgaccgaagaatagattgggaccagctcttggccgggataggaggtagaacaatcagttggttcccccgatggaaggaaggaaaagaaggagtccttttctcatgtggaggatacccaaacattccgctg

SEQ ID NO: 7375 - DNA, 600 bp, Glycine max
  Peptide Sequence Number=SeqID_124153
atgggaatccgacaggttggaccaatttatggaaacttggaactcagaaacagcaacagaaacaaatatgcagtaattgtttatgaattcgggagaatattattggattacagcattagaagctggcagaattcagaagccaaggtggatgtgatctctggtgagagggataccccgaaagatgccatggataaagcagctggtatatttctcagagaggagatcaatgaaggtgaaatagaagccattgaactaaatgctagtagttcagagagatcaagctatgaagatgatgcttatcaagcaataggtgatgagtatgattatctggtgaataataatgatggatatcagggaggatttagtgggaaatctgagaacttattagatggaaaccactataatgtgagtggtgaggaagatatggatattgatgacaaagttgactacgatgatgatgacgacaggcaaattgatcttgttgtcgatgattacacaattgggggcgactcagatgcaagggacaagaaagaagaaaatgcagaacaaaacattgatccggatggagttggttctacatcatcatactatagtgattaa

SEQ ID NO: 7376 - DNA, 426 bp, Glycine max
  Peptide Sequence Number=SeqID_124154
atgtctcttgatgatgctacaagtactgtgatgaaggctattgcttatggagctttgagggacccaaaaaagaacagttctaattcccaagaatctgatcctgatgtttgttatgctccccctggaaagaagtctcgtttagtatggcaaggagaattgcatcatcaccaatttgtcaaggctgtgaatgtgatgcaagttgggcttgataaggcacagccaaagagaactcttgaagtgatgaatattcctggtttgacagaagagcatgtagctagtcgtttacagaaatatagacttaatttgaagaaatctaataaagaggttgtgcaacaggatgagatgtcattgccaaactgtatagaatccagaggcagggtaggtccatttggaagatttgacttagataggttttggcgcaactag

SEQ ID NO: 7377 - DNA, 582 bp, Glycine max
  Peptide Sequence Number=SeqID_124155
atgccacctaaaaaaagggaagccacagtagcagccctagagcaagaagtagcgaacctcaaagtaacgctagcggagatgcaaacgaaggcagaggagaatcaagagaagttggtctcgctactcaccaacaaagaggctgagagtcctaggaagtctaacatatcaaccttgcagaacaggggatctgtcacgggcggaaacccagggtctcatgttctccatgaaaactccctggaggattttcgtcaaccaacgaagaaagtggaggtttccatgttttccgacaaggatccggtggctggattgcacgcactgaagtgtactttcagcaactttcagctctccaacaacagggaagtgtggatgattacatccgcgaatttgaacgactcacggtggaggtgccgcgtcttccaaatgaacaatatcttgggtatatttcatccatggactccaatcgaatatccgaggaagggtgagaagcatgagggtgttgggtcctctttctcgttccagattgttgaatctgacacgagtcgtataaagggaggtgcaagaacaaagacaagtctggaatag

SEQ ID NO: 7378 - DNA, 537 bp, Glycine max
  Peptide Sequence Number=SeqID_124156
atggagtccactggagctggcgcaaaccctcgaaccgagataaagggacatgacatttgtcatttcaggaactcaccgaaaggaggtagaaagtgtcctgaacgacaactacaaataatgatgcgagacgatgaagaggacgacgagggggaggatggaaggcaatttcgcaccatgaaatcacaagggaaaattaggggagttcctgtgttattgcttgttgatagcggtgcaacccataattttgtgttcgcacagcttgcggagacgatggggtggcccattactgagaccaaacccatgcgaatcaaactcggggatggttacagggctatgtcacgagggaggaacactggggtaaaactggagttggatgcgtccactatagaattagatgcacttctgtttgatttggaggggattgatgtgatactctggatggcttggctggcctcacttggaggcatgggtagtggcaagagttacatggagccacagagagtagcccaaagcaggtggccttacaaagtttcatag

SEQ ID NO: 7379 - DNA, 288 bp, Glycine max
  Peptide Sequence Number=SeqID_124157
atgtcatgcctatggacacggtcattgggggtgatgagagaggctcctttgactttgtacacagaagtgggaatgattctagaatcatatgtagtaaaaaaaggaaacatagaagttattgctctggtatttgctcgggacagagacaggtctttgggaactattaggtttcatgttgcattgtcaaatggtgtttcaactgtgggtcccatatacaagacaacctcagttaaatcaaacaatgctgattgttcaacatggctaattgctaggagggaagggcaatag

SEQ ID NO: 7380 - DNA, 210 bp, Glycine max
  Peptide Sequence Number=SeqID_124158
atggggtgctctgcatcgagagaagttggggtttgggccatgaggggacggagaacctcaagcgatgaggggtttaggttttttgggggaggaatatggagttgggggtggtggtggcgtcggggagaaggtggagatatggaaaagggaagaggagagaagaagaaagagaaacggacacaaagaagaatggacgcgagccatatataa

SEQ ID NO: 7381 - DNA, 1375 bp, Glycine max
  Peptide Sequence Number=SeqID_124159
ggtaggttgcgacaacgtggaacgtctgggttgtgaggaagaaggttccactgggtgttcattgtctgagggttcttgtattgtgagctgtggtggtgtggtttctataggtgagtcgtattggctactggaaaaggatcccgggaagggtgtactgggacttaggcgtttctacacacgtagtttgatgtatgatacctttcgaggcgtagaagccatgcatgaggaactcaggcccgttgtcactccttattattttgactttgcaattatattgggtttcgatggatgcaatgaaactcatgatagtgtgtcgggtttctgccttagtgtgcataagatgtatccattggaagagaagattagtgcacagttagtagaagacacaagcttagaaatggaaataaggttgaaggtgcacgattcccgaatgggtagcatgaacatgatggccgttagggagctttactatgattgggttgatgcgttcataagaatggagattattcagggagcagtcgtgaaggatcgagacatacctgggcttggtggtttatcaatggtgcatgatgagatggaggcaacttgtttggtctgctcagatgtcgtgtttccggccgatggccgctggattaaagcaagtagggccttgtactgctcagggtttatatcccggcggatacccatgcttccagtagcaaacgtcgacggtgtgacctatcttaccgcagtgagtgcatgttttccttccgccagtgttcttgttccttccttcgtgattaagaggcataccatgcttcttgtagcaaacgcttttcgtgtgaccgattcgtccacagtaatcgcagatggtttttccagcattaatggaaatatctttaggtatgggatccatgaggagcacgtgagatcgaatgttggcatactgttcattcaagccacgcaagaactgcatggctcgatcttcaagctttctttgtgcaatgatggtgaaggcggagcaagaacacctgatgttgcaatgctccttgtttcaacgttgacgcttcttgctggagatcggaaatcctcaaaagatctccctgcgaatatctcgatttcaggtcttgccaaatttcttcagctttgtccatccagagtatgttttgccttatggaagttgcaatggagtggactatccaagataccaccatattattgcaccgacgccaagctccgtacattctgtctgttttcaagggttcaggactggagaaacgagagcagtggttgggttttcacttggatgaagatacaaagctctgataccatgttgaagataatatcgggttgtgcagaaggagagaacatcgtgttcatattgaagatgtatcgg

SEQ ID NO: 7382 - DNA, 1815 bp, Glycine max
  Peptide Sequence Number=SeqID_124160
atgcctttcagactgatgaatgctctggccatgtttcaggctctcatgaatacaattttcggggatgtgatgaggaaattcatattggtgtttttcgacaacatcctggtttatagcccagattgggagtcgcatatgaggcacttaaccatggtgttagagctgttgcagactcaccaggtggctaatagaaaaagatcttcatttggtcagattttggttgaatatttgggacacataatctccctcgagggtgtggcgatggatcccagcaaattcatcgacgacaatggcaagattgccaagccactaactacccttactaagaaagagggtttccattgggataaccatgctcaagaagcttttgataaactcaaacagaagctaactacaggtcccactcaggccctcccggatttcagcaaggacttaggtggcagacatgtggattatagcatggcattggccgatagggacttggccaagtcagcttatgagaaagagttgataacaaaaaccacagttgaccagcagaattgggccaccaaactgttgggctatcagtttgacattgtgtacaaacctggtctggaatataaaggagttgatgccctctcacgggtgcatggtgaagctgaattacaacctatgatccactaccctcattggcccaaggggcaggaagtgattgaggaagcccatcgtgatgcagaattaaaagaaattatccacgcctttcgcaataatcaacccaccaaaaccggtttctcctatcagaggggggttttgctctacaaggggcatctagtgctcgctagagcttctccatggattcagcagctacttcaagagtttcatgcgactccactagggggccatctaggcttctaccggacttatcatcacgtggctgcaaatctgttctggtttggtatgaaacgtgttttgttcaggagtgtgacatgtcaacatcagaaatacatcgcagctgcacctggaggtctcctcccacctctctgtattccagagttgacatgggaggagatatccatggatttcatcaagggactccctaaatccaaaggcttcgaagcaattctggttgtagtggatcggctctcccagtatagccactttatcgctttcaaacatccttatactgccaagatagttgtggaggtgttcaccaagaactcaactcaagatgagcactgcttaccaccctcaaacggatgggcagaccgaggtggtgaaccgctgtttggaaacatttcttcgatgctttatggctggctgaccagccaaagtcatggtcacaatggaggtactactccttttgaggcagattatgggcggcctcctccaatggtgaattgtttcctcccaggagagacaaggatggaagcggctgcacaggcagcaatccttgggtgcttgaatctgccccaaactctctccaaggtattacatcccatttcagactttggagaaaattggtgcggtggcttacaagctgcaactgttgggaagtacactgtcaagggaactcttcccgagttggagagtgacaccacgaatcccatcacactggtggccgtcctcattacccatgtcattacaaagggatgtgactcactaaaacagtttttggtgcagtggaaagataagccaatcgaagaggcttcttgggaggaggaattcaatttccgaagtcaatttccatctttcagacttgaggacaagtctgtgattcaaggaggggagactatgacgggactgcatccgctgatagcggcccaaatgagttactaa

SEQ ID NO: 7383 - DNA, 417 bp, Glycine max
  Peptide Sequence Number=SeqID_124161
atgtcgccacacgggggcgacatggatgggggtgaaaaaaggaaagagagggatggggtttctcttgcttttggcatagcgggccccggcgggaggcccgcacgacgggctattagctcagtggtagagcgcgcccctgataattgcgtcgttgtgcctggactgaggatagatggggcgattcaggtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctcacaacgtatcttcacagaccaagaactacgagatcgcccctttcattctggggtga

SEQ ID NO: 7384 - DNA, 156 bp, Glycine max
  Peptide Sequence Number=SeqID_124162
atgagcgcgacagtgaacgaaatagtgtttggtaacctcatcaccatcgtgagaccgatagtgaaagcgagacaaatagtgaatgcgagagtgacactgatagtgagagtgccgatggtgaggagtttcagcaacacgacagtctctcgtgattga

SEQ ID NO: 7385 - DNA, 189 bp, Glycine max
  Peptide Sequence Number=SeqID_124163
atgggtgacttccccatcgatctttatctgacattgagcaaccatctacggggcctaatggatattcatactacattaattactgagagaaggagttgtgggggagagcaagagggacctgctgctcagaagagaaatcgagagagaaaaagtgagggtgaggagctgaagacaagggaaggttcttga

SEQ ID NO: 7386 - DNA, 216 bp, Glycine max
  Peptide Sequence Number=SeqID_124164
atgccactattgctgtcgatgccttgtctgtatggtgaaaaagggaagtttgatgagttgcttgaggataagggtgttaatatattgattgatccaaaggcccttatgaatgtcattggaactaaaatggattttgtagatgacaaactaaggatccagacacaagtcatttgtttatctacattactaatcaagatccatattcactttctgtga

SEQ ID NO: 7387 - DNA, 137 bp, Glycine max
  Peptide Sequence Number=SeqID_124165
atggctagaggaaagatccagatcaagaggatagagaacaccaccaagaaggccaacgagctcaccattctctgcgatgccaaggtttctattattatgttctccagcactggaaaactccacaagatcgagcaatc

SEQ ID NO: 7388 - DNA, 837 bp, Glycine max
  Peptide Sequence Number=SeqID_124166
atgaaaatccaattaggactgattttggcctcacaaaggtaccctaatacacctggcatttggacaagagaacaggtggaagcttggaaaccaattgtgagcactgttcatgagaagggagaattccaaccacatggtgaagccccaatatcaagcacaaacaagcgacctcgtaaggaaatccccaagcttgtcaatgaattcgtaattgcggccaaaaatgccatggaagcgggttttgatggaatagaactacatggagcaaatgggtacttgctggatcagttcctaaaggacaaagtgaacgacgaagatgatgagtacggaggtactatagaaaatcgttgccggttcccactgcaagtggtgaaggcagtagctgatgagatcggagctgacaaggttgggattaggctctccccttttgctgattgcgtaggagacgacaccaacaacgatgatcctcaagcattggggattcacatggctgagtcattgaatcaacttggcattctctatattcacttgattgagcccaggacgatggtaacacagttccacaagtttgacacaaaatatttgtccctagagccaattaggaaggccttcaagggaactttcattgtggctggtggttacgataggagtgagggaaacctagccatatccagcagtgctgctgatttggttgcttatgggcgcctttttctggcaaatccagatctccccacaagattccagctcgatgctcagttaaacgaacccgatgccaccaccttttccacccatgaccctgtgcttggatacacagattacccatttcttcaagatatatag

SEQ ID NO: 7389 - DNA, 321 bp, Glycine max
  Peptide Sequence Number=SeqID_124167
atggagaaaaagaaagtgcgaacaagaaccttcgatggagaagaacagagcatgaagaacaaccttcgatggagaacaacagttgtgattaggacgatcattgaggagggggggtcttccatgaccaaatttgggatgtcttcatcagtaggcatgttcgctacagtcggggatgaggatgatgtggatgtagatatttgggacggtccatatgcgtcaatcagagatggagatggtctaccttcagttggaggtggagatggtgtaggtgcaacatccgaagatctgattggcatagatacagtagacaaggatcggtga

SEQ ID NO: 7390 - DNA, 429 bp, Glycine max
  Peptide Sequence Number=SeqID_124168
atggaggcagtggattcatcgagatggtcattggagggtaatggcattttttgggtacacttgacgtatgtcgcattggaggattatacttatgtgattagtaaagagcccatttggaagaaaatatggaatattaatatccctcctaaggtgaatattttcatttggagattgatgagagatagattaccaagtagagaaaatttgaaaggaaggaatgtggtgattaagggctacattacatgttgtcttttttgtaagcaaggttgtcgtcctgtttggttcttggagatggtggttgaaaaacctcattttcgcctaaagcacgtcgtcatcggcattgttcccatggaaatgagttcctcgtcatacaacttggagccccaaagtcgcatgttggtgtttttattatgtagcaggagaatgtga

SEQ ID NO: 7391 - DNA, 1827 bp, Glycine max
  Peptide Sequence Number=SeqID_124169
atgggagctgtcttatcccagaaggcgcatcctatcgccttcttcagtaaaccttttaccccaaagctcatgcgtgcttcgacttatgtccgtgaattggccgcgatcactatggccgtgaaaaaatggagacaatacctcttggggcatcacttcaccattgttacggaccaccatagtctcaaagagttattgaatcaggttattcaaaccccggagcaacatatgtacttggctcgcttgatggggtatgattacgacatacaatatcgttccggtagccacaaccaagcagctgatgctctgtctcaattacctgaatctgattcgtctaccttaatggtgatatcagtccattgctacacttttatgaaggaacttcgccaacaattgcagactcatccacagtatcaacaacaattaactgatgttcttcgatatgccgccacccaccctgggttttcagtctctcagggtctccttctccacaagggacgcatatggctaccacaggggttaccaattatctctactctactaatggaatttcacgcaacccccacaggaggacatgcaggggtggctaaaactattgctcgcattacagagacattcacttggcctggtctccggcatgacgtcactcaatttgtagcaaattgtgttgagtgccaagtcacgaaatacgaaacgaagaaggcagctggtttattgtgtcctcttccaattccacaccggccatgggaagatctgtctttagattttattgtagggctgccaccgtataagaattataccgtgattctggtggttgttaatcatttttcgaaaggtatacatctcggcatgctaccttcctcgcattctgctccgctggtggcttcattgttccttgacattgttgtcaaactccatggcctccctcgaagcttggtttcggaccacgacccgctctttgtaagccaattctggcaagaactctttcgagctagtggtactaagctccgtatgagcttagcctaccaccctcaaagcgatggtcagaccgaagttctcaatcgaatcattgaacaataccttcgcgcttttgttcatcgtcactctcgtgcatgggaaaagctacttccctgggttgaactctcacataatacgtcatggaatgaaggcaccagaatgactccatatgaagttaagtatggtcagaaacccctcaatttggctgatcaggttgctggcgattccaaagttgatgttgtgcaagagatactcactggcagggacgatacctttcgcaccattcgcaagaagctttttaaagcccaaacacgcatggagcaacaagctgataagaaacaccgtgaagtcaattaccagccaggtgaatgggtgtatgtaaagcttcgacctcgtcgtcaaggttcagctaaaggagttcaggtgatcacggacaaattagctaagcgatactatggcccattccgtgttctagaacgccttgggcctgtggcctataaatttcacttactagaggaggcccggattcatccgatgtttcattgctcgttattcaaaccatttcacggctcaccggaaacaacacctacggaggactggtaccagatcggcaacgactaccaccttgaggacaaggtggatttgcaaggccccagggatgatacaaacacagagaccacatcagaggtgcatttagcagaagatgatacaaacatagagcccacatccacagagtcaaaaacagaggtgcatttagcagaaaagcccaagaggaaacttaccaaaccagcgtatctccgtgattacgtgtga

SEQ ID NO: 7392 - DNA, 537 bp, Glycine max
  Peptide Sequence Number=SeqID_124170
atgatgactgctgcagaatgtatgttaagagacttgggaaacaaggctttgaagagtattaatgaaattaggagcaagtggtcacgcaattctgatagaaagagctcaagcaccggctgcgaaggaagttatgaaggcctccttcgatgcattcctcacattttgcttgctggtggaaccaccagggtgttcaatgaatcagatcacgaaagtatacgagaggattttgacagtttgaagcagctattctgcagttttggagaagaattgatagcagaaaatgaggtggagaaagcggctgagatagtggagggagtgatggcactaatgggaatgagtactgaacaattgatggaaaacttaagtaccttatcaaatgagacaagtggtaatggtcagaagttgccaatgccaccaactacaggaaagtggaatagagcagaccccaacacaatattgagggtactgtgctatagaaatgatcgaactgcaagtaacttcttaaaaaggacattccaaatagcaaagaggagatga

SEQ ID NO: 7393 - DNA, 915 bp, Glycine max
  Peptide Sequence Number=SeqID_124171
atggtgggcaatggccaacaactcgaatgtcagtggttgtgtgaggccatttccattgagctccagactatctcagtcaccgtcgacttgtatgttctccccattgtcgacgcaaatgttattattggggtacaatggcttaaatctttaggcccgatgcttaccaattatgctgaattgaccatgcaatttttttacaatggtgctctggtcgaattgcggggagataaggatactcagatgggcctgatcactccaccgcaactccgtcgtctatgtcgtaaaccagagggtgccatttgcttccacatatcagttattgcggaggacattccttcatcctcttcacccacttggcccccagagcttcatgccctgttactcgaatttagacaattatttcagaaccttcaatctcttccaccacctcgcacgactgaccatcacattcacctcctccctcaggccaccccagtgaatccaagcaccagtccattctcttctccggtgttgctggtgaagaagaacgacggctcgtggcggttctgtgtcgattatcgggcattgaatgccttcacaatgaaggatcgtttcccaattccaatgattgatgaacttttagatgaattaggtggggcgcgatgcttctcaaaactggacctcttacagggataccatcaaattagaatgcacgaggcagacacaccgaaaatagcttttcgcacacaccatggccattacgaattcaaagtaattccatttggtctctgcaacatgccttcctcctttcaagccacgatgaatatgatctttcggccttacctccgacacttcatcattgtcttcttcgatgatatactcatatatagcagctccccggaggaccatttgcaacaccttgtgacaacatttcag

SEQ ID NO: 7394 - DNA, 729 bp, Glycine max
  Peptide Sequence Number=SeqID_124172
atgttgttggatgaaattgtgggtgctcccaccgtccacaaggaggagcacagcttgcccgaagatgatgcccggttatttataaaagaagaagctgggtcattgggttcgtcatccgccgcgataagaaggaataccctagaggggcagcgatgccctctgtggtattgttcgtcgcaggtgaaacaaagtcctcgctcccggcgtgaggcaatctcctcgggagaaaggcgtttcagggttggggccgcgggtttgggtggaagtggtgtgggctgggtagggggaggtaggagagggggtagcggtgtcgggcgaggaggtgggagtatcggggctagtggagggcgtggcaagacctgcagcttgggccagcgtcaacggctggtgagcctgcacctccctgcggatgtcggaggaaagtcccgagacaaagcaactcagaaggaaggatggccaagaggtaaattggtcgttgcttgtcatccattggaaccaagcaagggccctaccctccatttaaatggccgcaatggtcagccgatcatgctccagggtggaactcgaggtggggtaaaagggggtgtttgcggtgatgagctgctgattggtaaggcggaccaaggcatcctcaagtctatcaggaggaccataggaattgctggaatcagccatgggaggagcaacgagagcactaatgatagctctctgaaaatgatgctagcttag

SEQ ID NO: 7395 - DNA, 159 bp, Glycine max
  Peptide Sequence Number=SeqID_124173
atgcatatgacacagatgcaatttacgaatacgggagcccgagaaactgtctccttctcagatacaacgtctaggggtagcaaagtgccccaacaggggatcaagacagaacccatgtgcgatgcatatgcgaaaggcgcaacacgggaatgtacataa

SEQ ID NO: 7396 - DNA, 321 bp, Glycine max
  Peptide Sequence Number=SeqID_124174
atgcagtaccgcgccgatatgcgcagacaggcgatagagcagcgtatgcagcccggtctccgccgacggtgtgcggccgctcggcacatgattgtcggcaatatccacccgcagaaaatcggcggcgctcaggctgcccttgtctttgccggactcggtgaccaggcactgacgttcgtccaggcgcagcgacatgttgccgccggtcgccgggcaccagcctttgtcgccaatccagtggcaggccgccagcaatgcggtaagttgcggattctccgtcattattatcgtttcccgttcggtaaggcggccggcagatga

SEQ ID NO: 7397 - DNA, 2475 bp, Glycine max
  Peptide Sequence Number=SeqID_124175
atggcattaaacataacctccatcaaaacatcctccaacggcttatggcaaggagacaaccccttagacttcgccttccctctcctcattctccaaatcaccttaatcatcctcctctcccgctctctcgccttcctcctcaaacctatccgacaacctaaagtcatcgcccaaattatagctgggattgtcttgggtccttccgttctgggaaggaacaagacattcaagcaccgcctgttcccgccatggagcaccccgttgctggaatcgctggctagcataggtctcctcttcttcttgttcctggtaggtctcgagctcgacttggtcacgattcgccggagtggaaagagagctctgagcatcgccgtcgccggaatgtccctccccttcgtctccggcattggcctcgccctaatcctccgcaagaccgtcgacggcaccgacagagtcggcttcgctcagttcctcgtcttcatgggagtggcgatttccatcacggccttccccgtgctcgcccgcatcctaaccgagctcaagctcctcaccacgcgagtgggctgcaccgccatggccgccgccgcgttcaacgacgtcgcggcgtggatcctcctcgccctcgccatcgcgctcgccggcgacggcgtcaacagccacgtccacaagagccccctcgtctcgctatgggtgctcctctccggcgtggccttcgtcgccttcatgatgatattagtcaaaccggcgatgagattcgtctccggaaaatgctctccggtgaccggcgcggtggatgaaacctacgtgtgcttgactctgctgctcgtgatggtgttcgggttcgtgacggacatgattgggatccactcggttttcggcgcgttcgtgttcggaataacggttccgaagggcgcgtttgcggagaggctgatagagagggttgaggatttcgttgtagggttgttgttgccgttgtattttgcttcgagtgggttgaagacgaacgtggctacgataagtggcgcgaaggggtggggaattttggcgctggtgattgcgacggcgtgcgccgggaagattggggggacgtttctgacggcggtggcgtgcaagattccgatgagggaggcgatgacgctggcggtgctcatgaacactaagggattggtggagctcatcgtcctcaacattgggaaggaaaaaaaggtgttaaacgatgaaatgtttgccattttggttcttatggctctattcaccaccttcattacaaccccaatagtgttgtccatctataaaaacactaatgacatatcctttcatcaaaccctgagaaaactaggtgaccttgacactaatgataaagccactaacgagtttcgcgtcttggcgtgtgtgcatggccccaacaacgctccttccatcattaacttgattgagtcaattcgtagcatccaaaaatcctccatcaaactcttcatcatgcaccttgttgagctcacagaacgctcttcatcaatcatcttggctcagaacactgataataagagtggctctagccatgttgagtggctagagcaactttatagggccttccaagcccatagtcaattgggtcaagtttcagttcagtccaagaccactatctcttcgttgtccactatgcatgatgacatttgccacgtggcagatgagaaaatggtgaccatgatcatcttgcctttccacaagcggtggaagaaggtggaaatggaaaatgaggaggagaacagtgaggtttcccaacaccaaatggaggaaaatattggccatgggtggagaggtgtgaaccaaagtgtacttaggaatgcaccttgcactgtggctgtgcttgttgatcgaggatatggacatgggcctcagaatttgggcctatataccactgtgacccaacatgtttgtgttttgttctttggtgggcccgacgatcgtgaggccttggagttgggggatagaatatctaaccatccagcggttaaagtgactgttgtgaggttcattcacaaagatgtgttggaaggtaacgacatgtcacactcttcaccaagcaaaactaatgggaaaagttacaatttagccatatctaaagtgtaccctccaaaggaaaaggagctagatgatgcaacaatggcaaggttccaaagaaagtggaatggaatggtagagtgttttgagaaggtagctagtaatattatggaagaggtgttagcattagggcgaagtaaggattatgatctcataattgttgggaaaggtcaattttcgttgagtttggtggcagatttggtagataggcagcacgaggaattaggtcctattggagacattttagcatcatcaacgcatgatgtggtttcttcagtgttagtaattcaacaacataatgcgctactgaatggggagacccctttatctatgagaaatgacaatgtaatataa

SEQ ID NO: 7398 - DNA, 633 bp, Glycine max
  Peptide Sequence Number=SeqID_124176
atgttggatatctcgcaattcgatcagattaacccaccggcgcgtctgctgatggggccggggccgatcaacgccgatccgcgcgtgctgcgcgccatgtcgagtcagctgatcggccagtacgatccggcgatgaccggttacatgaatcaggttatggcgctgtatcgtgcgctgttccgcaccgaaaaccgctggacgatgctggtggacggcacctcgcgcgccggcatcgaagcgctgctggtttccgctattcggccgggcgataaggtgctggtgccggtcttcggccgcttcgggcatctgctgtgcgagattgcccgccgctgccgcgccgaggtgcacacgattgaggcgccgtggggcgaggtgttcagcgccgatcgcatcgaagacgcgattaagcgagtgcacccgcgcctgctgctgacggtgcagggcgatacctccaccaccatgctgcagccgctgcatgagatcaagcttatcgataccgtcgacctcgagggggggcccgtcgggaaacctgtcgtgccagctgcattactgaatcgggcaacgcgcggggagaggcggtatgcgtattggggcgctaacggagtgtatactggcttactatgttggcactga

SEQ ID NO: 7399 - DNA, 236 bp, Glycine max
  Peptide Sequence Number=SeqID_124177
atgacgaagggaaatgacctgccgcgcttaacgcagctccagttcgtccagcgcctggaacagttcggcgacgtgatgaatacgctgccgcccctgcgccagccgctcatgcagcaacgcattgctgagcaggctggccaggctcatggcggcggcatagctgtcgaacgccgacacgctgtcgagcggcacggtcaagtgccagttggccagtgggaacaacgcctgcgcctgcg

SEQ ID NO: 7400 - DNA, 639 bp, Glycine max
  Peptide Sequence Number=SeqID_124178
atgcaccgctccccccaactccaacctcatcattccggcgcaggccttgagaacgaaagggaacgtgaacttgttgggcgaaacagcgtgccgtctcatggtgttgtaaaaacgcagggcgtggggcttggagtgcgtcgtttgggcgaaggccctgatgagcgtgttgaagaggaaggcgtcgtgggaagggggaggggtggtttggtcatttgggaagaggacggaggaggcgtagtggacggcgttgaagtgggaggaggtggcggcgaactttgtgaggacgagtgggttgtggtggaggccgagtttgaggatgagggaatggatttgcgtgaaggtggtgagcgtgtcgcaggtggtgaggagggacaagatgggaggtggacttggaagaacgtggtggtggtgatagcagatgatgatagctttgttaattgcattgcttcatttttctgctcaaagtggaaaagcagtacaacaccaagtgcagaaacagaaccgcaatacgtatcagttcatttccctcttttcttcctttccgactctaccgtgcgccgtctcaagactctcaactctacttctctagccgctaataacatactttctgtctttcactctctctttcctatggcttaa

SEQ ID NO: 7401 - DNA, 558 bp, Glycine max
  Peptide Sequence Number=SeqID_124179
atgtatcaggctgaattcgaaagggatgagctcagggaccaaatccatgtgctatatataggcattttatcatcaagaatgcatttaatagtcattaccactcattattggcgtgtggggagtatagggcaaggtgggcaagaagaatttgtagaaaatgtgaacgtcagtaattgcatattcaatggagctagtagtgcagctagaatcaagacatggcccggtggaaaaggatacgccaagaatattgccttccagaatatcagcgtcaatcaaacagattacccaatatatctttcccagcattacatgggcaccccagaaaagaaggacgcagtaaaagtgagtgatgtcacatttagtaatatccatggaacatgtattagtgagaatgcagttgtgctggattgtgccaagatcgggtgtgacaatattgccctgaaacaaatcaacattacctcaatcgatccaaagaagccagcttctgcaaagtgcaatgatgttcatgggaaggctactgacattgtttctcctcctgtccattgtctgcatcgctaa

SEQ ID NO: 7402 - DNA, 1362 bp, Glycine max
  Peptide Sequence Number=SeqID_124180
atggtgaagtttgggttcgaagaggatccgcacgtgcggaacactttggttcacatgtattgttgctgctgtcaggatgggtcgtctgggcctgtgtctgccaagaaggtgtttgatgaaagtcctgtgaaggattcggtcacgtggagcgccatgattggagggtacgcgcgtgcgggaaattctgcacgtgcggttacgttgtttagagagatgcaggttacaggggtgtgtcctgatgagatcaccatggtttctgttttgtctgcgtgtgctgatttgggtgcacttgagttggggaagtggttggagtcttatattgagaggaagaacataatgaggtctgtggagttgtgtaatgcactgatagacatgtttgccaagtgtggtgatgttgatagagctgtgaaagtgttcagggaaatgaaagtgaggaccatagtttcgtggacttcgatgattgttggtttggcgatgcacggtcgcggattggaggctgttttggtgtttgatgagatgatggaacaaggggtggatcctgatgatgttgctttcattggggtgctctctgcatgtagtcactcagggctggttgataagggacattactatttcaatacaatggagaatatgttcagcattgtgccaaagattgaacactatggatgcatggttgatatgttgagtagagcaggacgtgtgaatgaggctttggagtttgttcgagccatgccggttgagccaaaccaggtcatatggagaagcatagtcactgcttgccatgcccgcggggagctcaagctcggtgagagcgtggcgaaggagctgatcaggcgcgagccatcgcacgagtctaactatgtgctgctgtcgaatatttacgcaaaattgctgcgctgggagaagaagaccaaggttagggagatgatggatgtgaaggggatgaggaagattccagggagcaccatgattgagatgaataatgaaatatatgagtttgttgcaggagataagtcacatgatcagtacaaggagatatatgaaatggtggaagagatgggaagggagataaagagagcagggtatgtgcctacaacatcacaagtattgcttgacattgatgaagaagataaggaagatgctttgtatagacacagtgaaaagcttgctatagcttttgctcttctgagtacgccccctggaacgccaattagaattgtgaagaacttgcgcgtctgcgaagattgtcactctgctactaagttcatatctaaggtttataaccgagagattgtggtgagggaccgcaatcgcttccaccatttcaagaatggtttatgctcctgcggagacttctggtaa

SEQ ID NO: 7403 - DNA, 496 bp, Glycine max
  Peptide Sequence Number=SeqID_124181
atggctgacgccgccggcgcaacgcacgaacagcatgccgaccggccagtgcgccgccacggcgatggcgtcgtgcccggcgccgctcggcagcgccaggctccgcccctgtacctgctcgacggccgcctgccagcattgccgcagatcgctatcgcaggcggtggcgtcaatgcggtaaaactcctcgctggcgaagcgcacgccgcggcgcgcgcagatcgcctgcgcctgcgccagcaacgccgtcaacagcgccgccagttgtgcatcctgcgggccgcgcacgtcgagcgtcaatcgcacttcgccggggatcacgttgaccgcgcccggcaggcattcaatacaccccacggtggccaccaaatgcggatcggcggcgcgggtcagagtttcgaccgccgttatccattccgccgcggccgccaacgcgtctttgcgctgcaccataggcaccgtgccggcgtggcccgcttcaccgctgaaagtgcag

SEQ ID NO: 7404 - DNA, 1230 bp, Glycine max
  Peptide Sequence Number=SeqID_124182
atgagaagaatctcgaatcttctctctaaatcgaaacaactcgctgcattcgcaagcctagaaaccaaacttcgcgccaatgcgcttcgctcttactgcgatcaatcgcaccttcgccgccaaaaccgtccagggccgcttgtgcagtacaggagtctagttgatcaagggaagttgcggcacgatcctttccaagagagtgttgcatcggagcttgagaatttgcttgcaaggttggagcagtacgagaaagatatggaagagtatcatgtgaatctagctaattgggagaagcagcgggagaatgagcgtcggaggcttctcatggaggaagttgagctgcaccagaaggacgagtactggtggaagcggttgaacaataagcttaccgaaaggtgggaatcccggaaaagaccaaaaaatatggagtcaggggtagggaaatgggtatcatatctcaaacgagagaagaagttggattcactagttggtcaccgtccaactgctcctccagctcctaaagggctttacatatatggcaatgttggcagtgggaagacaatgctgatggacatgttttatagtgccaccaaaggaattgtaaaacatcgaagaaggtatcactttcatgaggccatgcttagaattaatgaacaaatgcacaagatatggaagaaccaaatagaagagaagcctttgcaatcgaccattgctggttggattatgagtcttccttttgacacgaaagctaaggagtggttggctgctgaagaaagatacaagcaagaggtacagatgaaaaacattcttcctgctgttgcagatatgtttttcctggatggagaagagaatgaaaagggagctagcattttgtgctttgatgagatacagactgttgatgtatttgctattgtggctttatctggaattctaagcagattgctgagtagtggaactataattgtggctaccagtaatcgagcaccaaaggacttaaatgaggctggtatgcaaaaggaaatattccagaaacttgtctccaaattggaagaacattgtgagaaagtattgatagggagtgaaattgactaccgtcgttttatagcacaaaaatcagaaaaccaggataagatgacatcaaggttcaaccttgagtccttacttgtggttactatgggcatacaaaagattatccttacttgtggttactatgagaaatttatgaagtga

SEQ ID NO: 7405 - DNA, 276 bp, Glycine max
  Peptide Sequence Number=SeqID_124183
atgaatgaatttgagaaaaagtggcatgatgttacaggcagatttggaggaagaataatctcaaacaccatctcagtgatgtttggaaggacacttgaggttcctcaaagctttgatggagttgcacgcttcacatttgagtatctctgcggtcgtccgttgggtgcagcagattatattgcagtagctgaaaactttcacacggttttcatatctgacattccagtaatgagtatgcgcatccgtgacaagatattcctcaaacgcaatgcttaa

SEQ ID NO: 7406 - DNA, 369 bp, Glycine max
  Peptide Sequence Number=SeqID_124184
atgaagaagcaaaaaagttcaattcttcatgggacggttgaagagaaaggaagaggcaaagagcatggtggtcgttatgaagagaaggctttcaagtctcgacccttcacgactaacgatgagggtgaagagaaaatgacgtcgttttggagatttatttttttagggttgctccaaaacgatgccattttggagccttttttaagtggaaaacccaatttgggtttcgaaaaccaactgggtcacctggtttacacaaaatcggtcaggtttgactgggccatctctcgccagatgcatggctggttcaataaccaaaccaatccaattatatcactgggtcctggttggaccagtccaaccgactag

SEQ ID NO: 7407 - DNA, 2837 bp, Glycine max
  Peptide Sequence Number=SeqID_124185
ttcttcaaccattcgagctttctgccatggatgatccttatgatccttacatcatcaataatgctgatagtccgggtttgattctcgtatctaagcctctcacattggagaattggaactcatggaaacgagcaatgctcatggctcttggtggaagaaacaaacttggatttgttgatggaacaattcctccacctgatcctaaagatcctttgcatcatgcgtggctctcaatatggaaggatcttcaggatcgtttccagcaaaacaatagacctcacatccttcaaatgaaacatgatttgtcaaattgcttgcaaggttctctctctgttttgcagtattacacaaagatgaaatcaatctgggaagaattcagtgagtacaagcctgtacatcactgtcactgtggtggtgttcaaccactcttagatcactttcattttgagtatgtcctgacatttctgctaggcctcaatgaaagttacaatcaaattcgtggccagattctctccctggatccatttccctccattcaacatgctttctctctggtgattcaagaagaaaagcagcgagaggtaggtaatgtgcaaacttccttggattcgcaattggcatgtgttgttcaaggctctcagaattcgaaatctggcaacaaaaaggacaaagatcatccactctgtgcacattgcggtctccttggacacaccaaggacaagtgcttcaagattattggatatcctccaggtcacaagaagcacaagagcccagttaatcttgtcaatgataatcaaggagagtcttcaaactctttcaacatcgcccaatgccaacaactgctaaatcttatacatagtcagatggctcaagcaatggtttcagagacatcacagtcggatcagtcaaatcttggtatgatcttttcaactcctggtcagtcttctagcattaactctagttcttggattatagatttaggagctacatctcatatatgtcatgatcttaaactgtttgatcaatatactctgttatcaaatagaactgtcacacttccaaataattacaaaataaatgtaaaagcaattggttcagtcactctcactccttcgataaaactgtccaatgttttgtacatccctcaattccatgacaagcaacaaaatagagtgattggcaagggtaacctccatcaaggtctataccacttccaaccacacagtgaatatgcgtgtagttccttgcacactactgttttgagtcaatgtaataatgttgtagctgccaatggaccatttcctcatgacactcatgatggcaagaaatatttcttaaccatcgcggatgataattcgcggtacaattgggttcatttgatgagaaacaagtctgaggcaccacatctattacaagctttcttcaagcttgttcaaacacaattttccaaaaacattaaggctatgcggtctgataatgctaaagaattagctttgactgagtttttgcagaatgcaagatgtgtatccacaacagcttacatcatcaacagaacaccaagcttaaatctgcagaaccagtcaccatataagttgctatatggtaaaataccagcctatgatttgatgaaagtgtttgggtgcttgtgctatgcagccactgtccctgctcaaagacataaattcactcctcgggccactaaatgtgtgtttcttgggtatccgtttggttacaaaggatacaagctctatgatttagacaatcataaattccttatatctagagatgtgactttccaggaaaatagcattccttttgccaccagcacatatacagcatctgatccgtttccaaactttgttgtacccagacctttgcctgacatgctgcctgatccaaaccccactcctcaaccaccacctaaacctaaaccacaacttgagatagaaccgaaccttgcccaacctgatgttcaacccaatgcacatgtgagaaggtcaactagagtcactagaccacctactcatcttcataactatgtctttaatgtcacttaccccatccataatcacctcatgtatgacaatctttctccaacttacagagactatgtgtttaaagtctcagaaatttatgagcctcagttctatcatcaagcagttcgatttcccaaatggcatcaagccatgaatgaggaaattcaggcccttgaaatgaacaacacttgggttgttcaacctctaccacccggtaagagaaccatcggttgcagatggctttataaagtcaagtatagagcagatgactcccttgataggtacaaggcccgtcttgttgtgaaagggtacacacaacaagcagggattgattttctagacactttctcacctgttgccaagcttacgacagaaatatacatggacatgcctcttggttatcctgtcaagaatgataacatggtttgtaaactcacaaaatctttgtatggtttgcgccaagcttccagacaatggtttcataagttctccaccaccatccttgatcaaggatttcagcaatgccctgcagatcactctttgttcactagagggagtggagcaactctagtcacattgttggtgtacgttgacgacattatcattgttgggccaaatcaaaaattgattgcaaaaacccaacaaatgcttgccaaacacttcaaaatcaaagtgattggtgatctcaagtattttctagtcttggaaattgccaagtctcctcgtggcatccatctttgccaacgtaaatatactttgcaactcttgactgacaccggctttgcagcatcaaagccttaa

SEQ ID NO: 7408 - DNA, 936 bp, Glycine max
  Peptide Sequence Number=SeqID_124186
gcttcggttccttctcatttctgggttgaggcattgaccattgttgtctacttgatcaatcaccttccctcccaggttcttggcttcgattctcctttctttcaactttataacatacaaccgagttatgatgatcttcacccttttggttgtgtatgttttgtacatcttccacctttggaacgtcacaaacttggggctcagtctgttcaatgtgcatttatgggttatggtaccactcagaagggttttttgtgttatgatgttgttgcccaacatttccgtatctctcagaatgtggttttcttttatcatcaagatttctttccatttgtttctcttgacgctaatggttttgctactcttccttcttttcctaaggtttctcatgctacaaaatggtttaaaccaggctatgtatatgctaggcgccctcttgccccgccctttcctgactctgaactgtcacctaaacgtacaccaatagcacctcgtagatccagctgtatttctcgtacaccagataggtatgctatgcaagaggagttgcaggcacttcaggagaattataattgggatatcgttccatgcccccctaatgaatatggagtggattatgatgagacatttgcacctgtggccaaaatgactactattagaactgtgctatctattgctgcctccaagggctggtctctccatcaaatggatgtgaagaatgtctttcttcatggtgacctagctgaagatatttatatgacccctccacaaggtctccaatctgctgctcccgtggatactattctcgaagttaatgtcaaatatcttcgtgatgagggtgacattctacctaatcctttgttgtatcatcagttagtgggtagtcttaattatctgactattacacgtcctgacatctcctttgcagtccaacag

SEQ ID NO: 7409 - DNA, 630 bp, Glycine max
  Peptide Sequence Number=SeqID_124187
gctcgcctgtattggcagacgtctgtggagagtggtgttaggaagtctcatgtcatctgcctcaattcttggggtgcaacttatatatctgttggacaacattacttaatgtcaattggttttaagttgaaatccaacaagttcaagatgttcgtgaaagggaaaggcatgtggggacatattgatgggtcctcctctaaacccacagccatggctgagttggctgcatgggagacgcaggatgcccaaattatttcttggcttttggggtccattgagcctctaatgttggaattggacatagccaattacgctctgtcccgtgactcttctgtttcggaagctattgttgttgcctatattgcccaggatgaaggcaaagttaattctatgactgagacacccacttctgtcccaaccaatgttgatgccttaactccagagaaggtgcaacaaatggtgctttctgcattatctgccttaggcatccaggcctccaatcatatgactggtaccttggaacatttaaacaatgttcgcacttataatggcactcaaaacattcagattgttaatggtaatactctttcaatcactattgttggtgatattactccttcctttggtgat

SEQ ID NO: 7410 - DNA, 755 bp, Glycine max
  Peptide Sequence Number=SeqID_124188
gcaaaggcgaatgggccccgttcatagacattctcgcactattgatcttcggaggagtcctctttccgaatgtggatgggctggtggacctagcagcgatcgacgcttttctcgcctatcatgaccacaaggaaagcccggtcgttgctatgctagccgacctctatgacacctttgaccgaagatgtgagaagagcagtacgaggattgtctgctgtactcccgctctttatgtatggttggtttcacacctttttcaccaagaggtgaggcatgcctgcccgttagaaagccaccgttcatgcacagagaaaggaggggcaaattgggaccaactcttagcaagcaaagaaggagcatctgtcaactggttccctcgatggaaggaaggaagagtcggagttcttatttcgtgcagagggtttccgaatgttcccttgatggggacgaggggttgcatcagttacaatcccattcttgctataaggcaacttggctaccctatgagaggggcaccactagaggaagagctcgtgcctgtcatttcacgaggtttcaataagaccaacatggagacacttcagaaggtccgcaaggcatgggaggttgtgcaaaagaaggacaaagaactcaggggcagtaacaatgggcccatcggtggctaccgtaagtggttaaaagcccacgtgcaaggtttggattggcttccgagtctgagaaacgctaaaagagaggaagttgaggcagaatgctga

SEQ ID NO: 7411 - DNA, 294 bp, Glycine max
  Peptide Sequence Number=SeqID_124189
atggctcatagggaagaacacggccagaacaagttccgaggggctctgtggggcagtaacagtgagcttaagctccggagagaggaaagggatcaatcacgagtaaacagtttgatcttgaaagatgagttgaaggcttgctcgaggtccaagagaagtttgtctcagcggttatgcgagacagagaccaacatgttagctatcatcaccaagtaccaagaagaactaaatctagccacgacccacgagcatagagtggcggacgagtatgcccaagtgtacgcggaaaagtag

SEQ ID NO: 7412 - DNA, 672 bp, Glycine max
  Peptide Sequence Number=SeqID_124190
atggcgcgtctgtatcagccggtgaaagggcagatctccgctgacggactcgatgttaaccagatcgatccggccgactggcgcaaagcggtgggcttcgtcagccaggatgcgcgcctgttctacggcacgctgcgcgagaacgtgatgattggccggccggatgccaccgcgaatgaactgctgcgcgtgctgaatctgaccggtctcgatcacgtggcggcgcgccatccaagcggcatcaacctgtcggtcggcgagggtggtgaagggctgtcgggcggtcagcgtcagttagtatcgctggcgcgaactctgctgacgcggcccaaagtgctgctgatggatgaaccgaccagcgccatggacagcatgaccgaaagccagttcctcgcccatctgcgtcgcgccagcgaaggtcacacgctgatcgttgtgacgcatcgtccgtcaattctggcgctggtcgaccgcatcatcgtggttgaggaaggaaaaattgtcgcggatggcccgaaagagcaggtgctggccgcgctggaaggtaaaggtaaaacccgccagccgccgcgtcaggcggtagagcaggcggcgcgcgcacccgcgccggctaacgatgcttcggcaacgtcagagcccgccgtcgccgcggcagaggaggccgcagtatga

SEQ ID NO: 7413 - DNA, 141 bp, Glycine max
  Peptide Sequence Number=SeqID_124191
atggtgggaatcttttcgttgattacagggagaccgggatgtagtggattcggatcttcctcaactgctgaacaggttatcgaaggaattgatgccagcaacctcactgcaatcatcacagtacacacaagccttcggtga

SEQ ID NO: 7414 - DNA, 174 bp, Glycine max
  Peptide Sequence Number=SeqID_124192
atgacatgggcctttcgaattgccagaacacgtgctgtctccaaccctatgccactggctcctcctgcatttggacataacataagtgtctacattgtttcttactcaatttcttctttacctgtctcctttaacaccacctgcccccgacctgagataatgccaagtatttaa

SEQ ID NO: 7415 - DNA, 308 bp, Glycine max
  Peptide Sequence Number=SeqID_124193
ctctctcacgccgaaatttcgtaacatatttccttggcattgatgattctgcaccatcagctctctcatcccgaaactttgggacgtatttccctagcattggtaggtgggcaccttcagctctctcacactgtgacaaagcacaggttgatgctttgcatggggcaaggtgtgaaaacatgtcatattatgggcggttgaagcgtgtcaaagtcaaaagaggagatgtactggctgcaattaattatttgcaaggaaaaggtgacaacaatgctatttttttgcaagatacatggttacagaggatg

SEQ ID NO: 7416 - DNA, 489 bp, Glycine max
  Peptide Sequence Number=SeqID_124194
atgtcgcttgatacgcccagaaacagcaagccgagtcgaagagcagaagccacgtcaaaattgaaaagcaacgcgaacgcagcatctggtatggccgtccatgatgactgcaagctaaagtttttggagctcaaggcgaagaggacgtaccggtttatcgtttttaagattgaggagaagcagaagcaagttattgtggagaagctgggtgagcctgcaaatggttatgatgatttcgctgccagtcttcctgccgacgagtgtcgatatgctgtttatgattttgattttgtcactgaagagaattgccaaaagagcagaattttcttcattgcttggtcccctgatacatctagggttaggagcaagatgatttatgccagctccaaagatagattcaagagggagcttgatgggattcagattgagctgcaagcaactgatcctactgagatgggtcttgatgtgttcaaaagccgtgccaattaa

SEQ ID NO: 7417 - DNA, 576 bp, Glycine max
  Peptide Sequence Number=SeqID_124195
atgtttgagtcctctggtattccatgctcgcacattatgtgggcgatgcgtcttgagcacatccacgcattcccctcaagcttgatttgtggttttggggctctatcaggtggttgtaacaaattgtgtgaactaggttcgaaagatgttgataacttcaagtttgtaagggatgaattatgtaagttgactgaaaggttgcagaaacgagtggatttgggtggtgatcctgttaggcattctagtggtatggtagatgatatgaagaatcctaatgtgattaagacaaaagacgacctaagttgcggtgaagattttaacgtcaatgatccttctgttaataacactgaaggggctaacgtaagtttcagtcaagatgtagcactagttggtcgtattgagatgcctaatgcagtgccgaaaaaagcagacaatgatacagaaaaaagagaagtaacccaaaatttaaaaaacggaagttggccatggatgaacaatccatctactttggaacacaaatcagatgttagaggaatattgtttctaacccaaaaatcattttgtggcaaccaataa

SEQ ID NO: 7418 - DNA, 489 bp, Glycine max
  Peptide Sequence Number=SeqID_124196
atgaaaaactcaatttccgacttctctattctcagggcatttcatatctctctggccatctttccaaggcaccccgtatcctccaagtctcctggcatcctcccttggcaagctggctttccggcaatcgcagcttgtggtggcatttaccgtgattatagaggaagcttcatgggctgtttttcattttctttgggagtggcttcttcgcctgttgctgagctcactagtgctatggaggccatgaaatcgcttttgaaaagggtggcatctcttgtggacttgttaccatctagtatccaggagcctttcttcagggataatattcgatggtgcaacctagttgggattagggctcaaacccctcacattgtggacccctcaatcgccgaacttgagcttgcttactatttgagccactctaatgggggttttgcttattttgattgcaggtgcatgagcatgctagggactaccatagagctctaa

SEQ ID NO: 7419 - DNA, 2271 bp, Glycine max
  Peptide Sequence Number=SeqID_124197
atggctctctcctccctccacttccaccctctccctctcgcttacaccgtaataacccaacgccacacaactcctttctctttctcactctcttccacctttagattctcctcctcctccgcgctctcatcttccacttccgctacccaccaccccctccccccggacttctccccctcccagctcctcgacctcctccgccgccagcccgactcctcctccgccctcagcctcttccaatgggcctcggcccagcccaactactcggcccacccctccgtcttccacgagctcctccgccaactcgcccgcgccggctccttcgactcaatgctcaccctcctccgccaaatgcactcctccaaaatccccgtcgacgagtccaccttcctcatcttcctcgaaacctacgccacctcccatcacctccacgccgaaatcaaccccctcttcctcctcatggagcgcgacttcgccgtcaaacccgacacgcgcttctacaacgtcgccctcagcctcctcgtcaaagccaacaagctcaagctcgtcgaaacgctccactcgaagatggtcgctgacgccgttccacccgacgtctccactttcaacatcttaattagggctttgtgcaaggcccatcagctccggcccgcgattcttatgcttgaggacatgcccaactacgggctcaggcccgacgaaaaaacgttcaccacacttatgcaggggtttatagaagaggctgacgtggaaggcgcgctgaggattaaggaactcatggtggagtctgggtgcgagctcacgagtgtttcggttaatgttttggtgaatgggctttgcaaagaggggagaattgaggaggctttgaggtttatttatgaggaggaagggttttgccctgaccaggttacgttcaatgctttggtgaatgggttatgtaggactgggcatatcaaacagggtttggagatgatggattttatgctcgagaaagggtttgaattggatgtttatacgtataactcgttgatctccgggctgtgtaagttgggcgagatcgacgaggccgtggagattctccaccacatggtttcgagagattgtgagccgaataccgtgacttataacacgctgattggtactttgtgtaaggagaatcacgttgaggcggccaccgagcttgcccgtgttcttactagcaagggggttttgcccgatgtttgtacgttcaatagtttgatacaggggctgtgtttgacgagtaaccgggagattgctatggagttgttcgaggagatgaaggagaaggggtgtgatccggatgaatttacgtatagtatattgatcgagagtctgtgttcagaaaggaggcttaaggaagcattgatgctgctgaaggagatggaattgagtggctgtgcgaggaatgtggtggtgtataatactttgattgatggtttgtgcaagaacaatagggttggggatgcagaggatatcttcgatcagatggagatgttgggggtgtcgagaagttcggtgacgtataacacgcttattaatggcctgtgtaagagcaagagagtggaagaagctgctcagcttatggatcagatgataatggaagggttaaaacctgacaagttcacttatactacaatgctgaagtacttctgccaacaaggggatataaaaagggcagctgatattgtgcagaatatgactttgaatgggtgcgagccagatattgttacatatgggacacttattgggggactgtgtaaggcagggagagtagatgttgcaagtaagctccttagatctgttcagatgaaaggtatggtcttgactccacaagcgtataaccctgtgattcaagcactctgcaaaaggaagagaacaaaagaagccatgaggcttttcagagaaatgatggaaaagggtgatcctccggatgttataacatacaagattgttttccgtggcctctgtaatggtggagggccgatacaagaggctgttgattttacagttgagatgttggagaaaggaatattgccggagttcccatcatttggtttcttggctgaaggtctttgttctttatccatggaggacaccctcattcaactcatcaatatggtgatggagaaaggaagattctcacaatccgaaacatctattattagaggcttcctcaagattcagaaatttaatgatgcactagccaatcttggagctatcttggatcggaaaaagcccaggagattttga

SEQ ID NO: 7420 - DNA, 132 bp, Glycine max
  Peptide Sequence Number=SeqID_124198
atgagggcttctggtaatcgattaccaagggggtgtaatcgactaccaggcttaaaaaggggactggaacattgtggaggcctctgtggttatgagatgcatttgtgtggcggcatagatagattcttgtga

SEQ ID NO: 7421 - DNA, 183 bp, Glycine max
  Peptide Sequence Number=SeqID_124199
atgaagttgactggctatgtgccagatcttgcatttgtgttgcatgatgtgggagaggagttgaaaggacagctttttttatggcatagtgagaagctgaaaattgcatttggacttccaaaggatataccgttttattccaagagcaatgctggcatgcgcctgaggttgacgttgatttga

SEQ ID NO: 7422 - DNA, 600 bp, Glycine max
  Peptide Sequence Number=SeqID_124200
atggctccaccaattgagaccccaaacaaggtttccagctatcaacagtccccaaaccctcgtcttaacgagaggattctttcatccatttccaggagacacgttgctgcacacccgtggcacgatcttgagataggacccgaagctccaaagatcttcaactgtgtggtcgaaatagggaaaggaagcaaggtgaaatatgaacttgacaaaagaactggacttattatggttgatcgtatactttactcatcagttgtttatcctcacaactatgggtttattccacgtactatttgtgaggacggtgatcccatggatgtcttggttattatgcaggagccagttcttccgggttgctttcttcgggccaaagctattggtctcatgcctatgattgatcagacccacttcgcactgcagccagccagggagggactggatccgacccttgaggtagaaaaatggaagaaagaaaattctaatatcctgccgcaagtgctacagatgcgcatattctggcttttacagttagagggtgccactgttggcaaaatagaaatcatgattaagtacaataacaaagtgggagcaagctag

SEQ ID NO: 7423 - DNA, 499 bp, Glycine max
  Peptide Sequence Number=SeqID_124201
gtatttgaggaagaacctcatcattgtcttgttcttgaacaatgtcatcaacaatagtttgaacattgttttttattactggagttgtttcttgaacaacaataagtatgaggacttgaacactgtcaataacaggttcttcctcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaaa

SEQ ID NO: 7424 - DNA, 357 bp, Glycine max
  Peptide Sequence Number=SeqID_124202
atgcccggtttgaaccccgacattgtgcaacatcgattacctctgaatctcgggtgctccccggtcaagcaaaagttgtggaggatgaagcccgagatgtccctagaaatcaaagaagaagtgaaaaagcagttcaacgctagcttcttggtagtagctcgataccctgaatgggtggccaacattgtgctagtccctaagaaggatgggaaggtacgaatgtgtgtggactatcgggacccaaaccgagccagtctaaaggataactttcctttacctcacattgatgtccttgtggataacactaccaattttgctttgttttccatcttggaggggttctcgggtaacaattag

SEQ ID NO: 7425 - DNA, 264 bp, Glycine max
  Peptide Sequence Number=SeqID_124203
atgactagaagtaaaaggattcaagaggacaccgagaagaaggaaggttttttcccaaaagttgcagatgatgtccttactaagaaggacaatacacctaagaaatatgaagttcctattgacgagaactcaatgctaaagaagaaggagaaagccactcgaccacaagaaaaagaggctcttacaaaagagatccaatatgcatacaaagagggtggaaaagaggtactgacacctcctcagatttgtaagctttggggctga

SEQ ID NO: 7426 - DNA, 526 bp, Glycine max
  Peptide Sequence Number=SeqID_124204
atgtccatgttcccatcctgtggtctttcagaggccctctcacttggggctggctcccgctctgagattatctctagtcaggatgggaaaaactccaggggtgccccgggaaaatctctagccgtctggccaggcaaaaaaatagcagcagtgagagagagaagctctcaagcaagacctggcaatgcttctaatttcactgtccttcctacccctcttcctttaaaagccaacagagatgacagcctacgtgagtcagcacagggaagtggggaggcctctgggtctcagttccacatatcttccccctgcctgttcccaggggtctgcaggtccaacggccactccctgagagtccttgggtgtcagagggagcagctgccaggtggaaacggaatgaactgcctgcctgaactgcctgccgggggattagcagcttctgtgcaaagcttacaggatgcctctaaggcccctgtggcaggaggtcaaagaatcttaacaaggaggtgggaagtggaaatagaag

SEQ ID NO: 7427 - DNA, 285 bp, Glycine max
  Peptide Sequence Number=SeqID_124205
atggaaggttcccaacaaaacactcactatcctaaggaaaaattgcctaaaattattacacacaaatggaagtttggtaacctattggaggctcccaacacacttccaatgaaaggcctttttgttacaaaacttgaaagcaataaagtgcttcttagtccaatagctcttaaggtggttggccccttgcttcttgactcaaattcttcaagggatggcaccaatcctccttccaattccctatatggcaacccacaaacaaggaaacaaagagacaagcaatga

SEQ ID NO: 7428 - DNA, 265 bp, Glycine max
  Peptide Sequence Number=SeqID_124206
atggcagacaacaccagaatgaaagagctcgccaccaacgtgaagaaaaacgtcgacgatatcaagaagttgtacgatgaagttcagatccagtttgagcgttttggtgctgtgacggatgctcgatttcaaaccatggaggatctgcaatcgtccactgatgggaaactggataaaatcaacgaagctctttcgatgttattacgcaaactcctctcagacctcttcccatggtgttacgaactcaaacaaagctccgtttcag

SEQ ID NO: 7429 - DNA, 324 bp, Glycine max
  Peptide Sequence Number=SeqID_124207
atggtggcacaatggaggtttggagacattagaaagggatggcggtggaggttcaaagaagaatgcatcccggctagcgacgataacgttgagtctcaacgacatttaacgacgattaatagagtcatttatcgacggtctgtaataagacaaattaaggagaaggaaatagatgttgctgagtcatcaattcaagtgtgtaagggcccacatggaatgcaagaggataattctgttatgcatgatccggaattacagggaatgcgcaaaagcaccagagcacgcaaggccaacaaccaattgaaggatttcgttacttcttga

SEQ ID NO: 7430 - DNA, 825 bp, Glycine max
  Peptide Sequence Number=SeqID_124208
atggcagctgaacatcggacagaactatcgggaaacaattacacagatagtaacggttttgctgacctaccgtacattcctgttaaagacagtatcagggaaggatattttcatgcatttgatgccgcctacacgaataatttgagacaggaagcggtagtaacctatcagaaacgctttagtgataaatctcaaaaactggatttccagttcggatataccaaatcaacgagtaaatttgatcagaataatattttcagagatatcagttacatcaatcctaacgaaaaccttccaagattttcggatggtcttttactgaacaatgaatctgacatgagaattgctaattttaaagtggattattcgcagcccatcaagatccttgatggaggaaaggtaagtttcggtggattatatgaaaaacaaaacttcgatacccaaagcagaggtttgaccaacctggactatcaacgacagaccgcttccacctatcttgagttccaggctaaattgaaaaaattcgatttcacattaggatcaagggctgaaaattatgacatctctggaattacaagggtgattgacagtaccggtgcaatagttcagaaaaatctgatcccttttaataagtttaaattatttccaaatgcaagtgttcagtacagctttatgaatcaggtttctgtttcagcaaactataacaagaaaatcagtctgccaagtatttctgcacttaatcccaataacactacattccagggaccgaatacccaggttaccggaaatccgaatctgcagcctacaatctttgacgaattatga

SEQ ID NO: 7431 - DNA, 1461 bp, Glycine max
  Peptide Sequence Number=SeqID_124209
atggggaagagtcctggggggttgaatgacggtgacatgacaaatgacaattcttctagaatagagtccaagcgtgctcatcagtggttcatggatgaccctgaagtggatatgtttcccaataagaaacaagccgtagaggctccaaacaatttgttatctggaatgctcaactccaatatttcttcatggggaaattcctcaggatttcactctttaaatggtcattttactgaacagttatttgccccagatgcagtaactatgggttttgaagacacaaacaccccctctgttagcatagatgataagttgagtgtggaaagaaaggataacatggatccctttgggagtgagtcctcatttggtttatccatctcaactgcattagaagatcctcatttagtttttaattatgatggaactagaaaagtcaaagttaatgaggtgagggaatctgagaatgccatgcctgttgctacaaataatccctatgaaagaggtgttagtgacagtgtctcaaatccttgtctatacaaggaggatgataattccatatcaacaagtctcgcctacaatgaagaggttgcgaatataataacaatggatggcacatatgacaggacagataacaattttacatcaattattcaatcctataacaagggaaatgacagcttatctatacatccaacgttcaatgaaatggatttgggtttcagtaaggtagatagtaatgtaacatctattgctcaaggttacaacaaggcctataacaattccgtgttaactaaccacttatacagtaaggttgacaatgacactttatcattgcatcacacctaccacaagcagggaaatgatgtgccatttgtttcacattcctataataatggagagagcactatcatatcctttggtggctgtgatgatgatgcaactcccactcacttattcatttctgactatgagagcatctatcatttacttccaagtacagctcagacatctgaacctgagactgaaaatgttcccaagacaaaaggggagataaaaatgtgtagaaaagctacttcaaacaacttcccttcaaacgtcagaagtttgctatccactggtatgctggatggtctctcagtaaagtacaaggcgtggtcacgggaggttattaatgcatttgaatttgagcgacatgctggttgcaagacaaaacaccccaataatcacatttactttgataatgggaaaactatatatggggttgtacaagagctcaggagcactccacagagcatgttgtttgaagttattcagactataactggttcacctatcgatcagaaatccttctgcatttggaaagatgctccttctcacatttggactctctcttcctcctctacagaatcttttttgcctacagcagggaactccagcgcatatgggcaaaacaagaagtaa

SEQ ID NO: 7432 - DNA, 238 bp, Glycine max
  Peptide Sequence Number=SeqID_124210
gtggtggcggtgcgtctattgcccgctaccggccatcccaatgctacatgtggcgtgcagccctctcaaggcgaggatgtgtagtcctctggaggtgagggcgtgcacccctctaatggcgaggacgtgtggtcctctcaaggtgagggcgtgcagccctctgttggcgaggatgtgtagtcctctcaaggtgagggcgtgcagccctctgttggcgaggacgtgtagtcctctaaag

SEQ ID NO: 7433 - DNA, 786 bp, Glycine max
  Peptide Sequence Number=SeqID_124211
atgtccatgttccaagaaattatacctctaaacgcaggaaacgtgcttgggccagaggacagtggcccagcatcgaaatggctgaaccttattcgtcaagccttgaactctaacacaagctccagtggagaaaattctcctacatcgtcttttaacagtagaaggcaatgctgcccaaatgaacaacactattattgcctagcagcaagcaaacaaatggtgggtatcttcttgtgtgtgtgggtacgtgcggatctttacaagcatgtcagcaagttaaaggtgtcttgtgttggtagaggcatcatgggctatctaggaaataagggttcaatatcaattagcatgacattgtaccacacaacgttctgcttcgtttgtacccacttggcctccggagagaaagatggtgatgaggtgcgaagaaatttggacgtttcagagatattaaagaaaactaaattttcacactcattcaaagcacttggccaaccactccctcctgaaagcatattagagcatgataagataatttggcttggggatttgaattatcgccttgctgctgcttacgatgatacacttgggctgctgaagaagaatgattggcaggcactattagagaaggatcagctaaggatagagcagagagctggtcgagtattcaaagagtggaaggaagggaagatatactttgctccaacttacaaatatttatttgattctgaccaatatgttgcccaaactaacaagtccaaggaaaaacgacgaactccggcttggtaa

SEQ ID NO: 7434 - DNA, 747 bp, Glycine max
  Peptide Sequence Number=SeqID_124212
atgcgtacccctcttaaggcgagggcgtgcagccctgtgaagttcaggacgtgtcgccctttgaaggcgagggcgtgcagccctctgaaggcgaggacatgtagtcctctgaaggtgaggacgtgcagccctctgaaggcgaggacgtgtagccctttgaaggcgaggacgtgtagccctctgaaggcgaggacatgcagtcctctaaaggcaaggacgtgtagtcctctgaaagcgaggatgtgtagccctctgaaggcgaggacgtgtagtcctctaaaggggagggcgtgtagccctctgaaggtgaggatgtgtagtcctctgaagatgatgacgtgtagtcctctgaagatgaagatgtttggtcctctgaaggtgaggacgtgcagtcctctgaaggcgagggcgtgtagccctttgaaggtgaggacgtgtagtcctctgaaggcgaggacgtgtagtactctaaaggtgagggcatgtagccctacgaaggcgaaggcgaggacgtgttatcctctgcaggcgaggacgtgtagtcctctaaaggtgaggacatgtagtcctcggaaggtgagggcgtgtagccctatgaaggtgaggacgtgtagtcctctaaaggtgagggcgtgtagccctacgaaggcgaaggtgaggacgtgtagtcctctgaaggtgaggacatgcagtcctcggaaggtgagggcatgtagccctatgaaggtgataggtactagtacttaa

SEQ ID NO: 7435 - DNA, 351 bp, Glycine max
  Peptide Sequence Number=SeqID_124213
atggcgtgtgtgaatggacggaaacacatcaatctaatagctggacccggaatcagagtggtgaaaacgaaaggagggacaccaaatccgaagcctttttggaaaacgcgaaaagaacaaaaagccaaaacagaaagaagaaaagaaaaagagaagcatagcagagatagaagcaggacaagagcatggaacaaggagaaagtggaacattatagtgaagtggtactttgtagggaaggaaaggtggaaactgggagggagagagagagagagagagatgcagatgatgttttgttttgggggcttttctcggaaaggggatatttgattttgaaaaataagatgaattag

SEQ ID NO: 7436 - DNA, 201 bp, Glycine max
  Peptide Sequence Number=SeqID_124214
atgagaacagagttgaagaagaagatatccaagtcttcatggccaaaatttaatgtaagaaagtggctcaatataaggagcaacgatgataaatttcactcagatgcgtcatattactctttaccaggtgaaaacgtgtattttctttcgggtaatttgagggacagattggtggtacatgggtatgatgggttagcgtag

SEQ ID NO: 7437 - DNA, 219 bp, Glycine max
  Peptide Sequence Number=SeqID_124215
atggttgtcgatgatatgacgctgtgcatcatcgtcggctatggaggttcctcttcttctcgtttctccgatgcttatcccaaaagggtttttggagttacctcgaatagggttaaacataattcacctctagcgttttcgaaatctcttcctctcttacagagattgaagagatatatcactgtgtcactctctctgttatataatatagatagatag

SEQ ID NO: 7438 - DNA, 444 bp, Glycine max
  Peptide Sequence Number=SeqID_124216
atggctacttggttcaggtggattagaggtcccccctttagtatacaaccattagaaggatgtgatagaataaaggtcaccattaaagttgtgatgaggatatttttcaaggagtggagaaaaaagtcatttgagtgggagagggagatgcttttacaactaacaaatcttttggaaaatgtgcgggtacataatgttgatcttgatttgtggatttggttggatagccactcgggtgcttactctagaaattctgcatatgtacatcaattccaggaggttgagtccgaacctctttgcaacacacttgcagagacttggaggtttaaaattcctagcaaagttgcgttcctaatatggagggttataagagatagactccttagaaaagagaacttgttgaagagaggaattatggtggaggaatggtgttgtgatgaatga

SEQ ID NO: 7439 - DNA, 450 bp, Glycine max
  Peptide Sequence Number=SeqID_124217
atgagcacatctcggaagcctctcatcaagagacatgataggacattcaagcttacagatccatcgtcagagcactgcccccctggagagttcgtccgagaaatccctctttcaactcgaattcctgaagatgccaacatagaagcatactacgatgggccaggatcagtgcttgagatcctggtgccaaaacatcgcgtgggaccagaagagcatgaagtccgggtttgcctccgccctcatctgggagggaatgatctcaaattaatgggtgggattcttacggaaagtcagaaaccattgtccgataatctccgcaccttttataacagaaatttcaattcaatggaccctacctttttagactatgttggaatattggttaaaagaacaaagtcaacacccactatcatattaataatcctgaagaacttgttacctgtggaatag

SEQ ID NO: 7440 - DNA, 693 bp, Glycine max
  Peptide Sequence Number=SeqID_124218
atgccctcgccatcagagtactgcacatcctcgcctgcagagggctgcacgccctggcctttagagggctatgcgtcctcattttcaacttgcgctcccggttacgggggccacggtttcctttcaacggttcctgggctaccccctgatattggacggcgaccaactgtgcgagcacatccagagagggaggctatcacgcatctactatgcataccggggcaagatttcccccgtgccgctgcaaaaagacgagtgcggaccatgcgcaccaacatgaccatcccttacgtggatgacgttgctatttggcaacattctgcccagcgaccacaatgccaatctccccttgcagatggatcgcgcccacaagacacccagtggactcaaagaagttcaacagggccctggggtttccagctctggttacgggcctctgtcagtcctaccgggtgcccgttcccccaacaaggtcatgccatcgtgacatatgaatggcacccacaaagacacccagtggacccagagaagtccaacaggcccctggggtttccagctctggttacgggcctctatagtcctacagggtgcccgttccccccggcaaggtcacgtcatcatagggatcgcacctgcaagacacccagtggacccgaagaagtccaacagggtcttggagttgtcaagctctaa

SEQ ID NO: 7441 - DNA, 267 bp, Glycine max
  Peptide Sequence Number=SeqID_124219
atggtccgcactcgtctttttgcagcggcacgggggaaatcttgccccggtatgcatagtagatgcgtgatagcctccctctctggatgtgctcgcacagttggtcgccgtccaatatcagggggtagcccaggaaccgttgaaaggaaaccgtggccccccacactgaaaatgaggacgcatagccctctaaaggccagggcgtgcagccctctgcaggcgaggatgtgcagtactctgatggcgagggcatatggtcctctaaag

SEQ ID NO: 7442 - DNA, 159 bp, Glycine max
  Peptide Sequence Number=SeqID_124220
atgtcagtgaaaaaccacatcgggcgcctaggagtacatgacaagacaaaccacacactatttatctcgtcgcccttaaagggtcttagcattaacttgtcgcccttaaagggaattagcattaactcatcgcccttaaagggtcttatagttgtgtga

SEQ ID NO: 7443 - DNA, 238 bp, Glycine max
  Peptide Sequence Number=SeqID_124221
aaaatgcttatgcattgctcgttatgggaaaggtagtacatattgggttcttgacgttttcttgcagatcccaacgcttggaggggttgatggggacctggtgctgagaggaacgaggataagggctacgtgggggtacgtgagctcagttgaaggtgggcaactggggatggtgggttcatgtttgatttgtggatgtgggagagttgatttgcaccatcgcccgatcgccacctag

SEQ ID NO: 7444 - DNA, 243 bp, Glycine max
  Peptide Sequence Number=SeqID_124222
atgaaatggatatttggaaggataaagagcaagagattgccttcaattaaagctcccctgccctcaaaaggaacaacactaagtgaggcagagcaacaacagagcaagcatgctttaacagtgggcattgcctcaatagcagttgttgaagctgttgttactgctgctcatcgcctcactgggcaatgcaaggaaacctcaaaagactatcaacatgttaaaactagcaatggtgctctaact

SEQ ID NO: 7445 - DNA, 240 bp, Glycine max
  Peptide Sequence Number=SeqID_124223
atgcacgaaacacaatgtggaccactacgggtgcatagaatgaatcgaaaagcttggttcgaggggaggtggttgccgcccagctcgcccaggcgagctcagctcgcccaggcgagcagggttgcttcctccagaagcaaccgccttctggaggaatcttctggagggcccaaatgggcctgggtgctatttgcacccccatttttactaagtacacccccctctactgttttttggtaa

SEQ ID NO: 7446 - DNA, 357 bp, Glycine max
  Peptide Sequence Number=SeqID_124224
atggcccaggtggtggaaggtaaggtcgaagctcaacacccaaaattcggacagacccaggtggtggtgggaggctcctccatgatggacaagaggtcaagtgtcacccgagatgacctgggtcgcaacatcagtcgtgatggtgatggtgacaacattgagtgtgtggaacattgcggtggagatggactgttagtctctcacactactagtgcaaaaggttgtgatgttgatcacggttacaggaagtaccttatattcatcagttgtatgatgtcagacaaatgggtttgtgggggcgtgcaaaacttggcaacaaaacagtggatgtgtgtaggtgtctcagcttttacttga

SEQ ID NO: 7447 - DNA, 1664 bp, Glycine max
  Peptide Sequence Number=SeqID_124225
atggctgattccactccgactgcaactccttcaaacgacatcgtatcaagctctttccgacgaacggtcaccttatacgattggtggttggttatagccaaaaacgacttccaaggaaagcgtttagccgtcgctggcgtctcgtcgagaaaggatgaggcaacgcgtgtgtttgtttctgctgctgttatcaaaagatatgacgtgttttctctcgagactgcggatgggatatgcgtcataatcaggggcttcatcaacgagcagcgcactctcgaaaatggtttttccgccgaggttttccaccattttttatttggctttcctccagactgggaaaggtatgctctagattgcttcaaagaagaacctaccactgatgctgatttgggtagtgttgttcctgataatgcaccagctagctgtccaaaaattttatctgatggtgtggaaaaatctattcctacctgtttggtatcaccagaggaggcctcaggagatcacgaaatgtcattccccgaaaatgaatgcaacgtgtcaaaggagatgggtggggttcatgttgcttgtagtagtggtgggaaaagccatagtttcaagttgcacaatattaaagtatgccagcagaagaagcagcctgcttctgaatgtcttccgaaccatccagataatgagaactctagttcagtggccttggagaattgtaatgtagagagactggaaagtccgacaacacccattcagccgcaattgtggagtgaatattcaaacgatgcttgtgtggaaaatgctattcctacttctttggcatcagaggaggccccgggagatcatgagaagtcattccctgaaaatgaatccaacgtgtcaaaggaaattaatggggttaatgttgcttgtagtagtggtgggaaaagtcgtagtgccaggttgcatgatattaaagtataccagcagaagaagcctgcttctggagggtctctgaagcatccaaataatgagaactctacttcagtggccttggagaattgtgatgtaaagggactgaaaagtccagcaacacccattcagtcacaatcgtcaagacaactaagcacatcacctgggcagggaaaactgaataaatctgcatctgctttgaaaaatccacgagaaaaggatctaagccccttggccaagggaagccaacagaaaatatccacatttactccagagtcactaagtttcagaaaatccagatccggtaggttgcttctacctcccttagagttttggcgcaatcaaataccaatttataatgcggaccacgagattacagaaattcgggatggtgcatctctgatatcaccttgtagaggtttttcaccatcattgagtagcactgttactctgcctgcctcagaagtcagaatgtttgaacagggtatggatccccttggctttgcttatatcccaaggttttcaaggaaagttttgtgggttgatgagaagcttttaaaagagaagtcatttgagagagagtatagtggcttattggtgcattttctggttcattttctaatggcaactgggggtgttggtcattttcaacagtttagagggaaaaggtgcgatgcacctgatatagtcttaactaagtacatagttggcagtaggggcatggg

SEQ ID NO: 7448 - DNA, 756 bp, Glycine max
  Peptide Sequence Number=SeqID_124226
atggctggcaaaggagagggtccagccatcggaatcgatctcggaaccacgtactcgtgcgtcggtgtctggcaacacgatcgcgtcgagatcatcgccaacgaccaaggtaacagaacgacgccgtcttacgtcgggttcaccgacaccgagcgtctcattggtgatgccgcaaaaaatcaggtcgccatgaaccccatcaacaccgtctttgatgccaagagattgattggtcgtagattcagtgatgcctctgttcagagtgatattaaactgtggccttttaaggttttgtctggacctgctgaaaagccaatgattcaggtcagttacaagggtgaggataagcagtttgctgcagaggaaatctcttctatggtgctaatgaaaatgcgtgagattgctgaagcttatcttggctcttcaatcaagaatgccgttgttactgtccctgcttactttaacgattctcagcgtcaagctaccaaggatgctggtgttattgctggtctcaatgtgatgcgtattatcaatgagcctactgctgcagccattgcttatggtcttgacaagaaggctaccagtgtcggcgagaagaatgtcttgatttttgatctcgggggtggtacttttgatgtctctttacttaccattgaggagggtatctttgaggtgaaagccacagctggggacacccatctggaggaatttagagaaagacaagaaagatatcagtggcactcccagagcacttag

SEQ ID NO: 7449 - DNA, 159 bp, Glycine max
  Peptide Sequence Number=SeqID_124227
atggcgggagatgcatcaaagtttattcatatttctcccggaaatagtgaacatgtgacctctggaaacaacaacaaagtttatcaagtgttcatcaattatgtgataaaggctttttgctatcattcgatcttcataattgcttttgatgaagactaa

SEQ ID NO: 7450 - DNA, 681 bp, Glycine max
  Peptide Sequence Number=SeqID_124228
atggatcccgtgaaatacatctttgagaaaccggccctcacgggacgaatcgctaggtgccaattggtgtatgccatcctgacacggatgagcatccacgtggcccaggtgattgctgatgccatttatttatttgcaggaatggcgcctactaggcactcgttggacccagaaaagtccaatagggccttggggtttccggctctgatcacaggcctctgccaatccttcgaagctcaggtcacccccagcaaagtaatccgaccaccgatcacccgagccttcattgagaagtactgcacgcctaggcaggcacagggtgacgcacctcagggcgtgggtgcaccgccaccacctcggcaggctgatctggctgagccgctgggcgtggagcggtatctacagcatttggttcgccagcaggcggccaaccaccgcgaacaggtgcagatacacgagtatctctaccggttcaaccacagtcagaagaggcagggttccaccccttttgtatgccctaccccggagcagtttgcggctaaggtcgcatggcctggagactggcccgatgcccaggtcggggaggagcctgtaggatcccccagtgggatggatgaaccccgcatggacgaggatatgactgacttgttcgatttcttgggagggagcgaagccacatga

SEQ ID NO: 7451 - DNA, 273 bp, Glycine max
  Peptide Sequence Number=SeqID_124229
atgaagatagcaaacacaactgcgaatggtacaaataatcaagcaactcctaagtggattgaagtcaagagccatgttcaaagcggagggtatgagtgtggctattgcatgatgcattggatgtggaacatcgtcagtgggggtttaaagaatgattggagcatgtggtttcttgatggaacgacgttagacaaggaaacaaatgtgcagcatattttcttaaagttcaaagcaatcaatatggaaggatatcaagtaagggaatacccttag

SEQ ID NO: 7452 - DNA, 210 bp, Glycine max
  Peptide Sequence Number=SeqID_124230
atgaccttccggcacatgaccaaagcgcaccctcattcggcggttgcttacaataatttggcaaatgtactgctggcacagaaaaaggttgtccaggcagaggccgttgcacaacatggattggcgttggcgagtgaggatgaaaaactcaccgtccaacttaaacagactctgggtgagattcgccaagctaagaagcaaatgctgtaa

SEQ ID NO: 7453 - DNA, 708 bp, Glycine max
  Peptide Sequence Number=SeqID_124231
atgaacctgcatcacaacacttgtgttggtgctgaagcgctaatacggtggcggactgcagataatcatcttatcagccctgatattttcatccccgctgcagaagcctccggtgtcatctgccagattacacaacgcgtgtttgagttagtcgcaagggatatgcgcaatgcctttaagaagcaccagaacttttatgtgggcatcaacatttcttcccacgatatccgcgcaggcaatttattgtcactgattaaaaatctcgaaaaattaaccggggcaactggtaaccagattttgatcgaagtgactgagcgtggattcctggatgacgaggaagcgctgaccatgatcaggaatatccgtgactgcggcgtccgtgtggccattgatgattttggcactggctactcaagcttgtcttacctcactaaattccagttagattacctgaagattgacaagacatttgtggactccgtcggcacagatgccgttaccagccatgtggcttttcatattattgaaatggccaaaacgctaaacctgaacatggtggcagaaggggtagaaacccacgaccaggcacaaatattacaagatcgaggggtgacctatgtacagggctggttattctcgaagtcgcttaaagtgaatgacttttatcactatctggaaaaacatacagcccccccacttaacccttaa

SEQ ID NO: 7454 - DNA, 360 bp, Glycine max
  Peptide Sequence Number=SeqID_124232
atgtatgtatttaaaacggtgacacagacccttcgttggtttgtttacagaggggatcaagacagaacccatgtgcgatgcatatgcgaaaggcacaacacggggatgtacatagtacgacaatattcacaaacaaatataagcaaaaagtccccagtggagtcgccaactgtcgcaacctacccttcggcgggagggcgacgcgggactcgcgggatgcgtgttccacgaaaggaatacgcgcggagtcgccaccaacgtttatttgaggaaaacgtcggaaaaaccgaaaaagacgcgatctacgaacttttaagtgaaaggctcgggagttgtatttacgcatggggaaggtattag

SEQ ID NO: 7455 - DNA, 162 bp, Glycine max
  Peptide Sequence Number=SeqID_124233
atggagtttttcctaaaggaggaaactcttgttttatctcactcatacctaaggttgcgatttgaggagaaatggattttgtggattaaaggattcttggagagtagtagggtgttgatgttggtaaatgggagtccagacaatagaattcctggtgtctaa

SEQ ID NO: 7456 - DNA, 435 bp, Glycine max
  Peptide Sequence Number=SeqID_124234
atggttatcggttcaaggacgcaaggtgcccctgctttttcagggcgctacagcgctgaagtatccatgccatactcccaggaaaagctcgaacgaccttcaacaaatgggtacctgtacccgaaaccgacacagtgccggaaggtcaaggaagttggtgacctgatgacaggggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagtgagataccactctggaagagctag

SEQ ID NO: 7457 - DNA, 315 bp, Glycine max
  Peptide Sequence Number=SeqID_124235
atggatatctctgaagatactgacatccctgtaatattgggaaggccattcatgttgaccacaagctgcatagttgatatggggaaaagaaagctggagctaggttttgaagatcagaaaattgattttgatttgtttgttgaagacaaacctgctccagaacacaatgtcttcttacaggtaatggaaggatgtcaagaggttctaaagcttcacgctaagcacatctttggtcatgcgctaagccgaaagtctcaagcgcttagtgtccaacccttgcatctgaggctgattgggtccgctaagctggccaag

SEQ ID NO: 7458 - DNA, 453 bp, Glycine max
  Peptide Sequence Number=SeqID_124236
atggacggtttcgaaaccgtgttatggctcaaagaaaaccaccccgatattaaagtaatggccttgagcatgcaaggggatgacaaaagcgtcatcaaaatgataaaaaacggggcaaaagggtatttattaaaaaacacccaccctaaagaactggaaacagctcttgtgaaattaaatacggaaggattcttttatccggaatgggcgtcacgcattatattttctaatctgaacaatgaaactgaatctaaagatacagtgcggatttctgagcgtgaaaaagaattcctgaaatatacagttactgaactaagttataaagaaatagctgataaaatgtgctgcagtccaagaactgtggaaagttacagagaccagctttgtgaaaaattagatttgaaaacccgtgtgggactcgctgttttcgccatgaaaaatggattcgactag

SEQ ID NO: 7459 - DNA, 291 bp, Glycine max
  Peptide Sequence Number=SeqID_124237
atgaaaaaactattatttggaatcctggcattaggattcatgtccgcttgtaacagcgacaatgtttcaaatcaaggtgaagagactgcaaacaaatctgcaactgcttcagatttagccaacagaagatcttgtccttcagaagaaatcagaaagcaaacacttcagaacaatcctgaactcagacaaaagtatgcagctattgaagcgaatactgaaagatttgcaaacgcaattaaaatggggaaagttcttgcagatggtactgttgaaatccctgtggtagtaaat

SEQ ID NO: 7460 - DNA, 234 bp, Glycine max
  Peptide Sequence Number=SeqID_124238
atggtgctgatagcggctattgcaaccatattgacttccattatcttcttcatgctcaccatggccttcatcattgtggccattttctctttcatggcctccatgtcgacctccatctgctcttgcacctcctctactctacccattactctagctctagcacaggttcgaaatgggtttatgatcccaacatggttggctcatggtacctcacacatgcaactaagaatgtag

SEQ ID NO: 7461 - DNA, 429 bp, Glycine max
  Peptide Sequence Number=SeqID_124239
atggcatcaagaaaaagggatagaacagatggcatcccttcgtcatccactccatctcctccgtcagcaaccataggaccggatgtccaaagctctcaaaccttagtccctatgctagaaagcttattccgaggacaatttattatcatgcacagcctgcgagaattggctcacaacaggccaatcatacctatggagcatttacttgagcaagtagcctggcctggagctcaacctccattggtgagacccaacgaggctgctcctctggagcccacatctgcacgggttgaaccagtgccagctgatccatatgttagacaagtggcctcagatatcttaagaaggggggttgaattaagatattgcaaactatttccccaattaaaattctatttcaatttcaatgcaagtagcaagttcccttaa

SEQ ID NO: 7462 - DNA, 1218 bp, Glycine max
  Peptide Sequence Number=SeqID_124240
cagcaaccacagccggtggtgctgatcccgtcagagtggcgacgtcaggcgaccgtttgttgcagaaagaagccatcgagacattacgacgcgagcttctgccgctcgccaccatcgtcacgcagaacctgcccgaagcggctctggtgaccggcacgccgatcgccaccacggagaaggagattacccgtcaggccgatgcaatcctgaaggcaggtgcgaaagcggtgctcatcaagggcggccatggtgaggggccgcagagcacggattatctgtttgcggacggtaacatgcaggcgctttccgcaccccgggtggagacgaagaacgaccacggcacggggtgcacgctggcggcggcgattacggctcatcttcccaagggttgtgagttgcgggaggcggtggggcttgccaaggagtatctgaacggggcgctcgatgccgggcgggggcttgccgtcgggaatgggcgggggccgagtgcggggcttatccccctctgtcctgccggacatctccccctcaaggggggagatcgactcgcggttgggtctcgcccatctcaacgcttgcgaatggagcggtgggtgccccctcatccggcgctttacgccaccttctccccggcggggagaagaaacgcgtggcaacctctcgccatatgggtcaacttggcaaaagacctcacccctcataactatgccccgccttcagcccctcacgcacccgatgcgcaatcgccagaaattccgcgtcgatgtgatcacatccgtaacccggcccggccgcggcgacatgacgacgattttggtcgagagatagacggcttccgggatggaatgggtgacgaaacagatggtcttgccggtcctgtcccacagcttcagcagctgttcgttcaggtgatcgcggacgatctcatccagcgccccgaaaggctcgtccatcagcagcaggtcggcatcgaaggcgagcgcgcgggcgatggaggcgcgctgctgcatgccgcccgagagctgccaggggtatttcttgccgaaaccgttgaggttgacgagatcgagcgtgcggtcgatgcgctcgcgctgttccgccttgccatagcccatgatttcaagcggaagggcgatgttcttttcgatgctgcgccatggataaagcgcggcggcctgaaagacatagccataggagcggtccttgcgggcgtttccg

SEQ ID NO: 7463 - DNA, 345 bp, Glycine max
  Peptide Sequence Number=SeqID_124241
atgcccattcataccagaacccaagataagcctatagccatcccctacagtcccccaattcaaggaaacaacgcatggattcacacatacattgcctcacgaaatttgcaaaaaccaagcagccaaaacactaaaatactacaatggaaagccaaaaatcaaagaaaagtggcacttacttgtagggggctgatggcacatcaaaaccccccatacttagccttttgcactcctgggcaaaatgaaacaaagaacaaaatccaaggatatcaaagggagacaaacaaaaacattcacatatttctcaatgaacatcaaggaatgaaaggaatgggtaacatctaa

SEQ ID NO: 7464 - DNA, 342 bp, Glycine max
  Peptide Sequence Number=SeqID_124242
atgagtttggagcggtgtgaaggttcatggctcacattgatacatgtgacttggtgggtggttaggtggcatcgcggcggtaggtttggtgcaatgtggaggtggccttggtgttgggtggaggtggggtgtggtggtgatgaaggtttggggggagaagtaactacggttttgcttgggaaaggaagggtaaaaaaggggatatcaggaattttgggagtgcaccaagaaaaaatatgggatgcattaaataactgttatgacgaagctgacatgcggatttgttatggcccaataaacttggataagcccactaatatatttcgaaggctagtagcctaa

SEQ ID NO: 7465 - DNA, 1018 bp, Glycine max
  Peptide Sequence Number=SeqID_124243
atgcctatatatttcaggaagattcagaatcaccttggaagctttctttccgctacaacattctggttttatgggtcactaacacctcaagaagccggggcaatggcactcattactgctataaattgggttcaatctatgaacatttcaaatatcatatttaagcttgatttcaatttggaagtatgtagtggactgagtcactgcaagaaagatcatgttaacagagttgggaggaattgttataaggcagtagaaagtgaaaaaagagtggaaaagagggtcccattggaagagtcggaagcggaggggaggggagaggaagaaggaacatgtcaggcgttagagatgggcgttgttgttgttggtcttcctttctcaatggggagcgggagcagaagctactcggccaaccccgccgactacaagcttctagaagaagtcggttacggcgccagcgccaccgtgtaccgcgcaatctacctcccttacaacgaagaggtcgccgtgaagtgcctggatctggatcgctgcaacagcaatctggacgacataagaagagaagcgcagaccatgagcctaatcgagcaccccaacgtcgtgagggctttctgctccttcgtcgtggagcggagtctgtgggttgtgatgggattcatggcgcagggctcctgcctgcacctcatgaaggctgcgtatcccgagggattcgaagaggccgccatcggatctatcctcaaggagactctcaaggcgttggagtatctccatcgacacggacacattcaccgcgacgttaaggccgggaatattcttcttgacgataacggcctggtcaagctcgctgactttggtgtttccgcttgcatgttcgacaccggcgaccgccagcgctccagaaacaccttcgtcggaactccgtgctggatggcgccggaggtgctgcaacctggaaccggttacaatttcaaggcggatatttggtcgtttgggattacggcgttggagttggctcatg

SEQ ID NO: 7466 - DNA, 813 bp, Glycine max
  Peptide Sequence Number=SeqID_124244
atggatttcgtggccgcgttcgagagggactatggctcctttgggcccaatttcgtcggtgagggcttcatggacgcgcttcagcggtccaggaactcgttcaagcttctcttcgtttacttgcattcccccgatcaccccgatacgccgtccttttgccagaggacgctctgctctgagaccattgcggcgtttgtgaacgagaatttcgtgtgctggggtggcagcattcgcgccagcgaagggtttaagatgagtaacagcttgaaggcttctcgcttccccttctgcgccctcgtcatggccgccactaatcagaggatcgcgctccttcaacagttacttgtatctgctattgtgagtctgactgctattgcagccgctattggtgttgtggttgcagtttctgccctagcggagcggcccccatccgcgacagacacctctatagcggagcggtttcgttttgcggttggagcggccgctatcgcggtggcgctgggcggagcggcgcagtttctggaacagtttttcgcgccgctacttcgaagcctccaccttttcctcctcctcctcctcctctgccactctccgtcctcctccccctcacgcgccagtgctcaccatagtgtagaagatgtgttttccagagaggaagtgggggcggttggtgaggacgacgtcgtttttgagggctctgaaggtgcaatggagggggcgcttgaggtggtgccgtggtggaggttgctgattatggggagagtgatggacctggtgggaggttttggaactttcaggagggagaagctttaa

SEQ ID NO: 7467 - DNA, 207 bp, Glycine max
  Peptide Sequence Number=SeqID_124245
atgactataaaaggaagttttgtacagctagccattccacgctttaatggtcactatgaccattggagcatgttaatggaaaatttcctacgaactaaggaatattgggaactaatcgagcctggctatgtcgagccagcaagtggagcaacacagatagaagcacaacagaagaagaataatgagttgaagctgaaggatcttaaa

SEQ ID NO: 7468 - DNA, 474 bp, Glycine max
  Peptide Sequence Number=SeqID_124246
atgaggttttttcttggaattgaagtgccgcaaaagtctgatggtatttatatatgccaaaacaaatatgcacttgagattttgagaaggtttggaactgtgaactatgggattcattataagaagggagggaatggtgagctgttagcatttacagatagcgactatgtcggagatgtggaagataggaagagcacgtctggttatgtgtttctaatgagttcagtttgtgcttgtcaaggagtttggatgaagagaattttagagaagctgggacaatctcatgaaggctgcataactataatgtgtgataatagctcaaccatcaagctatctaaaagtcctattatgcatggtcgcaacaagcatattgacgtgaggtttcattttttaaggaatcttagcaaggagggtacaattgagttagttcactgtggaagtcaaggccaagtggctgacataatgaaccattaa

SEQ ID NO: 7469 - DNA, 567 bp, Glycine max
  Peptide Sequence Number=SeqID_124247
atggacatcgatgctcttactgttgatgagttacaaagctctttaatagtacatgaacagaaatttcagaggcgtaatggaggtcaggaacaagtcttgcaagtgtcgattgaaggaggaagaggtcgtggtcgtgttgcctataggggaagaggaagaggaagaggtcgaacaaccttcaacaaagcaactgtagagtgttaccaattccatcaactggggcattttcgatacgaatgccctcagaacaaagaagcaaattatgcagaggttgatgaagcagaagaaatgcttttgatgtcctatgttgagttgtatgaagctaaaagagaagatgcgtggctccttgattcaggatgttctaatcatatgtgcggtgatcaaactatgtccagtcaacttgatgaaaaattttggcattccataaaattgggaaataacactaagatgaatgtgctgggaaagggaagcgtgaagttactgttgaatggagttaactttgtttttcttgaggtatactatgttccagagttaaacaataatctcttaagcataggacagttgtag

SEQ ID NO: 7470 - DNA, 758 bp, Glycine max
  Peptide Sequence Number=SeqID_124248
gttgtgtggttcagtacttcggtggtagtgaagcctcagaagcagaaagtgatgaggtgtctgataaaaaattgctaggctacaagtgcgtgctaagttccaaagcaacagaagaaactatggcaaattttgctagatgggagcctgcccatggccgcttcaacttccgtcacccatggaggcaatatgttaaaattggggcatcgatgcgtagttgtgcttcctgtttagatgctcttattggatgcataaattcagacaaccaggcttcggatgacatgaagaagaatatgagcagcatctccatgaaagtgggtgccaattgtgcaagtgtcataagagagctagcaactacaataaggaaaatgaaaaaatcatctaaacttgatattttggttacacagatgaatagtgctgcacaagagctccgaagtttgttaaattcttgtccatacttggttaacccaccacataattccaaacgtagtacacgaacagaaacagcttcacctgatgatctagctccaaaaatagaaatcccacttatggaaattattcaggttgtaactgtagcttctttgctcattgaaattgtggctcgtgtggaagacattgtggaaaatgttgaagaactatcagatttggctaatttccaaccagaaatgaatgtcaaatccaaacaacatacatcggacagcaaggtctcccctgaccaacagaatgatggggaacccgttagaacactccaaatggtctaa

SEQ ID NO: 7471 - DNA, 1434 bp, Glycine max
  Peptide Sequence Number=SeqID_124249
atgggaagcaacaccgtgatccatcccaaagaagagtacctggagagcaactcagaagctagcacttattcatgcagatatatgtgtccaagcacaccggcatctaatagcaacaaaagttatattctgttgttcattgatgattacagtagaaaaacatgggtacattttttggtggagaagtcggaggctttaaattctttcaaatactttaaaactatggttgagaaagaagcagatatgtttattaaatgtcttcgtactgatagaggaggagaattcaattcaaatgagtttaatcatttttgcaaagaaagtgggatcaagagacaattaaccactgcttttactccgcaacagaacgacgtcactgaaaggaaaaatagaatagtcatggctccatgttgtctgataagaatattccaaaaaccttttggcctgaagtggtgtcctacattggcagtgaaggatataacaccagagaaggcttggagtggagtgaaaccctcaattgatcacttacgggtctttggatgcatagcacacgcccatgttccagaagcaaagaggactaaacttgataataaaagccttacttgtgtactattaggagttaatgaggaatcaaaaggctacaagttatttgatccaattgctaggagagttgtcgtgagtagagatgtgatttttgaagaagaaaaacggtgggattgggatggaaaacaaatagcaatagatataaaatgggatgagagtgaaaatgaaaatggagaaaataatgacagagagataggagagacttgtgatgaaggagttggagatgtttctagtgagagtgaagtgagagtgagggagttaaggcaacctctagaaaggcaaccacctacatggatgggtgattatgttagtggtgaaggtttatctaatgatgaggttcatatggaattaatggtgtcaactggcccattatgttttgaagaagctgtgaagagtgcaaattggagattagccatagacaatgaaatcaaatccatagagaagaaccaaacatggacattcactgagctacctgttggggccaaaagaattggagtcaagtgggtctataaaactaaaaacaatgagcatggaaagattgataaatacaaagttcgtttggttgctaaagggtactctcaaaagcatggagtgaattacacagaagtttttgcaccggtggcaaggatggacacagtaaggatgatcattgctctagctgcgcataaaaattggcggatttttcaactagatgtcaagtcggctttcctccatggtcagctaagtgaagatgtttatgtggagcatccaagaggatacgaaaaagaaaatagtgagcatttggtttacaagttacacaaagctttgtatggactaaaacaagctccacgagcttga

SEQ ID NO: 7472 - DNA, 408 bp, Glycine max
  Peptide Sequence Number=SeqID_124250
gtgattgaattaagttcaacacaggggctagagatgggactttatttgtttagaatggtgtctcacttcagagttcttgtatgtggaggagatggtactgttggttgggttctgaatgcaatagacaagcaaaattttgtttctcttcccccagttgctattcttcctgctagtataggaaatgatcttgcaagagttctctcctggggaggtgacttgggtccagtggagaggcaagcgggtcttactacatttttgcaacacatagaatatgctgttgttatggttcttgaccattggaaggtaacaattagtaatccacaaggaaagcaacagctgcaaccaacaaagtttttgaacaattatcttggtttaaagtatctagaaagtcagcttgttaaactttga

SEQ ID NO: 7473 - DNA, 423 bp, Glycine max
  Peptide Sequence Number=SeqID_124251
ctggagttcgccaaacagatcggcgccgatctggccatcaattccaaaacgcaaaacgccgaggagatcattcaacagcaatccggcggcgctcacgcgtcggtggtgacgtcggtggcgaaagcggccttcagctcggcggtcaatgcggtgcgcgccggcggtaaagtggtggcggtggggctgccgccggagagcatggatctgagcattccgcgcctggtgctggacggcattcaggtggtgggttcgctggtgggcacgcgcgaagatctgaaagaggcgttacagttcgccgccgaaggcaaagtgacgccgaaagtgaccaaacggccattgggcgacatcaacgccatcttcgacgagatgaaggcgggcaccattcgcggtcgcatggtgatcgatctcggcatggcgaaataa

SEQ ID NO: 7474 - DNA, 153 bp, Glycine max
  Peptide Sequence Number=SeqID_124252
atggaggttgaggaaccttggcaggggttatggctaccattgcattatcaagtggtgtttgggcattggtcgtgtggtgagaaggcaggccttgtggctgatttggggatggcttttgtggatgattgggtgagagggactgttattggctga

SEQ ID NO: 7475 - DNA, 297 bp, Glycine max
  Peptide Sequence Number=SeqID_124253
atggtggttctttgggcgtctcaggtcgatctcataattacatttgtcatgcatggcataagtatgcccaagtcattcatctctatgatatgttgtcgaagtattgacactcaatttctattccttggattatggggtcgaaccaagcacatgcttttaagaaaagggtttcatcaagtcaaggtcaagtatggaagtaaccagcttgcaaaagttggggcagaagatggatcgagtttacatagattttttggctactgccaacacatgatcgagctaaataatttacaaaattaa

SEQ ID NO: 7476 - DNA, 156 bp, Glycine max
  Peptide Sequence Number=SeqID_124254
tctacccaaacctcaaattcgaagtcccacaacgtagaggtgcgcttcacgactccgaaaatggcttcctttcgcgatttggagcagaaatggtgagcaaaggttggagctttgatggagcttcaatggtggaggagaaagggagaaaaaagcaac

SEQ ID NO: 7477 - DNA, 363 bp, Glycine max
  Peptide Sequence Number=SeqID_124255
atggaaaccaatgcggttgcagttgccgctaccagggctgttgctaaggtgaacccgatgcccccatctgatctcaaaccaaatgaatcatccaacctcagatatgccactgaagggcaagtaattggtgatatacccctgcaaaacactttggagggccctcagtatcacccacaaccacaccccttgcattccacagcgattaaaaaccctcatgctatggcggaaatgggaaaggtggatcatctaaaggaaaggcttagggccattgaaggaggcaaagattatgcctttgctaatctagaaaagttgttcctagtacccaaacatggtcattcccaagttcaaggtgtcggactttga

SEQ ID NO: 7478 - DNA, 161 bp, Glycine max
  Peptide Sequence Number=SeqID_124256
gcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttagttag

SEQ ID NO: 7479 - DNA, 270 bp, Glycine max
  Peptide Sequence Number=SeqID_124257
atgaaaagaaagaaaaatccaccaaaggcgagtgaagaaaaaaagaaggaaaaaagacctccagattttacaaggaaggcacaaaagaagaatcctctaggtttcgcacttgcacatatgagaagaaaactcattcgaccaggagttcgtggaaaatgcccaaagacaattgtgatagatcagcccatgtcatcaagtttcagcgagattgacagacccttggcatcactctatcaggaaagtttcacttggtcacataccaaagtgtga

SEQ ID NO: 7480 - DNA, 126 bp, Glycine max
  Peptide Sequence Number=SeqID_124258
atgttgttgaacaaacatattttatatgcaagaacaaagggtcattatgatttaccaaatgatgcttcaagtgttcctaatacacctttggatgcaagaggatcttctggtgctagcaacccttag

SEQ ID NO: 7481 - DNA, 603 bp, Glycine max
  Peptide Sequence Number=SeqID_124259
atggctcgtggcaacgatatggcgaaagaagtagaatggaggatcaaggtagaagaagacgatgacacactgcagaaaacaatagttggttgcatgtgggcagttacagcaggtctggctttgaagttgtgcaagtttgtgaagaaagcatgggaggttggggtgaatgacccaagaaaattcatccattgcttgaaagtagggattgcactttcagcagtttctctcttctactattggaagcctttgtatgatggagttggaggaaatgctatgtgggctgtcatgactgtggttgtagtttttgagtacacagccggtgcaactatatgtaaaactgttaacagaatgtgtggaacttcccttgctggatttctaggcattggtgtacattgggtagcaagtagggcaggagagcaatgggaacccgtaattgctggagtctctgtctttcttttagcttctgcagcaacattctccagattcatcccctccttaaaggctcgttttgattatggtattttgatattcatcctcacattcagcttggtgtcaatatcgggttaccgggttgatgaattgttggtcatggcacagtacaga

SEQ ID NO: 7482 - DNA, 303 bp, Glycine max
  Peptide Sequence Number=SeqID_124260
atgacgatggcaatgacaatgcctcttactctacggaataagctcaagactctttgtacttgtggtgatggctggtcttatgctattttctggcgctttcatccacggaattccttgttgttgactgtggaagaagcatactatgaagagcatctgggagaagaaattgccaacatgcatccgcaggatgattctgaatttcagcaacagttctcctctgggataaagactattgtggtggtacctgtcaaagcatggggagtggtacagtttggatccagaaagaagcaagcatgctcttga

SEQ ID NO: 7483 - DNA, 2151 bp, Glycine max
  Peptide Sequence Number=SeqID_124261
atgtcaaggcttgacctgattgtcgactggcataaggttgttgaattcccgttaataagtgtagctctttatctgaaagactggagagtagaagtttacacccatgtctcatctggaagaatcttagagaaagtggaatttttggagcaaacacaaagcgtgctaacagatatggatgatgatatgggtatgtttgacatgccgggaaattcagttttaccactagattgtgaaaataatgatttaaatgggttgtgggattccatttcttctgcaaatcccaacaattccttcccttcccaatatatgacttatgacaaagcaatggtttcattgcaagaagattcttcttattttagtgaccaattgaaaggtaccatggaagctcaaattgtattatcagatagggatagtgctgatgtgcttttgaagcctaactcttctacaaacaaattaattgccgaaaacccctattttggtgtatgtggtagtgaattatcttcttttaatttgttggagcaacaattggtatcctgtgtaagtgcacaagaagatgcagatgcgtgttttacaaaccaaaatgattttgctgccagcaaacttctagttcaggattcagcattgacctcactgtgcagtatggacagagggtcatttcaaggcaaattacaaaattcactggataaccaatatccaactcagtctggtgttgtgatagatgttgatttttcctcaagttcaaatgcattgcatggactctctgagaacttagagccagttgatatgtcagaagaaattttgaatttcagccctatggaagatctttgccagtggtttggtccttctcccgaggatagtatctgcgaagcagtaattgccttggataacaacttttctgaatcaacagaatttaatcccacttcctttgatctggttggaagtagttctttaaatgatatttcagtgacatgcctagcagagcataattccaactcaaatgggaaagaagcatctgtggtcatgcaaagcactgaaaaaggtctctttgatagcatggaatttgattttagctatgatcaaggtgatgaatggtgggggaatatgctttcaccagtggtgagtggtgttactgatactggcttctctgaatgtgtatcagagttgaatactactgatgcattgactggcacccggaagagattattctcagagttaggaattgaagagcttttgaggggtggagcaaattacaatccttttaatagttctgaacttgagtatgagttatcacccaataagagcgagacggtagaatcttcatcagtgaatagaaatccaatacatttcaccaactttcattggcctggggctagagcagacttgacacagcgactttgtgacttagacaacacaaacaatcttccaaccaagaaagataaattcccaaaattacaaacaggcatgtggattgatgatagtcatagcattaatattgggaaggctgtaccagtgcaccctcaaaagccagaggaacccagaaagccatccaagaagagggctaggccgggggagagtactcgaccgcggccaaaagatcgtcagcagatccaagactgtatcaaagagttgagacgaattatccccaatgatggaaagtgtagcattgattctttgttagaccgcaccatcagatacatgcttttcttacaaagtgtcctcaagtattcagacaagctacaggaaccaaatgagccaaaggcaaaggaagtggttttaaaagacagtggtgcggcggatagcaaaaacgggggcattacatgggcatatgaagtggcacaccaaacaatgctatacccagttatagttgaggacatgagtctacctggtcaaatgcttatagagatgctttgtgaggagcaaggcttcttccttgagataattgacaagattcagcgtttcgggctgaatatcttgaaagccaagatggaaagaaggaagaccaaactttgggcacgctttattgttgaggcaaacagacccgtgacaaggatagaggtgtttttgtacctaatccatcttctacaggaaacaaacacctctggcattgattcttctaataagcattgcgatgttattgaggccaatatttag

SEQ ID NO: 7484 - DNA, 1059 bp, Glycine max
  Peptide Sequence Number=SeqID_124262
atggatcaaagcagcatggattcgaacaatggacccgtatctaccgggtcggagtcaagtggatccgattcttacgagtccgatccaagtccaaacgtcatatatacccaaccccgaatatccccttcattttttccaccttcaccttctccctctgtggtgttccctgctgctactgagagcggagattcgtctcccccttctgttaccttccccactccgtaccaatcacaaaaacctcaccgcctgaagtcgctccccatttcggtgccctcaattaccgcgagaattatgaaaggggggcgatcgcaccgccctcagagctctgacccgccggacgagtgggtggacgggtcctggacggtggactgcatctgcggcgtcaccttcgacgacggcgaggagatggtcaaatgcgacgagtgcggcgtgtgggtccacacgcgctgctctcgctacgtcaagggcgacgacaccttcgcatgtgacaagtgcaaggccaggcacaacagcaacagcaacaacaccaccaccaccaccaccaacaccaccaaccccatggagaccgaggtggcgcagttcctcgtggaactccccacaaaaaccatttccatggacaacaaaaaagccctcccctccaggcccaggctctggaccgataagcccatcgaggagcgggtccatgttcagggcccaccgggcggagacccttccatcttcgctggccaaagcgcctcctcgattttcacgccccagctctggaaggcatgcgggtatgtccctaagaagttcagttttaagtacaatgagttccctttcttgaataatgataacgataacgagggcgggccagcaaaagatgatagtaacgataatggggctggtgctggggctcttgtttctctgtccaaagagggtaacaacattgcttctgctgctcctgtgttgaacacttcttcccctgttggggcttcggttgaaacgagatctggccagggcaagggcgcggacacgggcaagtttgggagcgaggacgtgccaccacgtgtccccagtgac

SEQ ID NO: 7485 - DNA, 577 bp, Glycine max
  Peptide Sequence Number=SeqID_124263
atgcccttccaggtgcaaggcaatcgtcatctgcagttcgtccagcgtgtacccgagtctcacccggtaaaaggcgcaggtatccagataggcctgcgccacggcgcgacggaaaacggcggtgttgacgacgtgtccgagctggtcagtcagcacggcaatgaccgacgcaaaggcagctttctgaacggcgtccggacactggccggtcgattcgagcgtgtccagcatgtcgaggaacagcacgccggaagtccgaatgcgagatggcgtaatggatttcactgtggaaacgggcagccagtgtgttcatgccacctcctgtacgggcagacgaccggcaaacgccagaatgtagtcacgcgccagcaaacgtcgggcgctgtgctcagagttggccacggtgcgcagcatgcacggggttgccgtcagcgcagagcggcgcacggccgcaaacagaaagcagaatgtaggatgagtcgggatgagggtcgtagccatggtggcagcctccttgaagtaaaggttattgctaccactgaagttcctacgcttatgggtggtagcccaaacgggg

SEQ ID NO: 7486 - DNA, 2716 bp, Glycine max
  Peptide Sequence Number=SeqID_124264
ggacgtcaagaaggagaggactctgctgaggccacctgttgttcataacagtcagcgtagcaaaggggatttcgtcgggaattcgagttccaaggagaggagtgggaagaaacgccttaggacttctgacagggaggtagatcccaggaagaaaacgctgcattcctccaaaacagtggttacgcccaccgctgatggaaagcaattggaattttgtgaggatagaggatcaaagattttcaaggctgacactcggagcataaagaacaaaaacttaaaagacatggtggttcaagaacatgtttctgatgatcatgtagctgtggatactaccatggaggagccaaataacaacttaacaactaccgaggactcctcagaaccattatatcctgacatgactaaacatggtgtttctgttggagatgttgtagcagaagagaaggctagccataaaactcctactttggttgagatgtcttccaagactgatgatgctgttacatcatctttaaagcagaactatgttggaaatgcttcagttaaagaaaaggatggagattgcttggtagctgataacgcagacgatactttagtagtaagaagtgcagcaagtcctcgcacagaaggtcattgtggttctgcaccagaacttgtggataaccaagtttctcaagatcttgaccgtaacatgcgttctagctctacaaaatgcaaagttaagatgaggagagatgatgttgataattttaggaagccctcaaattttcattcttctcctatgagtgatctaaaaaacaatgataaaccttctgaccacacttctgatattgttaaagtgaatgatgctccagttcccagtttaccatcatgtgaaagtaaggtgggtggttttgatatttcatcagaaccaatacctgctgatcataccaataaacccaatgaattatctggtgatttttgtcaaagaaaacaggaaccggtggggtctgaaggttccttcgaaacacaaaagggatttacagaaacaaaagacagtttggatgctgctaaagatccatcaaaatccgaagcaattggatgtctgcctaaagttggaaagtcatctccaacttcatcaaccatgaactccaaatcattgggtcatgacatcaaatctgaagatactgaaatccctaattcttttacgaagcatggagtgatggctgatagtaacattcacacaaagaatgaaaattgtccaagtgatgctgccagggatgaaaatcaaaagaagtctgtaaaagagcgaccaaaatcctctttgaattcgaattcaaaaggattgcagtcaagcaggagtatgcaaaattctgtcccaaagcaagtgaattcagatgccagagattctgttcatgtttcatcttctaaacctttgatacatcagactgcaagtatattaggctctagtgagtctaatgcatcattgcaccatcagaaggttttacaagtgcagaataagatttcatcttcagcgccacagaaagttgaaaaacttaaccaaacaaacatccacacttcctccaagttgaatcaaagtcatgtatcatcagtgaatccttctccaatatcgaattcttcaatgctgagtgatgaagagcttgctcttctattgcatcaagaactgaatagttctcctcgtgtacctcgtgtgccccgagcacgccatgcaggtagcttgccccagttgacttctgctagtgctacaagcatgctaatgaagcgaacatcgggtggaggaaaggatcattatttggtatctagacgaaaacacaaggatgcatctagacctgggtctggcagttctcgtgaacttgaagatgaagctaaaaagatagagaaggagaagggtccatcctcgtctgatcagaggaaactagatatgtcatatgtggaagatgctcctgcaagggaagaaggccttgcatctatggcagtgacaaactccatcacaaacaatactgtttcttccacctctggagttgcaaacagcgatgcatcctcccctccggaggatcagaatttgtcatctatgcgtaactcacctaggaatgtatctgatgatgatacagcaactgctggaaggccagttcatcgcaccttacctggtttaatcaatgatattatgagcaaaggcaggcgtatgacatatgaggaactctgtaatgctgtgctaccgcactggcataacttgaggaagcataatggagagcgttatgcatactcaagtcactctcaggctgttcttgattgtttgaggaaccggcatgaatgggcaaggttggttgatcgtggtccaaagacaaattctaataggaaaaggcgtaaactggatgcggaagagtctgatgataacggatatggtaagggaagaactgcaaaagatgttgaagggaagaactttgagttgcaaaaagaagagttccctaaaggcaagcgtaaagctcgaaaacgtaggcgccttgctcttcagggaagagcagtgaaggatgtcaggaggagacagaaagttagctcgctaacggatgaggatctgggtccattctccaattctagtgaagagagcatgttcagtgaagatgaaattcaggctggcagaatttgtcctgctggaagttcatcagatgaggcagtcttcgcgagcttgttaagtggaggatggattgcgggtgcttag

SEQ ID NO: 7487 - DNA, 372 bp, Glycine max
  Peptide Sequence Number=SeqID_124265
atgggagccaagttagcatatgacaccggaatttgggggatggcctttgtggataaatgggcagtaggtaaggagaagggttgggtaatgacattgttgggttggatgactaaatttgccttttttcagacccacatcgatcctttcactggcaaagaccaaatcctcaaagctttgaaggtgcgtagcccaccattttccatagtagaatactggtgccactttgagctgccaggttctccacctttgggcaaagaagcatctcttacgcaagaaccaatccatccactagaacgaggactgtcaagaggcgttcggaaggatcaaacagtgcctcatgaaccctcccgtgcttatgctgccggtgcctga

SEQ ID NO: 7488 - DNA, 393 bp, Glycine max
  Peptide Sequence Number=SeqID_124266
atgaaggcgcgaaacctcgtagtagcatcttccttagcattggaaaggcaaaatcttaatagcatgcacctcattaagcgagacacgtatggtttgtgctttggtcgtggagttccgaagcctggtgctggtagtgttggatcatgtgggggtgatagaaactccttggcctattctctatacgctcccactgtcgctttcctcaaaattaagcataagcttagttgcaatttttttgtctccattacaaaatgtactgtaagggatccactgagtagtgggtcttggccaaccgaacatgcaccaagcacacacgtccataatgggtgttactcggtattcattgatcggtattattataaggtagctagacgattgcagaacagaaggtaa

SEQ ID NO: 7489 - DNA, 642 bp, Glycine max
  Peptide Sequence Number=SeqID_124267
ggttttgccttgcaaaccttcccggtgatgcttttagtctatgggggaacttctttgaggcaaagaaacaaatgatggctgatgccaagtttgcggggctgcttggtttagccatttgcttaagtttttccatgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggtggtggatcatcatgcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagg

SEQ ID NO: 7490 - DNA, 762 bp, Glycine max
  Peptide Sequence Number=SeqID_124268
atgcccgaaccggaatctcagaacggacacgaaccagcgcccgaaccagaaccggagccgcagccgcagccagaaacgaaaccagagccaaccgagcaaacgcaaccacatttggaaccgaaatcggaatccgtgcccgaactagaaccaaatccgcagccagaatcggagccagtgccaacagagcaaacgcaagcaccattggagccgaaatcgggatcagaagctgatcccgtggtaaacgacgcagatcgcagagaaacgacaatccattccaatgaggcgaatgcgaatccttctcccactccgaagctccgaaaagacgaaggaagccgaacgttcaccatgagagaattgctgaatggattgaaaactggttccgaaccggagaaagaagatgccaactccccctacagcccagaacaacagcaacaccaggcagaccagaacaacgctgcaatggatttgataaatagcgttgtaggtgttgacgatgaaggccgttcccgacagaggattcttacattcgctgccaggagatatgctactgcaattgagaggaaccctgaagattatgatgcattgtacaattgggcattggtactccaggaaagtgcagataatgttattccagattccacttcaccctctaaagatgctttgcttgaggaggcttgtaagaagtatgatgaggccactcgtctttgtcccacactgcatgatgtacgtaaggatatccttctttatgatgttttagattaa

SEQ ID NO: 7491 - DNA, 201 bp, Glycine max
  Peptide Sequence Number=SeqID_124269
atggagcatgaaacattccttgcaacttggttggtagagattgatttatctcccaatggcttgagattctcaaatttgcaaccacagcctaggttgatcaaccatgaaaaacctatgctatgtaggtggcacaagcttaatcccttgaaaattgagggtaggagatttaccctagattcagctaaggactactttccttag

SEQ ID NO: 7492 - DNA, 252 bp, Glycine max
  Peptide Sequence Number=SeqID_124270
atgtcaccacacgttatgcaagatggtggaagcagccaatactgtatcatcatcgtgattttgcaaagaatatttctcggtgaaagagcagtctatgcaatgatgctggtgtttccacctgaattttctcctttgaaaactattttatttggaaatccttcccaagactccgttgaaccactgatggaagctttggaggaagattataaagatggaaatgagataaatgaatcaaggcagtttattggagga

SEQ ID NO: 7493 - DNA, 687 bp, Glycine max
  Peptide Sequence Number=SeqID_124271
atgagccaaacccgacccactaaggacagcgagtaccaagacaaaagttttcttattacaacccaggaacttccatcatgtgcagcagtgcagttcaccagggagccaggagatctcattacaagtagagcagtggtgatgatgctctgtttcatggctaaaaattcagaaacaaacagagcactagagaagcatgagagcgctcacatatttgtgtttgacgcaggagaagtgaaagttaattttgggctgcagtggtctggttggcttggtcatgatgcttcaaacaattggaaaaatggtgtgggcttctttcagctgccagtagttagtacttactcattcctttggattttggaatttcctggccatgcatgctttaccaaatataagtatccttaccttgggggcagtagtcacctctgctatctggcaatcactgcagtgttgatagccaatctatctgctttctacaattgggctatagcaatttctgatcgagcaaagatgcgtggccgcacaaaggaagctgaagaactatggaagcaggcaacaagcaactatgaaaaagcagttcaacttaactggaacagtcctcaggcgctcaataactggggacttgctcttcaggtatatttaacttgccagtattcaagcatttcactactacacacaaactgcaattaa

SEQ ID NO: 7494 - DNA, 1998 bp, Glycine max
  Peptide Sequence Number=SeqID_124272
atggaagaagagaaaaaacaagaaatagttgaaagagatcaggacttggaggatcagctacctgctgctgctgctgaagtccatgagtctcagccatggacagaacagataacagtgagaggaatatttgtgagcatgattattggaatcacattcagcataatagtgatgaagctcaacctcacaactggaatggttcctaactgtaatgtctctgctgcactcctagcctttgtgtttgtccggacctggaccaaactgcttcacaaggctggctttgtagccaagcccttcagccgccaagagaacaccatcatacaaacttgtgcggttgcatgctatagcattgctgttggaggaggatttgcttcgtatctgttgggattaaacaggacgacttatgagttgtcaggagttggaaacgagggtaataatccaggtgctattaaagaacctggatttggttggatgactggcttcctttttgtggtttgctttgttggtctctttgtcttgattccactcagaaagatcatgatagttgacctcaaattaacttatccaagtggcttggcaacagcagttctcatcaatggtttccatacacagggagacaaaatggccaagaagcaagtacgggggttcacgaagtatttttgtatcagtttcttatggggtttattcaagtggttcttctcagggatagaggactgtggattcgaacagttccctacctttggattgcaagcttggaagcaaacattctacttcgattttagtacgacttttgtgggagcaggaatgatttgctcccatcctgtgaactgttctttgctccttggagctgtgctctcttttggggtcatgtatccgctcattgatcggcttaaaggagactggttcccagataacttagaagaaactaacatgaagggcttatacggttataaggtttttgtttcaattgctctaatcctcggtgatggcatatacaatttcaccaagattctaatttctacagtcttcaatgttcatgaaagaatgaggagcaagaataataaaaatgtagcagctgctgttcggcacgagaatccttccgaggaccataaacaaactgatgaatttctgagggagaacattcccatgcggattggagtcattggatacgctgttttcacactcatttccataattataatcccacgcatgtttcctcagctgaaatggtactacgtggtggtagcttatatatttgctccatccctggcattctgcaatgcttttggagcaggtctcacagacataaacatggcatataattatgggaaagttgcactctttactctggcagctgttacaggaaaagaaaatggtgtggtggctggacttgtgggttgtggtctcattaaatccgtgatctcagtgtcttgcattctgatgcaagatttcaaaactgcacattacacacgtacctctcccagagcaatgttcatatgccaagtaattggcattgcaatgggttgtgtgacagctcctctcagcttcttcctatactacaaggcatttgatgtgggaaacccgcatggggaattcaaagctccatatgcgttaatttacagaaacatggcaatcataggggtccaaggtttctcagcattgcccctgcattgtttaaagctatgctttgggttctttgcttttgccataggcgtaaacatgataagagattttgcaccccaaaagattgggaaatggatgccattaccaatggtcatggccgtaccgtttctagttggggcatactttgcaatcgatatgttcataggtactgtggttgtgtttgcgtggcagaagcttgactccaagaaggcagagttgatggttccagcagctgcctctggactaatttgtggggaaggactatggactctaccagctgcgattctagctcttgcaagaattaaacctcctatctgcatgaaattcgttcctacctag

SEQ ID NO: 7495 - DNA, 4341 bp, Glycine max
  Peptide Sequence Number=SeqID_124273
atgaacgaatcttctgctagtaacatggagagttatctctacctccatccaagcgaaaacccagctatcgctcttgtttccccagtcctagactcaaccaattaccactcatggagcaggtctatggtcactgcattgagtgccaagaataaagtggagttcatagatggcagcgccccggaacctctaaaaacggacagaatgcacggagcatggcgtagatgtaacaatatggtcgtctcgtggatagttcattcggtggccatctccatacgtcagagcatactttggatggacaaagccgaggaaatttggcgcgatctgaaatcaagatactctcagggagatcttttacgcatatccgaccttcaacaagaagcttcgacgatgaagcaaggtacgctcacagtaactgagtatttcacacgattacgcgtcatttgggacgaaatcgagaactttagacccgatcccatttgctcatgtaatataagatgttcctgcaatgcattcaccattatcgcacagcggaaactcgaagatagggccatgcagtttctacgcggtctgaatgaacagtacggaaatatacgatcccacgttcttctcatggatcctatacctgctatctccaagattttctcctatgtggctcaacaggaaaggcaattactgggaaacgctggaccaggtattcatttcgaacccaaagaaatttctataaacgctgctaaaactgtctgcgacttctgtggacgtgttggtcacttagaaagcacatgttataagaaacatggaatgccctctaatcacgatactagaaacaagaatagtggaaggaaagcttgcactcattgtggcaagatggggcacactgtggacgtgtgttatcgaaaacacgggtacccaccgggttacacgccgggttacaagccctatggaggaagaaccactgtaaacaatctcgtagccgttgaaaacaaagctaacgaagatcaagctcagcaccacgaggctcatgattctgttcgtttctcccccgagcagtacaaggcactcctagccttaatccaggaaccatccgcaggaaacacgacaatctctcaatccaaacaaatggcttcaatctcatcatgtatcaatactccgacaaatccaggtatgtccctttctctcagaacaccatgcgtctcctggatattggattcaggagcaacggaccacgcgacttactccctacgcaaccttcattcctataaacaaatcgatcctatcacggtgaaactcccgaatggccagtgtgtttgtgcaacccactcaggaattgtcaagctttcatcaaacatcattttacaagacgttctttacattccttcctttacgttcaatatcatttcaatatcaaaacttgtgtcttccgttaattgtgaattgatattctcctctacatcgtgtgtattacaggaagtgaacagccatatgaggattggtatagttgaagcaaaacacggtctctaccatttaatacctgctcagctgaccaccaaaaccgtaaactccactattactcaccctcgatgtaatgtaatacctattgacctttggcattttaggttaggccacccatccactgaaagaatacaatgtatgaaagcttactatccccttctcaaaaataataaggattttgtttgcaacacatgtcatcatgcgaaacaaaagaaattacctttttctcttagccattcacatgcatctcacttttttgacttactgcatatggacatatggggtccgtgctctaaaccatccatgcatgggcacaaatacttcttaactatagttgatgattgctcacgctttacatgggttcatcttatgaaatccaaagctgaaacccgacaaataatcatgaacttcattacattcattgaaacacaatacgatggcaaggttaagatcatcagaagtgataatggcattgaattctccatgcatcattactatgcatcaaagggcatcatacaccagaccacgtgcattgaaactccagaacaaaacggaattgtagaacgcaaacaccagcaccttctcaatgtcacacgtgcacttttgtttcaggcaagtctaccaccaagcttctggtgttacgctttgccgcatgccacttacttgattaattgtattcccacgccgtttttgcataatgtttcaccctatgaaaagctgcataaacacccttgtgacatttctaaccttcgtgttttcgggtgtctatgttacataaatacactcaaggcaaaccggcaaaagcttgatgctagggctcatccatgcatattcatcggttttaaaatgcatacaaagggatatcttgtgtatgatttgcactctaatgatgttagcatctctcgaaatatcacattttatgaggatcattttccttatctttctgaaactcagcatacacacttagaatatccagctccctcaccggaatccttctccgacagaaacgatgacccacaaacagagagtctctcatcaccacctatgatctctataccatcatcaaatgaacctgaacataatcatcctccttcacaccttagacgatccaccagaaccaaaaacaccccaacgtacctccgagattaccacagagagttttcttcctctacaccaagcacttcaatggctgttcgttatccacttagttccgtactctcttactcacgcttgtctcctgcccacaggaactttgtcatgaatatttcctccgtcacagagccaacctcatatgtcgatgcttctcgccatgattgctggattaaggccatggaagccgagctacgagctcttcagtcgaaccaaacatggcgcctcacacctctcccttctcacaagacggctattgggtgcagatgggtctataaaataaagtatagagcagatggatccatcgaaaggcataaagcgcggctggttgcaaagggatacacccaaatggaagggttagactaccttgacactttctctccggtagcaaagctgaccacggtgcgccttcttcttgcaattgcagcattaaaccagtggcatttacggcagctagatgttaataatgcattcctccatggagaacttgacgaggaggtttatatgcaaatacctccgggactttccgttgataacccaaagcttgtatgtcgccttcaaaagtctctttatggtctcaaacaagccagcagacaatggttcgtaaaattgtcaagcttcttaacctctcatggctttcatcagtcaactgcggatcactctctctttttgcggtttactggaaacatcacaaccatccttcttgtttatgtagacgacatcattctcacaggaaatagcatgaccgaaatacaaacaattgtcaccctcttagattctgaatttaagatcaaggatcttggggatttaaagtttttccttgggcttgaaatcgcccgaagctcgaaagggatacacttatgccaacgcaagtatacattagacattctaaatgcatccggaatgctgggatgcaagcccaactcaacaccaatagactactctacgaagttacaggcagattcgggcagtcctctctcagctgagtcttcttcctcttatcggcgattgatcggtaaattaatataccttaccaacaccaggcccgatataacgtatgctgttcaacaactcagccagtacatggccgcccccaccaatgctcatcttcaagccgcctttcggattcttcgatacctcaagagttctccgggatcaggtatcttcttcactgccgcaggtaccgcacaactccgagcctttagtgactcggattgggctggatgcaaagattcaaggaaatccactaccggctacctagtttactttggttcctctctggtttcttggcaatccaagaagcagccaactgtgtcacgcagttcttccgaagctgaataccgcgctcttgcctccactacttgcgaactacagtggctgaccttcttgcttcaagactttcgtatctcattcgttcaaccagcgaacttatactgtgataatcagtcagccatccaaatagctactaatcccgtctttcacgaacgaactaaacatatcgagatagactgtcatattgttcgtcaaaagcttaactcaggtctcctaaagcttcttccggtttcgtcagctttacaactagcggatatattcaccaaagctcttgcacctgctgtttttcggcatctctgtaacaagctgggaatgatgaatatccattcccagcttgaggggggctcttag

SEQ ID NO: 7496 - DNA, 393 bp, Glycine max
  Peptide Sequence Number=SeqID_124274
atgcatgatatgaatgcattttacggacacgagagcccggaaaattatctctcccccccccccccccgattggttgctgctgaaagagtttatgaagggtccacgactgtacccaacatttctttgggcaatgatcaagtgaaggataaacaagtagttaagggaccgacgaaacttgtacatatgccgaatcctgatgaagatcccctctacctgatgacattgaccatcccgcaacttttcatcaagccgttgcaggtgtcatgggatgctagtgtgtttgaggtgtataatgataacttcccattatacgtaaagcatgaagatcttgctgaaatagctcacggtggtcaatgtataagcatctctgttatacagttttggattctgtaa

SEQ ID NO: 7497 - DNA, 303 bp, Glycine max
  Peptide Sequence Number=SeqID_124275
atggaagccaatgtggttgtagttgccgctaccagcgctgttgctaaggtgagcccgacgtccccatccggcatcaaccaaatgaatcatccaacctcagatatggtaggcaaagatttgggaagtaccggcggcccccatgatgtgcaaattcaaaacgagcacgccttcccgccatatggcttgcctctcaactatacgccacccaatgtggcgtacactcccaataagaatgtcaataactccactcctatacccattaggagccaacaaccccaaactgatcatgcacatgtctcttaa

SEQ ID NO: 7498 - DNA, 306 bp, Glycine max
  Peptide Sequence Number=SeqID_124276
atggcatttggtggaccagcagctcgcccaggcgagctgagacttagccatgaagtagctagctcgcccaggcgagttggttacttaacatggaagtcttttggtggcccaagcgagcaagaggctagcatgggcgagctagggtgtcataccctaatttcgtccggggaccatccgttgttgggatgcgaccctcgttcgaccacttcgaggtacttggcactcgtcgttaggcgattcgtgaagttccgtgacatgccgaaagtcaagagaaagcattgtcgcacaatccgtgaaatttcgtga

SEQ ID NO: 7499 - DNA, 165 bp, Glycine max
  Peptide Sequence Number=SeqID_124277
atgaagaatgaatggttgtggcttgaaactgaagtattctctgctagttctgcatatagagtaagacttgaggatattggccagacagaagatttaatagtatttcaagatctttggaaggaacatagttttggtggaggaacacatattatacccattttgtaa

SEQ ID NO: 7500 - DNA, 567 bp, Glycine max
  Peptide Sequence Number=SeqID_124278
atggatataaaggaaagaaatatgatcatgatgaaagaagccattcgtgtaagatttaatgacacaaagcctgatacagaaatgtcaaggcttgatgaatcttgcagacataagactagacgaaggcattggaccactgatagaacaatctacaggaacaaacatgtccaattagatccctcaaccaaagtccagacaagaggatctctcgaacaacaaggttacacaactctcatttcaaaagtggaacccaaacatattataagccatgcaagaggaacttcaacaactcctaaaaatgacgtttggaagcttgtagtactaccacaaggaaagaaaacaatcagtgctaaatgggtgtttagaaacaagctagatgaggcaggactacagataaaacaaaccaacattgacatctatatgcatcaaaccaagtatgtcaagggacttctcaagaagctcaagatggaagacgcaaaagaaatgaagactcttatgcatccaacaacatgtcttggattggacaaggaatccaacaaagtggacactcacaatacaaagcaatga

SEQ ID NO: 7501 - DNA, 777 bp, Glycine max
  Peptide Sequence Number=SeqID_124279
atggaagaaggatactctacaaacaagctaccactattcaaaggcataaaatatgactactggaaggaacatatgatagctcatttcaagtccattcatatagacctctgggacgtcgtagaacatggaaactacgtaccactagacgatcagctgaatgaagtttccagaacctcttggatagatgctcaaagacaaagatttatgttgaactctaaagctcgaaacactctgttgtgcaccctctctaaggaagaatatacaaaggtccacaactataaaagtgcaaaccaaatgtgggagacattagctttgatggatgaaggatcatcacaggtaacaaccttgagaactatgaagaacttgaactccgtgtccattgaagatctaattggaaccttaaaggttcatgagcaggaacttcaacaagatgaaggattcaaaagggggagatcgttggctctacctgcacaaaaaacatcctctacttgcaaggaatcttcatccagatctacatccaaaagcacatccaaagctgtcaactttgatacaccttatgatgatgagtccaatgatgaaggctcagacgaagatgatcagttatcctttatctcaaggaagataaggatcatatggaagaaaatgaggaatcaaattggaaaggatccaagaaaccacatagagaaagaaaagataaggagaaaagcttcatcatattctatgagtgcaagaaaccaaggcatttcaagtcaaaatgttcatatcttgataaattag

SEQ ID NO: 7502 - DNA, 279 bp, Glycine max
  Peptide Sequence Number=SeqID_124280
atgatttgtcggcagcctaacctcattacaagcctagaaagtccttcggattcagtttgtgtgtttatttctgtatggcatgagatgaaatgcaaaggagtagttgcgctcagcagaccatttgggctcagcgcgcttagcgtggcaaaggaatctggcagagttcaagagtcaaggcctcacgttaagtgtgtgatcaactcgctaagcgcgagggttgtccttagccaggctcaatacatgactggcgctaagctcaaaaccacttactcgcgctaa

SEQ ID NO: 7503 - DNA, 183 bp, Glycine max
  Peptide Sequence Number=SeqID_124281
atgggttcggtggcacgcgaaagggagtggggttggtcgagaagggtggtcacggtcgtgcggatggacgatgatccaagatcttttcctcctggagttgcgcgagccccgcggcttggactaaggtcaaaggctgaagcgcttgaacctcccggaaaaatcaaagctaacttcgcaagctag

SEQ ID NO: 7504 - DNA, 444 bp, Glycine max
  Peptide Sequence Number=SeqID_124282
attcaaaggactaaccgcctaagaatcctttgtcctaacacattcgagggtacatcctttgtggtacaagtagagggtacatctacttgggttgttatactgagaacaagagagggtacatctcttgtggatcaattcaagtggagggtacatccacttggttgttcaaagagaacaagggaggctacatccctagtggatctttggcttgtaaaggattttacaaggttgaaagaaatctcaagaaccgttggttgcttggggactggatgtaggcatgggttgttgccgaaccagttaattaggcaagctttgaaaaatgttgtttttcactttctcgctaagccaatccactggcttagcgagcgtccgctaagcgcaaggaagaatcgggaagaagatgagttgtacatgtgctctaagtgcaccgcttcatcttactaa

SEQ ID NO: 7505 - DNA, 219 bp, Glycine max
  Peptide Sequence Number=SeqID_124283
atggggacaccgctgtttgggaccgtgtcgggaaggaagtgtagtgcttatcctgctgtgaagcttaatgtggttctgtcaggagcagcatggcttgagcctgaatccataagccgttgcttcaccgatggaaatctagttactggagctgcatggccagggcaccctgagttcattgctcaattgatggcactacttggtattcaagtatctttctag

SEQ ID NO: 7506 - DNA, 513 bp, Glycine max
  Peptide Sequence Number=SeqID_124284
atggcctctggtaatcgaataccaatgtcgattacacagggtgatagggcactggtaatcgattaccatttagtgatcgcaatggcagcgcagtttattcatgatcgtgttgtgatggagtgcctagagggtgtttgggagaccctcgaaggcaatgagaggtgccgattccgtggcacaattcgactcactgctacttcattagttcatccggaggaacccgcacgcacacttcagcagcttgtggaatcgatattacctacacctactccatatcgactagtggagctagttcaagtgatagaggtgtcatcctctgaagaggatcttgaagaggacccagaggagttatctcctgaacctgctatggacgcccttgacttacctgaggatgatgaagacccactcattgatgttgattctccagaggatattatgtcagcatttgaggtagactctacagaggagagtggccctggaggaacagcgaatagtgacgactcttcattgtag

SEQ ID NO: 7507 - DNA, 276 bp, Glycine max
  Peptide Sequence Number=SeqID_124285
atgggtgccaagtacctcgaagtggtcaaacgaaagttgcattccaccaaacaatggtccccagacgaaattaggttactgtcttcacgaaggcatcctggtgccttggcgatagagtcgcttcatagcacgactttgactcccagaaccttggatgctatcattttcttgtggacaaactcaacattcctccagaaagttttgatgagttcagggttgggatatctcagcagcaagggagttagaggtggccattatatagagtttgagagttag

SEQ ID NO: 7508 - DNA, 420 bp, Glycine max
  Peptide Sequence Number=SeqID_124286
atgaaaaacctcgtcggacacttaggagtacatgacaagacatgcctcacaatggattgcttacatatgtatgtgtcataccctactttcgtccgggggcaattgtttgtcaacatgcggaccttagctgaccaatttgagatgcttacccctcaccccggtgtaatccaaaaagggggcgtacctagtcctggcccatctggaatattctggagggaggttgcttcaggtggaagctacctagctcgcctgggcaagctgggtggcaaccacctccctcatttttgctataaaatggcatttggggcagaggggaaggggttcagcaccctgggtattcagaattcacttaaaattagtgagaagaagaagaaagaaggagaaaatcaaagtcgaggcgcttctgggacgtttccgtga

SEQ ID NO: 7509 - DNA, 832 bp, Glycine max
  Peptide Sequence Number=SeqID_124287
atggcgggttcaaacacacatctcatagctgccaacacatcaaagaacaacaccgttcatgctaacaaaaatgtaaagatgttagcgctagagtatgttccacttccgacaagaagtgtgcatgaccctggacttccatacgaacaagaagcttctggaggaagtggcgataatcccatcaaagaggctaaggaacaagatcgtgggcgcgagtgccgcatggacttcgtccccgacgtcttcgccatcaacaccgaccacatcgaggtcgacaaggaaaccctcgacatgctccactccctcggtatcaatgacatccccggtatcacccaggttgaccctgtccctgttcagcagagcttccccttcaccaggagcgccactaccaacaaacttgcaaacatacagaagcaagcagaggaatatgcgactttggtcatggaagaactagaccctgaagacacaagatttatcatggtaaactatctagagatgctcttgttgcatggaccaagccattctactagaggagatagcaagtacctgagtcaaatgctaagcttaaagcttaagcctatagatgaagacaatcctattaagaggtggtacaaaaacaccaagagaaaagctgcatatgaggtgatgggccattgtgtatgcatggccaaaggtgcagccaaaacacttaaattaaagtgtatagctgtggcagtaacaattgaagttggtatacatggcatctaccatcttgcttgtgactttcctcgccttcttgatgcaagtagtgaaaagtacaagctcatggaaccttttttcggagatcaaccatcaa

SEQ ID NO: 7510 - DNA, 480 bp, Glycine max
  Peptide Sequence Number=SeqID_124288
atggaaaaaacgccttttggaccgatttttctccgtgagaccgtgacgcatcgcggttttgttttgggaacccgcgaaaccgaatcagatagtgcggcacggaaactaggaattagagcaatggcagaagatctggtgctggatacagcaatcagagactgggggctgatccctctctctgtggttatggaaaagtctgaccagggcaccaaccaggcaaactattgggctttccaatcatgggcaacagctattgctcaacattttcttttgaatccttcctctaaaggtgagaagttgaaggctgaattggaggatgcatggacctttcttcacgaagctttgaatggaaatattactttgacaggtgataactcaaaactgaagggtaagctggcaaccctgggtgataaggtgaaagaccttcaggctaaggtgagtgatgttgaggtgggtgataaggtgaaacaccttggataa

SEQ ID NO: 7511 - DNA, 462 bp, Glycine max
  Peptide Sequence Number=SeqID_124289
atggatgctgggacctctaccagggagatatattttgcatttctgaattgcaagaggagatctacttgtttaagcagggagatctctcagttacaaaaattaaataatttgcgtcccataccatcttgcacttgtgaggttccatgtgtttgtgaattggttccaaagattagacggtatagagaaaatcatcaagtgatcaggttattgaagggactcaatgaacaatattcagctcaagaaacacaattatgtggtccaattgatggatctttaatggaggtagagaaaggtccaaaggtagaggaggcagaaatcatagtcagttcaatggaggtagaggcaattacatgtgaagaggccaaagtacaaaagtttgctcatactgttaaaacatgctacaagaagcatggatatccttcctcaattcaaaaaggggagtgcagtgaacaattttgttaa

SEQ ID NO: 7512 - DNA, 225 bp, Glycine max
  Peptide Sequence Number=SeqID_124290
atgatagctccacttcaacagatttctcgatgtcatggtgcaatccttgaaggttcacagagccatgcaattcacgccatgttcgaagagctcactgacgttgacttcgtcaagatcgatgtcaacgaattgccgaaagggaaggaagttgacaaggttgtgggcgcaaagaaggatgaacttgagagaagagtgagaaacatgattgcaatcttagttttataa

SEQ ID NO: 7513 - DNA, 234 bp, Glycine max
  Peptide Sequence Number=SeqID_124291
atggatagagctactggactccgagcagaaaatgcattagatgcagatgatatcatgagcaaagaaacaaatgaagaggaagcaattcatagtgtgagttttgacttagagggatcaagttccgccacaagaaaagcattcgcccaaaaaagatgtgaaggaattcttgtgctaaagcaaatgcaattagaaaatttggaattattttggaagttagacttattttgtgactag

SEQ ID NO: 7514 - DNA, 153 bp, Glycine max
  Peptide Sequence Number=SeqID_124292
atgtctctcgtaaacctcacaggatacaacaagaatgtcttagcagagctaaggaaagacatatatatgactggtatatatgtgatccttggcttaagcaataatagcatggagctttcgcatgcacttgcatttataatctctaatgtttga

SEQ ID NO: 7515 - DNA, 447 bp, Glycine max
  Peptide Sequence Number=SeqID_124293
atggcgttgaatcctcaactgtttccaaatggaatgcccgttcctttcgtgaacgagatgtttgtgttggccagagacggcgtcgaattcgaggtcgataagattcctgcctctggcaatcatgggggtaatctcaaaacaaagggaatcgtgtatttgtcgaatattcggatggtcttcgttgctaaaagtccagttggacacttcactgcttttgatatgcctttgctttacatccatggtgaaaagtttaaccagccaatatttcactgcaacaatctctctggacatgttgaacctgcatctcagactccagttgatgagatgatgagacatgcgtatgttgatcctaatgatccaacaaaaatatttctgcaacaacccaattctgattctcagcttaggcgtcgaacatatcagccacaggcagatggaggccatgtctga

SEQ ID NO: 7516 - DNA, 1761 bp, Glycine max
  Peptide Sequence Number=SeqID_124294
atggaatccactttcaaagatgctgtgtccaagtttggaggaagaattgattggaaatctcgtcgaacccagagtctggtggaggagagaaacaagcttgcagaagactttagaaaggaagaaattgctgaggaattggaaaacactaagaagctgatagaagaactcaaaaatagcttagaaaaggtagaaaaagatgagcttgaggcaaaaaaagaggttgaacatgtgattctcaaaattgaagagatggagcaagacattgctagtgaagccagtattgaagccaaggcaaaacttgaggctaaaaaatccatgcttactgaagcgcttttggagtttgaattcgttgaaagagaactggactcagtgcgtaaggagtatgcttctatggcgagtggaagggatatagcaatcaacaatgcagaagagactattgcaacatccaagcagattgaaaaggcagttgaagacttgactactgagttgattgcaacaaaagaggagttgaactccacgcgaaccgcgcatttggaagcagaagaacaaagattaggagttgttgatcaagattctcacaatttaaagttggaacttgaaggagtagaaaaggagctccaaagagtaaatgagcaagttttgtcagccagggttctaaaatctaaattggaatcagcttcctccttactgcatgatttaaaagctgaattagcaacatatatggaatcaaaagtaaatgaggaatgctataaagaacaaaaagagaaacttaaggaactaaagctaaacatagagaaaacaacttctgatgttaacagcttgagggcggcttctgtgtcgctaaaatcgaaactagaaaaagagaagtcgattctcacttcccttaagaaaaatgaggaaaaggctttggccgtggttgcgaatctccaagatgaactagagaagtctaggttagccacaactttcattcagatgaaagagaatgaagcaagaaagatgatgactgagttgccaaagaaagttcagaaagcagcacaagaggctgatgaggccaaatcacttgctaaggcagctcaggaagagatgattgaagcccaagaagagcttgaacaagccaaagcccaatcaagcacattggaaagtagtttattggcaaaacataaggagatagaagcagccaaggttgttgagatgttggccagagatgcaatcataacattggagaagagtaaatcagctgaaggcaacaaaaatgacaaggactcttcctcaatggtgacactcacactagaagaatatcatgagcttagcaggagagcctataaggcagaggagcaagcgaacatgaggatcgaagctgctaattctcagattcagatagcaagggagtctgaactaagaagcttggagaagttaaaagaactgaatgaggagttgtctgtaagaagagaatctctcagcattgcaaccgagaatttcaaaaaggccaatgaaggaaagttagctgtagaacatgaattaagaacttggagggctgaacaagagaaacaaaagaagcctggtgaattgaatgatgaacaaacttctactccaactaagcctgcacatgattcatcaagccctaagggaaaagttccttcaaataacattgaagttggatcagcctcagataagaacaaaaagaagaagaagaagaagtcattatttccttccaaagttgtaatgttctttgccaagaaaaaaacgcatccaaccaagtga

SEQ ID NO: 7517 - DNA, 143 bp, Glycine max
  Peptide Sequence Number=SeqID_124295
atggaggattgggggaactttctccaccgaatccttgaggaggattctgctctgattaagatgttcctcttggtgtgggggttcgacgacaagcaacggcagctcgtggcagccaccggtggtcgtgggtggtggagaaggag

SEQ ID NO: 7518 - DNA, 195 bp, Glycine max
  Peptide Sequence Number=SeqID_124296
atggttattaagtttcagtggtggtggtccaaggaaactgttgctgtggttacaggtggaaacagaggaattgggtttgagatatgtaggcaacttgctggtcatggagtgattgttgtactgacttcaagagatgaaagtgttggtgttgaatcagctaaggtcttgcaagaaggtggcttgtcatcaacttga

SEQ ID NO: 7519 - DNA, 2866 bp, Glycine max
  Peptide Sequence Number=SeqID_124297
atggagaggagttgtattgccaaagacaatgaggaaggtcttgatttggtagagactgtgttcaattggtctctcaaggatgttctcaacgacaacctctgcaaacacaaggtactgaagatcccacagacattcctgtcaacaacagattacttgaactccttcattccttcactgattgaggaaactcggagcgatctatgttcgaacttgaaaggtgtgtcgcgggcttccttttgcgaaatctcaagcattgaactcgagaggtcaagaagcttcatacctaccaagagcttgttctaccaaatatctgtgaacagaagcagcaatgatgtgaatggaaaatatgagcctgaggttggagacctcattgccttcactgatattaaaccgaaaaccgtagatgacttaatcaacaggcctaaaagaaactaccatatcggttatgttcatggaataaaagaaagtattgacaagatctcaatattatcatccaaaagctttgacatggacattcagtttgccttgaggagcaagagtgatgcaccaaagctttatgccttccatcttttgaaccttaccacaaatgttcgaatttggaaagccttgaagtcacagcttgagggtgcaagcttgagcatgatgaagaaagtgctgcaagctgatataaataatggagaaaattgccaactttgcttttctggggaaaaccatagtgtagcttgttctagtgtacaaaacataatccggtctcaaaatctgaatcaatcccagaaagaagcagttgtaagctgtgttacttcgagggaatgtcatcataatgacactattaaacttatttggggcccaccaggaactggcaaaacaaagacagtggcttccttgttattttccctgctcaagttaaaagccagaacattagcatgtgctccaactaatactgcagttttggaagtggctgctcgcctgcagaatttagttatggagacacttgagtgtgatacatttggctttggtgacatagttgtatttggcaataaatctcgaatgaaagtagacagttaccggtgcctcaacgatgtctttcttgattatcgcgtagataatctcttgaagtgttctggatggaaacattccctggaatcaatgatcaagttaatcgagtaccccaagcagcaatatgattcgtataagcgtgaggaagaaaatagtcttaagtcattggaagaatttgctaagcaaaagtactttaatgaaaagcatgatgatcatctgacattagagcaatttttgaagaaggaatccacttgcattgaagagcaataccttttgtataaggatcataaaaggaaaaatatcaagacaatggagcaatattttatgcagagattgcgttccaatagagagcaactcgaggaatacatgcgaaccttgcatacacacctaccaacttctttaattccacttgaggagataaagaaaatgcctgtagctcttgatttgctaagttctcttgaaaactctttgagtaaagataagttcaagcaaacttctgatggctgtgaggatggagaaagcattcttgactgccttggaaggttaagcattaaaaatgaagagtgccttgtcaaactgagatcactttctcagacaatttcacttccaaacattactgacaaatatgaaatggcaaaattttgcttgatgagtgcacgcctgattttctgtactgctgcgagttctactaaattgttcgcagatggaatgacacccgtagaattcctagttattgatgaagcagctcagctgaaagaatgtgaatcaaccattccgttgcagctaccaggccttcaccatgtaatcctcattggtgatgaaaaacaacttcctgcggtagtcaaaagccaggtttctcaagaagctgaatatggaagaagtttgtttgagaggctggtatcgttgggacacaagaagcatctgcttaatgttcagtatagaatgcacccatccatcagcttattcccaaataaggagttctatgagaagcaactttctgattccccttttgtcagagaagtgagctacaacaggcatttccttgaaggaaaaatgtatgattcgtactcgtttataaacatagccaagggtaaagagaagatgcctcgtggtggacatggttggaagaacatggttgaggctgctgctgtttgcaagattattgaaagccttgaaaatgggaagaaagttagcataggaatcatatctccatataatgctcaagtgtatgaaatccaggaaagaatcacacggcaaaatttggtttctgatcctaacttctctgtcagtgttcgttctgttgatggctttcaaggtggtgaagaagatataataataatctccactgtgagatctaataagaatggaaaaataggtttccttgacaataggcaaagagctaatgtggcactgactcgcgctagatattgcctgtggatattagggaatgaaaacactttaagcagtgactactctctatggagaaatctagtcaatgatgctaaggaaagagggtgtttccataatgctgatgatgacaagaaactggcaaaggccattgaggaagaatccttgcttattgaactacttgatgaatatgagtccccatttaagaaactcagtctagggagcacttcacgaacaagaacaactgctaccaccttcagaactaatcatttaacctacataccagagggtctttcaggggcaggccaaggacaccaaggtggtgatgatgtgccctcttatctcgagtatctgcactgtcgaagagtgaatgagaaagggcgtcagggtgtgccagttccaa

SEQ ID NO: 7520 - DNA, 243 bp, Glycine max
  Peptide Sequence Number=SeqID_124298
atggggggtgcaaatagcaattttgacattttgaaattgggtcttcgagagtattttcgaagctggattgcttctggaggaagcaacccagctcgcctgggcgagctgggcggcaacctcctccccctttttcctataaataggctgaagggggctgttctaagggtctcggatccccctggtggtgtatttcagctgttttgggtgaaaaaaatcgtttacgtgaagaaaatcgaagccgag

SEQ ID NO: 7521 - DNA, 1218 bp, Glycine max
  Peptide Sequence Number=SeqID_124299
atgccaggcggcctcgctgcggccttcggccttcagttgggcgacaacggtcttgacctcctgcatgcggtctgccttgccgaccagcaccgcgtcgtcggtctcgacgacgatcacgtcatccaggccgaccagtgccaccaggcgctgtgcataggcataggtgttgcggcagtcgatggcgatcacatcgccctggtgggcgttgccgtcgccgtcctgctgcgagacatcgcgcagcgccgtccacgagccgacatcgttccagccggcgtccagcggaatcaccacggcgtctgcggttttttccatcaccgcgtagtcgatggagtcggaaggaaccgcagcgaaggcgtccttgtccagacgggtgaaatccgaatcgcgacgggcctgctgccaggcctggcggctgccggccagcatgtcgggctggaagtgctccagttcctgcaggtagcgcgaggccttgaacaggaacatgccgctgttccagtaatactggccgctgctgacgtagccggtgccggtgtccaggtcgggcttttcgacaaagcgctcgaccgcgcgcaacccctggccatcggcggccttgatatagccgtagccggtttccgggccggtcggcacgatgccgaaggtcaccagctttccagcttcggcagcagcggcagcggcctcgacggcgctgcggaatgcagtctcgtgggtgatcacatgatcggagggcagcaccagcagcagggcgtcggcgccgtcgcgggtggcttccagcgcggccaccgcgatcgccggggcggtgttgcgaccaaccggctcaaggatgatcgcggctggctcggcgccgacctgctgcagctgctcggcggcgacgaaacggtgctcttcgttggcgatcaccagcggtccacgtgcggcaatcggggcgacgcgcttccaggtggcctgcagcatcgtcagttcacccgccaagggcaggaactgcttcggatacgcctcgcgcgaaagcggccacaggcgggtaccggatccaccggacaggatgacgggctggatgctgctcatgcgttcctcggttactgctggatgaggcgggagatgtcgtcggtgcgcgcctgcatcagcgcggcatcgccacgggcttcaacattcaggcgcagcagcggctcggtgttggagctgcgcaggttaagcgccagtcgccgaagtcggcactga

SEQ ID NO: 7522 - DNA, 1430 bp, Glycine max
  Peptide Sequence Number=SeqID_124300
tgcagctcggtcttgacgccgttgtagcggccaacccagtcgcggtcgtattcggtcttgaagccgaacggcacggtcagcgaagcaccgaagtgcatgttgtcgttctcgccgaacggcacgtggaagtacgcggccggtaccggggcgatcatgccggcgtcgccgccgttgccaccggaatcggcgcgccgttgccgtactggccctggccgcggaacttggcgccgaagctgatggcgctgacgtcgccctggaccagggtgccgtcgagcaggcgcatggaggccgggttggtggcgatgaccgaggcgtcaccttcggtcgaggtggagccggcgaacgcgcggcccaggcccttggcactgttttccttcagctggaaggcggcagcattggcatcggcggcggccagcgcaccggcaacgccgacggccagcagggtcagtcgggcaatggtggaagcggtttgcatcgtagttctctctccggtaagcggtgatggtgctctgagtgcgcctgcgcccgccgggtcctgggacccatcggagcgcgccggattcccctcccgacatacgacgccgtatgcgacgcaggcggttttttcgtctcaaaagctgaacaggaccgtcgccaccgaaagtggccgcacgctaggctattggcatgttcgtctcgctcccgtcccgcaagaaggcggccctgcgctgggccacgcccgtgctgtttgcggcactatggctggcgttcctgtgcctctggctggactggggcgccctgtccaccggcctgacccacccgctggactggtgggcgaccctgcaggacggcagcgtgctgcgcctgttcaccgccctgttcctgcacgcggactggtcacacctgctgggcaatctggtgttcctgctgatcttcagcctgcccgccgaacgggtgctgggcccgtggcgcctgctgctgctgttcctggtcggcggtgcggtgtccaatctggtggccatctacaccatgggcagcccggaccagatcatcatcggtgccagcggtgcggtgtcagcgctcatcggcgcctatctggccctgttcccgggcgcccggctgggcgtggtgatcccgctgggcctgttcctggagttcgtgcgcgccccggcctacctgctgatcggcgtctgggcggcgctgcaggtggtgttcgcccatatcggccccagcttcggcatggtggcctggtgggcgcacatcggtggcttcctgttcggcctgctgtacggcgtgtacgtgcgcgccgcgatcgcacgccgcctgcgcaagcggcacggcttctgaacccctggtggtgccggccgctggccggcgtcacgctcacccgctcgttcgtagatcactcgagcacggctcgacgctacagaatcagggcttggccggagccg

SEQ ID NO: 7523 - DNA, 864 bp, Glycine max
  Peptide Sequence Number=SeqID_124301
atgagcctttcccgtgaaggtacacctgtttcccgagcgttcgacgacgtctatttctccaacgacaacggactggaggagacgcgctatgtgttcctcgacggtaaccatcttccgcagcgatttgccgcacatccgcgcgatctgttcatcgttgccgagagcggcgttcgatcgcttccgcgccgcccatccgcaagccagcttgcgccgcctgcacttcatcagctgcgaaaaatacccgctgacccacgccgatctggtgagcgcgcacgcgcgctggccggaactggccccgtgggccggacagctacagcagcagtggccgctggccctgcccggctgtcagcgcctgctgttcaatggcggcgagatggcttcgcgccggcgaaaaacccggagatgtggacgccttcgctgttcgccgccatggcgcggctggcgcgtcccggcggcaccttcgccacctttacctcggcgggctttgtgcggcggggcttacagcaggccgggttcagcgtggcgaagcgcaaaggcttcggccacaagcgtgaaatgctgaccggcgtactggacagcgcacccgggcagcggccggctcagccgtggtatgcgcgtccgcaggccaccagccgcgaggtggcgctgattggcggcggcgtggccagcgcggtgctggcgctggcgctgctgcggcgtggctggcaggttacgctgtactgcgccgatgccgccccggcgctcggcgcatcgggtaaccgtcagggcgcgctctatccgctgctcaaccagcacgatccggcgctcgccacgtttttcccggcggcattcagctttgcccgccgcctgtacgatgcgctgccg

SEQ ID NO: 7524 - DNA, 429 bp, Glycine max
  Peptide Sequence Number=SeqID_124302
atgtgccagggtcctaagtggggtcgcgtgcagtggtgttttgagttggctacgcatgtggatgacatggcggtcttcggcgatgatgacagggagtttggcatcggaaacaaacgccgaaaatatggctggacgcgccaccacatgtcagaacagtgggggcgctcaaatgccgtttggcacgcaaaggaggggcacatgagagagcgtcaaagctctgatgagtggaatggcgataaaagattgaggcttaattgcggatcccctatcttgccttacttacggcctctttcggagttacttgaattgcaacctcgagggtggcggtttagtcccacatcgactagtgatatggccaaattaaagaatataagtgggggcaagcctcactttactagtcggttttgtagagatgagttaggcctgtaa

SEQ ID NO: 7525 - DNA, 378 bp, Glycine max
  Peptide Sequence Number=SeqID_124303
atgcgccagagcactaccgtcgccgtcgacgtgcgtcgtgcggcagtcgcgtgcggcagtcgtgtgcatcgtgtgtcggtcatcggtcgtcggtctctcgcgtgcgtcgtctgctggtctgctgccgtcgcacttgagaacgttgtctgcagttgtcgtactgctgctggtcacgccgctgaagaggagaaactcggtcgccataagaaacccgcaacgccaccgctatttggtggtgtttttccgaaattccgcgacgccattccgccatggtgccgtcatgggctcatacttgaattgtgggatattcggatgcaaattgaactggctcttccactgataggagatccacctctggatattttgcatatttcctag

SEQ ID NO: 7526 - DNA, 771 bp, Glycine max
  Peptide Sequence Number=SeqID_124304
atgtatgtatgtatgcatttggtggctagattaaccaaggaaatagttgaaacataccaaatatgcaatccacagtttaaatattctgaagatctaaatccaaaaagatttttgaccagcccatctgttggagtgcttaatgatggctatgataatgtaaactcggatcttattttgacagtgaattttgtgttgatccatttagagaaaaataaaagatatattgtcaaagatctccttggccacgggacatttggacaagtggctaaatgctgggattcagataccaacagttttgttgccgtgaagatcattaaaaatcaacctgcatactatcaacaggcgctggttgaagtaactattttaacaacgttaaataagaagtatgatcccgaggataagcatcacattgttcgtatatatgattattttgtatatcaacgacatttgtgcatttgctttgaattgctggacacaaacttgtatgagcttatcaagatgaatcattttaggggattatcacttggtattgttcagctattctctaagcagattttatacggactggctctactaaaagaggctggcatcattcattgtgatctgaagccagaaaacattcttttatgtacgagcactgtgaagccagcagaaataaaaatcattgactttggatcagcatgcatggaaaaccgcaccgtttactcttatattcagagtcgatactatagatcacctgaggttcttcttggatgtcagtatcctaattga

SEQ ID NO: 7527 - DNA, 477 bp, Glycine max
  Peptide Sequence Number=SeqID_124305
atgggctcggatggatgtgacatttcaagggtaggaatgactggtaggggtgaccaccgggctgaaagtgctgccagaacgacggctggacacaccggaaagtgtctagtgcagaagctgtttggcatggcaaaaatcagtgtgtgggagtctgaatgggaggtcgaggctgtaactttggggatagatacattggaagattccgatcctgatgatggtggtttcaccggaaaactcatcggagacatagaagcagggatctgcagtgcgatttgcttgctccgacggtcatttttcacaattctggcttcaaaaatcgccgatatagctgtgatagcgaagtgtgacgcgatggcatttggactgcaaggcgtcatgacccgttgtgtaagaatcgcacaatttgcatgcaagatgcaattcaccaactcgtttgcgattcacacgactcgtgtgattcaggcacaaaaactataa

SEQ ID NO: 7528 - DNA, 4353 bp, Glycine max
  Peptide Sequence Number=SeqID_124306
atggttttgaattgtagaggtgaagttatctacaatgatggtattgaagagatgagagagagtgggagagagagtgggtgggagacacacagagagagagaaaaccaatggaccactgtgaggaacagaaaaagaggaaaatggagagtgaacacaaccgagagagcggatcccagacatagctacgaaggaaaaaggtttggacaacactccaactaccaatatgcaaattggagggatagaacagacatcacctcattctacttcactaggtttcctgaggacgcaacaaagaaggagctttggacccagttcaaaaaatggggggatgtaagggagattttcatatctaaacagaggaataaaggaggcaggaggtatgggtttgtgagattcaagggagtagctgatgagaacagattggaaaggcaactcgacaatatcatagttgggggcttaaagttgaacgtgaacattccaagatatgggagaggaaaggcgagtcaagggaaacctatagttaaccaaagcaggcaagggggaggagcaaagcaaacaagaacaaaggaacgacaacaattcaaaacacagaaacacataccacggtacctaaaaggacatacacggaggcagttgctatacgcacagacaaggttggacaaagaaggaaaacaatcatcccccaatttgaagaaacaagagacttttgaaagagttgaagaagaaatcccatggaacttagggtcagatgttatacctaagtatttaggagacaatatggtcctcctccttggccttacagacacaaaaactgaggacatgattacaaaagaaactaagcatggtgcgtccctgtttcactccgtagaaaaatggaacccacagatgaggcccgaaaataggatgcaatgggtgacttggtggacgttgatgatgatgtggaagaacgacgaaggttggacagggcaaggatccttatcagaaccccttggagatcgtcaatccaccattcgctcctctgggtcatcggaagagattgtgtccgacgatagcgacttcgacacaccattgacgaggtccaacggttcatcgccgaggcttctcgccgccaaatccatggctggaagcgatgtccgccaggtcgagaaagtacccaacggtctcccagggaacaaacacccaacgggtaatgaaggaagcagcacgacacattgtccaatacctgagcggcgcgtgatagaaagcgacaagggaaaactcatcgcactcgaagctggcccaatgtcgaaagaaattgccattagcggtgaaggtgcaggctggaacgtgaaaagcactgccaactccggggaaaaaaaggaaagtgagatgaataagttggcgaggtgcacagaaagcagctctgaaaaagcaaaaaaggtcatggagtatggtcaaaaggaggcaaatactcaaaatcacaatgggtcacaggaacctttattcaaaaattcacgtgacctacacatggaacctactgggcctaattctaaatggggccttaccatccacacatacagagcagtctcacattgtgaatgtgaaaaacatcaagagcagataacagagatatggagcgctttgaaggtgtattcaagggctagggggtgcagaaagaaagcagcccaaccaagcaggagagaaaatttacctgtaaaaacaaaatttatgcactctcaaaaacaaccccgacaagaactgcaaacagcaaacagaggtaacgaaggttacacagcttcctcggatttagactccgattcagactcaatggatctcaactcacagccagaacaaaggaagacattacaaagtaggaaccaatgtagcaacaactttcttgaagaagcaacaacgcaatgggaaatggaaaaagatttggggatgacatgggggtcaaaacaaccagaaatcattgaaaaaattgcttcaatggagataagagacaggaaggagagggttagggagaggggtgcagtggacaactatcagaagattggggacagtgaaatgagttgggaatctcaacctgcgattaacacaatcggtggactgctatgcgtatggaacgaacaaatttttaaagtggaaaggagggtctctgtagaagaagtaccatgcgtagggagaaggtttacttggttcagaccaaacgaggctgcaaaaagaaaactagacatatttttcgtctccgatgaatggataccgaaatggactggattcacgcagttcattttgaatagaaatttttcggaccattgcccaattttgcttagagctaaatatgttgattggggacccaaaccctttagggttatggactgttggctgaaagataaggcattccagaatctagtcaaggagacctggtcaaatacacaactaagaaggtgggggggatattcactgaaagaaaagatcaagacacttaaaagaaaaatccagcaatggaacaaaaagcagtttggagacacatttaagaaggtacaacagattgagtctactctaaataagctggaagtgggtggcaatgatagacaactgtcctctcaagaattgacgctccgcaaaaagctacaagaggatctttgggctgcttcccaatcacatgaatctttgttgagacaaaaggcaagaacaagatggataagggagaggggctgcaattcaaagtattttcacatgctcatgaattctaaccgcaggagaagtacagtcaaaggcatgcttattgaggggtcatggatcgaagaaccaaacagagtgaaggaggaacaaaacgatatgttggtgggacgtttccagaaggatgaaataaagtcagctatgcgggattgcggtactgagaaaagcctaggacccgatggtttaaatttcaagttcataaagttcttttgggagctacttaaacctgatttcattaggttccttgatgaatttcatgtcaacggtatctttccaaagggctgcaacgcctcttttattgcactaatccccaaagtgaaagatccacaatctcttaacgaatacataactatttcattaataggttgtgtttataagatcgtggccaagatcttagcaaatagattgaaaaaggtgctgccggacatcatagatgagagactaacaacattcattaggggaaggcatctactacatggtgtagtgatagctaatgaagtggtagaggaggcaagaaggcggaaaaaaccttgtctggtgtttaaagtagactatgagaaagcatatgactgtttcatgggaattcctaacatacatgatgaggagattgggtttttgcaccaaatggatacactggatcaggggttgccttcattcagcatcggtgtctattctagtcaatggaggcaaggggatcccttagcgcccatgctgttcaatattgctgcagaaggtctaaccgggttgatgagagaggccacaatggaaaacgtgaaggttataaaaaagatcctcagatgttttgaattagcatcaggcctcaagataaattttgcaaagagccgatttagggtaatcgggaaacctgagcaatgggggaaggatgttgttgagttcttaaattacacgctgattcttgtggggtggaggaatggagcaaaggaaaattgcgtgggtcaattaggaaacaatatgtctcccaaaagcgaaaagaggtttaggcataaaagatctccaagcgttcaacacaacattgtttggcaagtggagatgggaaatatttcagcacaacggggaaatgtggaccaaaattctactttcaaagacacatgggcaactgaggacaaaccactaatggtaaaataccataacatgtatcagatatcaaaccaacaacaacaaactatcaacctcatggggagccataccaaagtagagtgggaatggaagttcagctggaggaaaaccttatttgataatgaagttgtaatggctgcagattttctggaggaatcagcacaactaataatacaacagaatggagaagattcatggatatggaaggctgatccaagcgggaattattcaacaacaactacatacgagctactgttggaagcaacaaggggggaaaatgaggatgggactttagtggaattatggaaacttaagattcctctcaaagcagcagtgtttgcatggaggctctttagagacagactaccaacaaaagtgaatttgagaaggggacaggtggagctcaatgactcactttgctcactgtgcaacactaagaaggaagatgcagctcatctattcttcaactgtagccacacactccccttatggtag

SEQ ID NO: 7529 - DNA, 318 bp, Glycine max
  Peptide Sequence Number=SeqID_124307
atggcttggcagaggaggagtgcttacagaggctacagaatcgcattgatattccatgtgatggttctatccctgagcaccagtttatcaaagactttaagccatgtacacataactttatgtgctgcctttgtcttaccatgtgtgcaatcattatctctcaagaatgatgccctaagagctttatggagtgctgcatttcctaaagaagaactccatggtttgatttctgagcagtggaaggatatgggttggaaagggaaggatccatcaatagattttaggggtggtggtttcatatcattggagaatttgtag

SEQ ID NO: 7530 - DNA, 630 bp, Glycine max
  Peptide Sequence Number=SeqID_124308
atgaaaagaaagaaatacagcgcggacaaacctctccctgactcactttcgcagagtcgctacattgctctgaaagttggactagcgcttgtcgcggacgagggattggccgaggcggcaatcaccgttgaggacctcgatgacggtgtagttgacgtggttctcgagtttgaggatgaggtcaaagttgtgaaagccagcgtcggcatcaatggcagccaccgagaagcccaaacagtggggggtttgggttttttgggggttagggttttaacggttccactggaggataggagaatgggggcggaggaggaatgtggagttgggggtggtggtcgtgtcggggagaaggtggagagagggaaaagggaagaggaaagaagaagaaagagaacactgagcgagaagaagaggaacgaacacaaaattattgaacagtttcaaaagtgtcatatagaacatcctattgcaaaattctttggtgaatgtactgatttgaaaataaaattggatcgttgtttcagagaagagaaagctttgaagcggaaggctaactttgaagagagcaaaaagttgaaggaacagttgcgagctttgaggaaagaaaatgctacaagcagtggtcaatag

SEQ ID NO: 7531 - DNA, 612 bp, Glycine max
  Peptide Sequence Number=SeqID_124309
atgaaacctcaccccctccattatcgaaaccctaccatcccttatcccatctccgtctccgctcactctaaatcatttccaaaaaccaccatagaattggagaaaaacgaagataagaacgatatctttgaggggcatgaggcagctgtatattctgtctgtcctcatcacaaggagagcattcagtttatattttcaactgccattgatggcaaaattaaagcttggttatacgataatatgggttctagggttgattatgatgccccaggtcattggtgtactacagtgcttcatagtgttgatggaagtagaccgttttcttgtggaattagtaaagatggagagtcatttcttgttgaatggaatgaaagtgaaggagccattaagagaacatacaatgggttcagaaagaaatccactagtgttgtgcagtttgacacaacccaaaatcaatttttggctgctggtgaagatggccaaatcaaattttgggatatggacaacattaatcttttaacaagcactaatgcagagggtggactacagaatgaagtcaataccacaagtcaagatgcggagaaaactagagaactgtggaagatggagtag

SEQ ID NO: 7532 - DNA, 1035 bp, Glycine max
  Peptide Sequence Number=SeqID_124310
atgacaatagaacctgtatcaagtgccgaagctctgataccagatgacgtgaatcttacggggcagaacgaaactagtagtttccatcttcctataggagatgtcacaatcaccttcgatgatgtggcaccgttgcttcatctgtccatcacaaatgctttccatagcttcgagggtcttcatatggacgaagttgtgtttctgttagttgaattgcttgaagttagtgcagatgaagcaagagttgagacagtacaatgccatggggcatatgttcagctattgtggctgcgagacatttatcatagcgaatgtgatgccgcacagtggactgtagcagctcaagtatatttgttgcatatggtaggttgcactctctttgccaacaagagtgatacacacgtgcatgtggtattcttggatgacattcatgacctcacccaaagtggaagctatacatggggagctactaccctagtccatatgtatgacaatttgaatgatgcgtctaagagcaacgccaaacaacttgcaggatataacacactttcacattgttggatctacgagcattttccttttgttgctgagtctattgttgctgcttatgatcagaggaaaccacatgcctgccactggaagtcagggaagacattaccagtgtcgacgtatcgaaagcgtttgcatagattgatgtctgatgttggtccatctattgtcatacaccgaccagagagggttgtgcgacagtttaggtatgtgcagaccattcctccactcccaattacgtcaatgttatgcatagaagatattgatgataaatggattcagttttctgaatatcttacaccggtggatccacctagacatccacttgtcgtgcatgatgacacatttgttgaaccagatattcctcagcacctgatggcaacaccagctatggacgaggcacttgcatatgcacctgttcatgtagagcatcctcaacatgcagtgtatgatcatgttgttgatgactttccaaacactacatag

SEQ ID NO: 7533 - DNA, 204 bp, Glycine max
  Peptide Sequence Number=SeqID_124311
atggagatcaacattttcatatcttggacttcatttattctcactactacaaaagcagcttactacgtcagcaattcaacgacggtttcaaagaaacgtcgtagaagctcaaccggtggcatatccgtaattaagggcttcagaacgacgacgtttgccgctacccgtcgtagacatccagctgttgtggcgattcgtatttag

SEQ ID NO: 7534 - DNA, 123 bp, Glycine max
  Peptide Sequence Number=SeqID_124312
atggatgaagctagctgcggtggagtgaaaatagcaataatgttacaagggtgtgataaggctgagatggccgattgtttagtgggtgtttggaccaatgttggcaaattggttttatattaa

SEQ ID NO: 7535 - DNA, 396 bp, Glycine max
  Peptide Sequence Number=SeqID_124313
atgtggaacttcctaacatctcccatccaatctaacgcggacctcaccctctgctttgccttcgccacctgcagtgtcaaactactctacaagattttttgtcaagaacaggtgcaacagcaaggggtgcaagaactcaaacacgccataaaggatttcccaagcaggggcgtcgttgattacattgtatcaaataatgcaataattctactcgcactctcattcgtgtattataagcagagtaggattgaaatgcaggaaccctttgaagcagagaacttctgtgctggagcaggtgttgtgtggccgaaatgggggaggctaagagcacggttttggagacgcaagggacatcaagttaaaaggacaatcgcaaattggcaacaagttttttaa

SEQ ID NO: 7536 - DNA, 930 bp, Glycine max
  Peptide Sequence Number=SeqID_124314
atggcatcattagatagttctcagacagggggagaaaaaccactgtcaaataaggtgcaacatgtttatacacgaaggaaactacaacagaagaaagtacagcctatcatcccgacactagaacaaatagatttcctaatctcttctgaaattgttccaggtaatactgaacccccttattctaattcaaattctaatacccctatagcctttaggaaaggtccaaaatttgcagtaaaggaaaaccaagatgatacagcctttcctgttgcctctgttgagaatttgtttgccgatacgtcttcccaggataaaggcacttctcaaagaaatctgcctcagtctgcctcaaaagcaaggcaagatggtcccgaggctacacattttgaagaattaatcaatccagcaaagcaagatgatcctgaggctacactctttgaagaattaagcaatcctgcaaaatatggcttgtgtcaaccaaggaacactgaatctggttctgttatcataaatggcagaaatctgagtggtactggatatgctgaacaaataataaaggaaaagcaaagcattcctgttgtgagtgtcaatgacaaacaggatatgggtatctcagctattccagttgaagaacaggaaattagcatttcaacgacaaatgtcattgtgttaagtgacgatgatgaacaagaggccaatgctgcagataattcaatgggaagaaaggtggtggagagtcctgaaaattctatttggtattgtgtaggtccttatggtaaaaaaggaggacccttctcaatgtctgcactcaaacgttggagtgatagtgcctcacatcccttagaattcaaggtctggaagacaggtcagagtgaaacggaggcaatacctctcactgttgcgcttaaccgaattttctcaagtatgtag

SEQ ID NO: 7537 - DNA, 1416 bp, Glycine max
  Peptide Sequence Number=SeqID_124315
atgggggattgcctgaaagcttatcatcctcgttgcatggctgaagatgattcctttttggataatgaatgtaaatggacttgtgattcacattcttgctccctttgccggaaaccgtcaaagtttaagtgtttttgctgcccaaaagctgtttgtgggaaatgcttttctgatgctgaatttgctattgtcaaagggaacaaaggattttgcactcactgctcaaaacttgcatttctaattgaagaaaatgctgatgttgattctgatggggaaaaggtagatttcaaagatcgagatacctatgaatgcttattttcagaatattatgaaatcatcaaaaaagaagaagggctgaattcccaacatgcataccaagcccataaatttttaaagaatggcaaaaacaaatgtgacttggatccagatgaaataggtgaaggggaagatgatactggtgattctgaagacgtgagtaactttatagtttctgattgtgatgacctgaatgacacagcaggatcaaaatcagcgaggaaaaagaagggcatgggaaagctgaaatcaatgaaaggaaaggtgaaagataagaaggagtttattggatggggttcaagaatgctaatagaattccttaaatatatcggtaaagatacaagcaaagaattttctgaacatgatgttacctcaatcattatagagtactgcagagaaaacaatctttttgaccctaagaaaaagcgaaagatactttgtgatgaacaacttaggtctttaatagggaggaaatcagtaaataaaaacagcatacaaaatcttctcgcacctcactttgctgagaattccgaagaaatggatgatatcagtagtagttctgaagatagggattgcaatgaaccagtcaatttttcaagaaagagaaaatcaatttcatgtacagaatctcaacatccaaacctagtttctgaagagcgtcaaagctgtttcgcagccatagttagttcaaatctcaagcttgtctatttgaagaggagtttagtggatgagctttcaaagcagccagaaacttttgatggcaaagtgctaggaagttatgtaagagtcaaatctgacccatatgactatttacagaagaattcccatctgctcgttcaagttgtaggaataaacagatctttaaacaatggtgaaatcaacaaggaaattatgcttcagctttctaatgtgccaaaagctgtacctatctgcaaaatttctgatgttgacttttctgaggaagaatgtcaagatctgtatcagagaatgagaaatggtctgctcaaacagcctactgtatacagtagtactgcatctatggaagcttttggaagagagagtttaaatatggcttcccaactgttggctccatttaattga

SEQ ID NO: 7538 - DNA, 288 bp, Glycine max
  Peptide Sequence Number=SeqID_124316
atgaaagaactaagaagcattagtatttgccaaccaaagaagcaaaaattcagagattgcagtgaactgaaaaacctcagaaacatgtcgtttgagggaagctgcatacatttgtgttgttgtgacgtgtttggtggtggtggtggtgagtggcgagcgatgagtggtggcgtcacagtcaccgatacgttcccaaacaagacgcatgggggaaatgggcacgagaatcgaagattacctgagtcagactttggtgggacacagtatccaatttatctgtatatatga

SEQ ID NO: 7539 - DNA, 327 bp, Glycine max
  Peptide Sequence Number=SeqID_124317
atggatagtctcaagttcgcatctttgacgctgcctccttgttctcgacgctctgggatgctaggaaagaggttgaattcccctttacttattattgattcttcagcacagttttgctattgcaagggaaagattgaaagcggttttgttaaaagtttagaatggatgttaatcagtaaaaggtgggttgtaattaggaattggggattctcttgttctgtcatcagtaataatgactatgttagccttttcattgttcataatccatcaagctggctgaatgatggccgtctcaatgtttttggatggctttgcaaaaatgcttag

SEQ ID NO: 7540 - DNA, 519 bp, Glycine max
  Peptide Sequence Number=SeqID_124318
atggcgccacacgacaatagcaaaagatgtgatggtggtcctagtggcttcatcaatggtgtcgcaacgattagcgcgatgccctgtgctcgtggagtattgatcgagtttgggcgtagggagacacatagaactacacctgttagtcaagggaacaaccgtcactatccatcacgcgacggaggtgcttgccgacgtggaggatctggattatgccttatgtcgttgactggatgctgtggtcgggtgctgacatacataattctagcggctggagcagtgtcaacggaggttctatacctggctgagaatggagacgccgcaacaacgtggagctcagcatgtggctcttttggtcgattttgccataaggtcacagcatcagtagctatcacatttgtggcagtgttttgctatgtcttgctttccctcgtttcctcctacaaactcttcaccaagtatgatgcaccagcaagcaggcccactgaagccattgaggttgctgctttccctggctag

SEQ ID NO: 7541 - DNA, 255 bp, Glycine max
  Peptide Sequence Number=SeqID_124319
atggacaacaatataatcgtttggaggctggaggatgatggagagtatagtgtacgcagtgtgtacaaaatcattatggaaaatctgatggactatggagttgttagaagaggggatgaatttttccaagaatgggctcatgtgaaggagaagcataatagttcaacgaataaggataatattagcaacagtgatagctgggaacctccaaaaccaagaacattgaagtgcaatgttgatgctagttttagatag

SEQ ID NO: 7542 - DNA, 136 bp, Glycine max
  Peptide Sequence Number=SeqID_124320
atgaggaggaagaaggcagagcagaatggcgacaagagtgagagcgcgaggatggaggcagaaaggatagtgagagtgcgaggtagagaagcgtggatgcaagagttgaaaacagaagtgaaaactaggctaagag

SEQ ID NO: 7543 - DNA, 291 bp, Glycine max
  Peptide Sequence Number=SeqID_124321
atgagaatgatgtgtgactttgggttaggtttgtggggtggacttggagcaggtttttgtgttggggagagttttagttcaactgctgcacaaaggtacgcttgttgttcactacatattaagaatgaggttcattcatctattatgaaagctaaaatgcatggaagaagcctaagccttccagggctgcacattgcctcaggattgataagagcaagtcatttctatgatagttatttttcaaacagtggtgttgacacaatgagtcatgaaagggtgttgcacaattaa

SEQ ID NO: 7544 - DNA, 492 bp, Glycine max
  Peptide Sequence Number=SeqID_124322
atggatacagaagacttcagcttccccaaaattggtggcacttgtgcatatagcattgatttacctcctctgtggaatatatcaccaaaagacccttctaatcccaaccaagtccctagagaaggaagcaaaggagatgaaaaagattgctttgaagcaaaattgatctctaagggccacaggaagagcttttcatgtgtcgaagatggaaagaaaataacaagagtaggccatgaagcggctccaatggacttgttgtgggaggttttcaatgaggagttgtcttcagcaacagagttttcttccacgtcttcaagggagatggttgaattcagatgtgctactacagccttaacagttgccaagaccaacaagggtcttcttcaaaccaagaataggcctgaaattgctttcgataaagtgcttcaaaaaccttattcagttggttattctgggaatgggctctctgctgcttcaaatttgaatggttaa

SEQ ID NO: 7545 - DNA, 981 bp, Glycine max
  Peptide Sequence Number=SeqID_124323
atggaaatgatcatgaagtttgttgggacttgggatgaaccacatgataaattgtatcatagccaaccgacctgtgggttaagggaagtgggtaataatttatggattgaacctgtctttaagaaagtgagtgactttacaaccaaagatattgtagatggggaaagatcatccaaatgggtttcagcattcctctttggacaaactatatcagtgatttctcctgatgtttcatatgcaagcagctcagcaagaataaatgagatatatgaggttggagagttgtttgatttaagcatccaactaatatacttggtattgctattaggtttgctagggactggaactttctttgtgattcgtcaagttcttgtccgcagagaacttgacctatctgccaaagagttgcaggagcaagtaagaagtggtgatgctggtgcaactgagctttttgaacttggtgcagtgatgctgcgcaggaaattttaccctgctgctaccaagttcttgcttcaagcaattgagaaatgggatggggataatccggatcttgcccaggtttacaacgctcttggtgtgagctatgtccgcgatgggaaagttgacaaaggaattgctcagtttgagacagctgtcaagcttcaaccaggctatgtcacagcttggaacaatctcggtgatgcctttgagagtaaaaaggactacaagtctgctctaaaggcatttgaagaagtcctactatttgatcctaacaacaaggttgcccggcctaggagagattctttgaagggacttgttgatgcaaccaaaggagttactgtcatcaagtcaacagagaagaagagaaacaaagccacatttgtagggagctacgtaccttcctgggaagctcaccgctttcagttgcctctacaggaacctgcctccaccagctacctcaaccattattacgatttacaacacacgctttcatttttttaa

SEQ ID NO: 7546 - DNA, 411 bp, Glycine max
  Peptide Sequence Number=SeqID_124324
atggccaatttctacagaaacaacagcatgcaggaaaacttgatatcagcaaaactatatactttgtaccattacaaaacttgccatttttctataaaatacatgacaccaactcactcatgttacggaagaacattaaaacacgtgaaagctgaacaacctccagcaaactcctgctcttcgttgcatcaagataagcgtgaagggaacggattcattgatgggtttggtggggaatttggatgggaagagagtgggaaaagagagagaagaagaggaagggagaacgaggaagtgagtgaaaacggaaccacccatcttcgcttctgcttctgttccggtttgggttatcctgctccagcaagtaatgccacctcggacgggaacatcgttgttacattaccctcttga

SEQ ID NO: 7547 - DNA, 363 bp, Glycine max
  Peptide Sequence Number=SeqID_124325
atggacaaaaatgcttctgccttaaatttaaaaacaaaaacacgcacccaaccactgttacgcttcttcttcttcttcttcgctgttgtcttctccttcgtcgctctcctccaagcttcttcttctccttctttcggtgccattgacgacctgcattttggagctgctccgccgtcgaggttagaggatttagtttatagatacggacgtagttcatccgtattaggaagattaggaataggatttcggtttcttcatacggatatcatggttagaaccagaggtttaggtcgtgccctaggtagggttataggcagagccctggggagagaggatcatcatgattcagatgatgttccttag

SEQ ID NO: 7548 - DNA, 501 bp, Glycine max
  Peptide Sequence Number=SeqID_124326
atgtctgtcagcgttgagggctctgcctttggggcactatttgaagaaaaaaatgtccattctgaagacagcaacgagcttgtgttgcatggtgcatttccattggctaaacatgagagacagaatggatttaatgccacagacatgaatgcatttggaaactccttcaggaactatgatgcagaaagtgaaaggcaaagaatggtggaggaattatataggatgcaacacatcaaccagacatatgactatgggaagagaatgagggaggagtatgggaaattggacaaattagaaatgggtatatgggagtgttgtgagctgctcaatgaagtgacggatgatagcgatcctgatttggatgaaccacaaatacaacatttgttgcagtccgctgaagccattagaaaagactatcctaatgaagattggttacatttaactgctcttattcatggtatgtgctctatgttcttggaaattcttctttcttcgaaataa

SEQ ID NO: 7549 - DNA, 502 bp, Glycine max
  Peptide Sequence Number=SeqID_124327
gctgacgaaagaacagcttctcactcaggtgagattgaactgggtcactgaactctctcttcccttcgcccctttccttgttgggggggacacctgcttccttagcctgaaagatgggtcgcctacctctattgtattgagttgcccccctcgggcactggaagagtctagagcgactctcttcgtactgctaaggagaaggtgcggagcggaaaggcagaaaggaagtcagaagggaggtcacactggtgccaaaaaggcaaagataacatcctccaccaaagaaactcaagtgaagggacccgaacaagcaagggattcagatgaagcgcaaacgcaacgcgctcaagccaacaagcaaagagcgatagcagctctcccgagagggaatctttctctttctttccttctcccaggcgttattgtattgatggagaggattgagaacgaagtgagaggttatcagacctcaagaagtcaagggcttgattacgcgcattag

SEQ ID NO: 7550 - DNA, 1116 bp, Glycine max
  Peptide Sequence Number=SeqID_124328
atggagcgacagatgaaaaaaacaatgcgcaccgccttcgccacgaccctgctggctttttctctttctgcggcacaggctgcggcacccgagcggaccgaatgtatcgccccggccaaacccggcggcggttttgatctgacctgtaaactgatccaggtttcgctgcaggaaaccgggcagatcaccacgccgatgcgcgtgacctacatgccgggcggcgtcggtgccgtggcttacaacgccatcattgcgcagcggcccgccgaagcaggcacgctggtggccttctccggcgggtcgctgctgaacctgtcgcagggcaagtttggccgttactcggtggatgacgtgaagtggctggcggccattggcacggactacggcatggtcgccgtgcgcgctgacgcgccgtggaaaacgctgggcgaactgctggaggcgatgaagaacgatccgaccaaagtggtggttggcgccggcgcctccatcggcagccaggactggatgaaaaccgcgctgctggcgcgggaagccggtatcgatccgcgcaaaatgcgctatgtggcgtttgaaggcggcggcgaaccggttaccgcgctgctcggcaaccacatccaggtggtatcaggcgacatgagtgaaatggtgccgcacctgcagggtggcaagatgcgcgtgctggcggtgatgagcgacaaacgcctgccgggtgaactggctgacatcccgaccgccaaagagcagggctttaacgttgagtggccgatcattcgcggctattacctcggccccaaagtcagcgatgccgattatcagtggtgggaacagacgtttaaaaaactggtgaccaccaaagagtttcagcagcagcgcgatctgcgcggcctgtttgagttcaacctgttcggtagcgagctggacgcctacgtcaagaaacagctacgagccggttggtccacgccctttcccgctgctgctgctcggtctgatggcgatctgcgcggtgatgatgctgctgcgcaagccggacgccgtacagtggccggtggcggcaacgctgaaaaagctgctggcgctgtgcgtgatgctgatggtgtacggctggctgtttga

SEQ ID NO: 7551 - DNA, 1056 bp, Glycine max
  Peptide Sequence Number=SeqID_124329
atgtcgcctgataccacctggatgtggttgccgagcagcgcggtaaccgtcctggctgccgatggaggcgccggcgccaaccaccactttggtcggatcgttcttcatcgcctccagcagttcgcccagcgttttccacggcgcgtcagcgcgcacggcgaccatgccgtagtccgtgccaatggccgccagccacttcacgtcatccaccgagtaacggccaaacttgccctgcgacaggttcagcagcgacccgccggagaaggccaccagcgtgcctgcttcggcgggccgctgcgcaatgatggcgttgtaagccacggcaccgacgccgcccggcatgtaggtcacgcgcatcggcgtggtgatctgcccggtttcctgcagcgaaacctggatcagtttacaggtcagatcaaaaccgccgccgggtttggccggggcgatacattcggtccgctcgggtgccgcagcctgtgccgcagaaagagaaaaagccagcagggtcgtggcgaaggcggtgcgcattgtttttttcatctgtcgctccattgtttcttccagagtgtgattgccaccgaacattcgggataccgtcgagctggccaactggctgcagaaagcgctgacgcaaaaaggattcgccgtggactgggtggccgacggcgtggcggcggatcatgtgctgcaaagcgaagactatgcgctggtggtgctggatgtgtcgctgccgcggctggatggccaggcggtgctggcgcgcctgcgccggcgtgggcaacacgtgccggtgctgttgctgaccgcacagagcgcgctgcagcagcgcctggacgcgcggttgcgcgcgctgctgcgccgcagccagggccaggcaacgcagatgcaaagcctcggccagctggagcgcgatgcggaaggctatttcctgctgaatcacaagccgctgccgctgacgccgcgcgaggccagcgtgctgtcgacgctgatgcagcgtccgggacggccggtgtcgcgccagcatctgtacgagcaaactttcacactggcggatga

SEQ ID NO: 7552 - DNA, 303 bp, Glycine max
  Peptide Sequence Number=SeqID_124330
atgacttcaacacataaccttgcagctttacatagggcaggagcatatacacatttgatgaatgaagaagatattgagaatttgaagtggctcaaaatatttagcaaatatgacctctacagcaagagtaaagttctagtagacatagaaaaagttaagccatactatatgtcgctcatcgagaaggtgaatgggatgacaacggacaggatagaaatgggtttgatcctccatgtttccattcccgcacaagatgggactagtatgggtaccggtaaaacaaagaccggtttagaattttaa

SEQ ID NO: 7553 - DNA, 399 bp, Glycine max
  Peptide Sequence Number=SeqID_124331
atggctacaacttcaatttcttcaaaagatgtcgggagatggtttaccgatgagagcggatgcaaggaaaatgaccacatggcaataagtgataggcaagatgaggaggaagctaacaccttggaggaggagacatttgtcattcagagggagaatttgctaggagggtacccaattaaaggatcccgatggtggtgtgatattctaaagtcttgtgagcttttagagaacggacttgggtggttccaaaaaaatatttcaagagtgattggtgatggtagggaagtgagcttttggagagctaagtgggtgagtggagagactttgtgtagaagctttaatagggtgtttctaatctccgaacaaaaagacagcatgattgcggaggtgggaacatga

SEQ ID NO: 7554 - DNA, 371 bp, Glycine max
  Peptide Sequence Number=SeqID_124332
atgggtgaagtagaggagatacaagagaagatgaaggccgacatggaggccattaaagagaaaatggccacaatgatggaggccatgatgagcgtgaagaagataatggaagccaatgcggttacaattgccgctaccagcgttgttggtaagacacatgaaattccccaccacaatctagccgacttcgagccttggctcggatatgccactgaagggctagcagttggtggtataccccttgaaaacactccggaaggccctcaggccattgaaggaggtgaagattatgcctttgctaacctaaaagagttgttcctagaacccaatatcatcacccctcccaagttcaaggtgctggactttgacaa

SEQ ID NO: 7555 - DNA, 219 bp, Glycine max
  Peptide Sequence Number=SeqID_124333
atgataaaaattatatgtccagaacttcatgcaattaatacagaaacctgtgtcccaatgtcacatcctatcagagcattgtgtcatgacgtcctccagcacaaggtttctcaaaacaatccacctagtcatctgctatcacaaacacaaggctcgagatcatcacgggattcaaatacaaacagcacacaaggagtgagtgatcacattccaaactaa

SEQ ID NO: 7556 - DNA, 608 bp, Glycine max
  Peptide Sequence Number=SeqID_124334
atggcctccaggaaacataagagcattggggcgaggccaactactcaatatgatactagacggttccattcgcttgatgcttggaaccgttatacatataatgtcttgggaaggagtatttttccagaaaggaaggttgagatataccacacggagttcgatgacttcaagacagagttggaaaggagtaatcttcacaaatgcctcacctacttggctaatgggactattgatcttgctttggtgaaggaattctatgctaacctctacagctctgagggtccttcaccaaagcaagccagagttaaaggccacctggtgaagatagacgcagacaacctcaacgcatttctagagactcctgtagtcctaagggagggggagacattacccacccactctaggtactacaggttgcccatagactatagagagattgaggctgctctttgcataccagggagggggttcattttgaatgttgagggccatccagggaggattctcaggaaggattttactaccttggcccaggtgtggagtgttctctcttactccaacctggcctttacatctcacacctcagaccttacagtagacagagccag

SEQ ID NO: 7557 - DNA, 390 bp, Glycine max
  Peptide Sequence Number=SeqID_124335
atgccaggtttatcattgaagattgagacactcatcaaagctcaaactcaagtccctatcactacaccttcatttctaacctatgataaatgtgggattatgcatgggcttggagaatgcattattgatgacaagctagttgcagtcatggatgagatcaactttgtagagggaagagacaatttttctaatcaataccctagcaatttcaatcaaggacaaggctttaggattgaacaacctatgaaaaagttaaagaagaaggagaaagcaactccaacaccaaaaagagaggctcttactgaagagagccaagagaaaaacaaagaagatgagaaggtgatgcaatcctaccccgcaagggcattggatagagaagactccaagtag

SEQ ID NO: 7558 - DNA, 228 bp, Glycine max
  Peptide Sequence Number=SeqID_124336
atggtgaaatccaccacaactgtggttggaaagtgtgacgctggagctttgggaagttatggaatgactacgactgcatggtgtggaatacgaccatggttggaaggttcatacttttcaaagggaagtcatcatattgacatggtcatacttcttaccatgattgtgatgaatttacaacggttgtggtcaagtgacaaagtcttaaaatattcaaaagaaatgtaa

SEQ ID NO: 7559 - DNA, 537 bp, Glycine max
  Peptide Sequence Number=SeqID_124337
atgcattatattttgtgtcgagtattacttcctcgttccacaaatcttgctcaagcttttgaggaagatttaatcctattatgggccttgcaaactggccgtcaaattgattggatccatcttgttcgctaccttatgcataaggcattacgggcaaatgcacctctcccttatccccaccttattactctgattctgcagcacttcaatattcccccggttaatgaaccttttgtcaaggttaaacgttcctttgccattggagccactgcagttgcgtcctttaggtataggaaggatctggatggtcaatgggttcttaaacaagacctcctgcctaatgctcccgatgaatgcactccatctccaccaccaagggatccctcctcttcattgctgaatgatgttcttaataagcttcgggatgttcgtgtcttttttggagaccgatttgattccatggattcacgtgttacacgacttgaggatgatatgagctttatttgtcgttgctttgatcctctggctgatcattag

SEQ ID NO: 7560 - DNA, 252 bp, Glycine max
  Peptide Sequence Number=SeqID_124338
atgtcattttgggatggtgatggtgaaccagatctgaagaaggatggagatagtggctgcgagttgcaatgcaagcacgacctccctctgctcctcgatgcgggcaatggtggaggacttgcacttcgggatggaggtcttgcaacagtggagggattcgagggtttctttggagagggaatcaagatattgggatttctcgacaacggagtgttggagggaggagaagtgggtggagagggtggtgaagag

SEQ ID NO: 7561 - DNA, 1820 bp, Glycine max
  Peptide Sequence Number=SeqID_124339
ttgacgaagatattcctgattctgaatttcatcaaatggaagtcgttgaagaagtttctgtggattcagtacctggtggagaaaaacaagatgaattgcattggtccagctcacctacaaatcttgatcatgcgtctttagatgaaaaatttgttgctgcagtggctataatacccacagaatctgaatttggatgcacacatggagctaatgataaggttgaagatattttaactactggatcaagaatattcaattctgagaacacatgtttgatagttgacaaagatattcctgattctgaatttcatcaaatggaagttgaagaaatttcagtggattcagtacctgatggagaaaaacaagatgaatgcaaggaagaggacctgaatgctaaatcttgccgtgaagaagggtactcactggatgaagtagttgaagataatggaaacaaatgcattaaaaccatagatcctgcatcttttgatggaaagggcttggctacagtgactgtaatacccacagaatctgaatttggatggacactcggagataatgaaaggattgaagatattttagaaatggagtcaagaactatcaattctgagaacacatccttgctagatgaagaagcgattcctgttgacaaatttcaactaatcaatattattgaagaagttgctatggattcaatatctgatggagaaaaagaagataaatgtgggatggagttggagtcaaagttgccggcttccctgaatgagaaatcctgtcacgaacaaggtaactcagtgactgaaatagctggagatactggaaaaaagtgtgcaagcagcatctccttgcctcatcatttcaagtgtaagcctgctagtgcgccccaagttcgagccagaaagagtagatttgtgagcacagctaaggttggcactgaagttaaaaggagtaatgtaaagaatgttgtcataaataaatcaatgccaaaggatctttcctctgtttttgatgagaaagaagcattcactccaaataacgaaaacttgtgcccaaaatacctatcacttgcagtttatgaaaaagaaagcatctattcagccaaaaacataagcagtgtttctaacaaagtgaaccaaactccaaaagtagctcaagaatggaagtcacaaagaaagcctctccaatgtcgtatcaacttggtccatgagcaagatttgatgcagttaaaaaagaacagagtggaaagggtaccacccttccaatcactaatgaactctagaggcaatcataaatctgtgactgtttctgctgcaaaaagcattgatgatgcccatatttgtggacagatttcaaacaagtgcactaaaccttctcagtatactagtagagaacaaaagaggagctgggacatggttgtagacactgcttctcttctgaacaaggagtcaaggaaagctttgcagcttctacaaggtctcaaggggacccgtttaaccattccaagtttagtcataagggaactaggcagtatgaagcaacaatttagaattttgagaacaacttcagaggcttctttggcattagagtggattgaagaatgcttggagaaaacaaggtggtggattcatatccaaagctcaatggaggagttcaggctgacagctctaacccctcctgcttctcctcagactcgatttattgaagagagttgggctttgcctggtttcaatacctcgaagaaatgtgcttcacctaaagttgaagatcacatccttgactgtgcccttccactttttcaccatgattttggcagccggaattga

SEQ ID NO: 7562 - DNA, 855 bp, Glycine max
  Peptide Sequence Number=SeqID_124340
atggcttccattgccgccatggcagaaaacaagaacccagaacaagaagaccaagccagattcccaattctgacggtgctcaagaacaacgcaattgtcaagagcatcttcatcgtactcgatgaccacaacgaggatcagatggtcttgattggccgacaccctaactgcaacatcgtcctcacgcaccctagcgtgagccgcttccacctcaggattcgctccaaccattcttcccgcactctttccctctttgatttggcttctgtgcatggtacgtgggtgcgtgggaggaagctcgaacccggtgtgagtgctgaattgaaggaaggtgacactttcactgttgggatatccactaggatttatcgtctcagctgggctcctcttacccaattggatgatgagaatctggaacttagagcagaggaagagattccgatgcctgaagacattgtttctctttgttgtgatgaagaaaggaagagccatgctgaagatgaggcattgggagttctcaatggaactgaaacatcatgtgctccaacaaactctggtggtgaaaacataatttgtgactgtcaattatcacccccatacatacaatcacccccttatgcacaaccggttgatgaacttcataacaccaagaaaattgaagcttgtgttgaagtggagatacctagagaaactaatttgctatgcacattgagggaatatttgaaacacaacatatatgtctgccagttgtggaagcagtccaggggaccaagatacagcaatttcaagccccacatgatacttttactggacaaccaccttccttggaaatgcattggtccagcttcccaatga

SEQ ID NO: 7563 - DNA, 237 bp, Glycine max
  Peptide Sequence Number=SeqID_124341
atgacaagcactgagttatgtgacatggcaaagaaatcccacatttttctggatttggaaaaactggcatggatggggaacggcacgcgtgtgaaggacaaggttgaattgaagggttcgatgttccctttctttatggtgaacgtgccatgtgtaacgctatgccatgttggattatgtgtaaagtgtatgtctgaatgggccacgctgatgcggtttgtgtgggacactggctag

SEQ ID NO: 7564 - DNA, 579 bp, Glycine max
  Peptide Sequence Number=SeqID_124342
atgcttaactggggcctcaactactatagaaatctcaacctgtactactccatgtatgggcatgttgagaaactagcagaagaaataaagaaaggggcttcctctgtggaaggtgttggggccaatctcttggagcaaaattgtgcttccaaattcattcttactaaatttgagaagaaatgtaaacattttcctgtacctaagacactactcaatgaggtgtttggtaagatgagtgcaccacccaagagtaatgtaccagtcattacccccaatgaactatcagagactgatggcttcatgacaaggtttggaatgatggctgctcattataaagcctttctagatgctactggaggcttaaggagagcacaacagcttgcaggcaagtctattgaactcttctacaacactggttcacaaggtgaaagtccatatggtgtcgaaacttatgtcgttgacgaatcaagacaaccaagtgagcttgagttacaacaagcattccaccaaggaagtacattgtcggcatcacaaagaagctcaagcgagttgcataatgttgtcttgccatcatattag

SEQ ID NO: 7565 - DNA, 351 bp, Glycine max
  Peptide Sequence Number=SeqID_124343
atggaatggaaaagcttctggtctccgatgaggctcgcagggagttctccaatctccatcacgctttcgatgaggttaactcccaactccaaaccaagtttagccagggttcaggctttaatattgtcaccaatgagggaactaacctcgcaaattgagatggttatattggctgctggggatttcatcaatatacaagctcatgcatgcgttagaggtaaaagtgtgggagaagacataaggaaacttgagtatggagttcatgtggtgtttggaactcctggccaagtttgtgacatgatcaaaaggagaacattgcgcacgagggctatatggatgctagttttgtga

SEQ ID NO: 7566 - DNA, 322 bp, Glycine max
  Peptide Sequence Number=SeqID_124344
cgttcgacatgttcttgcttgggtcttccactccgccgcaaccttctcattccttggtccttcagtccaccgcaaccttgccattgtctgtgtaggtctacataggcagccacaaggttacatcactgtcaatgaaaaccatggaagggcccttttctactggttctttgaagctcaatctgaaccatccaagaagcctctccttctctggctcaatggaggccccagattctcctctattgggtatggcgcagttgtggagattggacctcttatagtcaacaaaaatcgggaaggactacatttcaacacacactcctag

SEQ ID NO: 7567 - DNA, 507 bp, Glycine max
  Peptide Sequence Number=SeqID_124345
atgaaatggagaaaagcatcgggggtgttatgtgatgcaaaggtaccgatcaagctaaagggaaagttttatcggactgcggtaagaccggcgattttgtacggaacagaatgctgggcggtcaagagccaacatgagaataaagtcggtgtagcggagatgaggatgttgcggtggttgtgtggtaagactcgacaggataaaattagaaacgaagctattagagagagggttggagtagcgcctattgtagagaagatggtggaaaatagacttaggtggtttgggcatgtagagagaaaaccggtagactctgtagtgaggagagtagaccagatggagagaagacaaacaattcgaggcagaggaagacccaaaaagactataagagaggttataaaaaaggatctcgaaattaatggtttggatagaagtatgatcactgcaaatcaccaaaaaaatgaagttgtagttaacggtggctggcaaaggcatccccgtttttga

SEQ ID NO: 7568 - DNA, 324 bp, Glycine max
  Peptide Sequence Number=SeqID_124346
atggcaatggagggaattaagcttgaggttggtgggagatggagaaactcactttctctcgacctcgaccacttgccacttccaacccacttcaatgcttttgcagatctggtgcacgcgccgtcgttcgcttaccgacgtgtggagaggcagctcgagaatgagttacgtttgcagagcctctctgaccgcgtggcggagctggagatcttggggctattcatttttgtgcatattcggttttattatttgcaaaatagggaccggcgagtcactgatggcgaaggcggcgatgaactctcacgcgccggcactctactttga

SEQ ID NO: 7569 - DNA, 336 bp, Glycine max
  Peptide Sequence Number=SeqID_124347
atgataccaaagactcaagtcaagaatcaagattcaagcaagtttcaagaatcaaagattcaagtgaagattcaagagaagactcaagatatgcaagaacctcaagaaaagcatcaagaagcaggatttgcttcttggttgatcactagactcaaaagactaaccgcttttgggttcattgcaagaagtgggtataacttcttggttgttatcattggacttaaaagactaaccgcatttgggttcattgcaagaagtgggtacaacttcttggttattatcattggacacaaaggaccaacgttccttggggttcattgcaagaagtgggcataa

SEQ ID NO: 7570 - DNA, 243 bp, Glycine max
  Peptide Sequence Number=SeqID_124348
atggttcggcggaaagcaacagcggctcgtggtggccatcagtggtcagtggtggtggaggaggagcttgggggtgttgggggagggtttaggggaagagaaggaggaagaaaatggcttttttacactgttggacgaaattttactgctttgattgtggggaatggtcttcttaacatccagacaaagttgcaagacgatccaacggttaacgaatccaggattgcaattttactgaaatag

SEQ ID NO: 7571 - DNA, 150 bp, Glycine max
  Peptide Sequence Number=SeqID_124349
atggggcagaagacagagggtggcagcgagtccccagtgaatgctaactatcgatctagggatccggtgaaggaaaggcaacgggaagatgcatggacttataaaggtacaaagaaaagaaagatccagggacataggtacaggccataa

SEQ ID NO: 7572 - DNA, 954 bp, Glycine max
  Peptide Sequence Number=SeqID_124350
atgttgagaagtcttcaactggagtctggttacagaatcatcttagctttgagactctcttccctgctaattttcttttcttcggttctgagtgctcgtggctacccttcaagagctcatatcttcatatatgcagtctgttctcaagaaaaataccaaccaaactcaccctttgaaggcaaccttaacagctttctgtcttcagttgtcagttcatcctctgatataacttacaatagttttgctgttggaaatggaagcctaacaccgcaagaaggaagtgtatacggcttatatcagtgcagaggcgatttgcatccaattgattgctcaaagtgtgtaggaagacttgttaaccaaatagggttggtttgtccctatgcccttggggcttctttgcaacttgaaggctgccttgtaagatatgagcatgctggtgatttcctgggcaaactggacaccagtctcagatataagaaatgtagtaaagccgcgactagcgacgtcgagttcttccatcgcagagacgatgttcttgctgatttgcaaacagctaatggatttagagtcagtagttcaggcatagttgaaggatttgcacaatgcttgggggatttaagtgtatcagattgctcctcttgtatagcagatgcagttggaaagctgaaaagcttatgtggatcagcagcagcagctgatttgttcttgggacaatgttatgctcgatactgggcctctggttattatcatgaatcaggggggaggagcatgaacagttatgccataaatgaccccttcgtagaaaagcgatcagaaaatgaagaggaagcagagattcctccaacaatgatcaagtggggaaatcggttgccattattgtgggagtgtttgcaggttaagagagaggtgctaaaaggggtaatcattacgaaaggtcctcaaatgtttgtttaa

SEQ ID NO: 7573 - DNA, 792 bp, Glycine max
  Peptide Sequence Number=SeqID_124351
atgcctactgacatcagggaaattgaggctgctctgtgcatacccggccgagggtttattttaaatgctgaaggtcaccctgggaagatccttagaaaagatctaaccactcttgctcaggtctggagtgttccctcatactccaacctcgctccgacttcccacgcctcggatttgactgtggatagagctaggttaatctttggcctagttactcagctggacatcaatgtcggagctctcatctctggaaagatcatttcaatggcccagtctaactcctctagactcgagttccctgctcatatcacaactttatattttcaacgtttcgaggccatgcttcgaagcatacatcaggggcagattattttactagaaagcctacagctggtagcgcctccagactccatcccgacggtagagcaatttaatgaatgggtagcctggccagggactcagcctcctcttcacagggaagacgaagatcctgccgctcaggtaccccatcagtcggaggatgagtcatcaaattctaccactcctgagcccttgatcaggaaaatgagggtagttgtaacccaggaagctgcagccacctctgaaaagtctcttgaagctactctagagcttccggcaccagtggcagataccacttctccacaacaagcagcatacccttccacgcttgaggatcaaactaccctagtcctatctccgaacacctctcttgtagcttctcttgtacttcatttgtcggaagaggaggagggtcagacacaggacacgtag

SEQ ID NO: 7574 - DNA, 769 bp, Glycine max
  Peptide Sequence Number=SeqID_124352
aggactacacgtcctcgccttcagaggactacacgtccacgccttcagaggactccacatcctcccctatagaggattacatgtcctcgccgtcagagggctacacgtccttgcctttaaagggctacatgtcctcaacttcagaggacaacacgtcctcgccttcagaggactacacgtcctcatctttagaggactacacgactacaaagcctcgccttcagagggctacacatcctcacctaaagaggactacacgtcctcgcctttagagagctacatgcccttagccttcagaggacttcacgtcctcgcctttagagggctacacggctacacgtcctcaccttcaaaggactacacatcctcgcctttagagagctacatgtcctccccttcggagcactacacctcctccccttcagaggactacacgtcctccccattagagggctacacgtcctccccttcagaggacaacacgccctcacctttaaaggactacacgtcctcgccttcagaagactacaagtcctcgccttcagaggactacacgtcctcaccatcagagggctatgctaaacgtcctcaccatcagaggactacacgtcctcgccatgagagggctaggctaaacgtccttaccttcgaggacttcacgtccttgccttcagaggactacacgtccttgccttcagaagactacacatcctcgcctttagaagagtacacgtcctcgccattagagcgctacacatcctcgccttga

SEQ ID NO: 7575 - DNA, 660 bp, Glycine max
  Peptide Sequence Number=SeqID_124353
atggctacgatcggacacaacaatctcaatgccaaattggttcttctcggggacatgggtgctgggaaatccagcctcgttttgcgctttgtcaagggtcaatttctcgaatttcaggaatcaacaataggggcagcgttcttttcacagacgctggcagtaaatgatgcgacagtgaagtttgagatttgggacacagcaggacaagagaggtaccatagcttggctcccatgtattacagaggcgctgctgctgctatcattgtctatgacatcactagctcgttatcatgggatatggaaaaaattgcagcttgtttgtactggctgcttggtctcaaaatcatgatgggaatggactcctttacccgagctaagaagtgggtccaagagcttcaaaaacaagggaatcctaatatggtcatggctcttgctggtaacaaagctgatttggaagacaagaggaaagtgacagctgaagaagcacgtgtatatgctgaagaaaatggtttgtttttcatggagacctctgccaaaactgcatccaacaataaagttaagagggacatcagtccaaagaggaggaaagcctttaaacttttcgagaaactctctctacccccactttactggccaagttgctattatattcactgctga

SEQ ID NO: 7576 - DNA, 1863 bp, Glycine max
  Peptide Sequence Number=SeqID_124354
atggacaaccttcaaaaatgcaaagcaaactacacagcactcacacctttaacgtttttgatgagggctgctgcatgctatgcaaacagaacctcagtgatccatgaaggaacccatttcacttgggcacagacttatgagcgttgctgccgcctcgccttctccctccgagccctcaacgttgctaggaacgatgttgtatcggtgctggcccctaacatccccgcgatgtatgagatgcattttgcagtgcccatggctggtgctgttctcaacaccatcaacactcgtcttgatgccaagaacatagccaccattctgcgccactctgaagccaaagtcttctttgttgactacgagtacgtttccaaggccaaagacgcccttagattactcatggacaacaacaacaacaacaacaacaagggtgttccaaaaccaaccaccataaatcaacaaaactctacattttctctcccactagtcattgtcatagatgacataaacacccccacaggaatccgtcttggtgagctagaatacgagcaaatggttcatcatggtaatccaaattacgtccctgaagaaatccaagacgagtggaccccaattgcgttgaactacacatcaggaacaacctcggagccaaagggtgttgtttatagccacagaggagcatatctaagcaccctaagcctaatcttaggttgggaaatgggaagtgaaccggtttatctctggacactacctatgttccactgcaacggttggaccttcacttggggcctggcagcacgtggtggaacaaacgtgtgccttcgcaccacagcagcacgtgacatatacagcaacatagtactccacaacgtgacacacatgtgctgtgcacctattgtgttcaacataatcctagaggcaaaacaaagtgagaaaattgacataaagttgaaaagaaattccccggtagagattctaactgggggagcaccaccaccagcatcattgctagagcaaattgagtcacttgggtttcatgtgacacatgcatatgggctaactgaggcaacagggccagcacttgtgtgcgagtggcagaaggagtggaacatgttgccaaagaaggagcaggcccaattgaaagcccgtcaaggggtgagtgtgttgactatggctggtgttgatgtgaagaatcttgacacaatggagagtgtgccaaaggatggaaggacaatgggggagattgtgctgaaagggagtggaatcatgatggggtatttcaaagatcatgaggcaacttcaaaggccttttttgggagtaataatagtaagggtgattggttcagaactggggatgttggagtgattcaccctgatgggtatttggagattaaggataggtccaaagatgtgatcatttcaggaggggagaatattagtagtgttgaagttgagtctcttttgtataggcatcctagggtgttggaggctgctgtggtggcaatgccacatcctaggtggggtgaaagtccttgtgcttttgtgtcattgaggaagaacaacaacaacaacaactcatcaaaaaaaattgatcatgtcactgaggctgagataattgcatattgcaggaagaatttgccacactttatggtgcctaaggtggtgaagttcatggaggagctgccaaagacttcaactgggaagattcagaaatttgaattgagggtcatggctaaggctttcatggtgtccgagaataatgtgcagaccaagaataatatcaacaagaagtctagccaagtgagtcaaaatagtattgttggggggtataacaacgagcaagttttggctctgtctcgtctttga

SEQ ID NO: 7577 - DNA, 450 bp, Glycine max
  Peptide Sequence Number=SeqID_124355
ccactggaacaaatcttatcaagcagactcaatgctgctagctttatacgtgccatctatgtcaattttggaccaatgggttcctatgagctcaactacgtaagtggtgaattattgaaagctggaataatatctaaccccgacaacaatgaagtgatttggcggatcacaaccaacttgtcaagcatagtgtccactctacctgcaaactgtaaagcaataggctgcacgcatggagctggttcccattcccaagggtccatgaacttcggagactacatcagagctgcttctgatgaacagatttatgtgtttgtggttggccagattgacactcagagtcagtcatacattgatgattttgtgaaagtttctgattatgatctagttgccagtcaatgcttgagtagggtgatctcagctatggagacaaaatggggcatttcttaa

SEQ ID NO: 7578 - DNA, 153 bp, Glycine max
  Peptide Sequence Number=SeqID_124356
atgcaaaattccaaagtagctagagtcggagcttcgatcgttaaacacctctgcacaaggaattgtacatccttgtgtggagtaggatatattcgaagcgcaagatatcattacaagcaacctctgagttttaagattggagatattggatga

SEQ ID NO: 7579 - DNA, 426 bp, Glycine max
  Peptide Sequence Number=SeqID_124357
atgggagctgcgagtcgtgagtccttatttgtagggaggtgtaagggctgtttgagagttcaattgctaaggaaatggaaaattttaaactcagatgaggatgcacagtttctgctaaagcaaaagaagaatctaaatgattatcggcctgacataattcacgaggctctgcgatgcattctagatagccctcttaataaagctggcatggtaggggcaatatatgttaaaattgatcaaggaggaatgtttgaagtcaagcctcatgttcaattacctcaaacatgcagtcgattctgtggtgtcataagtctctcctctacttcagaaaagtcggttgacatagaggaatatgtctcactttggagcaatgatttgagtcttgtctttgtgtacccagacagcttctcatgtgttttcaggtag

SEQ ID NO: 7580 - DNA, 324 bp, Glycine max
  Peptide Sequence Number=SeqID_124358
atggctggtgctgtcagtacggtttccggcgaactgaagccgtcgatcttggatcgtgtgcgagcagcaccgccgcctcctgattcctcccttcttttggctaccagacctcccaggcatctctctccctctctttctttctgcttcgctcctaaccttaccttatatcacttcacatgttcttttatattaggacaagcggtgtcctacttgacatgctcaaagctttgtgcaatttgttttgttgctggcgcgattttcggttactcgctcaggggacgagttaagcgttgggcttccaagattctcaagaagctcagctga

SEQ ID NO: 7581 - DNA, 309 bp, Glycine max
  Peptide Sequence Number=SeqID_124359
atgtatttgattttcgaacatgcacgaattggcataaagaatgatcccacttttatccatggaacaatagaagcctcgcactgtccctgtcttcgaaagaaacgttcagctagagtaggatcaaatgatgacgaggtgcatgaacagcctgaagaagcagttgttgatgatgtagttattgatgtcgaaggtttttcaggcagaccttatgacacattgattttgatggactatgtttatcatgtagttttgagagacacccacatttttcactatcagtacatgttcttatcaaatctttcttcttga

SEQ ID NO: 7582 - DNA, 1470 bp, Glycine max
  Peptide Sequence Number=SeqID_124360
atggcaaaccgtgccaaaaaccatcccatattggtttcaaaaatcggcatcataggagctggagtaagcggcatagcagctgcgaaacagctatcacaccataaccctattgtttttgaggcctcggattccattggtggagtttggagtcattgctcctataactcaaccaagcttcagtctcatcgtcgtgattatgaattcactgatttcccttggcctcaaagagacaatcctgattttcctacctatttggagatacttaattacttgcactcttatgctgagcactttgatgtgctcaagaacataaggttcaactccaaggtggtggaaatccgctacaccggcaaccgggaagtcactggctttggaagcctacttcctggtctgcctatgtgggaagttgctgtgcagaccaatcacttagacaccattcagtggtatgggttcgagttggttgtggtatgcgttggaaaatatggggacatagcaaggattccaacgtttccacagaagaaaggggcagaggtattcaagggaaaggtgatgcatacgctggattactgtaaacttgaccaggaagctgctactcaacttctcaaagggaaaaaggttgtggtcgtcggtttcaaaaagtcaggtcttgatttggccatggagtgtgctgaagcaaaccaaggacctgaaggacaaccttgcaccatggttgtaaggactttgcattggacagttccccattactggatttggggattgccatttttcttgttcttttcaacaagatcttctcagtttatccacgaaagaccaaaccagggcttactcagaacccttctatgcctcatgtgttccccactgctattacagaggcgtggaatttcaaagtttattgagtcctaccttttatggaaacttccattggacaagtatgggttaaaaccagaacacccctttgtggaagattatgcatcttgtcaaatggccatcatgccagaaaatttcttctctgaggctgaaaaaggcaaaattgtctttaagaaggcatcaaagtggtggttctggaatggggggattgaattggaagacaacactaagctgaacgctgatgtagtggttcttgcaactggttttgatggaaagaaaaagctcaaaaccattttacctgagcctttttgtagcctgttggagtacccttctggtattatgcctttatacaggggaactatccatccattgattccaaacatggcctttgtgggttttgttgagagtgtctcaaatctccactcgtcagagctacgctccatgtggctttctggactggtagatgaaaaattcaagctcccaagtattgagaccatgctttcacaaacacttaaggagatagaagtgatgaaaaggaagaaggactggatatctgaagtatttggaccctataatattgaagaatatgccaaagaagattga

SEQ ID NO: 7583 - DNA, 267 bp, Glycine max
  Peptide Sequence Number=SeqID_124361
atggctcaggaggaggggacttccatagatcaaatacttaagccatctcctgcaccagttcctgaggagacccagccatctacaccagtcacggagccagagcagcctatccaggattcatcagcagctccaacactagatcataatgaagatcagccacaagatgagcaggatgagagcatcatccataggaagtgcggttcaaagaaaatttgtcccaaatttgggggagtaattatcaaggaattaatgaagaattgggcttga

SEQ ID NO: 7584 - DNA, 237 bp, Glycine max
  Peptide Sequence Number=SeqID_124362
atggctgatgtaactagctcgcctgggcgagcaaggttacttttggaggaagcaccagctcgcctaggcgagctactgtgtaacctccacccgtcatttcctataaataggcatgagggggcagaggaaatgtgcaaagtactcaaaagaggggcaaaatggtcgctctggggacattttccaacccctaggctcactagaaagcttagggatgaagcaaccagctcgcctaggtga

SEQ ID NO: 7585 - DNA, 165 bp, Glycine max
  Peptide Sequence Number=SeqID_124363
atggcctttcattggaagcaattttgccttaggatagtgagtgttttgttgggaaccttaaatgaggcaacaagaaagaaccatagcttaggaaccaacatgagtcttcattcttcatctagtgttaatggtgagggttctactcctaaggaccccttgtattag

SEQ ID NO: 7586 - DNA, 171 bp, Glycine max
  Peptide Sequence Number=SeqID_124364
atgcagctttccgccattactataagcgaaacatcacgtggtagggacagcatggcatttcgccagtgggattggcaaaacaggcatggcatttcgccattggggttggcgaaacaagcacccatcacgtcatggcagcagtgggtttcgccggtggtattagcgaaatag

SEQ ID NO: 7587 - DNA, 330 bp, Glycine max
  Peptide Sequence Number=SeqID_124365
atggagaacttttacaagcagtttcatagtcctggggatataatagttcctcgaaagattccaaaggatgatgaacaagagaaaaatgatgaagttgaatctcaccaaagtaaaggtaccaaaatgaaagcttccaccaaacccacaagtggtactgctaataaggcaacaatttgttttactcagtctactaagacaacaccttctatggtgaaatcaaagaagattattttgatgatgccaaagactcaagtcaagaatcaagagtcaagcaagtttcaagaatcaaagagttgttcaatcaaagcaagtttcaagaatcaagattaa

SEQ ID NO: 7588 - DNA, 831 bp, Glycine max
  Peptide Sequence Number=SeqID_124366
atgaagtgtttctatttctcaaacggagaagacgaggattccgtggggggaggagcggcggcgagttcgcgcggcggctccacctcgcgcgtgtcgtgggctcgttcgctgagcctgatggacacgcgcagcagcagccgctcccacttcgactccgagtcgacggagttctccgacacggtggacttccaccacttcctggcgcagcgccgcgccaacgatctccgtctcttctccttctccgacctgaaatccgccacgcgcgccttcagccgcgccctcctcgtcggcgagggaggcttcggctccgtctaccgcggcttcctcgaccaaaacgacgtcgcgatcaagcagctgaaccgcaacggccaccaagggcacaaggagtggatcaacgaggtgaacctgttaggtgtcatgaagcaccctaatttggtgaagttggttgggtactgtgccgaagacgatgagagagggattcagaggcttttggtttacgagtttatgccgaataagagcttggaggatcatctccttgcaagagtgccatcgacgataatcccttggggaaccaggttgaggatcgcgcaggatgcggcgaggggtttggcgtatcttcatgaggaaatggattttcagaagaaaggttgcgtacaattatcctccctcgcaccttcgcgaaccaaggagcctctgcgaattaagtttgagagatggtttagatgcggaattaaacgagaacgtagcaagagcaaaggtacaattattaggtggggaaatttgcatctgggtgtaccaaatgtgcaaccaaactgggcagcaaatcattga

SEQ ID NO: 7589 - DNA, 273 bp, Glycine max
  Peptide Sequence Number=SeqID_124367
atgacgactaacagtaatcttggttcatattggaggttctctctcccgtggatgagatttgcacttcctaattggtcactccaagaaggattgtcccaagaaaaaggaaacacaaaggaattgggttatgaattctggatgtacatatcacatgttgcccttgaaggactacatcgaaaccttggagctcaaagaaggtggagtggtgcttctaggaaagaacaaattgtgcaaggtgcaaggtatgggttccattcggttgaagatgtttga

SEQ ID NO: 7590 - DNA, 1818 bp, Glycine max
  Peptide Sequence Number=SeqID_124368
atggatgtggcactcgtaactgtgaaatgttttactaaacatattaatgatccacgaaggaaggttactgtattgactaatgtggaatttttcccatcagaacagaacgaaaggagtaacacgaccataggagttccggtcaattggggagtgcgcatagccaaattggaaaccccgaacttcaagtttgaacatgagacgttggatttgaaagaacaaaaggtggatattagtcttcagagtttggggctacccttttgcgggaatctgtctgatgccacatcccaagtcagtctcagtaactgctcaacactgacacactcagctaccactctcctctctctagcttcagtaactagcttgccattttgctcaaactcaaagctcaataaatgtgcaaactttgaattgaaaacgtggaggaatcaatcaaggtggcgcaaagagaggagaagaggtggtagagagaaagtgatgggtcaggggctgagttgcagagggagccatgagcatggcctattccgtgctgtgcagcatggggacctagacactgttgcagctttgctacaaacacacccttctcttatgaaccacaccactgtctatgatcaccactctcctcttcatattgccgctgctaatggccagatccaggttttatcttggcttttggatggatctgtgaatccagatgtgttgaatcgccaaaagcagacaccgcttatgttggctgcaatgcacggaaagatcgcctgtgtggaaaagctccttgaagccggtgcaaatgtactaatgtttgatgcttgttacggaagaacctgcttgcactatgcagcttattatggtcattcttcttgtcttaaggcaattctttctgccgctcaatctagtccagtggctgcttcttgggggtttgctcggtttgtgaatattagagatggtagaggtgcaacacctttgcatttagcagctcgtcaaagacggcctgaatgtgtacatattctattgtacagtggagctcttgtttctgcttcaactggaagatatggatgtcctgggagcactcctcttcatcttgcagccaaagggggatctttggattgcatccgggaactattggcatggggtgcagatcgccttcaacgtgatgcttctgggcgaataccgtatgtagttgctctgaaacacagacatggagcatgtgcagcattgctgaatctttcgtctgctgagcctcttgtatggccatcatctttgaagataatcagtgagcttaatccagacgccaaagagttattagagcgggccctgatggatgcaaacagggaaagggagaaaaacatattgaaagggagtgattactctcttccatctccatcacattctgatggggtagatgacaatatctctgaggttagtgagacagaattatgctgcatctgctttgagcaagtgtgtacaattgaagtccaagactgtggtcaccagatgtgtgcacaatgcacactagccctgtgttgtcacaacaagcctaacccttgtacttcacgtgttatcccgccagtttgtccattctgcagaagcaccatagcaagattggtagttgtaaaaaaagaaagccctgatgacattgatcaagatggtgttgatatcacttgttccaagcatagcaagtcaaggaaatcacgaaactcaaacgagggtggtagcagcagcattaagggattatcaaatgtgaactcatttggaaaaatgggtggtcgcagctctggaaaaattgctgctgaaaatgagtgggaagatgataaacaacagtga

SEQ ID NO: 7591 - DNA, 108 bp, Glycine max
  Peptide Sequence Number=SeqID_124369
atggctcaacaggctctgatcgatatatacctgcgcccgcagaacaccaataccaatgatcctgttttatgtctccgtacgtatcgattactgagagatgtcatgtga

SEQ ID NO: 7592 - DNA, 2123 bp, Glycine max
  Peptide Sequence Number=SeqID_124370
tcattggtgaagctgatcaagtccagaaagggattgttgacttggttactgtgcataatgtcaggaagcttgttattggagcaataccagaaaattgcatgaaaatcaaaaggaattccagcaaagcaaattatgctgccaaaaatgctcccccattctgtgaaatatggtttgtctataatggtaagcacatttggacaagagaagcttccgaaacacctcgttctttgtcttcacgtgcccaacctgagactacaactgcagagagtttgagttgcagatcttttcatgatggtacgaaagaattgttacattcagaatgtcttcaattaaattctacaaagactacaagaagtatggttcagagtgaaatcattgaagcagaagctactttttcatccaaatcatccagttgtaatagtcattgttctccccaacattcggccggttggtatttagatactcattcagagtttgaggaagaaacaattgatagtcaacttattgaaaccaagagagaagctaaggctgcaacagacaaggccctagcagagctgttgaagagcaaaaggttggaagtcaaagccattgaagccattagtaagtcttttgctgttttttctcaagacttctgttccaacacaagtaacatgtactttcttcaggtcaacttttttgagtctgcccatgcacatgaagtaaagctcagaaaagaggctgaggatgcactaagagctacaatacaggagcaacagatgttcttggatgagaaagaagaaattgctagggagttggaaaggactgtgagaagtatttcccttctaggcaattgtgcacatgaaaccaaccataagcgagatgaagctgaaaatgaactatcactaattcaagcatccatctcaaacctgtggcatgaaaagcagcaaatcaggcagcagaaaatggaagccctacactggcttgagcggtggaaaagttgcggacaagttggagcagatcactgcaatggagtcattgggtttgctgaagaattccctgagcttgccgaattttcattatcagatcttcaaaatgccacatgcaatttttctgagagtttcaaagttatggagggtggatatggttctatttataagggggaaatgttgggtagaacagttgctataaggaagctccatccacacaacatgcaaggatcatcagagtttcatcaagaggctcaaattcttggtagtctccaacaccctcatctggttactttgcttggtgtttgccctgaagcctggtcatttgtatatgagtacttgcccagtggaagtctccaagattatctattccgaaaaagcagttttctgccattgactaggaacatccgagcacaatggattgccgaaattgctacagctctctgcttcttgcattcttcaaaacctgaaactattatccacggtggtctgactcttgaaactgtccttctggactctgcacttagttgcaagatatgtgaatttgggttcagcaggctggtgaaagaggagtcagtttatcttcctaacttccacttcagcactgagccaaagggttcttttacatatacagatcctgaatttcagagaactggagtactgacacctaagtctgacatatactcttttggaatcatcattttgcaactcctcactggtaggactccagttggattagtgggtgaagtacggagagcagtttcttgtggaaaattgtatccaattttggattcttcagctggagaatggaattccaccatggcaacacgattggctgaactaggattgcaatgctgccaactgaacagtagagtcagaccagagttaacaccttctctagtgagagaattgaagcagttgcttgttttagaagagcgacctgtaccatcttttttcttgtgtccaatctttcaggaaataatgcatgatcctcaagttgcagcagacggatttacttatgaagggaaggccataagtgaatggctggaaaatggacatgaaacttctcctatgactaatttaaaattgactcacctgaatctcactcccaatcatgcacttcgacttgctatccaaggctggctttgcaaatcttga

SEQ ID NO: 7593 - DNA, 171 bp, Glycine max
  Peptide Sequence Number=SeqID_124371
atgtccatagcgttgaacaaaactaacagcagcaaaatgagcacacccttgttccatgaattcaaaaagcaagcttctttcttcttcaaggagaaaattaagactgctagattagctctaacagatgtcacccctgcagaacttgatcacccttcaatttttgtttcataa

SEQ ID NO: 7594 - DNA, 333 bp, Glycine max
  Peptide Sequence Number=SeqID_124372
atgatagttaaccaacaagtgaaggtacctttctccattgggacatataaggatgaagttaattgtgatatagttcccatggaggcaggacatattcttttaggaaggccgtggcaatttgataggaagatcatttacaatggcctaactaatgagattaccctcacccatcttggcactaaatttgtgttgcatcctcaaacaccttcacaggtggccagagatcaactaactatgaaagataagagggatgaggaagaaaaaaacatgaaaatacaaaaaaaaagtccttactacaaagactactcaaaatgccccgaaatacaaggctaa

SEQ ID NO: 7595 - DNA, 1314 bp, Glycine max
  Peptide Sequence Number=SeqID_124373
atggttttcaagtacagcaagcactgtagagtctgcgacaagtgtgtagatcactttgaccatcattgtcgatggcttaacaactgtatagggaaaaagaactatcgacaatttttcaccctcatggttgctgctatgctcttgtttattcttcaatggctgactgggatacttgtgcttatctgctgttttgtcaaaaggaagcaattttctgtggatatctcctccaagttgggaaccagtttctctatggttccctttgttattgtggtgtctatctgcaccattctggctatgattgctaccttaccggttgttcagcttttcttctttcatatcctcctcattaaaaagggactcagcacatatgattacatcatagcaatgagggagcaagagcaggagcagctaggaaatggaggtcagcaaagtccccagatgtcaactgttagctcatttactggattgagtagtgcaagctcctttactactttacaccgaggtgcatggtgcacacccccacgtctgctgcttgaagatcagtttgatgttgtgcccccagaaacaggttctgtaagttcactgggaaagaagacaacgagagaagatccattaaagaaaaagaatcctggaactgtcaaaattagtccttggacattggcacgcttaaatgcagaagaaatttctaaggcagcttcagaagcaagaaaaaaatccaaagttctgcagcctgtaacaagacatggtgaggctatcagtttagaactggaaaacagttttggtagcagtggccgaagaatggttcccaggattgagggcaataagaaacgagcaagtaagcgggttcatcatcctgctgacttgtctatggagtccctgacaaaagtttcgtctagtaatactgataaagccttgagtgggatgtctaggttggctcctctccctattgaagcgtgcagcacatttcaaacaagtcaagcaatgtcaagctcagctgggattgttccttcatctcctgaaagtagtttagactctcctgatatccacccttttggggtgtcttcatcaagtgctgaaaaggcaagacagcttgcaggtccttcagctgctggtgctgcaactctgaaggaaattccgctgtcaagttcaactagtgatggatatgaggcttctggcggagaagacagtgaccgggttgacccaagtaggattgttcagagatctacaaattggactaatcttcttttcagagctgatcaggatgacaaggcttttaaaatgtctctttcatcaaccagtgttggttatagatag

SEQ ID NO: 7596 - DNA, 210 bp, Glycine max
  Peptide Sequence Number=SeqID_124374
atgaggaaacatgggtggcagttaccttaccatcctcttcaggtggtggctgctgctgtgtttctggctctggggtttgccttctatgtgttctttgctccttttgttggagagaagatgtatcagtacattgttattggcctttactcaccactgattcatgagtttgatttcttttttgtgaatctgagttttgtttccagttcatga

SEQ ID NO: 7597 - DNA, 2155 bp, Glycine max
  Peptide Sequence Number=SeqID_124375
atgggaaacggcatagggaagctaacggtgtgcttcaccggaaacggaggagggggtcgtcgaaagcaggatatatctattttaataacggagccgttagacgagggtttgggtcactctttctgctatgttagacccgacccgacccggatttcttcgtcgaaggtccactcggaggaaacgacgacgttcagaacaatctcgggcgcgtcggtgagcgcaaacacgtcgacgccgttatcgacggcgtttgtggatttgtactcgtacggttgcatcgacagagccgcggcgtttgagagttcaacgtcgttcgcggcgttaccacttcagccgattccgaggaccctcgtgaactcgggcccgttctcggggaacctgaacggcggtgggtttcccggctcgggcccactggagagagggttcatgtcgggcccaatcgagcgcgggttcatgtccgggcccatcgatcgcgggcttttttcgggcccgattgagagggaagggaacggaatcggaaacggatcggatcattttcagagaagcttctcgcacggagggttgggtttggggttgggtatgagagtgggaacgaggaagggtaagtggattcgcgttttgcagagggctatttccaagactctgtctcgggggcacaattcaattgtggctccgatcaagggcgtggtggtgaaggagccggagtggatggtggcagcggcggcggcagcggcggagaagcataacgagaatctgagcgtgaatttgagtagcgaggggagtttggaggactatgattcgatggagagtcagaatcttcaatgggcgcaggggaaagcaggggaggatcgtgttcatgttgtggtgtctgaggaacacggttgggttttcgtggggatctatgatggtttcagtggacctgatgcacctgattaccttctctccaatctctacaccgcggtgcataaggagcttaaagggttgttgtgggatgacgggtctgcaccggaaaattcaacgataaaagaggacatgttgcgagatgttactgcagatgttacggttactgatgaagatgatgcttgttctcactgtgttgagcaagataataatgataataatagaaagagcagtaataagagaggtaggaattcgaggaataagttcaagggtgctgcgaagaaatgggaggagaatcaacggaggtggaagtgtgagtgggatagggaaagattggagcttgatcggagattgaaggagcaactgaatttaagtcgatctgggtcgggtggagcagcgagttcaattaatcattcagatgttttggaggctctttctcgggctttaaagaagactgaggagtcttatctcgatgtggcggataagatggtgatggagaatcctgaattggctttgatgggttcgtgtgttcttgtgatgttgatgaagggggaggatgtttatgtgatgaatgtaggggatagtcgagctgtgctggctcagaaggctgagcctgattactggcttggcaagatcaggcaggacttggagaggatcaatgaggagacgatgaatgatcttgagtcttgggatgttgatacgtccaacttggtaccgagtttgagcgcgattcagcttaccaaggatcatagtactagtgttgaggaagaaatccagagaattaaaaaagagcacccggatgatccttttgctgttgtaaatgaccgtgtgaagggttctctcaaagttactcgagcatttggtgccggatttctcaaacagccaaagtggaacaacgcacttctggagatgtttagaatagactacgtaggaaactctccttacataagctgcctaccatatctaaaacaccacagattaggcccaaaggacaaatttttgattctatgctctgatgggctctatcagtacttgtcaaacgaagaggcagtggctgaagtcgagcttttcatcacattgcaacccgagggagacccggctcagcatttggttgaagaagtgttgtttcgtgctgcaaagaaagctggtttggactttcacgagttgctcgaaattccacagggtgataggcgccgttaccatgatgatgtttccatcattgttatttctttggagggaaggatatggagattct

SEQ ID NO: 7598 - DNA, 396 bp, Glycine max
  Peptide Sequence Number=SeqID_124376
atggacaagagcatgttagcggatttggattcgcttcctgaggctgataagcaaagaatgactgtcatgatcgatcagctccaaattcgtgacagatttcggggcttcatactatcccatatagtgaagttccccttaaaaccagcgcaacatctgaatgttgcttctggacgttttgggaacaacattttgttaaaagagaagcctagtctgagaatgtataattcactggttgagagatgcttcagtgattgtgttgacacatttaagcataaatccctgcaaaagcaagaggaaacctgtgttcgaagatgtgcagagaaatttctgaagcattctatgcgggttggcatgaggtttgccgagctcaaccaaggagctgcaacacaagattga

SEQ ID NO: 7599 - DNA, 882 bp, Glycine max
  Peptide Sequence Number=SeqID_124377
atgacttatttcttctcaaaggttgtcggcaccataggttatgctgcacctgagtatgttcagactggtaagctaactgctaagagtgatgtgtggagctttggtgtagttctttatgagcttatcactgggaggagagctgtagagagaaacctaccaaaaaatgagcaaaagcttttggaatgggtaagaccttatgtttctgatcctaggaagttctatcgtattgtagacccccgacttgagggacaatactgcatcaaatcagctcataaacttgcaattctagcaaacaagtgcatcatgaagcagccaaagtcccgtccaaaaatgagcgaggtggttgagtctcttggaagcattattaatgagattgttcctcaggatgaacaaatcccccaagctgctgtagtagcaattggagaagaaaaagaagaaaagttatctgtagagaacactaaacctgaaccttcagctaaacaagggaactattacctgaagaaggtttttgaattgaaagatattgtcagcttaagaaataagtctattggaaggttagattggaaaagttgggcacctgggctattttcagtcagtgaaatcaacattgtcaggcacacagttaacaacaagctgctatactcgcttgagtctttcaacttgcagcacttgaagcaccgtgttgttgtcgatgcgcttgcggatgaactcggaggcgcagccgttatcggcgacgatggtggcggtgagatcctgccgttgaggaccttgcggtgcatctggtccgcggcgttgcgggcattgtggcgggacacaaactcgatcaaaaaggtcacactgcggctgaggcacacacccttggaaacccagaatccgttttga

SEQ ID NO: 7600 - DNA, 1346 bp, Glycine max
  Peptide Sequence Number=SeqID_124378
ggttaaattcaaagcatgttagtgccgatgcaaaagatcacagcagtccaattagcaataaaattacaaaagatgtcagcacaccaatcagtaaagtctcagaggtatcagtgcctcagactcctcggattgagggtgagatcttgcagtcatccaatctgaagaactttagtttgacagaactcacagctgccacaagaaatttccgtaaagacagtgttttaggaggagaaggtgattttggatcagttttcaagggctggattgataatcaatcactggctgctgccaaacctggcactggcgttgttgttgcagtgaaaagacttagtctggatagcttccaagatgaagaccgacttctggtctatgaatttatgcctcgtggtagcttggagtatcacttgttcatgagaggctcgtattttcaacctctttcttggggtctccgtttgaaagttgctcttggcgctgccaaagggcttgcatttcttcacagtgctgaaacaaaagtgatataccgagatttcaagacctcaaatgtcttgctggattcaaattataatgcaaagcttgctgatttggggctggcaaaggacagaccaacacgtgagaaaagtcatgtctccaccagggtaatgggaacctatggatatgcagctcctgaatatcaaaccacaggaaatctgagtgccaagagtgatgtcttcagttttggagtagtcctgctggaaatgttatctggcaggagggctgtggacaagaatagaccatcaggacaacacaatttggtggaatgggccaaaccatacttagccaacaaacacaaacttttgcgtgtgttggataatcgccttgaaggccaatatgcattagatgaggcatgtaaggtggctaccctctctctgcgatgccttgcaacagaatccaagttgagaccaaccatggacgaggttgtcacggatttggagcagctgcaggttccccatgtgaatcaaaatcgttctgtgaatgcctctcgcggtcgtagaaaaagtgctgatgattttactcatggtagaatcgccacagcttctgtttccccgctctcacatgacattgcaaatacacggtgtgtgcctcagccgcagtgtgacctttttgatcgagtttgtgtcccgccacaatgcccgcaacgccgcggaccagatgcaccgcaaggtcctcaacggcaggatctcaccgccaccatcgtcgccgataacggctgcgcctccgagttcatccgcaagcgcatcgacaacaacacggtgcttcaagtgctccaattacgtcaaaatgcatacaatgaaattgatgctgcataa

SEQ ID NO: 7601 - DNA, 399 bp, Glycine max
  Peptide Sequence Number=SeqID_124379
atggatacagaattcaaaacaattgaggcaagcataatgtctatgcttggccaactccaatctgagggtggcatcctacaaagaatggtatacaagaataagaaccagcaccgacgcggttcctatttccagcgtcttttgaaggtaaggagggatttaaggctgctgcaattggcaaacttggaggagcttgtaacatcatgtttgcttgttatcaaagaagatagaccaaaacagaagcttcatcttttagagagcttaaaaaggagaaaatgtcataatgaaaagcataattttatggagcgtctgttaggtgttgcacacttactagtagagatggttgaaccaatactgaaggctgcatcatatccttctgcttctgctaatagtctaatttga

SEQ ID NO: 7602 - DNA, 1080 bp, Glycine max
  Peptide Sequence Number=SeqID_124380
atgtcacttcttaaccagctctttaacagaggcgttttcggcactcgatgcaaaacatgcctgaacctggcaatttcacgcattaagctgctgcaaaacaagagagatatgcaactgaaacaaatgtgcaaggagattagccaattcttgcaggctggccaagaggcaattgctagaatcagggtggagcatatcatacgggaacaaaatacatgggctgcatatgaaattttggagttgttctgtgaatttgttcttgcacgtgtacctataattgagaatcagagggagtgccccacggaattgcgagaagccattgcaagtataatttttgctgctcctagatgttcagatgtaccagacttattgcacatcaagaacttgtttaccactaaatatgggaaagaatttgtctctgcagtatctgaacttcgtcctgattcgggcgtgaaccgcacgatcattgaaaagctttcagttagtgctccatctggagaggtaaaactcaaggtcttgagggagatcgcagaagaatacaatatagcatgggattcttctaaaactgaggctgaatttaggaaaaaccatgaagatctcctgatattcaacaaagtttacatcggttgtcgattgcctacacaaccttcaccttttatctgggctcgggactatgtaaagattttcaacaaagaacaacataggcagggtggagcaaagcaagttagtgctggagctacgctttctcatactcccagcagaaatggttctaataatccatcaccttgtattacggaaccttctatcaagcctgtgcaagacaagcaagaatataaacaccttgaagctccgagcccttctaacaataattcttcgttggatactaatgaaatcgaacagtcacacaaaaacaataatgttcccgctggagatgctaaaagtgagacaagatttcaatcctctgatgtactggagaaggcacgggctgccattgcttctgcggatcgcgcatctgcagctgctcgtgctgctgctgcactagttcagagtaattttggatcattgaagctggaaggtaaataa

SEQ ID NO: 7603 - DNA, 375 bp, Glycine max
  Peptide Sequence Number=SeqID_124381
atgatcttccctgtgactgcgagatctgcttcgtctccgtcttcgcaacattgtgcttgcaaggttgatggttatggtgaggaaattgattggaaggaggagggtttgagtgatgggtctgtggttgaaacgttgaggttgttgttgatgggaggggaatctttgatactggggtcaaagctggtgctagttgcttttaggagtgatctcatgttgaacaacaaggtgattgaaatgtatgggaattgtaaaagcacgattgatgcacatagggtgttcgatcatatgcccaacaggaatatggattattggcacttgatgatgcacgactttgcaaataacaccaatggagatgatgccttgtatagttgttga

SEQ ID NO: 7604 - DNA, 3099 bp, Glycine max
  Peptide Sequence Number=SeqID_124382
atggttcagatcgcgaggaggaagaagggacggccgtcgaaggcggatctggctcgtcgctccggcgagtctcaatccgatccccggcggagcctccggcgccggagcgtgaggtacaacatcatcgattacgacggagattaccttgacgacgacgacgaggacgagaggaggcgcgagaagaagaagctcaagctcatggcgaagttgaaccaggacggcggagaagaagaagaagaggaagagcgggaagaagaagaaaacgaaactgcaccgcaccacactcgtgccgagtcgcgtgaggagcacgcgccggtagaagaatacgacgacgacgaaaaagaacaagaggaagagaacgaaaacgaacaagaggaagagaacgaagaagacgaagaaagtgtggtaaagggcagaaaagtggaatcgaaagggctccactctgtttctgcttcaggagctccagtgattcttcaatctggaattccgttgcctgataagaggactctggaattgatccttgacaagcttcagaatttaactgtttatggtgatgagcaagagggtgaatgtttttgtgtgctattttgttttctgacttgggactattgtgggggtgtggatgatggcaggaaggacacttatggtgtgtttgcggaccctgttgatccagaagagcttcctgattatcacgatgtgatcgagcatcccatggactttgccactgtaaggaagaacttggcaaatggatcttataccaccttagagcaatttgagagtgatgtatttttaatttgctcaaatgcaatgcaatacaatgcaccggagactatataccacaaacaggcgcgatcaatacaagaacttggacggaagaaatttgagaagttaaggattggctttgagcactctcagattgaactgaaatcagaacaaaaagcaggatccaattatttggttaagaagcagccaaagaagccattggcacgtgcctcacaagaacctgttggctctgatttctcctcaggggcaactcttgctactattgcagatgtacagccaacttcccatctgatgcaaggtggtagatgtgagaggtctggcaatcttgatggtattttggaggcaaatgctttctggattgatgcaaatcaagagaaagctgaagatgttttgttagggaaaggtcttctctctaagtggggaaggaagtcctttgcgcttgatgaaagtcgtcgtgcatcttacaatatgtccaaccaaccaattgttaaaccagattcaatatttatgacctttgagagaggaatgaagcatctggttactgttggacttcatgcagaatattcctatgctaggagtttggcccgttttagtgcatctctaggacctattgcttggaaaattgcttcccacaggattcaacacgcactgccagctggatgtaaatttggtcgtggttgggttggagagtatgaaccgctttctaccccaatattaatggttaataatcgtgtccaaaaagaaaatagtttggttatgaagttgcattccactactgaattaccaaagggtaaccaaaattgtaagaatgtggaatccagcatcatgcatcctgtaaatggacagatgcttgagggaaaacgtccttcaatgcctgatttcaaaggaaaacctttatttggttctgctggagtaaggctcagtgctcctgtcaacatcctcaatcaggagcagaacgcccaatccaggaaattaggcaagtgtgagaataagggtttgaaacaattggagttgaattctttaacctcaagtaatcagaataataatggtctggttgcaaagtttacaagtaatgcttctacagctaatgctcctgcagtagagtccaagcccagagagatggtgccaaggaacatgttcaaacagcccgatactaatggagttattagtggagagttgcctaatggaaaagtcacgaatacaagtttgaatagacaggtgactggttcatcatcacctgaaagtacatcgaatcaatcaagaagagctgctcctggtgttgtccatgggcaggagcagggtcttagcgacccaggtcagttgatgagaatgttcgcagaaagggctcaaaagcaacacacttccaatcattcgcatgttgatactccgccagtgacactatcaggtccatctggacagagaaatgactcgggcaatgcttcagcaacagctgcccatgcatggatgtctgttggggcaggagggtttaaacaaggacctgacaattctagttcacccaaaaatcagatatctgcagattctttgtacaactcaacaagagagttgcatcagcagatttcaaaaattcagggggagtttccccctggtgaaatgcctttccaaccatttcaagcagttgctcctcaacctattcacacaggcgctgtttcacagtttcccaaccggcctatggttttccctcagttagaatctgctgaccaagctagctttcaaatgagaatgtttgcagaaagggctcaaaagcaacacacttcttccaatcattcgcttgttgatactctgccagtgacattatcaggtccatctgaacagagaaatgactcgggcaatgcttcagcaacagctgcccatgcatggatgtctgttggggctggagggtttaaacaaggacccgataattctagttcacccaaaaataagatatctgtagaatctttgtacaactcaacaagagagttgcatcagcatatttcaagaattcggggggagtttccctctggtggaatgcctttccaaccatttcaagcagttgctcctcaacctattcagacaggcactgtttcccagtttcccaaccggcctatggttttccctcagttagcatctgccgatcaatctagatttcaaatgcagcccccttggcgaggtcttagtcctcgtagccagtcaaggcagaaacaggaaacccttccacctgacttgaatattgattttgaatcaccagggtcacctgtaaaacaatcttctggtgtccttgttgactcacagcaaccagacctagctttgcaactgtga

SEQ ID NO: 7605 - DNA, 600 bp, Glycine max
  Peptide Sequence Number=SeqID_124383
atggaaattttctcgcttttattcgaaaggattaatctgctaagacacaatcaaggcttacacggaagggcttcgatcaccgagcgggataagtcaagatatgtggatatcacagaggcagatgacttgccgaggaatgagtttgcaaacatagctttatatgtgcaagcagtctcagaatcgtcatatttcatttatgaaattgaaactagggagaagaatcaggtcattcatatggatgaagctcattatttttcttctgataggaaatttggtttttccatgaagaataatgaggcatattcttcaggtcaaggaaaaggatttgatgaagatttaattaagttgatatcagatgctgtaagtatccctgttattgcaagtagcggtgctggtgctcctcaacacttctctgaggtgttctataaaacaaatgaaacagtagcacttgctgccggcatttttcacagggaaagcggtattgcttctgttttggcagtgaaatcgagttttctattaattgcaagtgcctattcagttggtaaaagagcatttgttgaaggaaggcatagaagttggaatttgatcatgagcatttaa

SEQ ID NO: 7606 - DNA, 2383 bp, Glycine max
  Peptide Sequence Number=SeqID_124384
atgcagaaattgcaagaaattgcagtgtccttggctgttgattatttgcttccacccttaaagaaagcagtgaattcagtcatggaggttccaaaagatgctgcagacatgaacgacaaacttgatgggattcaagccatgattcatgatgtcgacaagatggcagcagctgaagaaggcaactcacgtgatggtctcaaagcaaaggtgaagcagctggtggaaacatctttttgcatggaagatatcgttgatgaatacattatccatgaggaaaggcagcttgctgatgatcctggatgtgcatctttaccttgtaaggctattgatttcgtcaaaactacggcctctcgtcttcaatttgcatacatgaaccaggacgtgaaatcagaatttcgtgggatcaaggagaggaacaaaactgaggattgctcccaaattcaatcttctggaggaaaccaaaacatcaccttcgacaaccttcgaatggctcctctgtttcttaaggaggctgaggttgtgggctttgaccgccctagacacacattggaaagatggttgaaagaggggcggaaaaagctcactgttgtctctgtggtaggaatgggaggaagtggaaaaactactcttgccaagaaagtttttgacaaagtccagacacacttccctcgccatgtctggatcacagtgtctcagtcatacaccatagaagggttgttgctcaagtttctagaagcagaaaaaagagaggattctacaatggataaagcatcgttgatacgtgaggtgagaaatcacttgagccacaataggtatgttgtcgtgtttgatgacgtgtggaatgaaaatttttgggaggaaatgaaatttgctttagttgatgttgaaaatggaagtaggataataatcacaaccaggcaccgtgaggttgcagagtcttgtaggacatcttctcttgttcaagtgcatcagttgcaacctttaactgatgacaaatctttcgaattgttttgtaaaacggcatttggatctgaattagatgggcattgtccaaacaatcttaagggcatatcaactgaaattgttaaaaagtgtgaaggtttaccactagctattgtggccactggtggccttttatctcgcaaaagtagagatgcccgtgaatggcaaagatttagtgagaatctaagttcagaattaggaaagcatcccaaattaactcccgtgacaaagattttgggtttaagttattatgatttgccttaccatctcaaaccatgcttcttgtatttcggaatatatccggaagattatgaagttgagtgcgggagattgattctacaatgggtagctgaggggtttgtcaaatctgatgaagcggcacaaactttagaagaagtggcagaaaaatatttgaatgagttgatccaaagaagtttggttcaagtatcttcatttacaaagtttggcaaaattaaaaggtgtcgtgttcatgacgtagtacgtgaaatgatccgcgagaagaatcaagatttaagcttttgccattctgctagtgagcgtgggaacttgtccagaagtgggatgattcgtcgcctaacaatagcatctggttccaacaatttgacgggaagtgttgaaagctcgaacattcgatcacttcatgttttcagtgatgaagaattgtcagaatccttggtaaagagtatgcctacaaagtacaggctattaagggtgcttcaatttgcaggtgctccaatggacgattttccgcgcatcgaaagtttgggggacttatcatttttgaggtacttaagcttcagaaggtcaagcatagtccatcttccaaaattaattggtgagctgcacaaccttgaaacattggatctaagagaaacttatgtgcgtgtgatgccaagggagatctacaagcttaaaaagttaagacaccttctgagagattttgaagggtttgaaatggatggtggcattggagatctaacatccctacaaacactacgtagagtgaacatcagccataatacagaagaagtagtaaaagggttggaaaaacttacacaattaagggtgttgggcttgacacaagttgagccaagattcaaaagttttctgtgctccttgataaacaagatgcaacacctggagaagttatatattactgcaagtcatagtgggaacatggatttgcattttgatgtatttgcacctgtacttcagaaggttcgtcttatggggcggttaaagaagttcccaaactgggttgccaagctccaaaatcttgttacgttgtccttgtcattcaccgagttgacacatgatccattgccactacttaaagatctaccaaatttgacgcacctta

SEQ ID NO: 7607 - DNA, 633 bp, Glycine max
  Peptide Sequence Number=SeqID_124385
atgatgaagagaaaacctaattatataaaagctctatcgaagagaactttgtcgtactcaggccctgttcaaggtgtgtggcggtgctttcgtatcatacgaactgatgaaggagattgtgtagagggaaaagtagtgtttggagaggataaaattggatgggtagcggaagaggaggaattagatacaatgtgtatggactcattacatggtgcaacaagatcttggagccagccatggttgctctttataatccagttcaacctggagcttctgctctcctatccagaatttttcttggaagtccaatttacatgggaaggtagcagcaaagtaagtgttgcaataggcgctagtataggagcagttgtagcccttgttgtcattcttggatgtgtgtactttgtggtgcaaagaaggagaaaaactgcttataataaacaaagaagcatggaactattcattgctccttcaaacggagacacttttgcatctacaactaacacatctcaaagtctatcttcttaccaatcctccaacactgatccaatgccaccgagcagtgactacttaggcgtccaggtctttacctatgaggaactagaggaagctaccaaaaactttgactcttga

SEQ ID NO: 7608 - DNA, 270 bp, Glycine max
  Peptide Sequence Number=SeqID_124386
atggttttgaccaccacctcctgcctctacacgtggcttgtcgctgctagcatgttcatcactgagggtttcaagaattttagtttggtaaaaggagttgttgtggaggtgaatcacggtggtggcgagcggaggaggagtttgcggtatgattctagtggattagagatgtacggtgattacagtaaagagctctctatgactacgctcgatttttcagagattatagggtttaatcatcagatcgaagagtcgaaagagagcggtgaa

SEQ ID NO: 7609 - DNA, 522 bp, Glycine max
  Peptide Sequence Number=SeqID_124387
atggccaagtgcaatattcatggaagaggtgaggcttgttatagcaaaatgcttgagaaggctaaagagaagatcacaaaactgaaggtcaaggacaatggcagtgaagagggtggcttggcgagactcagcttgggggtcaagggcaatggcagtgacgagggtaggcttgcgagactgagcgcgggcagtgaaaaaggctattttgatgatgccaaagaatcaagagttaagcaaagattcaataatcaagtttcaagtttcaagattcaagattcaagattcaagaatcaaggtacatcctttgtggtacaagtagagggtacatctacttgggttgttgtaattgagaataagagatggtacatctcttgtggatcagttcaagtggagggtacatccacttggttgttcaaagagaacaagggaaggtacatcccttgtggatctttgcatgtaaaggcttttacaaggttgaaaagaaatctcaaggaccgcaggtcgcttggggactggatgtag

SEQ ID NO: 7610 - DNA, 375 bp, Glycine max
  Peptide Sequence Number=SeqID_124388
atggcctctggtaatcgattaccaagggagtgtaatcgattaccaggcttaaaaaacgagatcaggaagttaagagggcttctgatcgtgatggcggcgcacgtaatccatgatcgagtggagatggagtgcctagagggagcttgggagaccctcgaaggcaatgcaaggtgccgatttcggggcacgattcgattcacggctacttcattggtgcatccagaggaacccgcgcgcatgcttcagtgcactgtggagtggatactacccacccctacaccatatcgtctagtagagacagtccaagtgatcgaggtgtcgtcttccgaggaagaccctgaggaggaccctgaagagctacctcctgagcctgct

SEQ ID NO: 7611 - DNA, 324 bp, Glycine max
  Peptide Sequence Number=SeqID_124389
atgtatgcagcggggaattctgatatctatggattcctcgagccattagtccattcagaggttccactgcagcggacactggcagatggtggtcatcttgcccaaggaacacttagttgtctgggtcttaatgatgctccacatcctaaatcaaaggctcctgctaggtggattgtcatcaagatgtccaccatcattttaggaacttttagaaataattgggaagcgtattttaacgatcctagaccattggagcctgagagaattaaagcattgcggatccagttgacacagttttatctccgagttagagatcaagcctag

SEQ ID NO: 7612 - DNA, 1224 bp, Glycine max
  Peptide Sequence Number=SeqID_124390
atggagggtatggcaattagtgatgatgcaagcaatggtgaaaatggattcctggcaatgtttggtggcgatgaaagtggtggtggtggcagtggcggtgtcggtagcggtggtgatcagggtggtggtaatgtggaggatgtggctctgaagaaggggaattggaatgcagttcagaggaacacagggttgaatagatgtggcaagagttgtaggcttagatgggctaaccatttgaggcccaatttgaagaagggtgcattctcacctgaggaagagaagctcattgttgatcttcatgcacagtttgggaacaaatgggccagaatggctgctttgttgcctgggagaacaaacaatgaaatcaagaactattggaacacagggatcaaacgccgccaaaggcagggtctccctctctattcagatgagcatgatcaacacaatcgttccacaacaccaacccctccaaccacacctttcccatgcctcaccccaacaggatcaaaccccgacattgccacaagttttgagttgttcaatcaaaaccaacaacaacatcatcaacaacaacaacaataccaataccaacaacaacaacaataccaacaacaccctctgtctccaactgcatctcatcattcccctcttagttcccctctccaacatagacaacccttcacctcttcatcacctcacaatttcttagaccattcacctcttccactctcctcatcctattcaccttcccctctctccttcaccttccaaagaccagcaccaatgctaagcacccctcttcgcttcaagcgctattgcgcctctccaagctacaacaacaacaacaacaacaacaacctctctgaccctcctctcaccacccaattccctcaccttgatggattcaggttccctgtttcttcaggcttctctcagttttttcagccctctttgttagactccgatcgaggcgtttcttcttcctcctcctctttggctttccaacccaagttggagctccctttaagccagtactataaaccatcccaagagcaagacattaaacttgacattgagttcaatgatccttcttttcaaagtagtagtagtggcttgatgggggatcttctcttcgaggctcaggcaatggcttcgggcaagaactcaaagaaacgaggctacttgagtttgaatgagggaaataatgtgtttaatgcatgctga

SEQ ID NO: 7613 - DNA, 342 bp, Glycine max
  Peptide Sequence Number=SeqID_124391
atgaagatagttaatgggaaacgagaaggccggccagttggtgcttatgaactagcaaaagcagttgaagagtttggcgccggtgaaatactacgtaattgcattgattgcgatggtcaaggaaaaggatttgatgtagatttaattaaattgatatcagatgctgtaagtatccctgttattgcaagtagcggtgctggtgctcctcaacacttctctgaggtgttctataaaacaaatgaaacagtagcacttgctgccggcatttttcacaggaaagcggtgcctattcagtcggtaaaagagcatttgttgaaggaaggcatagaagttcaaatttga

SEQ ID NO: 7614 - DNA, 219 bp, Glycine max
  Peptide Sequence Number=SeqID_124392
atggtttatatggaagacgattatgtgaggaagatgtcagatgaagtggatatagaggtttttgctactcgagatgaactattgaaatgggcttgggatgttgcatttgaaatggattttgttgttgttattttgaggtcagatacatcaaaaggacaacttggacgaaagacatttgttgtgtctgtgaaaggggtgaaaagtataggtgatacataa

SEQ ID NO: 7615 - DNA, 1060 bp, Glycine max
  Peptide Sequence Number=SeqID_124393
gtacttaagcttatgttcgaagatagtccatcttccaaaattaattggtgagctgcacaaccttgaaacattggatctaagagaaacttatgtgcatgtgatgccaagggagatctacaagcttaaaaagttaagacaccttctgagtgattttgaagggcttaaaatggatggtggcattggagatctaacatccctacaaacactacgtagagtgaacatcagccataatacagaagaagtagtaaaagggttggaaaaacttacacaattaagggtgttgggcttgacacaagttgagccaagattcaaaagttttctgtgctccttgataaacaagatgcaacacctggagaagttatatattactacaacaagttatcgtacgaagatggatttgcattttgatgtattggcacctgtacttcagaaggttcgtcttatggggcggttaaagaagttcccaaactgggttgccaagctccaaaatcttgttacgttgtccttgtcattcaccgacttgacacatgatccattgccactacttaaagatctaccaaatttgacgcaccttagtatactccttcatgcatacaatagtgaagttgtgcagtttccaaacagggggtttccaaacctaaagcaaatactactggcagatttgtatcaattgaaatccatcgtaattgaagatggagcattgccttctctcgaaaagctcaagttattcaggattcgcgaactgacagaggtgcctcgtggtattgacaagttaccaaagcttaaggagagttggagcttgatggagggtatggcaaacattagtgatgatgcaagcaatggtgaaaatggattcctagcaatgtttggtggcgatgaaagcggtggtgggggcagtggcggtgtcggtagcggtggtgatcagggtggtggtaatgtggaggatgtggctctgaagaagggtccttggacaactgcagaggatgttatcctcatggattatgtgacaaaaaatggtgaagggaattggatgcagttcagaggaaacagggttgaatag

SEQ ID NO: 7616 - DNA, 276 bp, Glycine max
  Peptide Sequence Number=SeqID_124394
atgggagatgtccaaccagtgataccaaacatgggagatgtccaatcagtgataccagacatgggagatgtgtcagagtcaagacatctgtgtaggactgttgaacccttgcaagagatgatctacttaaagatggtggttgagggcaccatgcaatgggagaaggttgaagcgacacttttgttgttgtctaaaggtactcatggtagaaatattagtagaggacaaggtggcagaagagttcggggtagctggggaggccgtggacgaccttag

SEQ ID NO: 7617 - DNA, 237 bp, Glycine max
  Peptide Sequence Number=SeqID_124395
atgaagatagttagtcatttgacttcttacttcctgcagtatttgttttattatctcattacttatgtttattgtaaggttaatgggggaccagaaggccagccaattggtgcttacgaattagcaaaagcagttgaagagcttggcgctggtgaaatactacttaattgcattgattgccatggtcaaggaaaaggagttgatgtagatttaattaagttgatatcagatgcttaa

SEQ ID NO: 7618 - DNA, 917 bp, Glycine max
  Peptide Sequence Number=SeqID_124396
tggatgcagttcagaggaaaacagggttgaatagatgtggcaagagttgtaggcttagatgggctaaccatttgaggcccaatttgaagaagggtgcattctcacctgaggaagagaagctcattgttgatcttcatgcacagtttgggaacaaatggaccagaatggctgctttgttgcctgggagaacagacaatgaaatcaagaactgttggaacacaaggatcaaacgccgccaaaggcagggtctccctctctattcagatgagcatgatcaacaccatcgttccacaacaccaaccccctccaaccacacctttcccatgcctcaccccaacaggatcaaaccccaacattgccacaattcccctctccaacacagacaacccttcacctcttcatcgcctcacaatttcttagaccattcacctcttccactctcctcatcctcttcaccttcccctctctccttcaccttccaaagatcagcaccaatgctaagcaccactcttcgcttcaagcactattgcgcctctccaagctacaacaacctctctgaccctcctctcaccacccaattccctcaccttgatggattcaggttccctgtttcttcaggcttctctcagttttttcagccctctttgttagactccgatcgaggcgtttcttcttcctcctcctctttggctttccaacccaagttggagctccctttaagccagtactataaaccacccgaagagcaagacattaagcttgacattgagttcaatgatccttcttttcaaagtagtagtagtggcttgatgggggatcttctcttcgaggctcaggcaatggctttgggcaagaactcaaagaaacgaggctacttgagtttgaatgagggaaataatgtgtttaatgcatgctga

SEQ ID NO: 7619 - DNA, 1287 bp, Glycine max
  Peptide Sequence Number=SeqID_124397
atggggaccctcaatcaaccgtgccccaaccctctcaactatctaacccgagcgcgacactcggctattcggttcgcgccgacccgattcaccgtcaaatgcggctacggctttgaatccgcgagtttctcgcagggagtcggcgcgagccgagccgattggcaaagctcgtgcgccatcttagccagtaaagtcgtgtcgcagagggaagattctcccgcccacggcggcgacaacaacaacaacgtcggcgccgtgaacggccacaacgccgccgtaacgaatataaatctcgtacctgtcaaagccgatgatgaaaacatcaagccgattccgccgaagccgctcacgatctccgacctgttgccggcgccgatgcacggctcgcagctgcgcgtggcgtaccaaggcgttcccggcgcgtactccgaagccgcggcggggaaagcgtatccgaacggagaggcgattccgtgtgaccagttcgaggtggcgtttcaagcggtggagctctggatcgcggatcgggcggttttaccggtcgaaaactccttcggcggctcgatccaccgcaattacgacctcctcctccgccaccgcctccacatcgtcggcgaggtccagctcccagtgcaccactgcctcctcgctctccccggcgtccgcaaggagttcctcgagcgcgtgatctcacatccgcaggccttagcgcagtgcgagcactcacttacaaaactcggcctcaccgtggcgcgtgaggccgtcgacgataccgccggcgctgccgagttcgtcgccaagaacgacctccgctccacggcggcgatcgcgagcgcgcgcgcggcggagctctacggcctccagatcctggccgacggaatccaggatgatccgaataacgtgacgcggttcgtgatgctggcgcgcgaaccgatcattccgcgcacggatcggccgttcaagacgagcatcgtgttcgcgcacgataaaggaacctcagtgctcttcaaagtgctttccgcgtttgcgttcagaaacataagcttaacaaagatcgagtccaggcctcaccgtagccgtccgattcgcgtggttgatgatgagagtgaaggaaccgcgaagcactttgagtatctgttttacattgatttcgaagcttctatggctgaggttagggcacagaacgcactcgctgaggttcaagaattcacttccttcttgcgagtcttggggagttaccctatcgatatgtcaccctggactccctcttgtccgcgccaaaattaa

SEQ ID NO: 7620 - DNA, 1884 bp, Glycine max
  Peptide Sequence Number=SeqID_124398
atgtatgttgtcgtgtttgatgacgtgtggaatgaaagtttttgggaggaaatgaaatttgctttagttgatgttgaaaatggaagtaggataataatcacaaccaggcaccgtgaggttgcagagtcttgtaggacatcttctcttgttcaagtgcatgagttgcaacctttaactgatgacaaatctttcgaattgttttgtaaaacagcatttagatctgaattagatgggcattgtccacacaatcttaagggcatatcaactgaaattgttaaaaagtgtgaaggtttaccactagctattgtggccaccggtggccttttatctcgcaaaagtagaaatgcccgtgaatggcaaagatttagtgagaatctaagttcagaattaggaaagcatcccaaattaactcccgtgacaaagattttgggtttaagttattatgatttgccttaccatctcaaaccatgcttcttgtatttcggaatatatccggaagattatgaagttgagtgtaagggattgattctacaatgggtagctgcggggtttgtcaaatctgatgaagcggcacagactttagaagaagtggcagaaaaatatttgaatgagttgatccaaagaagtttggttcaagtatcttcatttacatggtctggcaaaattaaaaggtgtcgtgttcatgacgtagtacgtgaaatgatccgcgagaagaatcaagatttaagcttttgccattctgctagtgagcgtgggaacttgtccaaaagtgggatgattcgtcacctaacaatagcatctggttccaacaatttgacgggaagtgttgaaagctcgaacattcgatcacttcatgttttcggtgatgaagaattgtccgaatccttggtgaagagtatgcctacaaagtacaggttattaagggtacttcaatttgaagatgctcgtaggttttatgttccgggcattgttgaatgtttgggggacttatcatttttgaggtacttaagcttcagaaattcaaccatagaccatcttccaaaattaattggtgagctgcacagcctagaaacattggatctaagacaaacttatgagtgtatgatgccaagagagatctacaagcttaagaagttaagacaccttctgagtggtgatagtgggtttcaaatggatagtggcattggagatctaacatccctacaaacactccgtaaagtggacataagctataatacagaagaagtactaaaagggttggaaaaacttacacaattaagggagttgggcttgagagaagttgagccaagatgcaaaacttttctgtgccccttgataaacaagatgcaacacctggagaagttatatattgctataagacatgatagtatcatggatttgcattttgatgtatttgcacctgtacttcagaagcttcatcttgtggggaggttaaacgagttcccaaactgggttggcaagctccaaaatcttgttgcgttgtccttgtcattcacccagttgacacctgatccattgccactacttaaagatctaccaaatctgacgcaccttaaaatcgatgttgcatacaagggtgatgttttgcagtttgcaaacagggggtttccgaacctaaagcaaatactactgttagatttgtttgaattgaaatccatcgttattgaagatggagcattgccttctctcgaaaagctcgtattaaagcgtattgacgaactgacagaggtgcctcgtggtattgacaagttaccaaagcttaaggttttccattgttttgggatgtcagatgaatttaaagaaaactttaatctcaacagaggacaacgtagtcaatggataataaaaggaccgtgggaatga

SEQ ID NO: 7621 - DNA, 237 bp, Glycine max
  Peptide Sequence Number=SeqID_124399
atgacggtggtggtggtggctgcgacggggggtggtcgaactatggcagcgaagagtggtggagtggttgctaaatttgcggttccgaataactccaagagccaatggttcctcctaagtcctacctgttatgacattgtggaaattgaacagaagggacaagcattttgggcaacacgggttggtgctcaaaatagcaaatccatcacacaacacttgggtgatgaagaactttaa

SEQ ID NO: 7622 - DNA, 795 bp, Glycine max
  Peptide Sequence Number=SeqID_124400
atgactctaacgctgtcctgccgaccaacttcgaacatcatgggttgcgcatgccggtatcgtgggttgggtggtggtgcgatgaggggacacgacgatgttggaggacggggtgagctctggctcgatgagaagtttaaggaaagtgaagagatggtggggtggggtggcattaaaagtttgagaaggagtgggaggggaaggttttggagaaaagagagactagagagaaaggtcaatgccggacttaggaggaaccattggctcttggagttattcggaaccgcaaatttagcaaccactccaccactcttcgctgccatagttcgaccaccccccgtcgcagccaccaccaccaccgtcataaattacttcctagttactacacgtttgatggagggtatggcaaacattagtgatgatgcaagcaatggtgaaaatggattcctggcaatgtttggtggtgatgaaagcggtggtggtggcagtggcggtgtcggtagcagtggtgatcagggtggtggtaatgtggaggatgtggctctgaagaagggtccttggacaactgcagaggatgttatcctcatggattatgtgacaaaaaatggtgaagggaattggaatgcagttcagaggaacacagggttgaatagatgtggcaagagttgtaggcatagatgggctaaccatttgaggcccaatttgaagaagggtgcattctcacctgaggaagagaagctcattgttgatcttcatgcacagtttgggaacaaatgggccagaatggctgctttg

SEQ ID NO: 7623 - DNA, 279 bp, Glycine max
  Peptide Sequence Number=SeqID_124401
ccctctttgttagactccgatcgaggcgtttcttcttcctcctcctctttggctttccaacccaagttggagctccctttaagccagtactataaaccacccgaagagcaagacattaagcttgacattgagttcaatgatccttcttttcaaagtagtagtagtggcttgatgggggatcttctcttcgaggctcaggcaatggcttcgggcaagaactcaaagaaacgaggctacttgagtttgaatgagggaaataatgtgtttaatgcatgctga

SEQ ID NO: 7624 - DNA, 309 bp, Glycine max
  Peptide Sequence Number=SeqID_124402
atggcttcctcatgccgcggctattccaaagcccaaatgtgcttcttcaagattctccgcataatttcatctaccccaccctccaaacaagaagaagaagaaccctttcccagcaaaggcgttggcatcgatttgaatctcagattctgttccgtcacagagaccccggaatccgaatcttcaagaagcgacgaaaacaacaacgaagaagaagaacccctgctcaaaccaacagcaacaaagggtttccggagaagagcgttaaagtttcggagaaactggacaacaaatacaatcattacgaaatga

SEQ ID NO: 7625 - DNA, 957 bp, Glycine max
  Peptide Sequence Number=SeqID_124403
atggctgctggagtgtataaccaaccaattgttgcttttcaatcccattctcacatcaacaattttaatcatcagcaaaagtttaataatttggtaagactggtgacaaaggactttatcggcagtaatttcctctcaagaagggattgtagagtaattcaatctttagcatctcaaacatctgtggttgacacagtttcatccccttcaaaaagcaaaactagtgatagagacactcacaagaaatcaaatgaagcttctttaatccttattcgacatggtgaatccttgtggaacgaaaagaacttgttcacaggctgtgttgatgtccctctaagcaagaggggtatagatgaggcaattgaagctggcaaaagaattagcagtattcctgtggatctcatatttacatctgctttgattcgagcgcagatgacagccatgcttgccatgacacagcaccgccgcaggaaggaatttgagcccacgacctcttcctttaaccaccaaggcaaccttataactcctatgaaggaagggatgtttaactgttataggtatggggaactacagggtctcaataagcaagaaacagcagacagatatgggaaagaacaagtacatgagtggcgtcgaagttatgacatacctcctccaaatggtgaaagtttggaaatgtgtgctgaaagggcagtttcctatttcagagaccaaattgaacctcaacttttatctggaaagaatgttatgatttcagctcatgggaattcactgagatccattattatgtatcttgacaaactaacttcccaagaggtgattgatcaagtgattagtttagaattgtcaactggaattccaatgctttacatttttaaagaaggaagattcgttaggagagggagtccgatagggcccactgaagcaggagtttatgcctacactaggatgaaatga

SEQ ID NO: 7626 - DNA, 1764 bp, Glycine max
  Peptide Sequence Number=SeqID_124404
atggaaccatgccaagcggaggagctgagaaagctaaaggttaatgacgatcagttggaggttcgtttcaaacgtccccaaggtgacaagcactatgctcatacattgccaaagcgcactcaaggggaatcacaccctcaatgcatagtcaacactcaagatgatccaagtctctcccacatccaccatcctgcaaggcggattactcgtccacactcctttgtcgaccacatcatggaagctgacatacctttgggttggaaaccactcaacctagagtggtatgatgggaccaccgatccagatgaacatctagatgttttcctcacccaggaaaatctgtacaccaatgacaattcaatcatgtgtcatgtcttccctacgtccctcaaaagggcggcattgacttggtatggtggaccccctccaaagtccatcgacagcttcaacactcttgtcaagcacttcaatgcacgtattgttgtccaaatcaataatctcaacccagacatagcattacactgcatgctcttagctctaaggcttggcgacatccagatggaagaaaagtctaggttcaggaatgaggttagacaagccggaaaaaatcccaacaagtacgagcattacacacccctcaaggctaatcatactacaatcctcgaggaagctttcaacttggaggtacccatcaagctacctccatcgtgtcctcccaggccaaggttagatgcaaccaaatactacagataccattgcagtatcggtcacaacaccaaagattgttgggcccttaagcgagtagagactagaggctatgttgacctaatgaccacttttggtcaaggccaactctccaagatctttacaattgggtatttaatcgtcaatgcaaatatctcttactttgttttgattggtgggaaaacactcaacaagcttgaagccattgtctccacaccgcatctaaagatgaagttccctaccttgataggagagactgtgactgtcaaattagatcaaaagcaagcacgacaatgctacacaaaaagcttaaaggtggcaccttatcctcccaccaaggagcctaccaaacctcaccccacaacgaatggtaccactcaagtcatgagcatggacgaaggatctccagtccaagccttgactatcttccaagtaagcctggatgatgaattcgatgtagatccgcgtgatgacacttttgacagagtcccaaagcctattgaaagcttgtcaagctacagcttaaatccaatcttgagcaatctatgcaactcaggaatccaccccaacattatctgccacaagctcatcatctgtccccaggccaaactgaagaggtggacaagctcctcaatgccaacttcatcagagaagccagatattctacctagctcgccaatgtcgtcatgggcgtgccccaaagatgcataccttctgcccaacatcgatagactagtcaatggagtgtccgagttccaagtactaagcttcctagacgcctactccgaatacaaacagattcgaatgcacattccagacgaggagaaaatgacattcatcactgaagttgtcaacttcagcatagcccaacatgtgccagacctggaagaggcctttggtgagctccgcaaatatgacatgcatctcaacccagaaaaatgtacttttggggtcggtggaggcaatcctattatcgtccaggaagtccataagctgaatggaagactagcatccttgtga

SEQ ID NO: 7627 - DNA, 228 bp, Glycine max
  Peptide Sequence Number=SeqID_124405
atggcgtctttgccatatgcccttagacttgtcgagtctagtgcacagggccataaggatgactctgttggctacctttgtttgaccattggtctaaggatgttcgacagagtgacaatggcaagtgggaggccatacttgcatataaggtgtttccagatgaacttctctacctcattggccataatttctcgcagtggtcttgcctcgatccatttagtgaagtag

SEQ ID NO: 7628 - DNA, 321 bp, Glycine max
  Peptide Sequence Number=SeqID_124406
atggtggcatggtccttagaacttttagagtttgatatccaatacaaaccatgcagccccatgaagacacaattcatggcagacttcctaacaaaattcactggaaatgaccaaaccactccaaactggtggagcctttacattgacgactcatccaacatgaagggaagtggggtaggaatcatcctcgaaggccctgacaatgtcactctagaacaagccctcaagctcaatttcaaagcctcaaacaatcaggccaagtatgaggcgcttattgtaggtctgaaactagcaaaagaagtcggggccaagaagctatga

SEQ ID NO: 7629 - DNA, 1935 bp, Glycine max
  Peptide Sequence Number=SeqID_124407
atggagaagtgtcgttcggtgtcgagagtggtggcctcgataagagttagagttgcaggtctgtcaagcttgtcaagccccccagactggacaagtgttgtctgggatgcttttgctaagttgtccgaagtgtacatacttttggctttgcaagcgagacatgtgcagtgtactcgcaacactcttgcatacatgtcactcgtggagtgggcacgtactagagacttgatgcatgggcacctctcgcctcacaagagggcgcggcttttcgctgctttctcaatcagggagcatgtcccggtcaccgtgactcttcgctcttctacttttaggggatcaaggagaagtggtggggacattagagcgtctccccacatgcgacttatccataacgctggggatgatgttctgaagtataagtccttcctcacctctgtagtaagcgtcactgctctgcaacaccaggtgaagctggcaaatcctgaggactgtcgcaaggtagccatccaggcttgcaggagtgatgacttctctctcttgaaggtcttgagtcttgttctccccttgatcgctttccagtgtgctcttctcgagcacttaaacatggccccttcccaactccacccaaacagttgggccatgctgactgacaagattggctgggtctccttgaatagcatgtccaagaatctatttgagttagactcaaatgcctttttccgcttcaaggatcgtttcttcaaggtcctggctactgatatcgtggctgatggtttttcacttatgttcaacagggatggggagccctacttcccattctactggcagtctgaccccgccaagttcaagtcatttgacaaggatctgttcaccttgattatgagggtcgacaaagctattttggataacatcatgggtgacttcacttggaggccccttgtgaagcatggcggatttgctggcgggactgtgccaccatccgctgttgttgcccctactgttatagaaggggggttgacacttccctcgtcggctaaagcttctgccccaactactactgttgttgctactgttacttctacttctccacctcctcctgttgtgcctattcgggaggccactcttgctgctggagttggtatgttggctgctttcaactatgccagtgtggtgacctcgagtgctcatgttatgctgcctccttcttctttgactccatcaattccaccctctattgtgttggtggcggcatcaccttcattgtcttctcgtccccatgtctctttggatcaactgtacacctctagcgatgctgattcattgtggggtgcacattatagactaaagcaaaagacctcgactgaatttgtcttagcctttgataagaagctcatccagtcagttggggagaatggacagcgacatcaagagtctatacgcaaggtggtgtccttagagacggaggttgccgaatggagggctactgcttgcatggtcaagaaagtaaagtgccctaaggtagctaacaccaccgtcgcctttcctaaagttataaggttgaacccccaactatcttcaaagggcgagcctgccaaggtggttgttgagttagatgcccgattgaaagattcggagtccaagctagaggagtctgtgctgcgagtggctaaggaaaagaagaccagcaaggagcttgaagaggaactaggaatttacaagaaggaggctgtcgggttcttcgtcaaggaccttgacttgggtcttttttaccctttcaaggacgtgaaggacagtgttatgcttgacgaggaagatattgctactaaggagaaggctggcgattatgaggagtggtatgacttttgcctattggtcatcttgacctatggagcttctcccctgatggttgtgaggagtggtatgactttcgcctga

SEQ ID NO: 7630 - DNA, 2222 bp, Glycine max
  Peptide Sequence Number=SeqID_124408
atgaggggcactatgcatgagcctcaagggaacctaggggcgaatcaaaagttctcacccgtcgatggtgaacccttcggtactagtaccctcaccttcagaggactacatgtcctcgcctttaaagggctacacgcccttaccttcagaggactacacgtcctcgccttcagagggctacacggctacacgccctcaccttcagaggactacacagggccacatgccctcgccttcagagggctgcatgccctcgccttcaaagggctacacgccctcgcattcagagggctacacgacctcacctttagaggactacacgtccttgccttcaaagggctacacgccttcgcctttagaggactacacgtcctcgcctttagagggctacacgccctcgccttcagaggactacacgtcctcgccttcaaagggctgcacgtcttcaccttgggtactagcaccctccccttcagaggactacacatcctcgccttcagagggctacacgccctcgccttcaaagggctacatgccctcgccatcagagggctacacaccctcccctttagagtgttgcgcgccctcaccttcagaggactacaccttctcgccttcagagggctaaatgccctcgccttcaaagggctacacgtcctcgccttcaaagggctacatgcctttgccttcaaagggctacacgccctcaccttcagaggactacacgtcctcaccttcagaggactacacgccctcgcctccagatggctgcacgtcctcgcctccagagggctacacgtcctcgccttcagagggttacaaatcctcacctttagaggactacacgtcctcgccttcagagggctacaggccgtcgcctttagagggctacatgccctcgccttcataggactacacatcctcacctttagaaggctgcacgcccttgctttcataggactacacgtcctcgccatcagaggactgcacgtccttgccttcaaagggctacacgcccttgccttcagaggactacacgtcctcactttcagaggactacatgtcctccccttaagagggctacatgccctcgccttcaaagtactacacgtcctcaccttcagagggctacacgtcctcgccttcagagggatgcacgtcttcactttcagagggctccacatctgcgtctttagagaactcaagttcttgggccaccccctgatattggagggcgaccaactgtgcaagtacaaccagaggaggaggcagggcaagatttcgctcagaccgctgcaaggagacgagtacggatctgcataccaccacaactctgatctcctcctgccgaagaggattgcacccacaagacactcagtgggcccggagaagtccaacagggtcctggggtttccagctctgattacgagtctctgtcagttctacggagtgcttgttacccccagcgcagggcgaggcatcacagtagcgggcagcagacgcatcgccactacctctagagttcacctcagctcatccacaaaaaggctggagcgttgcctacgacacatggccgaccagcaagcgaccaagtccaaagccaaagacgttaaagaagcactactaggaggcaacctagaattggctaagaagaagctccccgcgaagcggtccaggaagggcaccattgaagaggattccaaggcaagcgagcccattgacactcagagactaacatcgtcatctgcaactttcccggagatgtcagcgtcttctggccgagactgtgaaaaagtcttgtttgttatccgtcagactcaaggagacagcaagtccgatgacatgcggagataccttatggttatccgcaccttttgtcagctagaggcaagtgagcccgttgacacgcagagactaacatcgtcatctgcacctttgtcatccagagacggcaagtccgatgacatgcggagataccttatggcaaacgagcccgttgacactaagagactaacgtcgtcatctgcaactttcccagagatgtcagcgtcttctggccgagactgtgaaaaagtctcatttgctatccgtcagactcaagggtccgggtctgctagcatgcggagataccttagggttatccgcacctttcgtcagctagaggtaagcgagcctgtagacacgcagaaaccaatgtggtcatctgcacccttcccggagat

SEQ ID NO: 7631 - DNA, 651 bp, Glycine max
  Peptide Sequence Number=SeqID_124409
atggagggtacaaactacaggaaccgaatggaaaagcaattccaagaacatggaacaccacccacccgaagttctacttctgttgacctaatgcaagaccaaatgttgtacactttttcctactcaaacaagtacatccatggtcgtagctctgcaagcttgtcaaacccaaggtctgctcttggctcgcaaaacctaaggttcatccttggtgagtcctacatgtcgattctccaaagccttgttaaccctaggttgtttcccccaaagggctcacaaaacctaaggtctgcccttggtgagtcctataggtcatttctccaaaggactcgtgaagcccaaggtccgcccttagtgagtcctacaggtagattctccaaaggctcgtctaacccaagggctcacaaaacccaaggttccctcttggtgagtcctacaggctcgatgaacgcatcccttgttggttctccaaaggctcatcaaacccaaggtccaccctcggtgagtctcacaggtttgcaagacccaaggcccatccttggtaagcctcaacgcaactctacaggcttgttagaacctagggcaaacacgtccctggtccaaggctcgttaaacctaaggttcacccttggtgagcccctcttttgctaa

SEQ ID NO: 7632 - DNA, 684 bp, Glycine max
  Peptide Sequence Number=SeqID_124410
gctattactgttgaaaactatcatgaaaggaatccatgtgcctaccgctggacctctacgaaggcattaccagtgtcgatgtatcgaaagcgtctagatcaactgacgactagtgatgttggttggatgccttacggtgaccatcgtgcagttagagagttcatgctcatttctttttttcttctaaacatatctgatgggatttttcttatgcctagacaatgcacaccatactatatgaagtggttctacatgatttcgcatccattcatgaggccggtacaactcggggatccagtcagatatccacctatcgtgcaagatgacacatatgtcgaattagatatgcctcagtacctggtggcggcggcagctatggaggaagcacctgtaaatgcatcttctcatgcgaagcaacctagacatgcagtggatgtttgtcaagcaatatctgaaaggttggagcggttgctcaacctaaggatagcgactgaaagcacaaaaacatacgatgtcatgcaagactacctaaggatcgctagagaccatttcgcaagttctttaagcaaatggttgctcaccaatgaccatgaatcttcacctatagttaataaggcagcaattgcacgatatccacagttatcgtctgctttgacatcgacaatattttcaatggaatcgtga

SEQ ID NO: 7633 - DNA, 489 bp, Glycine max
  Peptide Sequence Number=SeqID_124411
atgggagtgagaatagcctttatggtagttttgtgtgtttttccggcgatggtctcagccatacgccctcacttaacccctttctatgtgaagggtcgcgtgttttgtgacccttgccgtgccggttttgagactcctctaaccacctacattgctggtgccgaggttactctgcaatgcaaggacagaatcacgaacaacaatgtgtacagcaagcaggttaagactgattcaacaggatcatttacgatcttcgtggacgcgaatcaagcaaatcaaaattgtgatgcgagtctagtaacaagtcctctacgtgattgcaaagagcccactccaggccgtgaccatacacgtgttaatctcaatcgcttcaatggcattgccaccaatgatagatttgtcaacaacttgggtttcatgaaggaaattgttgcatctagttgtgcaaagattttcaagagttaccaagagttaggtaatgggaattaa

SEQ ID NO: 7634 - DNA, 1386 bp, Glycine max
  Peptide Sequence Number=SeqID_124412
atgatgaccagttatgtcaacctcaaaatatggcttcttaactttgttaccttgtttagtattctttctttgtcccatggaagaagagcaaatgcaaattttcgagtgagagcagttaatctaggtggttggttggttactgaaggttggatgaaaccttctctcttcgatggcattccaaataaagacttcttggatggaactggtcttcagttcaagtccgtgacaacacgaaaatatctttgtgctgagtctggtggaggaaccatcatagttgcaaatcgcacctctgcttcgggttgggaaacatttgcattgtggaggctaaatgaggacactttcagattcagggtgttcaacaaacagtttgtggggttggatgggattaacgtcgttgctgtttccaatatttccactgattctttaacatttcatgtcgtaaaagaaagtgataattctaaccgtgttcgaatcaaagcttccaatggatacttcctgcaggccaagacagaggatttggtcactgctgatggatcagaggtcaacggatggggagatgatgatccatctgtttttgtaatgacaattggtaaaaggatgcaaggagaataccaagtaacaagtggttatggtcccacaaaagctcaccaagttatgaagttgctttgtttcttacatttatgcacgcatgaaaaggaacattggaaaacttttatagttgaagatgatttcaagttcatagcaagtaatggactgaatgctgttagaattccaatcggctggtggatagcaagtgatccaactccgcccccaccatatgttggaggttccttgaatgcattagacaaagcctttttgtgggcacagaaatatggattgaaaatcatccttgatcttcatgctgcacccggttctcaaaatggttttgagcacagctcttcaagagatggttcacaagaatggggaaaaacagatgaaaccattcaacaaacagttcatgttatagacttcctaactgcaaggtacgcaaaatgccaaagcctttatgctgttgagctaataaatgagcctctctcacctggtgtgacactagaggccttgaacaagtactataaggctggttatgaagcagtgcgcaagcactcttccacagcttatgtggtgttatcaaataggataggaccctcaaatcctagggaactcttccctcttgcaaatggccttatgcgatctgtgattgatgttcactactacaacctctttcaagatgtatttaatgacatgactgtccaacagaacattgatttcatctacaacaatcgctcatcacagttgagttttgttacaacctccaatggccctcttacttttgttgagaaaaagtaa

SEQ ID NO: 7635 - DNA, 294 bp, Glycine max
  Peptide Sequence Number=SeqID_124413
atggaggagattttttcttccaactggaagaacttgactatggagaagtatgatggtaccacagacctagacgaccatgtggatgtgtacattacccaggaatgtttcagaaaggttgcattgaacatccaaaaccttgacccagcagtggctatacaccatttgataacggtgttacgaccaagaccttttgccaaccgcctatacaagaaaccaacatctgatctcgacgaattgtggacaagagcaactaagtatatgcagatggaagagttagccaagtaccggaactag

SEQ ID NO: 7636 - DNA, 522 bp, Glycine max
  Peptide Sequence Number=SeqID_124414
atgttgcgtaagcctgagttggtcgaacgaatgatgacgtggtcaatcgaactttcagagtatgatatggcctatgagctgagaggaactatttgggcacagagtccaatattaaagcaattccaaagtcatcatcaagaagataaacaaggtgtttttgatctgagaccccaactcctaaagtactaccatgtgtttgaaaagctcaagggagagattaaggaagtgcaggtagcagaagctcttttttggattcaaaaggagatactcaagtacttaaggcatgagatactcccagttgacaaggatagagccagaaagataagaacacaagcctccagattactcgaactttgtgaagaagtgcctctagtgccaaagacatggaaatctgatacatcagccgaccaaagagctgcatccaatggtctccctttagtagttcgttatttggggaatggacattctcggaccttttcctatagctttggggcaaaggaaattcctactagtggcagttga

SEQ ID NO: 7637 - DNA, 333 bp, Glycine max
  Peptide Sequence Number=SeqID_124415
atggtcatcatcatcatcatcattgatgcaatcctccctagaaaggtactagtcaccagagccatgagcaagaggcttcatgaggattgggctagagttgttgaagaaggccttagggtttgtagggtaccctacaaattaagggcatcatatcctacaactattagagggtatgtgttcccatggggtgagcttaactattggaggggtgtaacacttgcttctcaaggaagcttcttaaggaagctttcttccattttggcatgtgatgagcttagctattggagggatgtaacactagcttctcaaggaagcttcaggaagcttacctag

SEQ ID NO: 7638 - DNA, 330 bp, Glycine max
  Peptide Sequence Number=SeqID_124416
atggttagaggtcctttaaagtatgtttctaaattgaattgtgatggattcatggagaaatcaacaagcaaggctcttgcttgggggatccttcgtgatcattgtgggcatgcagggattcaaattgcatggaatcgtggctctaagaaattaattgttgaatctgattatttgatctctatttcgctgttgatgcatgaatgtcctacatttcataattgttttagcttgatccacaacattcacgagtttgtcttggatagaggtgaggttcagtggtctcatactcttcgtgaagggaaccaagtggcagatatattctgttgctag

SEQ ID NO: 7639 - DNA, 162 bp, Glycine max
  Peptide Sequence Number=SeqID_124417
atggggttgttgcagataatggttagaattaaaggtctcggttgtgctttaggccgagcaataggaaaaacccatggaggagacaagagtgatgatgataatgatgtccctaacggcgaaggcctaccgcatctgcccacaggcagcgactccttagtttaa

SEQ ID NO: 7640 - DNA, 672 bp, Glycine max
  Peptide Sequence Number=SeqID_124418
atgacgatgacgagttgtgtcaacctcaaaatatggcttcttaactttgttatcttgtttagtatggtttccttgtcccatggaagactaaatgctcaatttcaagtgaaagcagttaatctaggtggttggctcgttactgaaggttggatgaaaccgtctctgttcgatggcattccaaataaagacttcttggatggaactggtcttcagttcaagtctgtgatgacagggaagtatctttgtgctgagtccggaggaggaacaatcctagttgcaaattgcacagatgcttcgggttgggaaacatttagattgtggaggataaacgaggatactttcagattgagggtgtttaacaaacagtttgttgggttagatgggattaacgttgttgctgtttccaatatttgcacttattctgagacatttcatatagttaaggaaagtgacaattcaagtcgaattcgaatcaaagcttctaatggatacttcttgcaggctaagacccaggagctggtgactgcagatgtttcagaggtgagagaatgggaagatgatgacccaaccatttttgtgatgacaatagctgcaaggttgcaaggggaattccaagtcacaaacggttatgggcccacaaaagctccccaagttatgaaggtcaaaatctga

SEQ ID NO: 7641 - DNA, 280 bp, Glycine max
  Peptide Sequence Number=SeqID_124419
actcggcggcgagttaaagactcggagggcgagtgaagagaaacggagggagaagtgggtggtggtggatttatacggtgacgttttggaggagacagaaccggtggtgaggtccaaaagaggaaggaaccaggcgttgccgtaccggttcagagactcggttgtggaaccgttgaaacgcgcgactcgttctcagagaccgtcgtcaaccgcacacctcagtaaacgactcttaggtcctcgcccacaacgtaaaacggaattattaattactcattaa

SEQ ID NO: 7642 - DNA, 279 bp, Glycine max
  Peptide Sequence Number=SeqID_124420
atgtttgatattccactaagattttatgaagcggaagggaccccacaagagcttcacaacaacagcaaggccccaaggggcaagaataagacagacctgaattctgcttctgcccctagagatcctctaaatgatggatctctccataaatggtggtataggtacatccattgccttgagaatggacggctaagagataaagaatggttattgtcagggaagcagacaaagtgccaaagttttcaacggaagaatacaaatgctatgcaatatttgtaa

SEQ ID NO: 7643 - DNA, 315 bp, Glycine max
  Peptide Sequence Number=SeqID_124421
atggagaaatactctactaatatgcaaggatgcaaaattatatttcttgctgagttaattgtcaaagggcacagaggttttcagtataaaaatttaaataagtctaaggaacttcaaattgggcttgtgcacaagtacatcaaacgttggagtgcagcagccacttgtgacttatgcattcttctagaccagcacgaagtgatgccttgcattttctaccctagagtccttgtcgacttgacatctagtcaccaggttcaaccttttttgttttttgtcaacaaggttcaacctaacaatgcagatagtttgtag

SEQ ID NO: 7644 - DNA, 447 bp, Glycine max
  Peptide Sequence Number=SeqID_124422
atgaagaaaagtcaacgttattccaattctaatgcaactaaagaatatttatctgttgtgaaacctgaattgtgcttctcacttatcctcattgaagatccaagaaggttacaagacttgcaagttgctaaatctaagttatacctccaaggtcaaattatagttgaagagccctacccaaactgccaagttgccaaccaaaaccaaggaatgtggacagttgaggggccaaagttctgctctgatcctacaagttttcttgaaaacacagatcagatgccatggttttgctttgatcttctgagcttgggtcctctccaacttgatttcatccaaccgagatccaagctgttaaatttggcattactcaacaagcatggagaaggaaaaggtgatgcacagtcaagatttcaaatagagagaaatcttgcagggcaagcatggtag

SEQ ID NO: 7645 - DNA, 528 bp, Glycine max
  Peptide Sequence Number=SeqID_124423
atgcgaaggctgctcgggaagatttctgggttcttgagcaatcgaactacggtgggagtggacaaaacagggaacaaatacttcaccagaaatgaagaggttgatggtatcaatgtggttatgaaccaaaaaggtttagtgttagccaagggggttggtctagtggtcaccaagctagtctgcaggataagaatgtgtataggagtggagtataaggttggcttggtggtaaaggggggtgaattggtacaaaccccctccggaatatttccaaaggaggcgacctgtggattatacataaaaagaaaggttaagtctcggtctttgagattgatcgaggtgggagctaactgtgcaattgccatagtgaaagagaaaagatgggtgatatttaagggagaggaggatcctacctctattccagttgaatggatatgttggctgaatgggcagcgtaaaaaggctccaactccagagatcatggctaggctagataacattatgttgcttacaatggttttcctttaa

SEQ ID NO: 7646 - DNA, 1029 bp, Glycine max
  Peptide Sequence Number=SeqID_124424
atgttttccctctcaaaacccatcctttctccggttcgccccaccctccctccggttcgctgcgggtcccgcgagctccgcgagcgaatcaagaccgtccaaaccactcaaaagatcaccgaagccatgaaactcatctccgccgcgcgcgtccgccgcgcccaggaggccgtcgtcagtggccgccccttctcctcaaacctcgccgcaatgctaaacgacatcacccagcgcctccaaaacgacgacgtctccacccctctcacccacgccagacccgtcagaaccgttgcactcgtcgtcgtcaccgcggaccgcggcctctgcggcggcttcaacaaatcggttatccgaaaagccctcgtacgaatcgaggaactggaaaaactcaacttggggtgcgttgtgatcagcgttggcaaaaagggtaactcgtttttcactcacagtataaataagaaacacccttttgtgaaagttgatagctttatcgaaattggtgggtttcctaccgcaaaggaggctcaggttatcgccgatgatgttttttcactgtttgttagtgaggaggttgataaggttgagcttgtgtacgctaagtttgtttcattggttaggtttgagcctgtgattcagaatttgttgcctttgggagaggtttgtgatgtgaaagatgagatttttaggttgagtagtaaagagggtaagttagctgtggagagggatgttgtgaagttgaaaaaagagggtgagatgtgttttcctctcatggagtttgagcaggatcctgttatgattcttgatgccatgttgcctctttatttgaatagtcaggttttgaggggtttgcaggagtctatggccagtgagcttgctgctaggatggtggccatgtcaaatgccacggataacgcagttgatttgagcaagaggctttcggttgagtacaatcgggaacggcaggcaaagatcaccggggagttgttggagattgtggctggagctgaggcattagcagaaaatgactga

SEQ ID NO: 7647 - DNA, 498 bp, Glycine max
  Peptide Sequence Number=SeqID_124425
atgaaacgcacaaattccaaatacggctatggacgtagaataactgccagttcacagcatctgaccagagaggaattaccaaattacaccttcccattgattcctgattccggaagctatccgtgttacttgttcccaagtctccaacaagcaaagtacatggttgatttggaaatccaggtccccagcgcattcgacccgtttgccgaggcgagagaatcagatgcccccggggcaaaggagtatgtgcacatacgaattcagcagaggaatggaaagaagagtctgacaacagtgcaagggctgaagaaggagttcagctacgagaagatcctcaaggacctcaagaaggacttctgctgcaacgggactgtggtgcaggacaaggagcttggcaagattatccaactccaaggcgaccagcgcaagaacgtatcccatttcctcgttcaggccggtcttgtccggaaggaccaggtcaagattcatggtttttga

SEQ ID NO: 7648 - DNA, 729 bp, Glycine max
  Peptide Sequence Number=SeqID_124426
atgaaactacacctgttgataaagggaattattgggaaaaaatacaaaaaattaaggggtatgaatagaaaaaagtgggggggaggtgccaaaagcaatccccttaaaatagagttggatgggaagattttgattttcacacatctatgcttggtagatgaattggataaagcaattgctgtagcgtctagagatccttcttggtatgggattgatgaagctgaggttgaaagccgaaggagatgggcaagcagtgctcgttctcaggttggcacaatgaagaaagcaatggaatctggcaagggctcaagtaccacaagccatgctagtgtaaatgggatgcgccgagaactgatgaggctaccaaattctcatcaaactgatagctccaaccagtatgctgccagagataatgatgatttcatacaatcagaatcagatagacagacgcttcttataaagagacaggatgaggaattggatgagctcagtgaaagtgtacgaagaatcggaggtgttggactcacaatacatgatgaactcactgcacaggaaaagattctagatgagcttggttctgagatggacagtacaacaaatcgtcttgattttgtccaaaaaaaagtggcaatggttatgaagaaggctagtgcaaagggtcagatcatgatgatattgggtttgttggccctgttcatcttcctctttatcttagtattcttcacctag

SEQ ID NO: 7649 - DNA, 1464 bp, Glycine max
  Peptide Sequence Number=SeqID_124427
atggtgaaggggttgcacgggcagaacctccccgcccacgtggcacagctggttgatcagctggagcgccactgcttcgctcccgatggatctctcatctccaagcctctcttcaacgatctccaactcgccagagaggaaatgtgcagggaaagactgcgttacctggaagccatggctatatattctgaggctattgcaatggtggaggagtatcagcaagccatttctgtgtctaaccttggtggaatcagagatactggcaatctttatccacagcttgggttgaagaactctcctcaggtttatcagactttagagcatcaaatggttgttgctgaagcagctcaacgattgagactacctcttatctccaaagatggggaggttcatgatgaagacattgaaaagctaagtgtagtgtctcgaagctctcttgacagtactgttagtggggctaattcttctaactataacacaccaagcagctctgttagtggggctaatactgcccttgctgcttcggatccagtggaagtcggagttggtggtgttgccaatcgttttttgggaattacaccttcttatttgtggcaaactcagcatcaaaaagcaccattatccgtggatatgactgaatatcgcctgtctgtttcacgggaggtagaggctcgcttgaagatgaaatgtgaaaaattatcagatgcctttgtattggatgacaatgattcttcatcatctggaagtcatagttcaagttctcggcttccagaaagggtgaaactgttgattgaggagattgaaagagaagaaacagcgctgcgggatgacctttattctgcagatagaaagtttgctgaatattataatgtcttggagcagatacttgcagtgcttattaaacttgtcaaagatttgaagttggagcatcaacataaatatgatgagatgcagaagacttggctctgtaaaaggtgtgagaccatgagtgcgaaattgaggcggtggaggtgggttgaggcaattagttggttaatgcgtggtagggagagaccagtttctagaatcccagagagtgagagacagtctacattctacaatacaatcattttttctcctgctaaactgggtttctccgttgatccaaatggaccttcgttatattttattgaggacaaaaggaaaaatgttctagagcacgttctcttgctcgaaacttacactaaggactctatacctgcccttcataagataaggaaatatcttgttgaggcaacagaagaagcttctattgcatataacaaagcggttacccgcctgcgggagtatcagggtgttgatcctcactttgacaacattgcaaggcagtaccatgatattgtgcagaaattggagaacatgcaatggacaatccaccaagttgaaatggatctgaaacgtttgccagataaacccagcacatag

SEQ ID NO: 7650 - DNA, 348 bp, Glycine max
  Peptide Sequence Number=SeqID_124428
atgaaacaacattattggccaagtttagttctttacagagaccttaacacaaactcttttttttcccacaaagttctcaagaaagaagaagaaaggatagccaaagaaggaagcaaaggaaaacgtgtcagcactggaaaagtcagtggtccagacttgaaaagttttattcagcaatttccagttccttcagaaggtaaagaggttgaagaatcacctagtgcaatggatggcttaaggaatcctcaggatggcttagccgagaaagaaaaagatgagtctgagtcttcagagccaacaggatctggtgcatcttttagaccaggaacttggcaacctccaacttga

SEQ ID NO: 7651 - DNA, 171 bp, Glycine max
  Peptide Sequence Number=SeqID_124429
atgacgactgagatgatacctatacctattttggagaaactttatggttggaagtcttgggtttcacaggaagcaaccggtcacaagaaagatagagaagcttccttggcagctgctaatgaccgaatgaaagactgcaccaaattcaaatattgccaacacgatttatag

SEQ ID NO: 7652 - DNA, 731 bp, Glycine max
  Peptide Sequence Number=SeqID_124430
atggataaagacccaccaattattacagagaccaatactgatgttgacaagtctcttaaagaggcttgggagtggtctaacagattggtattgaacatgatgagattaattatggctacaaatgtgaagccatatatgcctaaaatagataatgcaagggaattcatgaaattggtcaaggattactcactatctgatattactgacaaatcaattgtggggaatttatcaaataccatggagatggaagggagtgagtcctttctagtacagtttatttggaactatcttcctactaaatttagccaatttcaagtgaactataacactcttaaggaaaaatggaattttcaagaaattaaggtcatgttaattcaggaggaagggggattaaagaaaatgaaggacaactcaattagtctcacaactcatgatggagctagtactagcaagagcaagtcgagtagaaaaggcaaaggaaaattcaacttaaaggttaaagatggaggagtctgtaaggaaaagaagtgctacttttgtaaagagaggggattcctttcgatccaaaccataaaaggaactaaaaagtttctctacataggaaacaggatgaaggcaagaatagagggcattgggacttatagattaatcttggacactggttgtcatgtagatttgaaaggatgtctctatgtacctagatgggccaggaatttggtttatgttgcaag

SEQ ID NO: 7653 - DNA, 378 bp, Glycine max
  Peptide Sequence Number=SeqID_124431
atgaaaggaaatagagcatatcccttatgcatcagtggttgggagcttgagaaagttcttaggtacttacaaggcacaaaggattacatgctcacatataggaggccagatcacattgaagtgattggcgactcggatttagtctatgttggatgtgtggactcaaggaagtctacattttggtacatcttccttttggctgaaggagcgatgtcatggaaaagtgcaaaacaatccatgattgccacttctaccatggaggttgagtttgtggcatgctttgaggccacaattcaagcattatggttgcggaattttacttcaaggtttagtattgtcgatagtatatatagccagaccgctgaggatttattgtga

SEQ ID NO: 7654 - DNA, 260 bp, Glycine max
  Peptide Sequence Number=SeqID_124432
gattcttcaactttggaaactcacaaggccaatactttggtatatggtacaagaacatatcaccaaggactattgtgtgggttgccaacagagatgcccctgtgaaaaactcaacagcatttctcacactaactcatcaaggaaatcctgttattcttgatggctcaaagggtatcgtgtggttctccaactcatcaagaattgctgagaaaccaatcatgcagcttttagactcaggaaatcttgttgtgaaagattga

SEQ ID NO: 7655 - DNA, 696 bp, Glycine max
  Peptide Sequence Number=SeqID_124433
atgaccaagtggttttctgggataatgggcgcaacaacatggtgtaaggaagttttttctttgagggttttagctggcagtgtcggttatgcagttgatcttttcataaaagttgttattgctgaatttacttgcattctggcactaggagggtccataatggggataattgcaggagctatcaaaggccatacaagaggagctggttttcttgatggagcttgcaaaggagctgtcacaggggccattgcagcactagaattgccaaacattgctgcttgtgatgagccactttctaaggttgccctgttgagaagtttattaaatggaaagatatttgtggaatggatatgtccagctgttgcacaagcctatcaatgtcatatcagtgcacatgcaacatcttacggagaagaatcagatatttacaatgacgatattgtcaggggaatcacagtcaaagggatggcttggaatatcattcaaaagcttcctgttcaacaatttaattccagtaaaatgttcaaattatacaacgactcatgctgctcaatttgcttccaggattttgagtatgaggaatttgtgaggacacttcccaaatgtggccacttttttcactcagtctgcatagacaaatggctagtccaacaaggatcatgccccatgtgtagaatttttgtttcagatttatga

SEQ ID NO: 7656 - DNA, 219 bp, Glycine max
  Peptide Sequence Number=SeqID_124434
atggcatcgttttgtgctgcaaggactttcaacattccggcgatgaacgccggcgttcttcgccgccgggcatcgtgggccgccggaatagtcggagcctcggtggccggcgctgcacttttgcgctcttgttcgtctaagcgctctgcgccattcgcttgcatgagcctctctactgataccagatcttttagtgggggtactgcattgcttagctag

SEQ ID NO: 7657 - DNA, 387 bp, Glycine max
  Peptide Sequence Number=SeqID_124435
atgtatgaaagagatcaagccactgcctacccttttggtctacacatctcaagggtcatcaatgtcaagataatagttgacaagaaccagatcctgtggacagacactaaaaaagcctccacttatggttatgatggaaggtataatgttgaggaccatgacgtcatgcaagtgttatgtcctgttaggaagtatcactatgatgatgcttatgtctgctttacaaaggacgctgacaataactcgttctttcaacgcatactccaacttcctaccattcaatatgaagggacttataatctaaagaagatgactaaagaacaaatgatagctcatgtgactcaactccataaagctcaacaaaataagaaggttgaagaagaataa

SEQ ID NO: 7658 - DNA, 375 bp, Glycine max
  Peptide Sequence Number=SeqID_124436
atgaaaaatgatgctacttttgcagcaacaaacttgagggcagaccactacgttgctcaaacaaagttacttttgtactttgtcgctgataagatattgtatatctggagtgcaccaatgcaagataattcaggcactgatcacgttattgcttgtgctgtttttctctatacatgtccttctaaatgtgaggttgaccttgatgaagtgaatgctctagcagagctaatgacatggaagacagttgtagcggacattccttatggaggagcaaagggtggtattggctgcaacccaaaggagctcagcgtcagtgagttaggaagtctcacttgtgttttcttccaaaagattgatgatcttattggcatttag

SEQ ID NO: 7659 - DNA, 309 bp, Glycine max
  Peptide Sequence Number=SeqID_124437
atgttccatctacacaatcgtgtccaccttcatccccatccatttaaagagattcaaaagagttgttccaagggaacccttacagatgctcagagatttcctgtagcattcattaatggtaatcttgcatctaaatctccctactctgaattcatctctattgaacctgttgaaagggaaaccattagtgtccaagctcctacatggacgaagtatgactatgagcacacatcatctgaggcctttaaagctctaccaacagatgtcatagtttatcttccacttccacaatggacttgtcaagtctag

SEQ ID NO: 7660 - DNA, 819 bp, Glycine max
  Peptide Sequence Number=SeqID_124438
atggtttggctatcaaaggactttgagtcagagaggaaatggaaattagctcaggcaaaaaaagtagctttaagagccagcaaaggcatgttagatcaggctacaagaggtgaaaaaaagatgaaggaagaggagcagcggttaagaaaggttgcacttaatatttctaaggatgtcaagaaattctggacaaaaatagaaaagctggttctttacaaacatcaaatggaactcgatgagaagaagaaaaaggcacttgacaaacagcttgagtttctattagggcaaactgagaggtactcaacaatgttggctgaaaatcttggggatccttataaatcagcagagaataattctgcagagcaccgcaagagtattcattgcaaagatgtacatgatgttattaatgaacctaaggaagctgatgttgtggagtatcaatcagatgcagctgacaatgatgaagagtatgatgtgcaatctgatgatgaattggaggatgatgagcgaacaattgagcaagatgaggctcttataactaaagaagaaaggcaagaggaattggctgctttgcgtgatgaaatggatcttccgattcaggagttacttaaacgttatgctggggagaaaggagaatcggtaatgaaaggaagtagtccagagcatagtgaagatggtgggaaaatagttagagctggtgatggtaagaaaggactaggatcagaaaacagagatgatcttttatctgtcagcaaagttgacacaagcaactccagcatggtctctggtcgacgttgtacaaacatgtatccattataa

SEQ ID NO: 7661 - DNA, 3123 bp, Glycine max
  Peptide Sequence Number=SeqID_124439
atggaaagagttgatacaattgatcccaaggatgagattgcattattacaaaaggagagtgacatgcctgtcgaggaactgcttgcaagatataaaagggacccaagtgacgatgaagatggggaatatgaatctgattatgcttctgctttatcagagaaacattcggattctccagtccatcaagatgctgggcagaaggatcctgccattcctatggatgaagatatcaagtctggtgagcacctggctgccaccatacagttccaggaagaacagagggaatcacctcgtgaaaatttggaaaaaagagaaagtgaggatataattgctgatgcagctgctgctgcaagatcagcacaacccaccggaaacaccttctccacaactaatgtgcgtacaaagttcccttttctactcaagtactctcttcgtgagtatcaacatattggattggattggcttgtcacgatgtatgaaaaaagactcaatggaattttggcagatgaaatggggcttggaaaaacaattatgactatttctttgcttgcacatcttgcttgtgataaagggatttggggcccacatttaattgtggtaccaactagtgtaatgcttaactgggagactgaatttctgaaatggtgtcctgcctttaaaattttgacttattttggaagtgcaaaggagcgaaaacttaaaaggcaaggatggttaaaacctaactcctttcatgtatgcataacaacttatagattagttattcaggactccaaagttttcaagcgcaaaaagtggaaatacttgatcttagatgaagctcatctcattaaaaactggaagtcacaaaggtggcagacactcttgaatttcaattcaaaacgacgaattctcttgactggtacgccactacagaatgatctcatggaactgtggtctctcatgcatttcttaatgccccatgttttccagtcacatcaagagtttaaggattggtttagtaatcctatatcagggatggtagatggagaagaaaaaattaataaggaggttgttgatcgccttcataatgtacttcgtccattcttactccgtcgacttaagcgagatgtggagaagcaacttccaatgaagcacgaacatgtcatatactgtagactatcaaagaggcaacggaatttgtatgaagatttcattgctagttcagagacccaagccactcttgcaagtgccaatttttttgggatgattagtattatcatgcaacttcgtaagttaagttcttctgtttgctccatacttttgcctagtcccttttcaacagtggacctaagaggtttgggtcttttattcactcatcttgacagcatggctgcttgggaaagtgatgaagtacaaactattgagacccctgcgactttaatcatggaacgtactgatatgaccgaactagaagtaattcggccacagaaatgtcaaaaaaagttgcaaggaacaaacatttttgaagaaatccaacgggcaatctgggaagagaggctaaaagaggccaaggaacgtgcagcagctattgcatggtggaattccttgagatgtaaaagaagacccatctactcgacaactctaagggatcttgttaccttaagacatcctgtatatgatattcatcaggttaaagcagaccctgtttcatacttgtactcatcaaagctagctgacattgttctctccccggttgaacgatttcagaagatgactgatgtggttgagagcttcatgttttcaattccagctgctcgggcaccctctcctgtttgctggtgcagtacaagtgagacaaatgtgtttctgcacccatcttacaagcagaaatgctctgaagttctgttaccgctactagcaccaatcaggcctgcaattgtccgccggcaagtgtatttccccgataggcgtcttatacaatttgactgtgggaaactgcaggaactagcaattttgttgaggaaattaaaatcagaaggtcaccgagctctgatattcacccagatgacaaagatgcttgacatattagaggcattcattaatttgtatgggtatacatacatgcgcttagatggatcaacccagccggaggagagacagaccttaatgcagcgctttaacacaaatcccaaatattttcttttcatcttgtcaacccgtagtgggggtgttggtatcaatctagttggagctgacacagttattttttatgatagtgactggaatcctgctatggatcaacaggctcaagatcggtgccacagaattggtcagacacgtgaagttcatatctatagattgattagtgaaagcaccattgaggagaatattttgaagaaagcaaatcagaagcgtgcacttgataatctagttatacaaagtgggggttataataccgagttcttcaagaagctcgatcctatggaactattttcaggtcatagaacactttcaataaaaaatattgtgaaggaaaaagaccagaacaatggggaagtttctgtaactaatgatgatgttgaggctgcattaaaatgtgtagaagatgaagcagattatatggcattgaagaaagttgaactggaagaggctgtggacaatcaggagtttacagaagaagccattgggagacttgaagaggatgaatatgtaaatgaggatgatgacactgcagaattaggtgaatctgtttcgaatttaaataaagagaatgtgttaatgttaaacggaactgatcataaggaagatagaccgacacactctgttcctgtcaaagaagatgatcctgacatgttggctgatgtcaaacagatggccgcagctgcagctgcagctggacaagctatctcagcatttgagaatgagctacgccctattgatcaatatgccattcgtttcctggaactgtgggatccaattatagataaaacagccttggaatctgaagtcaggattgaggacacagaatgggagttggatcgcattgaaaagtacaaggaggagatggaagccgaaattgatgaagatgaggaacctcttgtatatgaaagtatgcaccacattactccctttgcttcataa

SEQ ID NO: 7662 - DNA, 405 bp, Glycine max
  Peptide Sequence Number=SeqID_124440
atgtatcggctgaagctcactgcccacagtcgtattcatcccgtcttccatgtatcattactcaaggccttcgtgggagaccccgaagcagctcacgcggatcccctaacggtcataaggactgaagaggccaccaacactcctttgacgatcattgactccaagctggttcccgccgataatgggacgcgccgtatggtgctggtgcagtggctaggttcttcccgacaagatacgtcatgggaggattggcaagtgcttcgcgaacactacaaccttgaggacaaggttttatttgtagaacggggggatgatacggacgttgaggatgaagccatgctccagagacgttcagctaggacgaagaacctacccaagcattgggatatctaccaattaggatag

SEQ ID NO: 7663 - DNA, 144 bp, Glycine max
  Peptide Sequence Number=SeqID_124441
atggagaaaggtacaagtcttcctatggagaaaggtttcaagatcctgttgtttcctatcattgatagtctaggaaaccccttaagactttttacatgtggtatcagagcatgtgttatgaaatttatgattctccaagaatga

SEQ ID NO: 7664 - DNA, 645 bp, Glycine max
  Peptide Sequence Number=SeqID_124442
atgggatatggcgaagcaggatggtggatggaaagatttgaagttgcagacattgatcacaataggcttctgaacttcaccgaacttaaagattttttacaccccgaagatagcaaaaatcaagaaatgttgaaatggatgttgaaagatagactaatgcgcatggacaatggaaatgatgggaaactaaacttcaatgaatttgaaggccgtctatatagtacatatgaaagttatatgaactttgaaattaatggaggacatgtaccttctccaaaagataaatttgttaagcttgatgtgaacaaagacaaatttttgtcaccagaagaattgataccgatactttcttatctgtatccgggagaggaagcttatgctaaatatttcacatgttacttaatgaatgagattgtttcaacaaacaaagccttgcttcaagatttcttcaagatcaagtcttgtctcaaaacaaagggtttcaaagtcatccaaggctctggtaatcgattaccattcctggctgatgataatggagatggaaagttgacactccaagagatgcttgatcatgagtttactttctacaacacagttcatgcagatggtcaccaagaaagtgatgatgatcatgatgagctttga

SEQ ID NO: 7665 - DNA, 474 bp, Glycine max
  Peptide Sequence Number=SeqID_124443
atgtcaaaggcggtggtttatatcctaatagccaccgccgtgttgttcttcatattcatgtccccattgaatctccagaagccaaagggtcgtcctaatcgcaggtttgggtacaaactacttgagcgagcaccgaatttggaccctcttgtgacaaatatcgagaaagagattgaaaagaaaatgtatcatgaacctgctcctcgtatgttgtccaatttggatagcaccacatcggttagtgatgttatagagacataccaatatcttacctcgggtgatagagaaccgaaagatggggtgattggtttcaatgagttagaggcgtggattactcaacgagcaatagagagattagattatctcacgcaagttgagttggattccaaagacaagaacggggatttggccatctcgtttaaggagtatttacctcagttttctgaaaaggatatgggtaatatgtttacgtga

SEQ ID NO: 7666 - DNA, 1467 bp, Glycine max
  Peptide Sequence Number=SeqID_124444
atggaagccggagcgaggaaatcgcgccacactaaagatctacagcttctattcactgtgccattctcatggctgtacttgctgctaggcctaactcaaccccacaaactggctcagcttgtaaggactccaacaccaggagattcgaagcccaaatctaaaaagaaacccaagaaggcaaagttcaaatctctaaagaaaggttctttaacctctggcttgagacctgtgaaagaagagtcacaagcacagcctatgaacatagatgatgagaatgtccctggtctagattttcagtctccaaattcaaccatgcagaaaaaacgtaagaaatctaaattaacaactgatggtgaagaagaaaagagacttaagaagtccaaaaagtccaagagggattctcctgacatttatgcttccgatttggaatccaactcattagttgtgcaggatgaacatgcagaatcaaagacttgtgaaagtctggttgatttagaacagaaaacagcaagcaggagtaagatgggaggaaaaatatccatcactcctatccctttaaaacaggtctggatgataaaaccagaaaaattgaaaaagggaaatcattggtccaaagattgtattccaccagctgatttttggctgcctcaggaggatgcaatattatgtgctgttgttcatgaatatggtcctaactggagtttggttagtgaaacactttatggcatgagtggtggtgggtcatacaggggaagatatcgtcatcctgtccaatgctgtgagaggttcagagaactattccaaaagtatgtcttgctgtcaatggacaatgcaaatcatgagaagatcaacagtccgggctctggaaaggctctgcttaaagttacagaggataacattcggatgctgttagatgttgcttctgagcagagtttctatacttccattggccagccttcacaaaattccttgaagaaatcctctgaaaggatggcatttgcaaatttggccccgagcaagaatttagtagcagctgcacttgatgatatcacaactaggcaagtgaatgacaaagtcattctgtctaaccaaggggaagacatgccagtgagtgcagatcagctggatataacactggagtttgcaaaagaggatagcgacgtcctatcttcatttccatctgttataaatttatcaatacatgggactgaaccaacaccatctttaaataagctaacaggagaagatgatcttaaagttgctgcttatgatgttttctcctttttcccacacccctcagggaggctgcaagagtttgtggagaagacagctctggatgggcatcatctgcattcccaaccaacgatacaaggtctcgacctggatccaggttacaatcctccggaaagcggaagtcttctgtatctgactcttctaagccttctagcattttctcctttgacttga

SEQ ID NO: 7667 - DNA, 261 bp, Glycine max
  Peptide Sequence Number=SeqID_124445
atggtcttactcctttatgaatcaaatgagaaattcaatgataggcttattgttgtcatcaacaaaatgaatcaaagcggtgcttttgcatttagggcacttgtggttatccttattgaccatcacatacataaggcaacaaaggaacctactagcaccatggaaatgacttcagggttactggagtattcgaggttgttgttgttgttgttgccatcttggtgtatgatcaaatgcttaccactaggacaaaaactatag

SEQ ID NO: 7668 - DNA, 261 bp, Glycine max
  Peptide Sequence Number=SeqID_124446
atggaggaggtggtggtgttggggctaagatgcagcaacaactccaagcatgggcatctgaacttgttgaatgttttggagaagaatgacaccaagattggagaactgagtggtgattgcattctgcatggagagcctgaattgctcattctcttgatgttgtcatttggcaaaggtttccatggcttgccctatcatatcttgcacttgatccctggtaatagtggtaggttgtgcatagttaagaggaatgaggcctga

SEQ ID NO: 7669 - DNA, 276 bp, Glycine max
  Peptide Sequence Number=SeqID_124447
atggttctaaaggcagtgcagcttatcgtgggacacgtaactgccacgctcgagggagtaacggcctttttctctcttgagtttggtgataaaaatgatgtgagttgtgacacaaccaataacaacattcgtgcgacggatgctagtgggagtgttggtggtggtgttgttgttacttttggtggcagggttcacaacaatgatggtgcccaggtgttaggaggaggggtgccacgtggtgcagctgaacataaaggactactactagaggcataa

SEQ ID NO: 7670 - DNA, 255 bp, Glycine max
  Peptide Sequence Number=SeqID_124448
cccgttcaagtgatcgaggtaacgtcatccgaggaagaccctgaggaagacctggaggagctacctcctgagcctgctgtggatgcccttgactttctagagggtgatgaggatccacttcttgaggtggattctcccgaggaagtcatgtcggcatctgaggcagactctacggaggatagcggcccgagggagatggcgatcagcggaggctcttcatcctaccaccactatggacacctttgctctggatga

SEQ ID NO: 7671 - DNA, 6564 bp, Glycine max
  Peptide Sequence Number=SeqID_124449
atggcggaacccgccgcagttccaaacttgcaacctaaagtcagccacgaagcgaaactgaaagaactgctccacagaatcacctcgctcgagataaagctatgctccgatggcgccaaagagttcgcgaagctcctcaggtccgagaccggcgccgacctcctccgagagtacgtgcgcggctccccgaagtgctcggagcttctcgaagcgtggaagcttcgcgaaggcaaacagggcatgcactacgtcttcgacctaatctccgccattctcagccacagagaaggtaagcacaaccctagcgacatcgaaagcgtgaatatcactaatgatttggataaattcgcgcggttacttatttccgaacggttgagtgatatccacaaggaggtgaacagcaaagagtggcggagacagaaggcggcgttgttactcatggcttcgattgcgcggcgtggcgcgagcttggcgtcggaggtggcgaagagcttcgatttcaagctcgccgagttcgggaggattgcgtcggcgaaccggagaaggaagccggaggcgagggttgggttgttgaggaagccgtttgtcggatttgcgatgtcgtttttggaggtcgggaagccgtggctgttgcggtgggttttgcagcagagagagatgtattccggcgttctgagagggttagggagcgatgatgatgaaactgtggtgtttgtgttaacggtgttgagagatagggttcttgttgaagagtctctggtgcagccgtggcttcggagtgttttgtttgggagtgccacattggagcagttggttgaggtttgtgcaagggaaggtggtggtgatgccgctgaggtggcgtttggggtgctttttagggtttgtactgatcctagtaatggtttgatgccggactcaaaaatgcggttgaagggtaatacgaagagaatcttggatctcatgaagaagctgcgggttacggaggttcagtatcataaggatttgcttttggctattgttgaggccaaggcttcttttgggttgtcgtatttgaaggagtttccttacaacattgataatttcaagtcttcttcatggatttctgcaatatctgtggcagctcagttggtttcattggtgggtaatggcatttccaaagaatctgtcaattttcgatcaaatggtccgcacctgtttgacaatatggatttgcacagtattgtgaagtgcttgtttcctcgtccattcagcagatcattgtttaataagggaatgcctcacattgaaccttatgtgaaacatggtactctaaggcttcttctggagttactgaaattgctggactctatttttggtggtttgaatcgtaattctaataccaacaatccattcatgcaacatatgatgtctatcaaggacgaaatccagaattatgttcaagcttttattcccgatctgcaggttttattaaatctactttcctctttagatgtcaattctgaagcctgtaactcaagtttaaagagaaatgcatgccatcatgaacataatagcagcagtaggaagaagttaaaacttgacatttcggagagtggtgatatagatatagttgttgctgggataagttctactccagatattgatttaactggcaacagtggaacagttgatggtggaccaagagcagatgctttggatgatgaggaggatctcatgaatagcataggggaaatttggggcgtggaccttcgttcaatggaaattaacacatttgaagatgtggaatcatacttgctgtctaaactgcttgatgctctcagatattaccgccgggctctgcctttttctttggataattcttttgaaacattcaagggtcttctcaaaagcccattggaattaacaagtcatctgcaggtctcagtgttgtccttgcttgtggaatacattgaatggtgtcctgatgatgaaattcctatcagaactccacccatgttgtacaaatacttacaaccattcattaaattgttaatgttttctccatacaatgaaacaagggaactggcttacaagctggccttggcagctatgttcagtactggtgcttttgatgggaatcttcacgagatagaagcatggtttttatttttaccaggttatcatggaaagaaaccccctgtcaaaatctcggaggttgatgtattacagagtttgactctatttgtcatatcattcttttgcgatgctgtttctacacttggaaataatttgattaaatattgggatattcttaagagtcatgcccattgtttggaaggtggtgaagatttatcacctcaatttagcccttttatcatatgtgtgctagagaagtgtctaaaggtgatccgacctaaaacaggatcctgctcgttgcctaaaaaatcaatggtattattatacacttgcaatacagtcaagtatctcttgcaaacacaggtcaacgcaggattgttatctgctttagttcatgcagacttgacagagagacttggtggaagttatgaatgtgatgaagtctttcctgagtggaagccactgaaggatttattggactttgtggagagcatattacaccaaaggaattattgcattttctctaaaaatgaagaatctgtccttcctgatagttctttgggaagtgcgcttggtagtgtaaatagattgttgaattgtgggtctggtcatggtattgctgaaacaaccatagctttcatatcctccattatattggaaggcaccaataaaatattgacaaatctgccatcacatgtggtcataccacgtgacttagttggagttcctttctcactcttattatcagtactttttcttgattatagtgttcttcaccatgcttctaagttgtggcctgtaatgttttatgctgccttggatatggccatgtcagatcttggtattgatggtcaaaatgcagctcctgttgagacttctgatcttacattgcatccagattctctaacttgtagccaacttttagatgcttctgaagttgatgctgttacatttagtatctttctaaaacaggcgcctttccatgtgatatttcctgcgatgatgtgtatgaatggtccttacatatcaaagctatctaaaatacaagagtttttactgcataaattatctgagtcaaatgatagcttgctccttaccaatctgcaactcattctgttctggactcatcggattcagttatgttatgaagttaacccaatagctgaagttgaacaacttttgaatctgtgtgttatacttgtagggagcttgttagctcaattattggttccagaaagtggttctgactggtctataaactctgccttttattcattaagacataacattcaagaagtgattaaaaccattttttgtcatccttgtgttttgatctcattatccttttctttgggaagttgtcagaatctttcaaatggaaatgtagagaatgatatcaatatgctaaatgtagtatccaatgaggggtttcacaactttggtaatccagttttaaagatattaacaatgactctagagtccatgtggtctttatctggtgcccacctttgtgtgtcaacagctgaagatgttgctaataatattgtgaaggcatttaaacgccttcaacaaaaactatttctggatgtcagaaacagatttgagctgtacattcgtactgaagatgtgatgcctcttcttccaacattgtatgctttacattctttgcatcgatttttatccccttttcagctccttgaattagtgaattggatgttcagtagagatgagtttgatgatttgccaattaagaaatcctcaatatttgttggatgttccttagctgctgatgctttcagtgctttatccatttattttcagcagtcaactgaaaacagggcaccgtatgatttgttttgggagatgggtgaaaagaatatgaaagctgatatttttgagcagatttacctcaaggtagttgacttttctgtatgttatgaaatagatagtgcagatagatgcttgcttgaagctgtcaatctcttgtataagcagaaacatttgcaacaagaaacgtttcatcctttgctgttggtcatgtggaaaattataatggttactccattgaaagtgctttcccattgcatttacaagactaatgctaagaaagctacgtttttacatattctttctgaattgagttccctccattcgttgatctttgggcatttatttttgggtacagtgaatagaagtttacatcatggtattggtgtgatggaacatacctttgatcctactctctcagaagatcagtttttgctgcttctgccggcctctttgtcatacttcagcttaatttctaagagacttagagagcagagtcacagagattttgaacatttaccttacttttattcaaaaattctcttaaaaggtttcagtcagtggaagaggttttcctcaaaagatatatttcaggaacaatatggggaattctttccatcatctgctcaagaacttctgtgtcttactgatcttagtcttcttgggaaatcaattcatatgttaaagtatcactttgctcataatggggatatgatgaaactgaaaaagcgattaaatctattcaaatccattttcccaaaatttgattcacatgatgatctgatgaactgtgattgtcaagttattgatagttattccctgcgtcagtctttgaacatcatcaattgtgttgttgcaaagatatcactttgtaaaatattattgtttcatgaagcaggtggggatttcaaagatgttgctgtgaaaatgcaaagcaaattaggtagatgcaggatacatttcataaatattttggtggatatttggcagtttattgttaagaaattttcgttagcttcttatcaatgtagaactgcaaaaggcactaacatttcattgctatataatcacttggagggttttttgttgaagagtattcttgaattggctggagaaatgcaaaatgatcttattcaattgcaagccatttccttccttgagcaattaatcagatctgctcttctctataggtttggtgattttacaacaatgaaaactgtccgggttatattatcacagcttagtgaggggaggctatcatatgatttatatcttcagttgttgcttgctcattctcagtttgctcccactctccattcagtgcgcaaacaagcaggttcccttttgaagcctgtatccagcattctgaaatgtcttgtgattccttctcttgatcattgtgaaaatgatgtgaaacacagagggctaacgactgagctctctagtggaccattggaaattgttaaaatactttggatacttttattggttaaggctcgtcaaattgactcagataatggaaatgacattgatgtaaatttaaaagaactgcatgcactgcttcgtcattcttatggtgcaacagtcaactggattgatttggaaatatacaatctgatgcaacagattgagtctatgagtggcctgctgtctcaaaatgccaagttagattcagaaacaattgaagaatggtacaaaagccagcatagagacaactttccaattgaccctgacatatgcgtgtcaacagttctctattttccgtatgatagaactttctctgatgagctaccatctataaacaagattgaaccagatactcctaggaaaaaggtactttattctcatgttgaagataaagaacgttatgatcctgtatttatattgcgattttcaattcatagtctctcaaaggcttatgtagcgcctgtggagtttgctggttcagggttgcttgcgattgcatttgttagcttgtcttccccagaccaagggataagaagattagcgtatggcactcttgataaatttaagaatgcagtagagaagtgccaaaagaggaaggatgtaatgggacttcggcttctattaaattctgttcaaaacagcatagaagagccatggcaaagaatcccatcagttattgctttatttgctgcagaggcatcttgtgtattgttagatccggcacatgatcattatgcagctataagtacattttttatacattcatctaagttgaatatgagggttatgtttgataactttttttggagtacctctgtcaatttcaaagcagagaggtcttggatgcttcgcctagtatatgcagggatgaactcagatgatgatgctgcgatatatatcaggaactctatccttgagaagctaatgagtttttacgtctcttctctttcagattttgagtctaagaacctgattattgaggtgataaataaatctgttaaattgcacaagattacccgtcatctagtgaagcattgttctttattttcatggttttcgtctctcatctccgttgccagacagaggcttaatggaaatgaaaataaacttttcttgaagcatgtgttggtagcattgaaggaaggtcctctttga

SEQ ID NO: 7672 - DNA, 240 bp, Glycine max
  Peptide Sequence Number=SeqID_124450
atggaaacaggaggtgcattcataagtatggcttcaagtgcaagctctgggcataaaaccagagggatcagcttttggctcaacacattatggggccaaggatttggagagtctacagaggaaagagaagaagagggacacatggcagaggaggcagttatgcaaagtggagattctgttgcagctgaagctatgattgaaaaaggaatatttgggaggggggatattcagaaattgtga

SEQ ID NO: 7673 - DNA, 189 bp, Glycine max
  Peptide Sequence Number=SeqID_124451
atgacggcggaagacggaggaataggaggagtcatgcgccttgatacgatggtcacctcaagtgatggagttgagttggcgatcatgatgaagaagaatgaaaggcgaggcaaatctttaggacaaagaggtagaggaggaatgttgtgtcaacgaagagaaggaaaagaaaggagcacaacaaagtag

SEQ ID NO: 7674 - DNA, 1498 bp, Glycine max
  Peptide Sequence Number=SeqID_124452
atggaaatcatagaagagagaaaattttctaaattgttgtcagagctgatagttttgtccgatgagattgcttctcttgctaagaactctgaaattgaggtgcatatttttgctgagattgccatgttggttgagaaatttccaccaatcttcaatgacttgagggaaaaaaacactgttttggacaagccacctataagaaaatccttggaatctcttgagaatgagctgaggcccagcctagaagtgtccacggacttcagagaaaagattggtacattgcaaagacaattgatgaatgtgagattttccggaagtgccatgaaactgactggagaaatagaagaggaaatagttaatgtctctatcgatgatgttgttttgcaacttaagaatggtaaggatgaagaatttgcggttgcacttttgagactaaaggagttcatgaggagtgaaagactggatggtggcttgattgatgaggaagcaactctttccattcttttcaatcgtctaggttcatgtaaggctgacaataggttgaccatcattcgattgctaagaagtattgctttaggaaatgatgagaaaaaggagaagatggtagaaattgaatttttatcggcagtggtgaagtcactgacaagagattcagaagagaggaaggaagcagtggggctgttgctagacctctctgacattcaggcagttcgacggcgaattggaagaattcaagggtgcattgttatgttagttgctatacttaatggggatgaccctgatgcctcacatgacgcggcaaagttattggatatattgtctagtaatactcaaaatgcacttcatatggccgaagctggctattttaggccactggtacagtatttgaaagaagggtctgacatgaacaagatcctaatggcaaaagcactttctaggttggagctcactgatcacagcaaactttcccttggagaagctggggcaattgagccccttgccaatatgtttagtactggatctggaattgcaggaactctgctacaacttcttttctcagtaacatctgtgctcatgactttgcgcgagcctgcatcagctattcttgcaagaattgctcagtcagaatccatccttgttaatgatgatgtggctcaacagatgctttcacttttgaatttttctagccctataattcaaggtcatctattagaagctctaaataacatagcctcccatcctggtgcatccaaagtgagaagcaaaatgaaggaaaaaggtgcacttcagttgctcttgccctttctcaaggaaaacaccaccaaagtcaggagtaaggtcttgcaattgctgtacagtctctcgaaagatctaacagatgaattgactgaacatcttaatgaaactcatcttttcaacattgtcaatataatctcaacatcaacattagagagtgaaagggctgcggctgtcggcatattgagtaatcttcctacta

SEQ ID NO: 7675 - DNA, 270 bp, Glycine max
  Peptide Sequence Number=SeqID_124453
atggctggtgttggttcttcttcttacaaaggcaatgacaacattctcttctgctttcatagcaagtccaagacaacaaccttcattaacggatggcagcttcaaagtggtggtttagctctgctctgtcaaaactgcggctctctttatgaaaatggaaccttttgtaaggcatttcacaaggaatctgatggatggagagattgtgtagcttgctacaagacttgtatagtatatgctacagactataagctcaattctatgatataa

SEQ ID NO: 7676 - DNA, 318 bp, Glycine max
  Peptide Sequence Number=SeqID_124454
atggcaccggcacaacctattgatatggctagacatctacctatgatgcaggatgacacatatgtggagccacatatccctgaggtcccagtgacaccagcacatgccccttctaatgtggagcagcctaaacatgcagtggaggcttgccaagcaatcacagaaaggttggagcatttcctcaacctaaggatagtcactgcaggcatagaaatacacgaggtcatggaagactgcttaaggatcactaggggtgtcacaacagagggcaatgtttatgtcaggtcgcgacaaaggcggcgcacggatcaacgatag

SEQ ID NO: 7677 - DNA, 447 bp, Glycine max
  Peptide Sequence Number=SeqID_124455
atgccgctaaaggtacttgattttgaacaagctccaatgttgttagaccgtgttcctgaaaatttggggaatttaattcacttgaagtatctaagcttgagcaatacatggatagaaagtcttcgaaaatccattgtgaaggatggtcttggagacatgacatccctacaaaagttacctttacttgaaatagtagacgatggagtggtgattagagagctaggaaagctaaagcagttaaggggtctggttatcatcatcactaatgttaagggagaacttggaaacgctttatgttcctcaataaatgagatgcagttgttggagaaactacacattgatacaacagataaaaatgaagtgattgagttgcaatttatgtcaaccccatctgcacttaggaaggaagctttgcctcagtgggaagttaaggaagttgccaattag

SEQ ID NO: 7678 - DNA, 1548 bp, Glycine max
  Peptide Sequence Number=SeqID_124456
atggcttcttcagcagccaccaccatcccttcactttctgagagaatcaccgcaccatatggctcctggaagtcccccatcaccactgacgtcgtctccggtgcctccaagaggcttggcggcaccgccgtcgacggccgcggccgccttatttggctggaatcacggccagcagaatcgggacggggggttcttgttgttgagccggaaaatccaggaggtgaggctgtggacattactcctaaggagtttggagttagaacagtggctcaggagtatggaggtggtgctttcacagtttcaggcgatgttgttttctttgcaaattacaaagatcagagattgtacaagcaatccatcagttctcttgatgtgcctcccatacctctcactccagactatggtggcccagtagtcagctatgctgatggaatattggacgtacgctttaaccgttttattagtgtaagggaagatcgttgcgagagcagtcaaaatccaactacaactattgtatctatagcacttggcagtaaggatgctcaggaaccacaagtactagttggcgggagtgatttctatgctttcccgcgtcttgatccaaaaagtgaaagaatggcttggattcagtggagtcatcccaacatgccgtgggataaatcagaactatgggttggctatatttctgaaaacggagagatctacaagcgggtatgtgttgccgggaataatccttcacttgtggagtctccaactgagcccaagtggtcttctgatggagagctgtttttcatcacggatagggaaaatggtttctggaatctccataaatggattgagtctgagaataaggtcttgcctgtttattctttggaagctgagtttgcaaggccactgtggatttttggtatgaattcttatgaatttcttcaaagtcatacacggaaaaacttaattgcttgcagttacaggcagcaggggaagtcatatcttggaattattgatgatgtgaagggctcaaaattaactgtgctggatatccctttcacagatatagataacattacttctagtaataattacctttttgtggagggagcatctgccgttcatccatcatcagtggccaaggtgactttagataatgataaatcaaaagcagttgacttcaacattatttggtcctcctctcctgatagtttgaagtatagttcttacttcagtaaacctgagttgattgaattcccaactgaagttcctggtcaaaatgcttatgcatacttttatccaccaactaatcctgatttccaagctagtgaagaagaaaagcctccattattattgaagagccacggtaaatctggtgtgggaacaacaagatcaaatcctcctcacatggctgctgtcgatgctctcgaagtcgatcttatcacgctgtttggaagcatccacttgtatcaagatagatcaatgtgtgcttttcttcttaaggttcaagagattgcagatgtgttagtgtcagttggaagcttgatttctcctcaataa

SEQ ID NO: 7679 - DNA, 2310 bp, Glycine max
  Peptide Sequence Number=SeqID_124457
atgagtgtggtggggtttgacattggtaatgagaactgtgtcattgctgtagttaggcaacgtggcattgatgttttgttgaattatgaatccaaacgtgaaaccccggctgtggtctgcttcagcgagaagcagcggattttggggtctgctggtgctgcttctgctatgatgcacatcaagtccacaatatctcaaataaagagactaattggaaggaagtttgcagaccctgatgtgaaaaaagagctgaaaatgctccctggtaagacttctgagggtcaagatggaggcattttgattcacttgaagtactcgggggagattcatgtatttacacctgttcaatttctgtccatgctctttgctcacttaaagactatgaccgaaaacgatttggagatgcccatttcagattgtgttattgggatcccatcttactttaccgacttgcagagacgggcgtatcttgatgcagcgaaaattgccgggttgcagcctttgagattgatccatgattgtactgcaactgcccttagttatggaatgtataaaacagattttggcagtgcaggtccagcttatgttgcatttattgacattggtcactgtgatactcaggtctgtattgcatcatttgagtttgggaaaatggagatactttcacatgcatttgataggagcttaggagggagggactttgatgaggttatatttagtcattttgcagcaaaattcaaggaagagtaccacattgacgtgtattctaaaacaaaggcgtgctttaggctacgtgcagcatgtgagaaattgaagaaagttttgagtgcaaatctagaggcacctctaaatatcgagtgcttgatggacgggaaagatgttaagggatttatcacaagggaagaatttgagaagctggcatcaggattactggagagagtttctattccttgccgcagagcattaactgatgcaaacttgacagcagagaagatttcttctgtagagctagttggttcaggttctaggattccagctataagtacatcactaacttctctgttcaagagagaacccagccgacagctgaatgcaagtgagtgtgtagctcgtggttgtgctctacagtgtgcaatgctcagtcctgtttaccgcgtgagagaatacgaggtcaaggatgttattcccttttcaattggactttcatcagatgaaggtccagttgctgtgagatcaaatggtgtacttttcccaagaggccaaccctttccaagtgttaaagtcataacctttcagcgaagtaatttgtttcatttggaagctttctatgctaacccagatgaactaccacctaggacatctcctaaaattagctgtgtcacgattggtcctttccatggatcccatggtagtaagatcagagttaaagttagagttccacttgatctgcatggcattgtcagtattgaatcagctacattgatcaaggatgacatggatgatttggttatggctggtgattatcattcaaattctgatgcaatggacattgatcccatttctgagacagttaccaatgggtttgaagatgataccaataagaagttggaatttccatgtagttctgctgatggtacaagaaaagataatagaaggcttaatgtgccagtgaatgagaatgtctatggtggaatgacaaaggcagagatctcagaagctcttgaaaaagaactccagttagcccaacaggacagaattgtagagcaaaccaaagaaaagaagaatagcttggagtcttttgtttatgatatgaggagtaagctcttccacacatatcggagctttgcaagtgaacaagagaaggatggcatatctagaagccttcaagagactgaggaatggctttatgaggatggtgttgatgaaactgaacatgcttattcttcaaaactggaagatctgaaaaagctggtagatccaattgagaatcggtacaaagatgataaagaaagagtgcatgctacacgagatttatcaaagtgcattttaaagcatcgtgcttctgcagattcccttccaccccaggataaagaactgatcatcaatgagtgcaataaagtggagcagtggttgaaagagaagatccagcaacaagaatcatttccaaagaatactgacccaatattatggtcaagtgatatcaagagcaagacagaggagttaaacttaaaatgccaacagatattgggatctaaggcttctccatctccagaagacaaagacaagccggatacattcaatgatccctga

SEQ ID NO: 7680 - DNA, 583 bp, Glycine max
  Peptide Sequence Number=SeqID_124458
atggccacgttagccattgccgttctcactctcactgctcgcgtttcttcttcttcgtcaccttattattattccaactttttcttcactcgctccttcaacattttcaccacaaaaatcaccgcaccctatggctcctggaagtcccccatcaccgccggcgtcgtctccggcgcctccaagagacttggcggcaccgccttcgacggatgcggtcgcctcatttggctggaatcacgtccagcagaatcggggaacactgagctcacagctttagccatgaagttcaaacgaatggaggcaaacaaactgacgcaaaagaaatgtgagtgttctctcttccttcctactgttccttcttctgccttccttctcttccttctcctctatggaagagatgctaatggcggtgctgaggcggatggcgctttgcccatgcaagacctttctttgtttgattttttccggctttggtttttatattgctttggacggaaaaaagatgtagttatgttcgattttgaagctgtgacctttatgtttgtgacgatcacacagcctgtttgtcttgccttctctgtgg

SEQ ID NO: 7681 - DNA, 465 bp, Glycine max
  Peptide Sequence Number=SeqID_124459
atgtgcatcgactaccacaagcttaacgaatccacaaggaaaaaccattttcctttacctctcatggatcatatgttggagaggcttgcgagacaggcctattacggcttcctagatggatactccggatataatcagattgttgtggaccccaaggatcaggagaagatggcttttacatgcccttttggtgtctttgcctatagacgaatgccatttgggttatgtaatgcacttgccatattccaaaggtgcatgttggccatttttgcagatatggtggagaaaagcatcgaagtattcatggataacttttcaatgtttgggacctcatttgaaagctgcttaaagaacttggaaatggtactacaaagatgcatagaaacaaacttggtgctaaattgggagaagtgccacttcatggttcgaaaaggcatagtcttgggccataaaaatttggcttga

SEQ ID NO: 7682 - DNA, 312 bp, Glycine max
  Peptide Sequence Number=SeqID_124460
atgcctattatggagtttcggaatggtcattccataagtactaagtacaaattggactttcagaatacctattccggatacggttcccactatttctcttccaaaatagatgttgtacaactgcacgtggacaacgcttttgctgcctcccttatggaagagaatcactgtgtacagcgaagagatggaaaggaagctcgtggagtcaaatgcaaaggaggaagaagaacctcatggagttcaatgttaaggtcgtggtggcatctcttggtcgtgaagaggaagctcgttggtggtgaagttgaacgctga

SEQ ID NO: 7683 - DNA, 276 bp, Glycine max
  Peptide Sequence Number=SeqID_124461
atgaggatgaacgcctacgaatcctccataatttataagcaaaagatgaaggtgtattatgacaagaaaatacagagacaggatttccagctaggacaacaggttctactctttaactccaggcttaggttatttctaggaaagctggagtcaaactggtcatggccattcatgattaaagaagtgagaccccatgtagcagtggagttgatggaccctacaatgggcaaccctgaaaagagatggatccctaaaggaagcacaacgtctagctaa

SEQ ID NO: 7684 - DNA, 264 bp, Glycine max
  Peptide Sequence Number=SeqID_124462
atgaaatccggtgcggttattgacctgattgaggtagtgggttttaaaaaccgatacggcttacaagagttacccccaaaccagccggatttaaccggaccattatgggctaaatgcataactggtctaataactaaactggctcgattatgtcactgggttccagttggatcgtcgaattgggtttttgaactatggtgcgaacgatgttggggaccgaagtgcaggcatcgattagctgcggcttcccttgcagtgaggtag

SEQ ID NO: 7685 - DNA, 231 bp, Glycine max
  Peptide Sequence Number=SeqID_124463
atgttgaaaggagggagcatagactcagatttgcaagaagcgatagcgagaaaagttggagaggttgagttttttctggaagtagagatagaggtgttggagatgcaaagattttggcgggaagaaacggtccaggggagaggaggaggagtcgtgggtgaaccagatgccatcgaggagccgtcgcgattaagaggtgtcttcgttgcggaagggagacgtatctcataa

SEQ ID NO: 7686 - DNA, 966 bp, Glycine max
  Peptide Sequence Number=SeqID_124464
atgtatgacccagaggatggagctccaaaatactgcagggtgcaggggcaggtcattagattcgatgcaaagacaatcaacgacttcctcgacaccccagtcatcctggctgatggagaggactattcagcatactcccaatatctgcatacgtacccggaccatcaggccattgcagcaaccctatgcacacctggtggaggttttgttctgaatgttgatggtgctccatggaagctgttggggaaggatttgaccacactcacacaaacatggagcatactttcttactttaatcttgctcctacttctcacacttctgatctgaatgttgacaaggcacgactgatttatggtctagtaatgaagatggacatggacttgggcagtttcatctcaggtcaaatcacacagattgcccagtccagcacctccaggctagggttcctagcgttgatgacaacgctatgtgacgctcagggggtaatttctgattccctgacattcgagtcactaagccctgtgatcaacttggcctatattaagaagaactgttggaaccccacagatccatccatcacattcctcgggccccatcgtacccgcaccagagctgccgcgccaaacaccctgcctctcgcacaaccaccaccacaggtcgcacgtcaccagaaaccatccacttcagccccgccggatctacacagtcagatgctccggtccatttatcagggccaacagatcatcgtccgagatcttcatcgactttccgttcacatgaagatggacccaccacttatgaccccagaggccttcatccagcaggttgcgtggccaggagtccaaccctctactgatgggaggggtgagccctctaaggtcagagagactatggccggagctaaagatgacatcatcgcgaacctgacagctactgatttgggcccatggccagacttgggttga

SEQ ID NO: 7687 - DNA, 192 bp, Glycine max
  Peptide Sequence Number=SeqID_124465
atggttaccgaatcggggatgaggactttactgagagtggtacctgaggatatgtcgtgggggtcaggagaccttggggacgtcaggtggggtgctattgcccaaaaccaagcttggccaatcccgacccaacccgggcatagtcagccagtgagaacctgtgacgtacctaagcaggcgagctcctggtag

SEQ ID NO: 7688 - DNA, 204 bp, Glycine max
  Peptide Sequence Number=SeqID_124466
atgggtgatgggtgtatttatgaagaggcagagagagacagaagcagagggttcatgtggagtgtgggggcaaagggacatggtgggaaccaaaccactggtcttcactgttctatgttagttctcccaatgccaacgttgacatggaccctatctcacaccctcactcacaattacatcaactacattcattcacctttataa

SEQ ID NO: 7689 - DNA, 294 bp, Glycine max
  Peptide Sequence Number=SeqID_124467
atgaagactgtcatgagaaggagatttgtaccaagccactatcatagggatttgcacagaaagttgcaaactctaactcaaggttccatgagtgtggaggactactacaagaagatggaaatagccatggttagaaccaatgttgaagaaaaccgtgagaaaactatgacaaggtccaagactaaaaggatgaagcaagcattgcaagccctgatcctaaagatcaaaaagaaagaagaccaatgtgaattaagggctgcacctaattgggttactctcctacagatattttga

SEQ ID NO: 7690 - DNA, 1401 bp, Glycine max
  Peptide Sequence Number=SeqID_124468
atgggaggtggtggtcgaagctcagctactctcaagcatcaaaactcaattaaaaaccattcaaagaagaagcgtgtcccacatgcaaagccacccttcactctaagccaactgaagaaggcaatttcaccacattgcttccaccgttcaacattccgttcattctcctacgtcctctatgacctaaccatagcctcatgcctcttctatgccgcagtaaattacatccctacccttccccatgaaaacctctccctcctagcatggcctctctattggttcatccaaggttccatcctaaccggggtttgggtcatcgcacacgaatgcggccaccacgcctttagcgatcaccaatggctcgatgaccttgttggcctaatcctccactcacttctcctagtgccctatttttcatggaaatatagccaccgccgccaccactcgaacacaggatcactcgaacgtgatgaagtgtttgtgccaaaaacaaagtctagtatgggttggtattctaaataccttaacaactcaccagggagggttctcacacttgctataaccctaaccctaggttggcctctttatttagctttcaatgtttcgggtaggtcttatgagagatttgcatgtcactatgacccttatggccccatttactcaaaccgtgaaaggcttcagatttatgtgtccgatgctgggattcttgcggtgtgttttggtctctacaaggctgtcttggcaaaagggcttgtttgggttgtttgtgtttatggggtgcctttgttggtggttaatgggttcttggtgttgatcactttcttgcaacacactcaccctgcggttcctcactatgattcctccgagtgggattggttgagaggtgctttggccactgtggatagagattatgggattttgaataaggttttgcataacatcactgacacacacgtggcacatcacttgttttccacaatgccgcattatcatgcaatggaggctactaaggctataaaaccaattttgggagagtattatcactttgatgagactcctatttataaggcaatgtggagagaggcaaaggagtgcatgtatgttgagcctgataaagggtctaatgggaaagttataaattctgctactcttaatctgcacaagatcaaaaacaagaaaaacacagaaaacacagcaaagcaatacacaacagagcaagagcccaaagatttacgtggttcggcaatgtgcctacatccacgggaaaacgcagctcatcatcatcttcacattgatcatgaaattacaagttcaatacaagcagcagctagctttgatctctcttggtttctctttcaacaaaacctctctcaatcacctagctcactacctcccttttga

SEQ ID NO: 7691 - DNA, 495 bp, Glycine max
  Peptide Sequence Number=SeqID_124469
atgagtgagaaaaataataatgctgatgtcggcgattgcatgattcttgatgaccatgaaggagaagagcattgttgtggcaaaggaacaaatgcgaggagtgtttcttttttgccaataagccaagagaagataggagattcgactaaagttgtgataaaacaagacatgaagggaggagagcataaatatgggtttaacaataataaacgtgagaagccagagaaggtaagggtggtggatgatgaaactggagacaaacatgagttgtatgaagtcctaaggatgccatctagaacaaaaaaccgatgcctcaagttttttactgaggacaggaggggtattataaacatcgttctctacatctaccagacaccaaatccaaaggaaattgttcaaataaaaatagtgtcttatcactcttgtagttatgttctttgcgattgctctgtggcacttgatttgcatggtatccatgttaaattttctgtataa

SEQ ID NO: 7692 - DNA, 285 bp, Glycine max
  Peptide Sequence Number=SeqID_124470
atggcacgaaacttcaagctttcctccaccttagtacctagcggaggagtgtatgtagggttttcttcaagccacagttccaagagcagtgtagggggttctgtgggttcgagcgaggggtttccggcagtattgaaaacaatgtgggacaatgtgggtgttgagagagcggtggcagatttcaggcgggaggagaaagagaagagcgatttcaggcaggaggagaaagagaagagcgagtgcaaggttttcaagcacgcgggttgtgaaatgtcaacgttttaa

SEQ ID NO: 7693 - DNA, 333 bp, Glycine max
  Peptide Sequence Number=SeqID_124471
atggagcaaccacaagacatcgtagtcccttttcatcatcaaccaaccatccaagactatatcatgctgcttggtgagctcctggatacttggtttgcactcaaacagactttggtagacaggaaaaaagctaaagaggaagctatgtatcaggccaagaaaatgatgcatcttgaagaacgtcagcaagcaaatgatgaagtctatcgtctgaagaccatcctaactacacgagtacatgttcctacccaatcatctacaccagttcctgtagagtctttagattctttctctgactcttttgagaggaagtttcttgatatggccaagtga

SEQ ID NO: 7694 - DNA, 234 bp, Glycine max
  Peptide Sequence Number=SeqID_124472
atggaggtccttggtgcttgttcccatgaattggttgtggttaaggtttttgtagacttattaggggaaattgatttggttacccctgttgtttcagttgatgagcttgaagatgatccttcttcaaacagttgcttcttggatcaagaggagttagaacagtttttgcttcttgtacctagcatggttgacaagggggctgcccttgctcctacatatcctcaagtgcgatga

SEQ ID NO: 7695 - DNA, 246 bp, Glycine max
  Peptide Sequence Number=SeqID_124473
atggactcaagcggtgtgcttagcgggatgacacctcactcaacgaacatgcacagctcatccttcttccatattctttctcgcgctcagcggatggagtggagtttgatacaatttacacaggttttatacacaaaagttattcatattcatcgactaacaactcccccaaatttacagttttgcttgtcctcaagcaaatacagaacagctcactggtccccaagtgacaagaatatgcagtga

SEQ ID NO: 7696 - DNA, 108 bp, Glycine max
  Peptide Sequence Number=SeqID_124474
atggcgggaacaaggatgccgccattggcagcagcgggatggggtatgactcagcttaaaccgccagctagttcacatgcacccacttcttgctttagaggagagtag

SEQ ID NO: 7697 - DNA, 177 bp, Glycine max
  Peptide Sequence Number=SeqID_124475
atggcgagttcaacatgctttcaacaaatttcttcacatttaactatcatgaagcagaaacctagcaaaactacccatcatatctcccaaaaccccatacccacgaacatcaagagagaaagaagtctacccaaacctgaaatttcgagaagtgggcaccaaaggttggagctttaa

SEQ ID NO: 7698 - DNA, 240 bp, Glycine max
  Peptide Sequence Number=SeqID_124476
atggagacaggggaacgagggaggggcgacgagggagggtccgacaccgacctctcgcggcggtttgtggaggtgagggagggaggacaaggttccaacgccagacaacactcgcgtctccatgacgaggaaggaatagcaagaagaagagagtcgcgcgcgcgcgcgcgcgcgcgcgcgcgcgcgcgcgcgcgcgcgcgcgcgcgcgcgatacagagaacgtctggtttctttctctaa

SEQ ID NO: 7699 - DNA, 291 bp, Glycine max
  Peptide Sequence Number=SeqID_124477
atgggattgaaggccatttctgatggcaaattagctgtgttgcttttatctggtggccaggtacatagaaccagatggactggagatgcttcttcaagcccaaaactcccgtccaaactccacaaaaaacaatcatcttgcaccacttctgtagcaattgttgcttgtgttccaaaaaaagttcacattgagggagctggtgaaacaggattcaagatatcatcaattgaaattacggatgctatcaaagctgtggattggatgaacctattcagccagagcctgagctga

SEQ ID NO: 7700 - DNA, 210 bp, Glycine max
  Peptide Sequence Number=SeqID_124478
atgcgggtgaatagtgggaacacttctaattcaccttcgtattgcaacaataagaatgcctattcgtctgtggtgggttgccctttttgtttgttattaaatgtattaggaaatcgtgatattccaatggttggcaaatatgcctgtagaattggaaggatatatccgccctgggtgtacgatcctgacagtttttattgcaatgcctaa

SEQ ID NO: 7701 - DNA, 210 bp, Glycine max
  Peptide Sequence Number=SeqID_124479
atgtctctcttgctatccccttcccctgctatgcttccttcctccctacctatcagtgagcagcactactgttttatcagcggtcttctctcacttaaaagtctcccagacccgccttctgtacttggaaacgagctaacaaacgttagcgagcatataagagggcatgaaatagctctaccgggacttctccttatatatagcttttag

SEQ ID NO: 7702 - DNA, 291 bp, Glycine max
  Peptide Sequence Number=SeqID_124480
atgagaaccctaaggccttctttatcagctttagcccaatccttgtgcagcctcttggtcatggctctgttgcgcttaactcatccgtgggctaagcgcgcatccactgctaagcgcaacttcagtgtgcttagcacaacagaagaatttggcagggcatcatcatcaaggttgcgcgctaagcacgagatcagtgcgccaagcgcaacaattgtcttcagccaagctcagcgcacgactggcgctaagctcaaatccacttactcgcacttagcgcgagggtggcgctaa

SEQ ID NO: 7703 - DNA, 570 bp, Glycine max
  Peptide Sequence Number=SeqID_124481
tgtgccggattacgggaagagaatgcaactaccgcaagagcccttgaacaagaggccaagagggctcgcaaggaagagtatggccgtaacaaatttcgcggagctctgtggggtagcaacaatgaactcaagctgcgaagggaagagagggaccagtcgcgagcacatagcatggtcttgaaagaggagttagttgcctgttcaaggtccaaaaggagcttgtctcagcgtttatgtgagacggagaccaacatgctagctatcaacgccaagtaccaagaagagttaggtctagccatggcccacgagcatagggtcgcggacgagtatgcccaagtatacgcggaaaaagaggctagaggaagggtgatcgactctttacaccaagaggcgaccatgtggatggatcggtttgctcttaccttgaacgggagtcaagaacttccccgattgttagccaaggccaaggcgatggcggacacctactccgcccccgaagaaattcatgggcttctcggctattgtcagcatatgatagacttaatggcccacataattagaaatcgctag

SEQ ID NO: 7704 - DNA, 402 bp, Glycine max
  Peptide Sequence Number=SeqID_124482
atgggtaaagtagaggaggcgcaagagcagatgaaggtcgacatgttggccatgaaagagcaaatggccacaatgatggaggccatgatgagcatgaagaagataatggaagccaatgcggttatagttgccgctaccagcgctgttgctaaggtgaaccgaatgcccccatctagcctcaaccaaatgaatcatccaacctcagctatggtaggcaaagatttgggaagtacgggcggcccccccattatgcgcaattcaaaacaagcatgccttctcaccatatggctggcctcccaactatacaccaccccaatgtggcatacattcccaatgaggatgtcaataactccgctcccatactcattgaaatgtctctcaacccatgggggaggcacatga

SEQ ID NO: 7705 - DNA, 207 bp, Glycine max
  Peptide Sequence Number=SeqID_124483
atttcgaagaccaagagggttgtcgtgaggaactggaaagacaacattatggttgacatttgcgagttttacctcaaaaatgacaagcaattgcctagcaggaaaggaatagtaagggttttagattgtttagtgcattgctctggttacttctccagcgtaatgttggggaaactcagacttttccgcttcgtgaagttaagatag

SEQ ID NO: 7706 - DNA, 126 bp, Glycine max
  Peptide Sequence Number=SeqID_124484
gcttggcttagtgcgaggataagaccgcttagcaagttggctgagctcagccttggccagcttagcggaccaaatcagcctccaatgcaagggttgggcgctaagcacttgagactcgcggcttag

SEQ ID NO: 7707 - DNA, 877 bp, Glycine max
  Peptide Sequence Number=SeqID_124485
gtcgactctagaggatcccactgtggcggcagtcgcggcgtccgtcaccgcaggtgcagcgagaactgcccgaagcgctggcactgggcgtgcgccgcgaggctgcactgcggttgcaggcagacgcgtcgatgacggtgcaggtgttcgacctggtgcccggcggttggccgttggagtcgctgccacagcgcgtgcacctgcaggcgggcaccgctgccaccctgcactaccatctgcagccgctgcagcgcgggcatttccgcttcgagggcgtgcacctgcgcatgcgctcgccgtggcgcctgtggtggcagcaacgcacgctgccccccgcgctggacgtgcgtgtctatccgaacttcgtgccgctcacccgcttcgcgttgttcagtgccgaccaggcctcgcggctggtcgcctgcgccagctcgactggaaggccaccgcgcgtgcacgcaagctgatctcgcgcgagtaccaggacgagaagaaccagcagctgctgctgatgctcgacagtggccggcgcatgctggccagcgaaggcggactctcgcacttcgaccacgcattgaacgcctcgctggtggtggcttacctggcgctgcgccagggtgacgccgccggcctgttcgctgccggtggtgaacgccgctgggtggcgccgcagcgtggcatgggcacggtcgagcacctgctgcgtgccagctacgacctgcagccgcgtgcggtggccaccgattacctggccgccgccaccgaggtgtcgctgcgccagcgccggcgcgcactggtgatgctggtcagcaacgtgcgcgacgaagacatcgaggatctgctggcggcggtgcgcctgctgcagaaacgccacctg

SEQ ID NO: 7708 - DNA, 756 bp, Glycine max
  Peptide Sequence Number=SeqID_124486
atggcattcactgtggttggcggctgtgggcctggtggtggccggctatgcttacggcgccattttcgtcggcagcgcgaccctggtaaacctgatttcgccgccggccagccatgcgcgtttgctttcactgttttacgttatcgcttatatcgccaactgggtgccgatcttgttggggatcgtggtcgaccgtgtcgatctgcagcaggcaacccatgtgctattcctgagcagcaccacggtatgcctgttgttggcatggatgacgttactaccgggatcctctccggcgtgtggggctgggttgccgtcagcctggggctgatcggatgggccggttttctcgactgcacagcatatttcgcctgcccgcagggcgggctgaaagggctgttgatcggcccgatgacctgctgcaacggcgtcttctgggcaatggcgatcatccacggcaacgaactggcgccgcagtgggagctgctggggtatctgctgaccggcgtcgttgcgttcctgatgtgcattcaggccaaacaacagtggctggggtttgtgcccggcacctttatcggcgcctgtgcgaccttcgccggcggcggatattggccgctggtgacactttctctgttggtgggcttgctgtttggctatgcgatgaaaaacagcggtctgtggtgggcggcgcgcatcgaaaaagcccgagccgcacagacggtcaacccgaatgccggctcaaacggtgccgccgagtga

SEQ ID NO: 7709 - DNA, 465 bp, Glycine max
  Peptide Sequence Number=SeqID_124487
atgagtgaaataaaggaggtacaagagcagatgaaggccgacatggaggtcatgaaagaaaaaatgaccacaatgatggaagccatgatgagtataagaaaaatgatggaggtcaacacgactacagtcattactgcaagtaccaccattgaggttgacccaactcacccatctagcctcaaccaagtaaatggcccaaccttggatatggtaggtcaggaaggcaaagcgttgggaagtgcgggcgacccccattttgtgcaggtccagagcaagcattccttcccaccatatggcttgcctcccaactatacaccacccaatattgcacatgctctcgatgagaatgtcgataactccactcctatacttactaagaatgtcgataacaaccccaatctggtcaggcacaggtccctcaacccatgggggagacacatgaagtaccccgagaccacactctag

SEQ ID NO: 7710 - DNA, 528 bp, Glycine max
  Peptide Sequence Number=SeqID_124488
atgacattgctacttagcaacattctgctcagcgaccgtattgccaatctccccctgcaaaagtatcagttgggatcgcacccacaaagacacccagtggacctgaaaaagtccaacagggccctggggtttccagctctggttacgggcctctatcagtcctacagggtgcccgtacccccccggcaaggtcacgtcatcatagggatcgcgcctgcaagacacccagtggacccgaagaagtccaacagggtcttggagttgtcaagctctaattacgggtctctcaagggcatcaggccccctactaatcgagctttcatcaagaagtattgcgcccccaggcaggcgcagggcgaaacaccacagcagcctggggatggccggcagcgggcaacagacgcaccgccatcacctctagagttcacctctgctcatccacgaaaaggtttgagtattgcctacaccacatggccgaccaataggcgaccaagtccaaagccaaaggacgcacctagttgctcatga

SEQ ID NO: 7711 - DNA, 180 bp, Glycine max
  Peptide Sequence Number=SeqID_124489
atgccttatttcggaataaaactctgtctaataagcaagttccctgagttcggaaaattggaccaaaaagtaactgcaggggaaatccaacatctttatgatgtcattactaggatggagaaggtttttgagcagggcaatgccattgttgctggagttgaaggggtggaatgccactag

SEQ ID NO: 7712 - DNA, 279 bp, Glycine max
  Peptide Sequence Number=SeqID_124490
atgaggtgggttgttacatttttggtgcccaagaaggatgacaaatgcaccttttgtgtcgatagtgtagtcttcttagcttttgtggttagcaaaaatggggtccatgtggatgctgagaaaatcaaggccatccaagagtggaccaccccaaaaagtgtaggagatattaggagcttacatgggttgacaagtttctatagatggcttgttcccaatttctctacacttgcttcaccactcaatgagttggtgaagaaaaatgtggcattcacatag

SEQ ID NO: 7713 - DNA, 564 bp, Glycine max
  Peptide Sequence Number=SeqID_124491
atggccccgaggaagcttgcctcaaagaggtccaggaaggacaaggcagccgaaggaactagttccgctccggagtatgacagtcaccgctttaggagtgctgtacaccagcagcgcttcgaggccatcaagggatggtcgtttctccgggagcgacgcgtccagctcagggacgacgagtatactgatttccaggaggaaatagggcgccggcggtgggcaccactggttactcctatggccaagtttgatccagaaatagtccttgagttttatgccaatgcttggccaacagaggagggcgtgcgtgacatgagatcctgggtaaggggtcagtggatcccgtttgatgccgacgctatcggccaactcctaggatatccgttggtgttggaagagggccaggaatgggaggcaagtgcgaatcatgcgcaccaacatgaccaccctgacccagatatggatgacggttgctcctcagcaacatcctgcccaccgatcataattccgaccttcccatgccgaagtggtcagcttggtgtacgccatcctgacacgggatga

SEQ ID NO: 7714 - DNA, 219 bp, Glycine max
  Peptide Sequence Number=SeqID_124492
atgtccagtattttcgggccagatgtcctggacatcgtatccgacattgtggatcctgcagcttccattcttcatttgacttttatcttgccttccagtattttcgggcaggatgtcctggacattgtatccgacatcgtggatcctgcagcttcaatgcttttagcaattccagtattttcgagcaggatgtcctggacattgtatccgacatcgtga

SEQ ID NO: 7715 - DNA, 214 bp, Glycine max
  Peptide Sequence Number=SeqID_124493
tattatggcacattctccagacaagataaagagcatcgatggctcaaaagaaactcttaaacttagtgtgaggatcagtgatctatggtttattggcacgcctaacaaatctgagcaagctgaaatggtgtttgtggacttcgatgaggttgtctttcgccaagtttcaggaaaaggtagaagggtagtcttcaaactaaaggacttgaggtaa

SEQ ID NO: 7716 - DNA, 213 bp, Glycine max
  Peptide Sequence Number=SeqID_124494
atgcgagaaggtagctttgcaccatgtgttttttggatatcatctgaaggattgccccttattctctcatacataaccaaacagattctgcatgcatctcctgcagacttcaagcagcttttgcagaatagagaagtaaagtttgaagattttaccgatgttgctggtattgctagacttattaaaacacttcatcctgattggagtccctga

SEQ ID NO: 7717 - DNA, 1119 bp, Glycine max
  Peptide Sequence Number=SeqID_124495
atggaaactgaaaattgcgaaacttttggcacaacctcactagatactactagtgttggtattgttggccactataagttcgaaaatgggtcatctcagtttgctttcatgaaagttgagaatgaaagaggagtttcccttgaccattccctcagcttctctactgaaaattttgtgcagacccttgcattttgcaacagcttgattctcatgtctggttttagtggtgacaaatcctgttaccatgtgttgaatcccttcaccaagcacaatgtcatgatccctcaaactagtatccaagggggtgttgttagagttggattggcctatgatggagaccaattttttgatgttgttcttgttgaagcagggtcctcaaattccaatggactaaaactgcatgttttctcttctgaaactggccaatggaggtgccactaccccatcaatttagctgctgccccttctttgccagaacatgagttccaagaacttggaacacctcctctttacgcgaacggcgcgattcattgggaaatagatggatatttgttggtgtatcaagtccaaggcagccaatgtgcactatatgaactaccaaactactttgagggttggtcttggcaatcaacactgccttaccgccgttgcttgtgcgaatcaggaggcaaggtgtactattgctactccgatttcgatggctttcacatttggaatctcctcaatgagcaagaccatcttgaattcttcaattattatgattacaaaaggtttccatggaaactagttcatagtgtcatgcatgaagtgcttatgcctaagaaccaaaacttttttggcagcttctttgattgggagccttacaaggttgcacctattgcctacatcgaagaagcacagatcatatatttgcagcttccaggaactgttgttgcttacaactttgacacaggaactatggaatcaatctgcaactactcttatccaggcttaaacttcagttgctgctcattcttttcttcaactactactctgcctcacaatgcacagagagacaacactgatggagaattggagctgaatctacccatagcagagatggaaaagttaaccctctaa

SEQ ID NO: 7718 - DNA, 364 bp, Glycine max
  Peptide Sequence Number=SeqID_124496
atggtcaagtctcaaccaattctgagatacctcaggcggattattcccgcagtagcattagcaaccctcttatcggcatgtagcagtacccataacggtcagaacgcgaataacgagaatcatgaagttaacaaccagaatggttttttacttcaggcgtctcaggacgaatttgaacaaatggtgcagaacgtggacgttaagtcccgcatcatggagcagtacagtgactggaaaggtgtgcgttatcgcttaggcggcgacaccaaacgcggcattgactgttctgcttttgttcagcgcacctttcgcgaacagtttggtttagagctgccgcgttccacatcggaacagcaggacagcg

SEQ ID NO: 7719 - DNA, 381 bp, Glycine max
  Peptide Sequence Number=SeqID_124497
atggcagcggaatggagaagtaagagagagaggagacgccactttaaggagaagatgagtctagaagaagctcaccatcataggaggccatggataagagcttggaggaagaaggagatgaatgaagggagaggaagagaagagcacaaaattttgtgctctaaaagagctttgaaatctaaaataattggacccaatcttggtccatgggctcaaaaatctaccctaaggttcatgagaaccctagggccttcttcagcagctctagcccaatctttttggagcctcttactcatggctctagtgactagtcccttcctagggaggattgcatcaatacgtaggagtgagggtaatacccttgtcgactcaaaaggataa

SEQ ID NO: 7720 - DNA, 345 bp, Glycine max
  Peptide Sequence Number=SeqID_124498
atggaaccccatgtggcacaacctcacccaaggacaccaaatgctgctcctactcgtcccatgcctgactacacctctcatatacaagatagggaggtggcaacaaaggagtcctcttatttactagaattgcctcaaaaccctctctgggaccagataacatcaaccaacatcaaccatctgcagatgattcgactcctccctaatcgaatcaaccgtgccaatacccctcaacgacttccacctagctgcaagctttgcggctcacatatgacaattgatcataaagaaatgtcagtgcaactactccccaggcgtactccttgcagtgacttagatcactga

SEQ ID NO: 7721 - DNA, 3207 bp, Glycine max
  Peptide Sequence Number=SeqID_124499
atggcagaccatcgaaatggaagtacacaaccccccaatggaaaggccagtgcagcaggatctgcatattctattgatctgaatgcatttcaatcccgattgaaatatttttataagcattgggatgatcacaaaacagatctgtggggctcttctgatgcaatagcaatagcatgtcctccaccttcagaagacctgcgatacctgaaatctaccgctctgaacttatggctgcttggatttgagttccctgagacaattatggttttcatgaagaagcagatccatatcctgtgcagccaaaagaaggcttctattcttgaatctgtcaaaaaatctgccaaagaggcagttggtgcagatcttgttttgcatgtcaaacctaaaaatgatgatgggactgctctaatggatgctatattccgtgccatccgtgctctgccaaagtctgatggccatgattcttccactgttggatacatatcaagagaggctcctgaagggaaactgcttgaaacatggactgagaaattaaaaaatacaaaatttcaactaactgatgttgccaacgggttgtcttatttgtttgcggcaaagagtaacgaggagcttacatcaattaagagagcagcatacctcacaaccagtgtgatgaaaaactttgtggttacaaaacttgagaatgtaatcgatgaggagaagaaaatctctcactcaacattgatggaggagactgagaaagttattctggaaccttcaaaagtcaattgtaagctaaaggcagataatgttgatatttgttaccccccaatttttcagagtggtggagagtttgatctcaagccaagtgctgtcagcaatgatgagttactgcattatgattctgccagcgtgattatatgtgcagttggagctcgatataagagttattgctcaaacatagctcggacattcttgattgatgcagatcctcttcaaagtagggcttatgaggttcttctgaaagcccatgaagctgtcataggttctatgaagcctggaaacaagttaagtgttgcataccaagctgcagtttctgttgtggaaagggatgctcctgacctgatttcatatttgacaaaatctgctgggacaggcatcggcattgagtttcgtgaatcaggattgaatcttaatgcaaaaaatgaacagataattagagaaggcatggtctttaatgtgtcacttggttttcagaatttacagtgtgagaagagtaaatctaagaacaagcaattctctttgttgcttgctgacacagtcatcatcaccaaagataagacagaaattgtgactgctacgagctcaaaagctctgaaggatgtagcatattctttcaatgaggatgaggaagaggaaaggccaagcacaaaaccagatgccaagaaagctgagccctttatgtctaagacaactcttaggtcagacaatcatgaagtttcaaaggaggagcttcgcaggcagcatcaggcagaacttgctcgtcagaaaaatgaagaaactgcgaggcgtcttgctggtggtggaagtgaaacaggagagtcccgttcctctgcgaggacttcagcagaactcatggcctacaagaacataaatgaccttccccctcccagagagatgatgattcagatcgatcagaagaatgaagcagttctcttgcctataaatgggagcatggtaccttttcatgtggctttcattcgaactgtttccagccagcaggacaccaaccgcaattgctatgtcagaattatttttaatgttcctgggactcctttcagtcctcatgatgcaaactcaatgaagttccctggatctatatatttgaaggaggcgtcattccgctccaaggattcaaggcacattagtgaggttgtgcagtccattaaaacactcaggcgacaagttgtagcaagagagtctgagagagctgagagggcaaccttggttactcaggagaaactacaacttgctaataatagatttaagccgataagattgtctgacctttggatccgtcctgcttttggtgggcgtggaaggaagatacctggtacacttgaggctcatgtgaatggatttcgttattctaccactaggcaagatgagcgtgtagacataatgtttcccaacattaagcatgcatttttccaacccgctgagaatgaaatgatcactctcctacacttccatctgcacaaccatattatggtagggaataagaagaccaaggacgttcaattttatgttgaggttatggacatggtccagaatgttgggggtggtaagaggtcaacgtatgaccctgatgagcttgaagaagaacagcgagagcgacagaggaagaataaaattaatgtagaattccaaacctttgtgaatcgggtgaatgatctctggggacaacctcaattcaatggccttgacctggagtttgatcaacctcttagagagcttggcttccctggtgtgcctcataaatcttcagtatttatcgtacctacttctgcctgccttgttgaactgatagagactcctttccttgttgtcacgcttagtgagattgagattgttaatcttgagagagttggacttgggcagaaaaactttgatatgacagtagtatttaaggacttcaagagggatgtcctcaggattgattctatcccttctacatcactggatggcatcaaggagtggcttgacacaacagacatcaaatattatgagagcaggctgaatctgaactggcgtcagatcctgaagacaataacggatgaccctcagagctttattgaaggtggcggttgggagtttctgaatttggaagctactgattcagaatctgagaactcggaggagtctgataaaggttacgaaccatctgatgtggaacctgaatctgattcggaggacgaagcttctgacagtgaatcacttgttgagtctgaggatgatgatgacgatgaagattccgaggaggattcagaggaagagaagggaaaaacatgggaggaactggagagggaagctagcaatgcagatagggagaagggaaatgagtctgacagtgaagaagataggaaaagaagaaaggcaaaaagctttgttcagttgttctatgcagttgctgcggttagcagctttttgtgtttggactttggagct

SEQ ID NO: 7722 - DNA, 390 bp, Glycine max
  Peptide Sequence Number=SeqID_124500
atggcatctctaggtctttcccaacaatttacggtcgtagagccagtaataccttatgagagcacaaaaaggagttgtgttgctgctaatccatcaggggacgatatggcaattggaaaagtgtacaatttggggtcaaccatacaccacaagaaaatagaggataataatgtgagggtggtggttgaagaggttagagatgttgatgctctagttcctttccttactgatgaggttgaaacaatgggacatgcccccaatcacttcattcagtggctgagaagtcttgtcaagtctatttcagctaagtgtatggaggaatgtagcaaagatgtttcacacaaaaggttgaaacctcaagtcgatccacttgacatttattcatggtag

SEQ ID NO: 7723 - DNA, 240 bp, Glycine max
  Peptide Sequence Number=SeqID_124501
atgactttagggcgagtgaggacggtgagagtgagagtgagagacaaagtttttggaggaagcgtcgccatggaagggttcagaagcacatgcaatgatttgattcacgtcgtcacggagaaaagggaatgccaccgacgaggatttgattcacgctgtcatggagaaagggaaacaccagcaatgaagattcagaagttaaagtcgcaaaaggagtttgagggttttgcaagaaattga

SEQ ID NO: 7724 - DNA, 585 bp, Glycine max
  Peptide Sequence Number=SeqID_124502
atggctggaggtcaagctgccgcccgagccgtcattcggcccgtgggtggtggccgcggtgtattcggcgctgggcctgctgctgtgcgccttcatgctggtgtgggcgctgccgatctggcgcgacctggaagccctcaagacggcggcgttgcgcatggggcagggcgacctgcaggcccgggcccgcctgtcgcgacattccagcatcggcaacctgggggacactttcaaccagatgtccgagcgcatcggcgcgctgatcaacaaccagcgcgaactgaccaacgcggtctcgcacgagctgcgcacgccgatcgcgcgcctgtcgttcgaactggacatgatcggccgggcggaagagccgctcgagcgcaagcgcctgatcgacgacatgaaaagcgacgtcgccgaactggacagcatggcttccgaactgctgatgtacgcccgcctggagcacaagggcgacggcgtcaccctgcagccgcaggacgcccgcagctggctcgattcggtttgtgcagcacgccgcgttccaggcccgagcagtccggcgtgcgttgcgaagtggtgctgtgccag

SEQ ID NO: 7725 - DNA, 810 bp, Glycine max
  Peptide Sequence Number=SeqID_124503
atggtcattgaccaatccctcttctatgatttaacccaattgtctagtgatggcgtatcatttgaaggtgcactggatgatgattggaaattcgatttttctgtgcatgatgcttgccggttggtttgcaccaaccaaacggatatgactggaaggctgcttgccagttcattggctcttgaaagctgcatcctccattatctaattgtccgtatcttactccccagatcttcaaaccttgcacaagtttctaaagaagatctaatagtcatgtgggccattcatactggccgacaaattgattgggcacatctagtccggtatcacatgcataaggcattgcgattaaatgctcctttgccctatcctcaattagttactttgtcccttcaacattttaacatccctcttgattctgaaccttatgttccaatcaagagatctttcttgatcggtgctgctatggttgcctcctttggttaccgcaaagagcgtgatggctcttgggtaaaaaaggatgctcaaccaaatgatgatgaaggacacttaccggctgaaggggactcttctctccttcagagtattttgtacaagtttgatggacttcaaacctatgtttgtgagaggttcgtcatcatcaaaaagggggagattgtagaagcaagcttcatgatgatgaaccaagcaattttgatgatgccaaaagcccaagtgattgattcaagacttcaagatcaagaatcaagaatccagtccaagattcaagattcaagagaagaaatcaagaagcaacaaatcaagacttcataa

SEQ ID NO: 7726 - DNA, 843 bp, Glycine max
  Peptide Sequence Number=SeqID_124504
atgggccaggcccggaaacggagtgctggcaggcgagaggcgcggcatcgtggcggccacttcacaaccggtaccacgaccatgcgcctgaacaacaagatcgccctcatcaccggtgccagcgccggcatcggccgcgccagcgccctgcgcttcgctgccgaaggggcaaagctggtgctcaacgcacggcggccggagccgctgcaggcgctggccgagcagattcgcgccgccggtggcgaagccgtggtccatgccgccgacgtggccgacccgggtacggcgcaggcgctggtcgatctggcccagcagtcattcggtggcctggacatcgccctcaacaatgccggcatgcttggcccgggcgtgccggcggcggagttcccgatggacgcctggcgcgaagtgatggcgaccaatctggatgccgccttccatgccgcacgcgtgcagttgccggcactgctggcgcgcggcggcggctcgctggtgttcgtcggcaccttcgtcggccacaccgtgggattcccgggcatggcggcctatgcgtcgagcaaggccgggttgatcggcctgagccaggtgatcgctgccgaatacggtgcgcgtggcgtgcgcagcaacgtgctgttgcccggtggcaccgataccgagatgggccgacaggcggctccgaccggcgatgcccgcgacttcgtgcgctcgctgcacgcactgaagcgcatggccgaaccggaggagatcgccaacgcggcgctgttcctggccagcgatgaaagcagtttcgttacgggtaccgcgatgcgcgtggagggtggggtgtcgatcacccgtacctga

SEQ ID NO: 7727 - DNA, 1514 bp, Glycine max
  Peptide Sequence Number=SeqID_124505
ctagaggatccccccatgatgaagtggccgcagcccggcacgatgctgccgcgcacgttgtcggcgtgcggttgcagggtcagcatcggcgcatcggcggtggcgtgctcggcgccgatggccagcaccggcatcgccagccggcgctgtgcacgttccttgttctggcggatggtttccgggatcgcgcggtaccaggcgaagccggcccgcagtgcgccggggcggctgtaggcggcgatgtaggtgtcggcagccaccgcgtcacggcggtacgaccagcggtcgaacatgaactccaggtaggcgcgttcgcggccactgatcagtgcttcgggcaggtccgcgacctggttgaacatgaagtgccagaggaagatgttgtcggccggggcagcgaagatgcccggttccggcgccaggccgggaatcaccgcttcggtaaccgccagctggcgcaccgcctgcggctggtcgctggccagtgcataggcaatccacataccgatgtcatgtccgactacctggtagcgctcgtggcccagcgcctgcatggtctggtgcaggacggcggcggcactgccggtgtcgtagccgtggctggggcgatcggattcgccgatgcccggcggatcgaccgcgatggcttcgaagccggcttcggccagggcgtgcagcacatggcgccaggcgtaccaggtctgcggccagccgggaatcagcaatacgggttcaccgtgacccgcggacacgcaatgcacgcgctggccgtcgatgcgcaggtaatggtggcgcaggggagcgtcgccggcagcgccagcggaaagagaagtggtcatgagggagtgctccgttggggctcaggcgatgccgagcatctgctgcatctgcgcggtgctgatcggtgcaccggcgaagtcgtcgaagatcttgtcggtgaccggaatgatgtggtcgtggatgaatgcagcgccttcgcgcgcgccggcttcctggtccttcaggcagcactcccattccagcgtcgcccagccctggtagtcgtactgggccagcttggagaagatcgacttgaagtcgacctggccgtcgcccagcgagcggaagcggccggcgcgctcggtccagtcggcgtagccgccatagatgccctggcggccgctggggcggaactccgcatccttgacgtggaacatgcggatcagcgggtggtagatgtcgaggtactgcaggtagtcgagctgctgcagcacgaagtggctgggatcaaacaggatgcggcagcgctcgtgctggccgacgcgctcgaagaagcgctcgaagctggtgccgtcgtgcaggtcttcgctgggatggatctcgtagcagaggttgatgccattgtcctcgcagctgtcgagaatcggccgccagcggcgggccagttcatcgaaggcggcatcgatcaggcccggcgggcgctgcgggaacgggaacaggtagggccaggcgaacgagccggagaaggtgcccat

SEQ ID NO: 7728 - DNA, 324 bp, Glycine max
  Peptide Sequence Number=SeqID_124506
atgctgcgcgaggcggtgatgacctacacccgtcgcgggcgcccgcatggttgcctggtggtgtcctcggccagcagcgtgtcgcccgatggcgaaggcgtgcgggactggctggccagtcatcgtcgccagcgcacggcggcgatcatcgcgcggctgcagcaggcgcaggccgagggggagctggccgacgacgcggaggtgcaggcgctgggcgaccacttcgccacggtgctgcatggcatctcggtgcaggcgcgtgatggcatcagccgcgagcgcctgctggcgatggtcgatgtcgcgttgaccccgctgccctga

SEQ ID NO: 7729 - DNA, 1162 bp, Glycine max
  Peptide Sequence Number=SeqID_124507
atggcagaccatcggaatggaagtgcccaagcagccaatggaactgcccaagcagcaggaactgcctattccattgatctcaatgcatttcaaaccagactaaggtcattttatcaacattgggatgcacacaaaacagatctttggggctcttctgatgcaattgctgttgcatgtcctccaccttcagaagatctgcgatacttgaaatcgactgctcttaacttatggttgcttggatttgagttccccgagacaattatggttttcacaaagaagcagatccatatattgtgcagccagaagaaggcttctattctcgaatctgtcaaaaaatctgccagagaggttgttgatgcagatcttgttttgcatgtcaaacctagaaacgatgatggaactgctctaatggatgctatattccgtgctatccgtgctctgtcaaagtctgatggtcgggatactcccactgttggatacatatcaagagaggctcctgaagggaaactgcttgaaatgtggactgaaaaattaaaaaatacaaaatttcagttgaatgatgtggccaatgggttgtcttcattgtttgctgcaaagaataatgaggagcttacatcaattaagagagcggcatacctgacaacaagtgtgatgaaaaactttgtcattccaaagcttgagaatgtaattgatgaagagaagaaagtttctcattctacattgatggaagacaccgagaaagctatcctggagccttctaaagtcaactgtaaactgaaggcagataatgtagatatttgttacccaccaatttttcagagtggtggacagtttgatctcaagcctagtgctgtcagcaacgatgagttacttcattatgactctgcaagtgtgattttatgtgctgttggggcgcggtataagagttactgctcaaacatagctaggactttcttgattgatgcagaccctcttcaaagtagggcctatggggttctcctgaaagcccatgaggccgtcattggatcattgaagcctggaaacaggttgagtgccgcatacgaagctgctgtttccgttgttgaaaatgatgctcctgacttgatttcgtacttgacaaagtctgctggaacaggcattggtattgagtttcgagagtcag

SEQ ID NO: 7730 - DNA, 195 bp, Glycine max
  Peptide Sequence Number=SeqID_124508
atgcaacaacaacaagaaagggttagggataaagcacttagaagacctagattcaaaatagaacacttacaagttcatcaggaagggaagaagttaaagaggttgttgacgattttgcaacccttatgggtattgaagtgcttagaggtagtacaagaaggtggtatcataatccttgggttagggtctcgatga

SEQ ID NO: 7731 - DNA, 120 bp, Glycine max
  Peptide Sequence Number=SeqID_124509
ggaaaagcaagtattcttgcaaaaccgggtgtgaagctggaaatacctgacggagctgtgatcgcagacaagtttggtaggggtaaaaataagaaggcagtttctactgagcatgtctga

SEQ ID NO: 7732 - DNA, 474 bp, Glycine max
  Peptide Sequence Number=SeqID_124510
gctgcaatgggtgctttcgatggtattattgacacagtttctgcggttcatcctctcttacctctcattggtttgctcaagtctcatggaaagattgtaatggtgggtgcaccagagaagcctttggaactgccagtctttcctttacttgctggtaagcatcctattactgccaagaaagagacccgcattgaccttacagttatagaaattttatcaaggcacgcatctgatgagttctaccttgggcaaagagatggtggtgactactggacttctgatgccgaaccattagaggcctttaagaggtttggaaagaatcttgaagagattgaaaacaaacttatagagaagaacaatgatgagacattgagaaactgctatgggccggctaaaatgccttacactttgctctatctttctagtgaggagggattgactttcagaggaattccaaacagtatctctatctaa

SEQ ID NO: 7733 - DNA, 231 bp, Glycine max
  Peptide Sequence Number=SeqID_124511
atgggtgctgaaacatttgtcgatgctcaaagctcaaagctttctacactgccagttaacaagttgattgtgctttacatggttttcaagcttgacgagagttacacgccgagcaaagtttccatccgtgccggtgatggttttcacaacttgaaggagattaagactgtggaactcgtgaagccaactgggtgggtttatctatccttttctggagttgatcctaggtaa

SEQ ID NO: 7734 - DNA, 312 bp, Glycine max
  Peptide Sequence Number=SeqID_124512
atgatgcaatcctatcccgtaagggcattgggtagaagactccaagtagattgggctagagatccaagggaaggccctagggttctcatgagccttaggctaagctctagcttctttaggaatcttcttaaggaagcttctcaaggaggtgagcctagttatgagagggcatcctctccaagcttcttatccaaggctcatcttggtggtgaagctccttcttccatggcttattccctagtggatggcgcctcctctcccctcttctcctttgtcttccgctgcatctccatggtggaaaaccaccattaa

SEQ ID NO: 7735 - DNA, 1113 bp, Glycine max
  Peptide Sequence Number=SeqID_124513
atggccaccgccacgcttagccccgccgacgccgacaagctctccaacctcaaatcctccgtcgctgcattgagccaaatcagtgagaatgagaagaatggattcacaagcctcgttgctcgttacctcagtggcgaagcacagcatgttgagtggagtaagatcgagacgcctacggatgaagtagtggtgccttatgactctttggcaccgactcctgacggttctttggaggtgaagaacctcttggacaagcttgtggtgttgaagctcaatggaggcttggggacaactatgggttgtactggcccaaaatctgtcattgaagttcgtgatgggttgacatttcttgatttaattgtcgtccaaattgagaacctcaattccaaatacggaagcaatgttccgttgcttttaatgaactcattcaacactcatgatgacactcaaaagattgttgagaaatataaaaactcaaatattgagattcatacgtttaaccagagtcaatatcctcgtttggttgttgatgactttttgccattcccatccaaggggcagacaggcagggacgggtggtaccctcctggccacggagacgtcttcccatcattagtgaatagtggaaagcttgatgtgctattatcacaggtcactcccaagacattggctgacgtgaaaggtggcactctgatttcttatgaaggaaggctcctggaaattgcccaagtaccagatgaacatgtcagtgaatttaagtctatagagaaattcaaaattttcaacacaaataatttgtgggtaaacttgaaagcaattaaaaggcttgttgaagctgatgctctgaagatggaaattattcccaatccaaaggaagtcgatggagtaaaagttcttcaattggaaactgcagctggtgcagcaataaggttctttgacaaagctattggaattaatgtgcctcgatctcgcttccttcccgtgaaggcaacttcagacttgcttcttgtccagtcggacctttacactttacaagatggattggttattaggaaccaagctagggcaaatcctgaaaatccttccattgaattggggccagaatttaagaag

SEQ ID NO: 7736 - DNA, 1173 bp, Glycine max
  Peptide Sequence Number=SeqID_124514
atggggcactggagtatgtcggcggtgaattctgtgtctgggaagagaatgattgtgatttgttgtctatgtgccaaaattgggcttgccgatccagaaaaagaagtgcatgtatacttagaaaatgttgatccagagaggggtcatgttaatgaacttgggccagtgattgaagcacatgcaatgcctataaattatagtgcagaagatgtggctgaggctgttgttaaagagtgtactcataatggtattgaagatatggatgttgatggtgttaaaagtggttcaaatgatgaaaatgaagtagttgaaactggtgtacaagatgcagaaactgaagttgttgaaacaggagttgaaatagaacctgaagttgttggagttgaaattgaagttaacaatggtgcatatgacgatgaagttaaagaacatgatggggatgttgagttttctgatcattctaaaagtgacccaaactatgtatatgtgtctgcagaagatgatggacaatcaagtgacgcattggtagatagttaccagtccgaagaatttcagtctcttcccaacaatgatgatgaaggtgactctaattataaaatcgtgtatcctcaatacgatcctagaagtagggtggctgataagcttaggtttcatccaaacctaaatcatgtggaggcacatgaacatctcagagaacattatggtgtgcacattgatgaaagaaagatgtttaggactatcaaagaggctcgatcactgattgaaggaagcatccaattacaatgtgctaagctttgggactattcacatgagttaacaagaagcaatgaaggatcaactaaaggattcaaggctagttgtagaccttttattggtcttgatggttgtttcctgaaagggtactatggtggtcatttgcttccagtagtgggacaagatgcaaacaatgccttttttgtgattgcatatgtggtagtaaatgttgaagataaagataactggaagtggttcctcactttgttacatgaagacataggagactacatgcaatatggctggaatttcatgtcaaacatccagaaggggtttctttctacaatgcaggaagttatgtcaagtgtgaaacacaggtattgtgttatgtccttatggagaaatttctcaaagcagtga

SEQ ID NO: 7737 - DNA, 414 bp, Glycine max
  Peptide Sequence Number=SeqID_124515
atgaagcggaagaaatggtcagaactggaagagcaaatcctcctctccaaatactctgagctcctccgttcaggaaccctcgccaagctcaaaacgcgcgagaagaagttcaagttggtggcggagcatgtgaacgcggtgcaccacctcctcgacctagcctcgttccccttcaagtggttatggcatgatgtctcgataaaggtgaggaggttggattcggtggtggagctgagggaggtggtggtgaagtgtgaggagaggcagcgggagagggagttccaccagaaaaaggtggaggcggagtgggagaggaagaggagagaggcggagggagtggttggaggattaggagatggagttggaggagcgacagttaaggtgggtcaggagggagctggagaagaggcttag

SEQ ID NO: 7738 - DNA, 807 bp, Glycine max
  Peptide Sequence Number=SeqID_124516
atgcatggtgactgtcgctatggttgggaaatttgggaacgagccactttcgagaacgagatcgtgaaagtgtgggagatgaagtacaatttggaaacaaagaagtttcgagaaggaaactttggaagtggtggtcctccagaaggaggtggtgtatctttgagttctgggcattctgtcacacatattcaacttaatgaccagttttcttgtgggaatgactatgctctgaaggtaaggaagccgtatactatcactaaacagagagagcgatggacagatgaagaacataagaagttccttgaagctttaaagctgtatggacgggcttggcgacgtattgaagaacatgttggcacaaagactgctgttcagattcgaagtcatgctcagaagtttttttctaaggttcttcacgatcctactgggaacaatacaaacacagtggagtcaattgaaattcctcctccaagaccgaaacgaaagccgatgcatccttaccctcgtaaactagttgagaccccaaataaggaaatttcgatcccagaacaacctatgaagtctaattctctgaagtcgtcagactttgatcaagaaaaccaatctccaaaatcagtattatcaggagttggttcagacagccttggctcctctgattcagacacaccaaatggaagtttgtcgcccatgtcatccattagtggcttccatacaagcagttttacacgtgccaaacccaaaacaacaacatctgaggaagaagctgggatggacactgattcaactcatgatgagaaacctcttatg

SEQ ID NO: 7739 - DNA, 1112 bp, Glycine max
  Peptide Sequence Number=SeqID_124517
cttcactcgaaagtggaaacactgctctcatcgactcgaaagcggtttgcggtttccgtcatcggcgagacgccgccgccgtctggaattggaagaccgtcgcagtagtcgcaccatcgcagcacgcattgagtattggtgcgattaaatcatacaaagatgtatcttattttcaaaccgaacaagtaggatcatgggaagatccagatactggaagtgacagtgagtgtgatgatgaagaatatgaggaagttgaagacgagaactttggatttgaaagtgattcagaagaggaagggatgaaggcttcagttgctactgatgttaatataacttcaggggacaactatgaagaacttattaagaaagagattgaacagcttctggaaccggaagaaagagcaatattgcaacagaatattactcctaacttggaaaaaatatcaactgaaaaatggagcccgctgcacactcttgtgctttcaatgcagatgagttgtgtggataagcttcttgaaaatggtgttgatattgatttacctgataaggaaggtcttactgcacttcataaggcaattacgggtaaaaaagaagctgtgattagtcatcttttacgaagaggtgcaagtcctcatgttaaggataaggatggagccgctccacttcattatgcagttcaagttggtgccaagatgactgtgaaattattgatcaagtacaaggctgatgtcaatgttgaagataatgaaggttggacccccttgcacattgccattcaaagcagaaatagagatatagcaaaaattttgttagtcaatggtgctgataagactaggaaaaataaggacggaaaaacagccctggatctaagcttatgttatgggaaagatttcaagtcttatgaccttgccaaattactgaagacgacgacggattgtggacgacagcaccacgagagaagctgtgaagggaaggaacttagaagctgcgacgaagcgagaatgagaagacgacaaacgatagatgatggcgtcacaagagaagctgcgagacgaaggaacctaggagctgcgagcctacgactaagtgagaacgagaagacaacggattag

SEQ ID NO: 7740 - DNA, 261 bp, Glycine max
  Peptide Sequence Number=SeqID_124518
gcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccac

SEQ ID NO: 7741 - DNA, 1431 bp, Glycine max
  Peptide Sequence Number=SeqID_124519
atggctcatctcttcagagacctctcattgggccactccaagagagactccacgccgccgctgccgccaccgccgataatgcctcccaagcccgccgccgtcaccgccgccgacgaccttccctctccgctcggccaactctccgccagtctctccgattccgacctcgcgctaacggcgtacgagatcttcgtcgccgcgtgccgcacctcctccggcaagcctctcagttccgctgccaaccactcctccaccaattcgccgagtcagaactctccgaactcgcccgcgctccagcgatccataacctccacagccgccagcaaggtcaagaaggccttcggtctgaaatctcccggttcggcctccagaaagagccctggctccggttcgggccagggaaagcccaagcgccctctcaccgtcggcgaactcatgcgcaaccagatgagggtttccgaagccatggattcgcgcgttcgacgcgcgctgctcaggatttccgctggccaggttggaagaaggattgagtctgtggtggttccgcttgagttgttgcagcagctcaaggcttcggattttactgatcagcaagagtacgatgactggcagaagaggaccttgaaggttctggaagctggtttgattttgcatcctcacatgccgttggataagtccaattccgctgtgcagcgtctgcggcagattgttcatgctgcattggataagcctatagaaaccgggaagaatactgagtctatgcaggttcttcgtagtgctgttatgtctcttgcgaataggtcatatgacgggtcttatgttgattcgtgccactgggcggatgggattcctctgaatctgcggctttatgaaatgcttctgcaatcctgctttgatgctaatgatgaatcatcgattattgaggaatttgatgagctaatggaacaaatcaagaagacctggggaatccttggattgaatcagacgctgcataatctctgtttcacttgggttttgtttcaccggtttgtcgtgactggccagctggacttggacttgctgtctgctgctgacggccagctggcggaagttgcgaaagatgcaaagacaacaaaagatgcagaatattccaaagttttgagttctacattgacttcaattatggggtgggctgagaaaaggctccttgcttatcacgaaacttttgaccggggaaatgttgaaaccatgcagggcattgtctctttaggggtagcagcagctaagattttggttgaagatatatccaatgagtatcgccggaggagaaaaaatgaagtcaatgtggcacgtgaaagaattgaaacttacatcaggtcatcactgcgtactgcttttgcccaggcaagttctttctgttttccattggcttttccatttagtaaaaggtga

SEQ ID NO: 7742 - DNA, 1433 bp, Glycine max
  Peptide Sequence Number=SeqID_124520
atggagaaagctgactccagcaggagagcgtccaaaaatcagccaaatgctcttcctggccttgtcatccttgcaaaggatgtaggtagcctggcagtcaatgaaaagcaagtgttcagtccaatacttaagagatggcatcctttggcagcaggtcttgctgtggccacccttcatgcatgctatggaaacgaattgaagcaattcatatcaggaatcacagaattgacacctgatgctgttcaagttttgagagccgcagatcagttggagaaagaccttgtgcagatagctgttgaggattcagtggaaagtgaagatggtggtaaggcaattatccgtgagatgcctccttacgaggctgaaggtgcaattgccaatcttgtgaaaatatggatcaagactagaatagacagactgaaggaatgggtcgacagaaatctgcagcaagagctgtggagtgctcaagcaaatcaggaaggatatgccccatctgctgttgaagttttgcgaattataaatgaaactttagatgctttctttcagcttccaataccgatgcatcctgcattgcttcctgaagtaatgaatggtcttgacagatgccttcagtactatgttatcaaagcaaaatctggctgcggatcacggaacacatttcttccaacaatgcctgcgttgaccagatgcactattggttcaaagtttcagggctttgggaagaaaaaggataaatctccaaatcctcagaagagaaatcctcaggttgcaacaaatggggatagctcctcgggaataccccaactctgtgttcgcataaatactttgcaatggatcctgggtgaatttgatgttctggaaaaaagaataattacccttttacggaactctgaatctgctcatgtagaagatttttcaaatggattagcaaagaagtttgaactatctccagctgcatgtcttgaaggaattcagcaactctgtgaagctgcagcatatagaattgtcttccatgatctaagccaggtattatgggatggtttatatgttggggatccagcatcttcaaggattgagccatttcttcaggaacttgagcggaagttaatgttcatttcagatactgttcatgaaagaattcgcacacgaattattactgaaataatgagagcttcctttgatggattcttgcttgtattgcttgctggaggtccctcacgttcttttacccggaaggactctcagatcatagaggatgatttcaagtttctcaaggagttgttttgggcaaatggggatggtttgccttctgaattaatagataaattttcaactactgcaaggtctatccttccccttttcagaactgacacagagaccctcattgagcagttcaaacggttgaccatggagacatataaatcctctgccag

SEQ ID NO: 7743 - DNA, 948 bp, Glycine max
  Peptide Sequence Number=SeqID_124521
atggggacaaatcaaaacggcaaaaggttttatcaagtcaaggttaagggtctagatgtcaccagcctcaaggaattgggacgattgatgggacctctccaaaggaaagccttctgcaaagtgtacggaaagatcctagatttgatcacagcggaggtatttacggaagctgtcgtatccctcgcccaatactatgatcagccgttgaggtgcttcacatttggggatttccaaatggtaccgactattgaagataagattgcagctatggtcagagattcggcaaaagaattggatcgcatgaagcaaactcggaacggcgtagtgggcctgcctcggaagtacttggaaggcaaggcaagggatatggcgagccaagagaagtggggcccgtttgcggatatactagctttgttgatttatggggttgtcctctttccaaacgtggacggtttggtggacttagccgcaattgatgcttttcttgcatatcaccatagcaaggagagtccagtggtggctatcttggcggacttgtttgatacctttgaccgaaggtgcgagaaaaacagcgcacgggttgtctgttgcttacccgctctcagtgtgtggttggtttcacacctattccaacaagacacaagacacccgtgtccgcttcaaagttatcgctcatgcgtcgaaaatggaagagtcgattgggaccaacatttggctaggataggaggcagcgcaatcaattggtttcctcgttggaaggaaggcaaggagggagttcttttctcgtgtggggactaccctaatgttccattgatagggactaggagttgtattaattataatcccgcactcgccataagacagctagggtaccccatgaggggagcgccaacggaagggagtctctcaactttccttgtgagagatttaggcgcgcaaggtctcaag

SEQ ID NO: 7744 - DNA, 984 bp, Glycine max
  Peptide Sequence Number=SeqID_124522
atgaatgctgaaattgaggctttagaggctaatcatacttggattttgactgaccttccacctaacaaatctgctattggatgtaaatgggtttataaaatcaaacacaaggttgatgggtcagtggagagatataaagctaggttagtggcaaaggggtgtactcagattgaaggtcaggactatcttgataccttttcaccagtggccaagataactactgaagcaaaacctatctctactcccattgactatgctgtaagactacaccaacaatctggaactccacttgatgatacaacagcttcatcatatcgtaggctcattggtcgccttatttacctcacaaacacaaagcccgatatcacatatgcggtgcaacatttaaatcaatttgtagctcatccttcttcagctcatcaacaagcagcttataggattctcagatacttgaaagcagcaccaggttctggtatatttttccctgcttccagcacattgcacctcagagcttttagcgactctgactgggcaggatgcgttgatacaaggcgatctatcactggctactccgtctatcttggtaattcccttatttcttggaaatccaaaaagcaggccacagtgtctagaagttcatccgaggctgagtatcgggcactagccagtgctacatgtgaattacagtggttaacccacttgcttaatgactttggaattgtttacactcaaccaactcttttgttttgggataatcgctccgctcttcacattgctgcgaatcctgtctttcatgaatgtacgaaacatattgagatagactatcacattgtgcgcgagaagttgcattccggccttatcaaattgctgcccattgcttctgttcaacaacttgcagacatatatactaaagctcttccaccaggtgctttccattttcttcagtgcaagctgggaatgtcagacatacattctccagcttga

SEQ ID NO: 7745 - DNA, 279 bp, Glycine max
  Peptide Sequence Number=SeqID_124523
atgacgaacgaacgaagaacggctgaaaatcttcgcgaaaatccccacggaaaccttacagaagcgcctcgtctcggattttcttcacagaaccaattttttttcactattttcaagaaaatgggggagatgctagccacccagctcgccaaggcgagcaaggtgacttcctccagaagcaaccgccttcgggaggaatcttctggagggcccaagtgggcctggttgctatttgcacccccattttctctcaatacacctttgccttttttttggtga

SEQ ID NO: 7746 - DNA, 270 bp, Glycine max
  Peptide Sequence Number=SeqID_124524
atgtctgagtggactcatccagtgaacatctacttgatcctaaaggttgaaaggaaagatattgagttggtagaggaggaagaggcacggattggtgctgattcttctagtgcaacctctaataaatctgagatttataaggaggaagcagggaatgtagcacagaagcataaagcaaagagggtggagagtgtcaatgttgatgcaaaagcctttggtgatcactggaaagttcagattgctctatgcattctgaagctgaagcactag

SEQ ID NO: 7747 - DNA, 393 bp, Glycine max
  Peptide Sequence Number=SeqID_124525
atgacggagaacaagaaagaagatagagggagagtgcaggttgtcattggtcttctctgtgtcgatccaaacgccgatagtggcagtgcagggtttgaaatagaggcgaagaacaaagtgaagatcaaggattctacaacaaagtctccaacttctgtccttgaagacgagttattttatggaaccacgtcctgtgccctgaaagaggaagttaagttggagaaagaagtgactgcagacgtcaaagatgatgggacctctcttatatcgaaaacaatggtggaggaagataatttaattgaagctaggatgaaggaagaggaggtgcagtatgaggaggcacttgaccttaacagcacacagtttaacaaattggatgagcttttaacttaa

SEQ ID NO: 7748 - DNA, 240 bp, Glycine max
  Peptide Sequence Number=SeqID_124526
atggttggtaactttattcatgtgaattcctcacagttcaaaaatgaaagaactgaactacctgtgtatgcatgtttagctggtgccacagctgatgtccattgttatgatgtcttgaataataaatggtctaggataactccctttcgagaacctccaactccaagggttgcacatgtggcgatcaactgctataggaactatggtggttgttcaggtagcatggaaataatatcttaa

SEQ ID NO: 7749 - DNA, 147 bp, Glycine max
  Peptide Sequence Number=SeqID_124527
atggcaacaaatcctcatgaaactttaaccttaaagcattggtcagagcttgctcacggtagagagttggtggttatgatggtgcaatggcttttaagggaggttatggtgactgagtgggagtttgaagagaattttgaattttaa

SEQ ID NO: 7750 - DNA, 195 bp, Glycine max
  Peptide Sequence Number=SeqID_124528
atggagaggttgagagactggaggttggagtgggaggcgagaaatgacaagtcattgagggagccaaatagggcattttgggagagatctagggaggttaatgtgaaggaaaacttggagtgggagaaaggaggcatggcggcgggaccggagagttacatcaactctaatgaaattgctcaaatcgatttttaa

SEQ ID NO: 7751 - DNA, 219 bp, Glycine max
  Peptide Sequence Number=SeqID_124529
atgcctcacatttttcaaggttgccaagtcgaatatgtgaagtacaacacaactcaaagggggcgaggcgaaacaaaatggcgtcttctcacgaagaaaatgcgtggagtcgccaccaacgtttattcgaggaaaatgctagaaaaaccaaaaatgcaaaggtctacgtattttgaaaatgagggttcgggagttgtttatgcacggggaaactattag

SEQ ID NO: 7752 - DNA, 636 bp, Glycine max
  Peptide Sequence Number=SeqID_124530
atgaagagaggagataaggataaagggggtggtgaaatgtgggaggcaggagacaaaagcagacaccccaacaaatatactgtcattgacaatcattttgtccaatattttaaccacctaactaacgttttctcctacagttttttaatgtcttcaactgtgaagttaaatggcgtacaaactaaaggacaagaaacagagcataataacatttcagagatcaacgtcagggtgtataacttagcacaaaaagtacctacaatgatggggtttggtacacgaggactatttaaaaacccggaccgtcgtatcgttccaccggcgccgtcaacctccaaggctcgaaccaccatccttccactcaaccgcgcacttgcactcgtcggctcaagctaccaccgcagcacgcctcagccgccgccagttaacaaggcattttgtgacatagaacctatctacacatttgaaggcacgtatgacaaacaccttggttgcaggcagggaaattactggtattttatgtgctttaagccggttgctcaaaaaagcattgtgttgaggaaaggaccaaaaagacccctaagggagaaacttactttgatgcaatgtcaaagtgagtgggacattgaaaagtaa

SEQ ID NO: 7753 - DNA, 240 bp, Glycine max
  Peptide Sequence Number=SeqID_124531
atgatcttgtcaagagtggtgcttgagattgtaagtggacttaaggctgtggattttaggcaacctgaggtgctattggtaaacaaggttgatgaatttgaggtgagaaaaaggccactagaggcattagcatatatgggactaaatggagagtacaatttgaaggagttaatgagattgctgaaaaaggtgccaggtcagagtctgaatgacataaatcagttgcagcatgtgagataa

SEQ ID NO: 7754 - DNA, 192 bp, Glycine max
  Peptide Sequence Number=SeqID_124532
atggcatttgcaggaacaactcagaagtgcatggcttgtgacaaaacagtttatctggttgataagttgaccgcagataaccgagtgtaccataaggcttgcttcagatgccaccactgcaaaggaacactcaagataattcttccatttttgattggcaaattgttagtttttttagcggttatggattga

SEQ ID NO: 7755 - DNA, 378 bp, Glycine max
  Peptide Sequence Number=SeqID_124533
atgctccttgccttacaccccaacaagttcttagatagtctgtgcaaaaaaccacctggtagcatggacgagcagtgtgaacaagccaagggatccagatggaagaaatgtcctgaacaagccaagcgaagcgcataccaaggtcgatttccacaagtcgaacaagaagcacaagccagacaagcgccaacttctctccaaagggcccaggtacaagcgttacacaccactaacacccaatcacaccatgattctagaggaagctttcaacctggaggtgagagggtcaagaccagaggatacatggacttgatgaccaccttcggtcaggcaagctctctaggagcttcaccatcaaatatctactggttgacatag

SEQ ID NO: 7756 - DNA, 285 bp, Glycine max
  Peptide Sequence Number=SeqID_124534
atggtgcttacgccaacaccgtctttgaaatcggatatttctacatctaacacgagaaacgatgtagaaagtgcatcttactacgtcggtgtctacgtcagcaccgatttagaaggcgcaggttactacgtcactacctacgtcagcactgatttagaaagcgcagattactacgtcactacctacgtcagcactgatttagaaagcgcaggttactacgttgggcctaacatcatcaccgatccacccttctacatcagtggtttggatggcaccgatgtgtaa

SEQ ID NO: 7757 - DNA, 207 bp, Glycine max
  Peptide Sequence Number=SeqID_124535
atggagatgagcgttgcgggggagatcgtggtcttgctgttggagacatacgttccaggtttccgaccgccactatggtgccttccacgccaccaaccacgtcgcagtcgaggaggaccatccttcaatacggcgccgcttcttcttcctagggtttctctgaaccaattcctatggctatcagaggcgtcgatttcaagtggttag

SEQ ID NO: 7758 - DNA, 228 bp, Glycine max
  Peptide Sequence Number=SeqID_124536
atgccacctattttgctcgcgctttcttcttcttcgtgcgtgtaccctctgcatcctaaggttgttctccatcgaagcttgttgttctccattgctctgaagaccgtgacagctcgccttttggttgtacgtttcactgccattgtcgctgccattgtcgatgttgggttcgagtgtcgtggtgaccgtcgtatcgtcccaccggtgccgtcgacctccaaggcttga

SEQ ID NO: 7759 - DNA, 843 bp, Glycine max
  Peptide Sequence Number=SeqID_124537
atggaaattgtcgctcatgccgttgtggttggtgtctttgtctgccttgatcttttgctcttcttctatttgcttcctagttgtgctgctcttcttgatgtcttccgagtcttggtcatgattggtgagaagttggcgcttgtctggcttgtgcttcttgttcgacttgtggaaatcgaccttggtatgcgcttcgcttggcttgttcaggacatttcttccatctggatcccttggcttgttcacactgctcgtccatgctaccaggagcatggaatgcaacactacctcaagattgagattttggatctacacggttgtacgcccaaatttgtccatgaactttctgaaggacttgtcatctgcttgtcgcagactgacttaggcggtcgatgtcatgtggtgagacctcctagtagtgtattgtgcatggaatcattcgatgagggtgtcaaagctatctatggacctaggtttgcttgtgtcaagaaggcatccagatgctcgtctggatctgttgtctcatcgtaccactcgaggttgagtggtttccacctcaaaggctcagatcatctgcagtgttgcctctgcatcgggagtgtgattcccctttggtgcgttcaggcaagttggtttagagtgtttatgcctatcatagttttcggacagggattggagtctgtgaggggggtctcgcgtctgaggtcagatccattgctaaccatggataaatatgagaggattgatgagaggccatgggtctcgaacttcatacgtcgactaggagaagtgcctttgataggaggggagacttgcaaaataaggactttggcactcaagtaa

SEQ ID NO: 7760 - DNA, 318 bp, Glycine max
  Peptide Sequence Number=SeqID_124538
atggtcaaaattaacattcttttctttgattggttccatgcttataccattagagaaaacctagattacccttggaagcaagacatcataggtgatctaacaaccaatgttattaccaattggcagatcaaagatggtgtgttaatccaattggaattacctccagcaacacaatatcaattgtcaaaggtcaaagatagtaatgataaacctgtcatggccacaccctttaaaactaaagatgtcaatgaagaagtcacctcaaaagccatcaagagcccaatggaacaggctaattataccaacaaatatcttcag

SEQ ID NO: 7761 - DNA, 378 bp, Glycine max
  Peptide Sequence Number=SeqID_124539
atgactagaagcaagaccattcaagaggactataaggagaagaaagattctcctccaaaagttacggatgacttccttactaaagaagaccaagaacttaaggaaaatgaagttcctactgatgggaacccagtgccaaagaaggaaggggatgaaaaagagatactgacatctcctgaggtaaacatggaggcggatgaagatgttcctatcatattggaacaacctttccttagtactagtgattttcttgttgaggttagtgtagaagcaagatattttgatgatgccaaaggatcaagtgcttctcaagttttattcaagacaagaatccaagaatccaagaaaatcaagatatatgatcaagttgatctctag

SEQ ID NO: 7762 - DNA, 255 bp, Glycine max
  Peptide Sequence Number=SeqID_124540
atggaggagggtgccacgtgcccggtttgccttgaggaaatggggaaggagcaaaacctggtggcatgtggaacatgccgtaacccaattcatgaagagtgcttgatgaagtggaagaggaccaagggaagaagtgctagctgtgttatttgtagagcaaggtggagggatagggtggagcaagatgagtatctgaacctgtctgcttatgttggcgaagatgatgtggaacaacctgatgtctgcacttgttaa

SEQ ID NO: 7763 - DNA, 1686 bp, Glycine max
  Peptide Sequence Number=SeqID_124541
atggaagacgccggcgggaagattgtgaagtccggccaggtgtcgcgtaaggtggttgacgtggctgcgggggaagcacacactctccttcttactggggatggcagtgtttactgttggggcaagggaatgtttggacggctcgggactggggcagaaaaggacgagcttttaccagtacaactcaactttggatacccaaatccaaacggaacagaaggcactttcaaaatagtgggaattgctgccggtgcttatcacagtcttgctctagcagaggaatcacatgacaatgaatatgctgttggagacaattctctagtgccccgcatactgaacaagtttcttgaattgcatccccctgattcttcttcatcgggtgacttcatcattgatgttgcttcacctgttcaactttctcagatatgtgctgtcaaagctggaggaatgatgtctctagctattgataaccatgggaccctgtggatgtggggaaactgcccacgacaaagcaaagaaggtgggttagcacttgtaagcagtttcactccaactccagtttgggattttcagggccacactgttgtcaaggttgcatgtggaaatgagcatgttgtagctctggttagtgctggagagacatacaatggtgaagatctagtgtgctactcttggggttataacagccgtggccaattaggcttgggggatcgagagagcagactgcatccggaagttgttagaacatttgacgaggagtccccttatgaggtagcatgtggtgcctttcacactgctttgctcactcgtaaaaagaaacctagtgacacagtagaaagcacatgctggacctttggccttggggataatggccagcttgggcatggaactacacaaagcacattatttcctacacctgttaaagaattgccacaaaatgtatcacttatctgtgttgactgtggtttgtttcatactagtgttgtttcctcagatggggatgtgtggtcatggggaatggagaagggccttggcttatgccctgatgctagtcgtgctggaacagattcgggcgatgccctctctccccgtctcatgtcatgccagccccatcaacttaaatttccagatccagttaaagttgcatgtggggccgcacatactgttattgttgcacgaaagggatatagaatgtggtcttggggtaggggaaggagtggagttcttggagatggtaaagggtttgattgttacactcctacagctgtgctatggccttctacaatggaggattctgaggaagaggaagtaaaaagctccggtgagcaagataaggctagagaaaaggagactgaattggcaacagaaacagaagagaaattatcttcagcattgaatgagctgaagctgcttcaaacaaagctatctataatggaaaaatatgctagtatacttcatggttctatttttggaaaaccttttgatgaacaagatatccctgtttcattgcggaattcaggttcatttgacattgcaaaagaatgggagagtatgttggaggcagcagatcaaaggaagctgattaggttggaaatgttttaccgtgacatgcttactggagtgaaagatgaactaatgaagagaaggatcaaggaaattgtacaagagtgtctccaatcttcagag

SEQ ID NO: 7764 - DNA, 534 bp, Glycine max
  Peptide Sequence Number=SeqID_124542
atggaagaagagtccttggcagcagtcccatttgacagagctattgaacaggcaattgtatctatcaagaaaggtgcatatttacttaagtgtggtcgtagaggaaagccgaagctctgtcctttcagactttctcaggatgagagaaatttgatttggtactcaggacaacaggaaaagcatttgcgattgagtgtagttaccaaaatcgttcaagggcaggaacatataaggtcccagaggcaaaatgagtccgaaaaggagtgtcattcattttcactaatctgtgctaatggtgaacgttctcttgatctgatatgcaaggacaaagcacaagctgcttcttggtttgttgccttgaaagctgtgatttctaggtgtcagcatcctagagcttttagtagtttaagaagttgcaaaggggtgcagagttgtgttagtagtcctgctggaatcttaagaagaaagaaaaatcttggccttctggacgatacctctcaatttactcaggttttcatacatcttctttgttag

SEQ ID NO: 7765 - DNA, 2561 bp, Glycine max
  Peptide Sequence Number=SeqID_124543
tggcaagttctccatacattgatccagatattcatggcaacattgagtcaacccgcattgataaggagcacaagaagaatttgtccgatagctatctgatgcattttaccaccccgcatgtaggaaaaagtaatgtgttgaaggatgtaatgatatggggtggagggattggatgtcttgtagggattgtgaatgaaaggtttgtccatcctggaatttattctttagtgccaaagttactagaatccactgcaatgttagatgttcataacatagctttaggaggaaaacatgctgccttagttacaaaacaaggggaagtgttttgctggggtcaagggaagtggggaagactggggcaaaaaattgatatggacattagctcccccaaaatagttgattctcttaatggtcttcatgtaaaaactgttgcttgtggtgagtatcatacatgtgctttgacagattctggtgaagtatatacttgggggaacgatgtttgttgtgcagatttattgaatgaaggaagaactagaagtcagtggataccacaaagacttggtggacccttagatggtattagtatctcaagtgttgcttgtggggaatggcatactgcaattgtctctagttgtgggaggttatttacttatggagatggtacatttggggttcttggccatggcgatcttcggagctattcaagtccaaaagaagttgaatctcttaatggtctgcgggtgaggtctgctgcttgtggatcatggcatacagctgctattgttgaagtcatgtttgaccgttttaggtacaatagtgctagtggtaagttgtttacatggggtgatggagatgaagggaggcttggtcatgtagataatggaaacaagattgtaccaacacgtgttacacaacttgttgactatgattttgttcaagtgtcatgtggaagaatgttgactgtagcactcactaacatgggcaaggtttttgcaatgggaagtgccaaatatggacaactaggaaatccacatgccagggataaagtagtgattgttgaaggacaactcaaacaagagtttgttaaagtgatatcaaccggttcatatcatgttgctgttttgacttcagcagggagtgtctacacatggggcagaggtgaaattggccaactggggctaggtgatactgaagacagatacacaccttgttttgttgaggctctaagagacagacaggtaaatactattacttgtggtccaagcttcacagctgcaatctgtttacacaaacctatttctattagtgaccagtcaacttgtagtggttgtaggttgccatttgggttcacaaggaagaagcacaactgctataattgtggtcttttgttctgtcgtgcttgtagtagtaaaaaaattacaaacgcacctctagcccctagtaagagcaaggcttttcgagtttgtgatcagtgtttcgataaacgacaggggggtgcccattcagtaatggcatcaaagtccagaaattacaacactcagcaggtgttgaagcatcaacacaaaatttctgatgtgactgaagataggggagagacaactgtgacacaaggtcctatgttatcacttggtcagtcatgttacaggaaaagcatgccaagtggacgaaaggattggaaaaaccatcaagaaattcagcaggatgtagaagacagttcttctatgctaggtggaatgccacagtgggggcaagttccatgccctgccatgtttcaaataaattgtacagaaaatccagttgttcatgtttcttcatccaaaaataaattagccacagtttctccctttaatgtggaatctacagcatataacttctcctccaatgtggagactgatacaacaaagtctgacaaggtgctccttgaagaagttcataggcttagagctgaggctaagagacttgaagagcagtgtgagctcaaaaaccgtaaaatacaagagtgtcgacaaaaaattgaggagagttggtttgtagcaagagaggaagctgctaagtgtaaggcagcaaaagaggtcataaaagctttagcactgaggcttcatacaatatcaggaaaggataacgttggacaagaaggaaaagttgggccaaatgaatttgtgcctaacgtggcacccatacatacagaaatgaagagtccacgagatgtcagcgtggatagtctatccaattcccctatagtattctctgacacattaaaatccaaatttgggagaagtttgttccccaaaattgataattctaacataaatagagcagaatctcaacaagacaacaatattgatggcttgaaggctgaatgggtagaacaatacgagctcggtgtttacatcacatttacaactttgccatgcgggaaaaaaggccttaagcgagtgagatttagtcgaaagcgattctcagagaaggaagctgaaaaatggtgggaagagaatcaagtgacggtgtatcacaagtatgggattgaaggatatataaataataacactagccaaagtcag

SEQ ID NO: 7766 - DNA, 2013 bp, Glycine max
  Peptide Sequence Number=SeqID_124544
atggctcctgtttcattgcctcctgggtttaggttccaccccacagacgaagaactcgtttcttattacctgaaaagaaagataaacggtcgtaagattgagttagagatcatccctgaagttgatctttataagtgtgaaccatgggacttgccagggaagtcattgttaccggggaaagatttggagtggtatttcttcagccctagagataggaagtaccctaatggatcaaggaccaatcgtgcaacaaaatctgggtattggaaggccacagggaaggaccgtaaggtgaattctcagagccgtgcaatagggatgaagaaaaccctagtttactatagaggtagggcaccacatggttgtcgcaccggttgggttatgcatgagtaccgtcttgatgagactcagtgcgaaactaattcaggcttgcaggatgcatatgctctttgccgtgtgttcaagaagactgcagtgattcccccaaaagttggagatcagcactatgttaatgttcttagccatgcaaatcagatgacaagtgatcaatcatcaagcattgacattgagctatactcagaaggaagaggagaagttttagagagctcaaattatttgatgccgtgggatacatgcccatccccaaacataaatattgggtcttctctcaatatcaatatcaatggtgggacgaaaagggataataataataataatattgggacatggtcacacttcttatcatcagaagacttactcaatcttccaacatctacttcttcatttcccaattatggatctatgagttaccctccatcaaaggtggatatagcactagagtgtgcaaggatgcagcataggtttaccatgcctcctttggaggtgcagcaggacttccctcaagttggcatttccgagctgaagatggcacaagcctcggcttccaatatgtgcggaggaagcagaaataatgaaacagatatcttgcaggaaattctttcagttgctcatgcttcccaggaattaataaatcaatccaactactcatcatcacaggcatttggtgccaatgaaaacaactacgctcctcctcatgaaagtgatttcacttttatggttggcaccaattacaatcatgtgaatgatatgaacaccatgggatttgttgacaatatagcatgggaagaccctaacgcaagatcaatagagatcggggatcttgatgatggattcaagacagagaggatggtagagaatttaagatgggttggaatgtccagcaaaaatatggaaaagggctttatggaagagcaaaagattgtgccaattgagcatatctcaaacttccaagctaacagggaagaaaatgaggtgcaagtagtatctgagcagcacaatagcaacaaagaactcaatgatactgacattgatgatttctcaatgggattcatcaatactgacgaccccaatgagaacttcatagatgagggtaacattgactattcaaattctacaaactttgaggttgttgaggaaacaaaagtcagtcatggaatgtttgtctccactcgccaagtagctgatacattctttcatcaaatagctccttcacaaaccgtcaaagttcaactcaatccagtactggctgaaaatcaatctatagagaatgcagtagtaatggttaaccaagggcactctttctttagaaagtttagggcttatgtgatggggaagctgatcaagccatcaaacacaatagcaagtgcccttgtattcatctttgcacttttgttggtgcattgtgtttgtttgaaggagcaagtaggtgaagatttgaaaccagaccccaaatgctttgatggtgctaacaccatgaagaaaatgagacaattaccagctgagaataatatcatatggaatgaacaagaaaatttttggtctgttggtattaaatgtgggaaaggatttggtgtggtcttgaagaagataggcattttcctcaccatatcatag

SEQ ID NO: 7767 - DNA, 660 bp, Glycine max
  Peptide Sequence Number=SeqID_124545
atgccatcggaggaagtgctcaaacttaactgtgatggtgatgtaactgatggaaggagagcctattgtggtggtgtcctgaaggatcactttggctcgttccttttagcttatgcatgtaatattgtttcatgctcggttattcagcccgagttatgggctgaaacttgttccagaaatagtgactataactaccgaatcagccaacgaatgctagataatgcgttagaacacagaccaagtggcaacaagctcaggggcaatctcccagtcaccgaatccacagaagattttggtcctgacataaatccagtaacatgtaaagccattcaatcagaaagtagcatattatttgtcaaggaaaaagctgtcaagatagggagcaactttgaaaaacatcagcatcaaatccatgagtctgtagcatcccattgttcaattaattgcaaaagtccaacagcaagaacagtctttgatcctgccacactgttcccatcttctcaaaagataccgatcaatgcaaaagtaggcagtggtggtgggatttatcactccaaaaaggataccaaacaaagaataatacattgcctgaatgaacattatttgagcatggctatggagtatagcaaaatcacctgtatgggacaatcctcattttga

SEQ ID NO: 7768 - DNA, 378 bp, Glycine max
  Peptide Sequence Number=SeqID_124546
atggcttctcgttatagatctgtttcgcaaccagcattctccataatcaaatccaccatcaccaaaccttcctcgaagctcctcccgtcgtcttttctcctcaaaactcgttctcccgttacggccaggcaagtccctttcgtccccttcaggggtgggtgggcggtgagctcggttgcctgcagtcgctgcttcccctgcactcggcggtttcatcagcgcgcctcacctcatgtctgggcatcgattcgagtaggtcgaggtcgctgtctcagggtatgctctgcaatgccaactccggagtttgatttctccaaattcttttttacccttttactctccgtaagcattcattgcaacttccccctcttttcttag

SEQ ID NO: 7769 - DNA, 738 bp, Glycine max
  Peptide Sequence Number=SeqID_124547
atgagatgggtagtggttgaacaaagcaagaggtacctcattcagctcatggattcagctccttctagttcttggctgcaagccttctccttcttagcattggtttggttatttaactgtggatgtgtccatggagcctccccagcagtgaaagtaggtaacttttcaaaggtggaagatgctggaaacttccacatctactatggccagaccttcaaagtcattaagaattctgctgatggccagagctaccttcttctccagcctactcaattttcttccatcaattctggcagaataattcaaggattgcatcaaggactaaatattgcacatcaagaatcaaatcatttgtcattccattgtcaaactattctgttgatacaactttttttccggcttttaggtttagtggagagcttgaaaggcataacctcagactatgtggcttctccatgtgtgttgaaactgtatcaaggaggacagctagaaatgttcaataatagtgattaccaaaagcttgcagagttctcttcatactttcttagtgacactgatcagcagccagcttgcaattttgcaacttttgttccatttatggaagatactcctttgcagataaatctttcctccataacggagaatataaagaacttgtcatatatttatcacaagagaagctactggaaaggagttgcaaatacacttactaattggataggaatgttgattaattaa

SEQ ID NO: 7770 - DNA, 759 bp, Glycine max
  Peptide Sequence Number=SeqID_124548
atgcaacaccggtctaagatgaacaagaggccacgttcttacgatgccaatgacgaagccaatccacgacgaagccctccgaatactcagtttcgaagcacgattaatagcactgctgcagcagcgaatgctctgaacgcaacactaacagtatataaagagcagctcatctcgaatttgaagcagaatatcgacaaaccgccaccgatcggattgacactacaagagtctacaatcaaatcaatagaggataccgtgaatgctagttatgaaagaaaaaggaaaagtgcacctttaatacctaatgatttacgggctgatatttttcctgctactggtcttaggattggagaatataagtttttggctacacataaaggtactttgatggttggattttactatgctacaaaaagacttgcctgggagatatttgatatacatggtgggattaagtacaagattgaagtaccatggcagaacattttggccatgcgagccattatagaagaaaataagcatggaattcttcaaattaagctggctaaggcacccacattctttcgccacattgatccaccaaatccacgaagtcatcctaaatgggagccatcaaatgacttcacgggaggtcatgctttgaaacaccaggtacattcccttggttttcctccaggagatcttgacaaatactatcggaaactgatacaacatgataatcggttattacagttgagccaagtatcattttcgaaataa

SEQ ID NO: 7771 - DNA, 567 bp, Glycine max
  Peptide Sequence Number=SeqID_124549
gttaaggtgaactatttgtgcttggctaaagttgccacaactaggacaacattcaagccaacggtagcttggatgaggtataaaaatgaaaagtatcaattgaagtacgtgcaagatgcaggcggagagattttgggtgccaacaaaaacacttacaatgtctctgatcctgatgacttggaggaatttcatgccatcctatgtactgcggaagtagtcattgatgaaacactaacatctgatccagtcaactacaccatgtcagcatttatccaaaatctaaatgttgaagatcgttcttgtttttcctttatttcaaacacaagtctatggagatatgacaaaagggtttataattctgtagctcttgactggtataatggagctgtgtcccaacctcaattggcactagcagatcttattgaagttttatttcccactggaaattacacaatgacatattttaggaacattgcaaagggagaagtacctataaacattggtcccgaaatgtgtgatagggacacatccacagcaatggagcctaccatagtagcatgtggatga

SEQ ID NO: 7772 - DNA, 504 bp, Glycine max
  Peptide Sequence Number=SeqID_124550
atggcgcggctcaacagagcagccgcaccgtcctacctatttaaatctttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttga

SEQ ID NO: 7773 - DNA, 306 bp, Glycine max
  Peptide Sequence Number=SeqID_124551
atggatggcgctaaagcgcgcgacctatacccggccgtcggggcaaggaccaagcccccgatgagtaggagggcgcggcggtcgctgcaaaacccagggcgcgagcccgggcggagcggtcgtcggtgcagatcttggtgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggtga

SEQ ID NO: 7774 - DNA, 2538 bp, Glycine max
  Peptide Sequence Number=SeqID_124552
atggcttcttcaccgctcttgacaggcaaagaattggtaaccaatgacatgcctgataatgcaatgaggccaagttggtaccatgtgaagaggtgctttgctaagtacattgagaaggggagaaggattatgaaacttcatgacttgatggaagaaatggagcttgtcatagataacaacaatgagaggaatcaagtgttggaggggaaccttggcttcttattgagttgtacacaggaagctgctgttgatccaccttatgttgcctttgcagtaaggccaaatcctggagtttgggaatttgtaagagtgagctctgaagatctttcagttgaacctatatcctccacagattacctcaaattcaaggaaagtgtgtatgacgaagaatgggcaaacgatgaaaactcatttgaagcagattttggagcatttgatttccctattccaaacataaccctgccttcttcaattggaaatggactccatttcgtttcaaagttcttaacttcaaggtttagtgggaaactaacaaaaacacaacctatagtggactacttagtatcactaaaccatcaaggagaaagcctgatgatcagtgatacccttagttctgctgcaaagcttcagctggcactgatggtggctgatggacatctctcagcacttcccaaggatgccccttatcaggattttgagccaaagctcaaggagtggggttttgagagaggatggggagatactgcaggaagagtgaaggagacaatgggaactctatcagaaatactacaagctccagatgcagtgaatttggagaagttttttagcagggttcctacaattttcaatgttgtgatattctctatacatggttattttggacaagcagatgttcttggcttgccagacaccggtggacaggtagtttacatactggatcaagttagagctcttgaagctgagttgttgctcagaattaagcaacaaggtctaaatgtaaagcctcagattcttgtagtcacaaggctcatccctgatgctcaaggaaccaagtgtaatcaggagttggaaccaatcattgataccaaacactccaacattctacgagttccttttcacacagataaaggaatcttgcgccaatgggtctctcgctttgacatttatccttatcttgagaggtttactaaggatgccacagtcaagattctcaacctcatggatggaaaaccagatcttattattggaaattacactgatgggaatttggtagcatctcttatggctaacaaacttaggataactcagggaactgttgcacatgctttagagaagactaagtatgaagattcagatgtcaagtggaaagaattagatcccaagtatcacttctcttgtcaattcatggctgatacaattgcaatgaatgcatcagatttcatcataaccagcacctatcaggaaattgcaggaagcaaagatagaccaggacaatatgaaagtcatgctgcatttacactcccagggctgtgtagggttgtttcagggataaatgtatttgatcccaagttcaacatagctgcacctggagctgaccagtctgtctatttcccttacacagacaaagtcaaaagactcactcaattttttcctgccattgaagacctgttgtacagtaaagtggataccaatgagcatattggatatctagaaaacaggagaaaacctataatcttctcaatggcaaggtttgatgttgtgaagaacttgaccggtttagttgagtggtatgggaataaccaaagactgagaaagatggtgaaccttgtcatagttggaggcttctttgaccctttgaaatccaaagatagggaggaaatgacagagataagaaagatgcatgatttggtagcaaagtatcaactcaagggtcaattcagatggattgctgcacaaactgatcgatatcgaaatggagagctataccgcttcattgctgacacaaagggagcttttgtgcagcctgctttgtatgaagcatttggtctcactgtcattgaagctatgaactgtggtttgcctacttttgctaccaaccaaggaggtccagcagaaatcattgttgacgggatctccggcttccacattgatcctcacaatggagaagaatcaagcaacaaaattgctgatttttttgaaaaatgcttacaagattcagcacattggaatagaatttcagcagccggattgcaacgcataaatgaatgctatacatggaagatctatgcaaacaagatgttgaacatggggagcagttataccttctggaggcgggtgaataatgaacaaaaagaggcaaagcaaagatacatcaagatgttctacaatcttatgtacaagaatttggtgaagactgtacctgttccaaatcatgaacctcaacaaccacaaccagtggtgtccaagaagcaaagtgtcaaaaaacaaggcacaagcaaacgttcacagtctggattgcaaagcttatttggagcttaa

SEQ ID NO: 7775 - DNA, 567 bp, Glycine max
  Peptide Sequence Number=SeqID_124553
atggcccggatttccatttgcaacagactgggacaaagccatatcagcaagaccggccacttgttgcttcagctcctcaaacgctttcttcaacttctcaaggttttccataatgatcatcccttccacgggccgggcccaccagagctgggcttcggcctccttctgctttctattcagcttctcggcgtgcttcctctccgcctcgagctgatcgttgatatgagtcagctggccgtggagctcaatgactttggccatgtagtgcatgttgccagcctccggcggtgggcctcgcttgagataacgctctatgacgccatccacgctggggtggccgaaggagaacactttctcccccggcgagaacaccaccaaagccacgttggcgccgcagagagtgcaaagctcgctggctttcttgaaaagcccgctgcggcgcttggagaagagtgtgaagtgctcaattatagggcttttagtgtgaatgccatccgaaaggatacaacacgtggtttctggactgcgagattgagaaaatcgtctttgaatggcgtttatggctaa

SEQ ID NO: 7776 - DNA, 486 bp, Glycine max
  Peptide Sequence Number=SeqID_124554
gctactcagatttggaatcttctccagcttgatgttcaatttcatgttttagatgataatagcttgacttggcttcaaaggaacttcttggcggcgtttggtggtcttattcgcgacaatcatggtccttggatcatgggattttatggatcatgtggaagttcatccaacaaaaatgcaaaacttcaagctatatatcatggcattagtgtgacttggcttaaaggagttcaacatctaacttgtgaatcagattcaaaagtgacttttcaactcatcacagatggagtcatttcttctcatattttctatctttttattcaaaagattagaagcttcctccaccttcactggaagctcatgttcaggcactcccattgtgaagggaacacttgtgcaaattggctcgccaaaaaaggagcttcaaagaatgatcatctccttagtttggatacttgtcctcctaaactgaaacctatgttaatg

SEQ ID NO: 7777 - DNA, 507 bp, Glycine max
  Peptide Sequence Number=SeqID_124555
atggagcttgaagcattgtccaaaggtctaaaaagcttgatcagtctctataattttgggataaccacaaagcaagctgttttgcctgagaacaagattgcaaacttgagttctcttcaatatttgacaattgaatgttgtgacaaagtggagtctttattcttaggggtagaactccctattcttaaagcattggatctagtgaatttgcctcattggcttcaaggatctgtcaacacattagtatccttgatgctagacaactgcgataatcttgaggtgcttccagattggctgccaaagctaacttgtctgaaagtacgttatgtcgcagattgtcccaagttgcagtctcttccatatggcatccattgcgtcagtgcccttgaacacttggaaattgcagattgtcctgagttatgcagaaaatacaagccacgagctggagagtgttggaaccaaatatcacacatcaaaaagattaggactgttgaacggaatatctga

SEQ ID NO: 7778 - DNA, 144 bp, Glycine max
  Peptide Sequence Number=SeqID_124556
atgtcatccttcctccaaggcgaattgcagaagatgatgaacccctttggcatgaagacagggaatcctctgatatttggattgctatttgggttgttgcttgtcattctctcgttggttgtggagaaacaagcatgtgtatga

SEQ ID NO: 7779 - DNA, 432 bp, Glycine max
  Peptide Sequence Number=SeqID_124557
atgacgcattcctatgtgactgattcagatgtcacaggaagggaacaagacaaaggagagatcataaagctcttgaatcagcaagatcccaatgatgattgtaatagtctctatgttatccccattgtgggaatggaaggcttgggaaagtccactcttgcaaagtttgtgttcaatgataagaggattcatgagtgtttccctttgaagatgtgggtgtgtgtttctgaagacttcgacattaagcaactggttattaaaatcatcaactctgctaatgattctgcttttcttgctgatgctcctgatccccaactgaattttaacatattggatatagagcagctgcaaaagcaattgagaaacaaacttgctggtcgagaattcttacttttcttggatgatgtgtggaatgagaaccatgttaaatag

SEQ ID NO: 7780 - DNA, 717 bp, Glycine max
  Peptide Sequence Number=SeqID_124558
atggctttccaatccttcgaggtggtgagctgcgcctctgtggaaccaagtccgttgctaccttctctctccaacgcggccataatggtgacacgtgttatgctcaggaacggatttgagcttggaatgggtctaggcaaggacagcctcggaaatgccgacgtagtcaatgttaagggaaatccgtacaagtatggattggggtacgaacccgggatgccggggaggaggaatgtgccgtcaagatttcaggcagacaaagtatggcccggccgtcttagccaatctttcaccagtgccggaatggtgtccgaggaagaagtggccgcagtaggagaggagttccctcaagacccaccaaatttcgtgcaaccatgccaccctgattcccgattggggaactggcgcgtgataagccagtcagaagtctataccgctgattcaatatatgagggtcgattctttgaggatcctaacaatgagggtttgacgatcgatttcgaccgagatgtaagccaaatgatgaacgaagaagaggaagaggacgtcctttcaccagagttggagaggttgatcgctcaagaagaacgtgaaatgaaagccttaccaagaggaaaccgaactgataaacttagagaccggagagggaaagaaagaagtgaaagtaggaatcggtatgaccgcacctatcagccaaggcttgataacccttcttga

SEQ ID NO: 7781 - DNA, 234 bp, Glycine max
  Peptide Sequence Number=SeqID_124559
atgtcagaattcacaagcgattatcctcttcaaatttcagccatcccgcatcaatcagattttgcaccttatgcttcagggtcatgcaatgctcaatggaatgccccaaaactcctccatgatgatcacatgttgtgttcgagtcgtatcctcataaaaatggagattgaggaaccttggctggggttatggctaccatcgcattatcgagtagtaggcggaccttgtggctga

SEQ ID NO: 7782 - DNA, 375 bp, Glycine max
  Peptide Sequence Number=SeqID_124560
atgaatgaattcgagtatcgaacacagggaactaatcctaaattactaaaccctcgatccctcgtcaggccgaatatccaagcttcttccgtagatccctcttgctctgaaatcgtgacgttgtgtttagcgccaccctcgcgctttgcgcgatctcaaacttatcaaggtaatccttgtggcgtctaccctaacttatcttccttcactggaagtggcgtctaccctaacttatcttccttcactggatgtggcgtctaccctgacttatcttccttcaccagaagtggcgtcatccaaaactccatagcctgtatcaaacgatccgctcctagtcaggttcacatcatctggtatcagagctttggctcttga

SEQ ID NO: 7783 - DNA, 318 bp, Glycine max
  Peptide Sequence Number=SeqID_124561
atgtgtcttttcaaaaatctttttctaaatttcttcactggtaatcgattacaggtttctggagtttcgttgctggtaatcgattacatgttcaaaattcaaattcaaaactattttcaacagctatttctcaaacttcccttctgtgcttatccttttgaagtggccttgtttgattcttctttggcatcatcaaaatcatatgtattaaacaagcaagatcaaagggcactcataatggagtttgaattcaaattcgaaacaacggttgatgaaaaaggttacacgaagacatttagagctgctagatttaggtag

SEQ ID NO: 7784 - DNA, 240 bp, Glycine max
  Peptide Sequence Number=SeqID_124562
atgtcaccaagtagatggagtttggagtttgagagcttcacaatcaagagcactagtgatcacaagaagtttaaagcacggattgttgccgaaccagttggtgaaaggtttgacactttggaattacaagtggatttgcgcttcaatgaaatggagtcaagaatcacaaaggttgaagaagatgtgtcttacattcgttcaagctttgatcttccaccaccgccgccaccattatcttag

SEQ ID NO: 7785 - DNA, 297 bp, Glycine max
  Peptide Sequence Number=SeqID_124563
atggaagcaatatccattagtgttggagaaactggaccacatggagacaccaagaggacaagccttggaaattccgctcttttctttgaaaaagtcactcctaatagtgtctttgcgaataagaaggtattcttcattgaaggggaagctcctatcaatagtagtagaagcatcttcttgttccccaagggtgttttgtcgcttggtggacaccattggcgagaaataagaacaaaggtgatcaaagagaaacacaaagatattttgaggaagaagaagacgaacaatggagattag

SEQ ID NO: 7786 - DNA, 288 bp, Glycine max
  Peptide Sequence Number=SeqID_124564
atgatttttactgtagctacagtaaaaaaggatcatcatttaaagaaataccaaaacagtcatcctcattttgaacattcttcttcatcttgttggagtaacaacaagacttctttcaagtttttagtcaaattttctttggagctagagcttgccaggaaggcagctaattgggacttctggttgaggaataaagaagtctcaggatcagttgcttttaataactccgagtgtgatttaaaccaaagtttaacctggtctggttcagctttcgatgagtcaaattaa

SEQ ID NO: 7787 - DNA, 405 bp, Glycine max
  Peptide Sequence Number=SeqID_124565
atgaaggtttttattcaaaaggaagtctctcctactcaaaggaaggcaaaggtaaccaaagcagctccaacaactaaggtcagtcccaaaatgattggaaaggaatggacttcgccatctcctcctacatcatattcaccaccacatactcgtccattcactccaccatgtcaacgtccacctctatctcttattaacttggagacattcaggtcagataagaagatgaagacaccattgatagatcaacatagatttcctctagccttcacttccatgaatccacagaatatgtataggaagtttgaaactagtgatatgatgttcaaggagattgtccataaactatattcctctgcactcacacaagtttggatggagtttgactatcaacatactccttga

SEQ ID NO: 7788 - DNA, 417 bp, Glycine max
  Peptide Sequence Number=SeqID_124566
atgtcagtgaaaaatctcatcggatgcctaggattacatgacaagatagacaacacaccggttagtcaggtcactttcactagctcacaactcaatacatacagtgtcgcgacctacccttcagcaggagggcgacgcggaggctcatgggagcgtcttccaaggaaggaaaacgcatggagtcgccaccaatgcttattcgaggaaaacgtaagaaaaaccagaacgtgtggtctacaaactttaatcgtgaaaggttcgggagttgtttttacacacggggaagggtggtcgacaaaagcgggacttttgcttctacgtatcctcaattgtgatgaggaactcagacctacgaagttcttgccaaaagcggtaaagttatgtgttaattttatgcttttgaacggtccatgttaa

SEQ ID NO: 7789 - DNA, 177 bp, Glycine max
  Peptide Sequence Number=SeqID_124567
atggaagagctactctttagatgcaaagcgcaatgttccattgagggattatcacaacatcagtatcatggctcactagatgctagaaagactactacaatagaacaaattttgtactatactggaatgaactacaaaattggagaggttcaagtgggaataacaaccatggaatag

SEQ ID NO: 7790 - DNA, 471 bp, Glycine max
  Peptide Sequence Number=SeqID_124568
atgccagtaacagtgcaaagcaaggaaccatttagtgtttcgatcaagaatgcgaaaaataccaaaaaaaggggcaaaagggtcttttcattgagtttcctggatcctagctcacctagggtagcctctggctcacctaggccccaaaattacttcagggtgaaggaacaagctcgcctgggcgagccagttacattaggagtaagcatcagttcgcttaagcgagttgccattgcccgaagtgcccattttcctatatataggcgtgctagggaggttgagggggggggggggggttccaaggttcagtacttgagggaattgagagaattgagagagaagaagaacaaagtagaggaaacaaagccgaggcactaccgaatcgcgactgtgatcaatctctacatggttccttgtttggtgttcttcctacgactgccggttagttttgtttttaagattcgaatgtga

SEQ ID NO: 7791 - DNA, 144 bp, Glycine max
  Peptide Sequence Number=SeqID_124569
atgccgccctctgaaagcgaggacgtgcagtcctctaaaggcaaggacgtgaagccctctgaaggtaaggacgtgcagtcctctgaaggcaagggcatgcagccctcttacaacgagggcatatgcatgcaacctttgtcttga

SEQ ID NO: 7792 - DNA, 243 bp, Glycine max
  Peptide Sequence Number=SeqID_124570
atggttgtgttcttaggttcccacaccttgggaaagttgtctagcaccttcaggtttatgaatagggatatccctattggtaatcatgagctagatttcatactgggtggacttgatgtacatctccattatgtccttctagtaagggtagttttcttcagcgaagcctggtggcctagtgagagatgctcccttagtgataaacttgtgttggttatctaccatttggatcttttcctctaa

SEQ ID NO: 7793 - DNA, 147 bp, Glycine max
  Peptide Sequence Number=SeqID_124571
atgagatgttacaaccaagaggttggagttgatcctgtctttgtggatcacccttggtttcttgaaaagatactgattagtgtgactaaacttcatggtatgatggaaaactcgacaaaaactttatggaccaactacacgaaatga

SEQ ID NO: 7794 - DNA, 561 bp, Glycine max
  Peptide Sequence Number=SeqID_124572
atgagctcaacatcatcaacagcgtcaagcaggatgagggatcctataatgacccggccctgcatattacagtttattgcagcatttcacaatgagaaggactatatagaaataccgtcattctaccattcacagtgggcgccacgttatccaaaatttgcccgtccttcgcttgaacaacagacatgtggcagacccctactagcatttagaatgcatgtctggactattgaactcactcaagccctgcttggtgatcctaaaccactgattcatccacctattgcagcaatacaccttccttcttgtggtttccatatgaccattttaagaaagttcaggcctccattacaatggtttgtcgtcccagttggccctggctttcacggaaaatattttgcggagccatggtattggtttctttctaaagatgattttgttcgcggagacgaacttttattctattacagaagtcgtgaggatatttgggaaatggttattagaaaacagaggaattgggtgacaacgatgattggtgaatttaaatttttattatgttag

SEQ ID NO: 7795 - DNA, 342 bp, Glycine max
  Peptide Sequence Number=SeqID_124573
atgtcattggacctatccataggcagggccgtccaagggaaaacatttagtcgtatgatcactatttttgtttcaatgcagctccttccaccagcagctttaaattttttgtttggatcacaaaaagtaattcttgttcagagaggctatggcaaacgcaaccaatggcagatcaccatgcacgatggtgtgccatctattgcccagccatggttccaatatctctatgaaaataatttaatggctggagaagaggtaatattcttcttcagatttgacgaacacgtatgggaagttctatttagaaaagaagttatatgggatgaggacctctccaactga

SEQ ID NO: 7796 - DNA, 744 bp, Glycine max
  Peptide Sequence Number=SeqID_124574
atgtctggcccaaagaaaagccgtggccgccaaaagatcgagatgaagaaaatgagcaacgagagcaaccttcaagtcacattctccaagcgccgcaacgggcttttcaagaaagccagtgagctttgcactctctgtggtactgacgtggcgctcgttgttttctctcctggtcagaaggtgttttcctttggccaccccaacgtggatgccgtcattgaccgctatctcgcacggcccccaccgacggactccggcaccatgcagatcatcgaggcccaccgcatggcccacgtgcatgacctcaacgtacaactcactcagatcaacaaccagcttgaccatgagaggaagcgcaccaatgagctcaatctcatgaacaaggaagcccaagcccagatgtggtgggcacggcccgtggatgggatgagtatggcccaagtgaagcagttcaaggcggcgttggaggagatgaagaagcaggttgcgcgccttgtcgatagggctatgcttcagagtgttacaaacccaactcttcaatttttccccggggtttcttcctcttccaattccaaccttgtgcatcagccacacccacttccagctccgcaggtgttcaccccacacctgattcagccacccatgcttcagaacttcatgtttcatgatgggagcatgatgcgccaccatgggtttgataacattggaatgggaggatatggacctactgcgggtttcttttga

SEQ ID NO: 7797 - DNA, 365 bp, Glycine max
  Peptide Sequence Number=SeqID_124575
atgtctagcgcaaagaaaagctgtggtcgccaaaagatcgagatgaagaaaatgagcaacgagagcaaccttcaagtcaccttctccatgcgccgcggcgggcttttcaagagactctctaaaaagttttctccttcggccaccccaaagtggacgccgtcattgaccgctaactcgcgcgggacccacccacggacttgtcgggcgccatgcagttcgtggaggcccaccgcatgggccacgtgcgtgacctcaacgaacagctcactcagatcaacaaacacctcgaagccgagaggaagggcgccgatcgacgagctgaatctcgagaagaaggaagccgaggcccacctgtggtgggccag

SEQ ID NO: 7798 - DNA, 207 bp, Glycine max
  Peptide Sequence Number=SeqID_124576
atgcttcagattgttacaaaccgtactcatcagtttttccctgctggggcttcttccgctaattcctcttccaattccaacccactgccaccaacgattcagaactttatgtttcatgatgggagcatgatgcgtcaccatgggtttgattatggacgtagtgcagctagtttagttcatgtatgtgacatggttagcactgattag

SEQ ID NO: 7799 - DNA, 165 bp, Glycine max
  Peptide Sequence Number=SeqID_124577
atgatgaatcaacgtcgactattacccctagccttccaagctaacgatgcggaaaaagaagttccatctgttcttgatagcttccttcaaaggacttctggcttcccagggaatgtctgggtagaagatatgatttctttcgaattgaggtttattcgtctttaa

SEQ ID NO: 7800 - DNA, 321 bp, Glycine max
  Peptide Sequence Number=SeqID_124578
atgtctcctccatctctagaaacctcacaatctctcaaaatctcatccaaagctccgcaagatggcttcctcgtcaagctcagctctctctcagtctctccacagccaaaaactctcaaaaaactcaacaacccttccaaaatcgagttttcaactttaaatagcctaagggttaaaggcagtgcgtttagcgagttcacactcgctcaacgcctctgtacagctcatccttcttccagattcttctgtgtgcttagccggaggatagtgcgcttagcggatgattcgcccagtgcgcggcatggctcagcgagttcataa

SEQ ID NO: 7801 - DNA, 243 bp, Glycine max
  Peptide Sequence Number=SeqID_124579
atggtggctgaagagtatagactagtacctgatacattgtatttgacagtaaactacattgatcgatatctatcagggaatgtgatgaacagacaaagtaaatacgaggaaatttgtgcacctcaggtggaggaattttgttacataactgataacacatacttcaaagaagaggtttgggttgaattcttttgcggcttcaagttatatttctttatgtatgttgaggtgtacacatattaa

SEQ ID NO: 7802 - DNA, 348 bp, Glycine max
  Peptide Sequence Number=SeqID_124580
atgcctactgtatcctgcacctctaacgttgcttaccaaaacgtaaatgcacacccttctttaacagcgtcgcggctccaagatggaaagatcttggtccttgattccattgccttttttgcctcgggttttgctgcttgtagctccttcaaggacgagggtgcttctgctgcaaatgtgtctttttggtctgttggagtgagtgagaacaaaaatgatgactatgattgtgaaagtgagactatcatgacaaggcctcacgaattcagggttcacttaataatagttcaggggaaacgaagccaacataacaagtttaaaaagccattggataagataacgatgtag

SEQ ID NO: 7803 - DNA, 1339 bp, Glycine max
  Peptide Sequence Number=SeqID_124581
atgaagactattgggagggaagcgagggcggtgtacaatgcggggcaagcgacggggatgacgttttgggctccgaacataaacgttttcagggatccacggtgggggagagggcaagagactgcaggagaagaccctttgatgaatgccaagtatggtgtggcgtatgtgagagggcttcaaggggattcctttgaaggagggaaactggctgagaggcttcaagcttcggcgtgttgcaagcacttcactgcctatgatttggaccaatggaagggcctcgatcgctttgtcttcgatgctcgtgtcacatcgcaagatttggcagacacataccaacctccatttcaaagttgcatagagcaaggtcgagccagtgggataatgtgtgcctacaaccgtgtcaatggggttccaaactgtgcagatttcaatcttctaaccaaaaccgcaagacaacaatggaaattcgatgggtatattacatcagattgtggagcagtctctatcatacacgagaagcaaggttatgcaaaaacagcagaggacgctatagccgatgtttttagggcagggatggatgtggagtgtggtgattacataaccaagcatgcaaaatcagcagtgttccaaaaaaaactacccatatctcaaatcgaccgtgcccttcagaacctcttctccattagaataagactaggcctattcgatggaaaccccaccaagcttccatttggcacaattggtcccaacgaagtgtgctccaaacaaagcctccaactagccctagaagcagcaagggatggcatagtgcttctaaagaacacaaactcactcctcccacttccaaaaacaaaccccactatcgcattaataggccccaatgccaatgcctcatcaaaagtcttcctaggaaactattatgggcgtccttgcaatttggtgacacttttgcaaggctttgagggctatgctaaaacggtttaccatcctgggtgtgatgatggcccacaatgtgcttatgctcaaatagaagaggcagtggaggttgcaaaaaaagtggattatgtggtattggttatgggtttggatcaaagtcaagagagggagtcacatgatagagagtacttagggttgccagggaagcaagaagagcttattaagagtgtagctagggctgctaagagacctgttgttgtggtgcttttgtgtggaggcccggttgatattacttcggctaagtttgatgataaggttggaggaatcttgtgggctgggtacccgggggaacttggaggagtggccctggcccaggttgtatttggtgatcataacccag

SEQ ID NO: 7804 - DNA, 942 bp, Glycine max
  Peptide Sequence Number=SeqID_124582
atgactaacattccttatccacaacctgaggttttgcaaactatttataaagttttaaccacatttaaagagggatcaaaggtgtatggtaagaatagtgaagagtggtttcaaaaagaagaagacgaaatggtgggatccattgctaggacattggaagaagaggtcaagtttatggcctcttcttctaagttctgggctgaggaagcctcgctttggcaggtgctatgtgagcttttggaaactcatccagggctggagttcctgcagagcacacctgagtttcaagagagatatggtttgtcttccatcttggttataaccttgcatttagggaatgaatcactaaatgagggtggaatgctttttgtggacaagcaccctaaccttagggtccgtgttgttcatgggaacatgtttactgttgctgtcatactcaatgagatccctcaaggtgtgaaagaggcgttcctaaaaggagcgacatccaggcttggaagagcaattgctctctacctttgccaaaagaaagtcaaagttctggctgcagtttacaacataggagctataagtgctgccttccttgccaacattgccaaaactgatgcaaaagtaagcttcaatggaaattcatatcacttatccgcatggtctttgagcatcttaccagactgcaagagtgtagtgcttaatacggcaaagattaactctgcatctatgatttcaagcttcacaactgaatctttaaaagaagaggttggctctttggatgattctggctcgggatggagttggattagtgaacctatcgatatttcaaaggctcattcattctcaaaattttgcattgatcttgatgctgctactgaaactgtccttcacattgaatcccttggtcatactcttcatgctttaataaatgggatgcttgcagctaaataa

SEQ ID NO: 7805 - DNA, 180 bp, Glycine max
  Peptide Sequence Number=SeqID_124583
atgagccaatataatgaaattgaggcacatattgtctcaaatttgcaaaaaatgatggatgaaaacaatgctcatgcaaagagtttcaggatggcaagggatagattgacaggcactgaagtgcataatgtcagattcaaattgatcgctggtcgggaaaaaaaatggtcatacatataa

SEQ ID NO: 7806 - DNA, 537 bp, Glycine max
  Peptide Sequence Number=SeqID_124584
atgtcttccgtcttcatatgctttccaacacagacatatgggacgtcgagtactgaacttcactccttacgaattcctagtatcgccgatcgctgtggcctttcactttcttctctacttagcgcgtataaccacaacaacacttcgcagaaccaaaagaactgttacattgtgctcaaactggcggcgaatatggaggaagaagatgattatgttgagtatgtgcccgtggccaagcgtcgggccttggaagctcagaatattctccaacgcaaagggaaggcctctgctgccactgacgatgatttggagaaacaaagagtggctgaaactaagcccagtcttctggttaaagcgtcacagctgaaacgagagcaacccgagatcagtgtgacggagcagatcgttcaacaggagaaggagatgattgaaaacttgtcagataggaaaaccctcatgtctgtccgtgaattggctaaggggattacttatacggaacctttgcctacagggtggaaagcccgcctttgcatgtga

SEQ ID NO: 7807 - DNA, 720 bp, Glycine max
  Peptide Sequence Number=SeqID_124585
atggttcatggtccatgtggaattttgaggcctgcatctccatgcatgaagaaaggaaaatgcagtcgattttatccaaaaaagtttcagcccacaactcttatagatggagatggttatcctgtgtatcgtagaagaaacactggtcggacaataaccaagaatgagattataattgataatagatgtattgtaccctacaatccaaaattgctgaaaaaatatcaagcacatataaatattgaatggtgtaaccaaagcacttctatcaaatatttattcaagtacatcaataaaggatatgatagagttaccgttgtcatggttcatgatgacaatggaacagttccccatgcaaacactccgaatgatgaaatcaaggaatatctggattgtagaaaaactgttgtagagaggctacacttccatcttccaagacaacatagcattctctaccaagaccatgatgatattgatgatctcctctttaactcaagcatttttgaaacaaaattcatagcttggatgagtacaaaccaagcttttgttgaaggtcaaagcctgacttattctgaatttgttactaagttcgtgtataaccagaaacagagatgttggcaacttaggaaaaagggttatgctattggcaggcttcaatgggttcccccaactacaggggaattattttatttgaggatgatgttgactgtctctagatga

SEQ ID NO: 7808 - DNA, 192 bp, Glycine max
  Peptide Sequence Number=SeqID_124586
atgggattagttgttgtagaagaagtaaggtcaaataaggatgctaaagttggcacactgttggatcttactcagtcgggtgcatttaatgggtactctgttgatcccattgaagatttgcttggagaaaatcagaataacactggccttctatttagtttccaacaaggtctaaaatggaactttgagtag

SEQ ID NO: 7809 - DNA, 168 bp, Glycine max
  Peptide Sequence Number=SeqID_124587
atgcagcatagaagtggtggttttggatctggtttcattcccattgcagagtatggaagtgactttagaaagggttctagcagaaaagctgtgaggctattatacagcgtaaaggttggtcctctatttggctggaaaccaattcgaccttggtggtggcagctttaa

SEQ ID NO: 7810 - DNA, 210 bp, Glycine max
  Peptide Sequence Number=SeqID_124588
atgagtgctttggtgttatatgtgctgcaaaaacacagagtaaagcttgagagagaagttgaagatctgaagactctcgctcaacgtggcatacgcgctcagcatggcgcagacgctcagtgggcaacactcgctcagggtaaagaagtcacatggagaagcttgatacatgaaggcgcgtctagtgcgagtcgggcgctaagcgcgtga

SEQ ID NO: 7811 - DNA, 312 bp, Glycine max
  Peptide Sequence Number=SeqID_124589
atggaggacactcagggtaccagcagggaggaaatttctctcaaaatcaagcccaaggttggagatcccacccggaaaataactttaacaaagatcaaggagggtttactccctacagggatctcgccggaaaacttaaacttacttgaatcatctctaacaagggttaagctgatcaaaggagtagaaccaacagttatctctcacctagacgtagcatactctaagggtcatcctcatctaactaaaatgcataacaaaactcctagcatgaaaggtgattcccaagggtctataaaaaccttaagataa

SEQ ID NO: 7812 - DNA, 834 bp, Glycine max
  Peptide Sequence Number=SeqID_124590
atggtcccaagcttcctgagtagtagtgacgtctacaacatagtcctcatctaccccgacctttgtagcatctctagcattaccgccattggtgtcatctctagtgccagagagttggatggagagctagtggaggctctgaatgacaaggagctagagctagtggaggctctgcatcatcgaaatgagctagttgcgacagctagaggagggatcaccggaggaggagttggtggagtgtctggagtggctcgagccctaacccaccttggccccgagaagacaatagaagaatctgttggattccagcagtttttccggatggaagccgagccgagatgtaatggattgggcaatctgggtaatctgggaagaaatgaggctgcccaggtccatgtccatcttcatcaccaacccataaatgagtcaagcacgatcgacattgaggttaaaggtgtgagaggtaggagtgaggttgaagtagctgagaatgctccacgtcttggcctgggtggtaaggctactgctccccctctgggtgatgacaggtgtcttgaggaaagttttcaacgtctgagcattaaacggaataagcttcccccagaccctacactacttcggggcattgtcctctgggtcatagatgttggagcatgtgaggcgtctatgccattgtcttcgctggagctcgtcataaaactcattgtacatggtgggggcgagctccataatcctctctggaagaatgttccaaaggtgaacgttgtcctggtagtggagctaggcaaccttagatacaaaatgggaggagtcccaagcaagatccccccttga

SEQ ID NO: 7813 - DNA, 543 bp, Glycine max
  Peptide Sequence Number=SeqID_124591
atggttcagcgacttttcaagagaaataaggtatctttagtgaaaaatacagaagaagatttcggtgaggggtctaataaaggaaataaagttaggctttttattggtggcaacaaatatgagatcctatctattgacaagaaatcttatattgcacctaattttgataaggagatattggaaacaaacgagatcggggtgagttctgctagtggggacagttcaaataatggatatcacaccaaagatattggtgcaaagaaggagaatgtcatgcatactactcacatgaaggccaataacaagtctatggccaataataaacttgtaccttacaaaaaaatatgtggaaccttctcaaagccctttagagttgatgaaggaaaattcgcaatagatgttgcaggaaaaaggtcaaaaataagagatccattggcgactcatggagatatggactatacagatgagacaactatagggatggtggtggcctatgtggaaagtggtgttcatttgccaaacaatcttgtagtttcctcatga

SEQ ID NO: 7814 - DNA, 213 bp, Glycine max
  Peptide Sequence Number=SeqID_124592
atgagattttggatgttagctttcgtttctaaacgaccatttagaggaaacactgggtcaaacaaaatagaagaaaatcactcaaagtgtatcaatctcacacagggtgttagcagctcaacagtgagggacccttctttcttaggagaccccaccgttccttctttcaagggcaaggatggaaattcaatcctaggtcaaggtttatggtga

SEQ ID NO: 7815 - DNA, 438 bp, Glycine max
  Peptide Sequence Number=SeqID_124593
atggcttgcctcccaaactatacaccacccaatgtggcgtacattcccaatgaggatgtcaataactccactcccatactcattaagagccaacaacctcaatctgatcatgcacatgtctctcgacccatggaggagacgcatgaaattccccaccgcgatctagccgacttcgagccttgcctcggatatgccgctgaagggcaagcagttggtggtgtacccctgcaaaacactttggagggccctcagtatcatccacaaccacaaccctcatgttccacaacaagtaaaaaccctcgtgctatggcagaaatggaaaagttggatcatttagaggaaaggctcagggccattgaagtaggtgaagtttatgcctttgctaacctaaaagagttgttcctagaacccaatatcatcacccctcccaagttcaag

SEQ ID NO: 7816 - DNA, 246 bp, Glycine max
  Peptide Sequence Number=SeqID_124594
atgactgagttatacctagtgcctgacatagtcatccttctgaagttcatggtaccggatttcgataagtacaaggggaccacttgccccaagaatcatctgaaaatgtactatcagaagatgggggttattagtacaattcttatatggctccagatagaatgtagctacaaaacatgtgcaaaaagaagcacgaatctttcaaagaatacgcccaaagatagagggatctggcaactcaaatag

SEQ ID NO: 7817 - DNA, 328 bp, Glycine max
  Peptide Sequence Number=SeqID_124595
tccgggtggatatctcactacattgacgcagtttgttcaaagacgaacgccctgaattatgccatctgcttaggctttcaaatatggtacgctctaatgccaagccttatgctggtcttagggtattatcatcaaatctttaagccagaggtagttaaatacatcaaggacaccataggagtatggcacaacgatattgtcaagatcgcatcagatctaataggcaataatgaattcttcatgcagcccgacgtgggaacgctcgaaagcagtggggcctctgggacagggaccagacctgagtcgctaacatttgggaataagagaa

SEQ ID NO: 7818 - DNA, 300 bp, Glycine max
  Peptide Sequence Number=SeqID_124596
atggcggcaagcattaagaaaactaaaaaacagggcgaacccttaaaaaccatgaggcccaaattaattgaagaattaaaaaggtattttttaaaagcaaaaataaaaatcaccgaaggaggttgtcggagaagttcatggatggatggaggtcgccaaaggacagagattgagggtggcaaagaatggacagcgtggtcgcttgggggaagcttcatgagggaagaagatatgcttttcgccgtcttatatcttagaaaggtgtttctaggaggttacaatactcacacatcctattaa

SEQ ID NO: 7819 - DNA, 171 bp, Glycine max
  Peptide Sequence Number=SeqID_124597
atggatttggcagggtcaaggagatcagcgaataggcagggtgaaggggatcacaaaaagggtcaaatgtatcaacaatggttgttaatttgtgaagaaatcaactcctgcgagaaatatcataggtgtaaaatccagcaggaggcatgcaaagaagcaattaacaggtaa

SEQ ID NO: 7820 - DNA, 475 bp, Glycine max
  Peptide Sequence Number=SeqID_124598
gaatttaagctcaatccagctgccaaaaccttctctccatcttttgtgaatcctatatcagcaacttctgctgcaaacatggtatacataccaaatagctctcctccagtctctgttactattcaacctgaagttggattcaatacttttgcttctcggccatcaatgcctcttaaagttgcacagtacagtaatttgacagtgagcaatggtggcagtggctctcaattttcacagcctattgttggacatgtggcacatagaacccaacctctacggtatgctacacattacagtccagttttgtctgaacatgcttatatgcaaccaagctctcctgctgttatggttggacgttccccccagttagtctatgttcagccagtttcccatgatttgattcatggaacaacaactgtcccaccagtctcagctcgccctctgttgaatcatgtacaatttccaaagcagcagg

SEQ ID NO: 7821 - DNA, 234 bp, Glycine max
  Peptide Sequence Number=SeqID_124599
atgagaaagagaaccagtgaaccacacaaacagaaccacagacacagaggaacaaaacagagagtcagagatgaccttggatgtggccaagaagtgctctggactctggacatggtgaaaaaaagctctggtcacagtggtttctgcagcagttttgggcatggtttagagaggatgcagaatttgtgcgaggttgaagaacacgcagcaatgcctgctaagggttacagataa

SEQ ID NO: 7822 - DNA, 429 bp, Glycine max
  Peptide Sequence Number=SeqID_124600
atgacattattttctttcattttggatttctgccaactgttctttgacagacaagctggagacgacaagtcaaactcaaaagggaaaactgatgactgtggacagaagtctgagtctgttaatgaaaaaattgatgaaaagactcaaaacctcaattcaagccatgaaactgatacatgtccaggtcaagaggtagctgttgagcatggaagcaccgataggacatcaagtccttcggataatggattactctgcaacaatgcccctgcatctgttaaggccaatgatcggaatagtgaaaggtctacttctgcagactctgtctctaaaaatttaacccaaggtgtggatatcatccaagattcacagccagcaaggtccattgaaatatctgctccaaggggtacagattctaccagaaatgctaag

SEQ ID NO: 7823 - DNA, 342 bp, Glycine max
  Peptide Sequence Number=SeqID_124601
atgggtgatcagataagtattgttttgaagaaagcaaggatgaccaagaagggaaagggcaactctaatgtcggaaatgagggcttcgtggatacactagtgattctatccagtgatcttgtgcaagttgtagctaagggagtaatatttcctgcagatggtgttggtggaaacataactggtgatgatgaggaagcagttgcacataatgtttgttccgagagtctaacatgtgaggtagagaatcatacaggacctttgatgggtgcaaaacaggttaatcaattaagaagcattcactgtatattctttgcttgccatgcacatgccattgttgagtaa

SEQ ID NO: 7824 - DNA, 1005 bp, Glycine max
  Peptide Sequence Number=SeqID_124602
atggagaataacaattatcagagagaaataatggaagagcaaaggtttgaattgccaccaggattcaggtttcatccaacagacgaagaactcatcactcactacctctcacagaaggttcttgatagctgcttctgtgcaagagccattggagaggctgatttgaacaaaaaatacccaactggtcaaaggactaatagggccactggtgctggatactggaaggccacaggcaaggacagagagatatacaaggcaaagacactgattggaatgaagaaaactctggttttctacaaaggaagagctccaagtggtgaaaaatctaactgggtcatgcatgaatacagattagaaaatgaacattctgtgcaaaatccacccaaaaaggccatgaatgattgggccatctgcaggattttccagaagagtaattgtgggaagaaaatgcccatttctaggttgttgaggttcagcacttttgcaaaggacataccttcattgatggattcttctccaaacaacaacaacaacagtgaatcaaaacctgttttgggggagtcatcacatgcaacctgcttctctgatccaaaccaaagtgaggataaaaaaacagaaaacgaaaacatagctgaaagctatgaaatcatcatgttggcatcttcatattcttcaaacccctctgatgtttcccctgactcatggactttttccaaatctgcccctactgtgtcccaccaatcactccaagttggaaactcacactgctcagattacttcatgcttcatcaggaacagtccatgttggggatgttgattgaaaaccatggatcaagtactggccaaagaactcagaaagctcaggataataataaagactttgatgctgacatgtcctcggtgatgtacaacaacaatgaaatgtttcaaagatcatttgggaaccaggaatattcatcaccttctgtaggacatgtgtattctagtggcctatggggattttaa

SEQ ID NO: 7825 - DNA, 252 bp, Glycine max
  Peptide Sequence Number=SeqID_124603
atggattgcagaaacagggactcaatcacagagaatcacacttcatcatcatcatcatcatcttcttcttcttcttcttcttcttcttcttcgtgtgattcactcagcgaagccttgcttttcaccaccatgtgcatcgttggccaccccgtcgatgttcacgttaaggatggctctgtctattccggaatcttccacactgcttctgttcacgccgattacgattcccttgtaggctcaaatgggttgtga

SEQ ID NO: 7826 - DNA, 198 bp, Glycine max
  Peptide Sequence Number=SeqID_124604
atggctgaagttgcaaaacttgtcaacagtgccgacgcttccaaccccacgccacagacgaaaatctttgctaagcctctgcctgacagctcaaaagttgaggaacgcgttcataccttgctagacatgcatggagttgtcttcgctctttccactcccaaacccgatgtcgctgctaatgccagtcaacttcaataa

SEQ ID NO: 7827 - DNA, 174 bp, Glycine max
  Peptide Sequence Number=SeqID_124605
atgaatcgcacgaagcaatacaaatggaggcttcaatctcttctccttctctctgacgtttggaaattctatcagagcaataagaggaaaagcttgaggaatcacaggaaattgctagagatgccgctatcaccgttggaatacacacatgagcccgtttatagggatccttag

SEQ ID NO: 7828 - DNA, 294 bp, Glycine max
  Peptide Sequence Number=SeqID_124606
atgtcacatcctatcagagcattgtgtaccgacatcctccagcacaaggttccttacagcaatccacctagtcatctgttctcacgaacgaaaggtttgagatcaccacaatatccaaacacaaacagcacacaggaattcacgtcattccaccacttatcgcgtaacatcacatctcaacattacacgtcttacacattttcacatcattcacgtactcaaggatcaaaacacaatatcactcaaccaatcaatattgatcaatacacaagcattatgcaacaagtatactaa

SEQ ID NO: 7829 - DNA, 195 bp, Glycine max
  Peptide Sequence Number=SeqID_124607
atgaagacacgccccatttccagtgtcaacgacttcttgctcgcgttctggacaccctttctgctgctgcacttgggaggccctgataccatcactgcttttgctctggaggataatgaactttggctcaggcacatgcttggactcattgttcaggatgtatttaaacagtttttatattctgcatcactttaa

SEQ ID NO: 7830 - DNA, 996 bp, Glycine max
  Peptide Sequence Number=SeqID_124608
atgggggaaggagcgagcaatggagggatgctgtaccacgaggtgcaggagtcgaagctctgcgcggtgcattgcgtgaacacggtgctgcagggcccgttcttctcggagttcgatttggccgcgctcgcctccgatctcgaccgcaaggagcgccaggtcatgctccccgcgctctcctcggcggatttcgaatcgcacaatgtctcgctcgacggcgatttcagcatccaggctctggaagtgtgggacctacaagttatccctcttgactctccagttgctgagcctgcccagattgaccctgagctggaaaatgccttcatttgtcatttgcaagaccattggttttgtatccgtaaagtgaacagggagtggtataattttgacagtctctatgcagccccacagcacctttccaagttttacctctctgcctatcttgactctttgaaaggctttgggtggagcatattcctggttagaggaaattttccaaaagagttccccatctcctcatctgaagcttctaatggatttgggcagtggctttcacccgaagatgctgagaggataactaaatcttgcaactcagtacaggctccacaccagagagttaacgagcgccaacagaattatgatcagtttctttctcatggggaaaccgaaatgctattagacatggaagatgaggatctaagggctgcaattgcagctagtctgatggattcatccccagttgtgacaaatgctgaagccagtactcctcaaaatgataatcaaagtagtaaacaagtggcaaccactgaagctacccctctaaatgatcaacactccaaacaagtggaacccattgaagccactccgcctctcaatgctcaaagcaacaaacatttgcctgctactgaagctggttctcctctgaatgatcaaaacagcaaagaagtggcatctactataggtgataacgctcaagatgataaccagaaaaaataa

SEQ ID NO: 7831 - DNA, 318 bp, Glycine max
  Peptide Sequence Number=SeqID_124609
atgaaggattatcttccaacaacagtgctacaaatggttaataatatgaccataaggctggctacgaatcaggatggaattatagcttggatgaactcgagtgatggagttttcaatatgaagtctgtgcatgaggctcccaacaatgggggtttaacctttcattgctatgagaggctttacaatttagaggctgatgtggatagaaataaaagagggatggatagagaatgtgaaggggataatggacatataaagaaggtttcctctattagagatgctcgggcggctttggatgtattcattagagagctctga

SEQ ID NO: 7832 - DNA, 480 bp, Glycine max
  Peptide Sequence Number=SeqID_124610
atggtgtttaacagcattagctgtcgtcgaaactttttccaagttaaagaagagaatggaacagaaaagagtgacgagcaggaggcatgcatgagactccgtgaagtgtgtgttgatcatgaaccctcagctgtgaagggagataggagtaaatctttgttatttgatgcctgtaaactggccagtgttatagacggtttaagattagaagagccagacaaatggaaaaaggcagacaaatggaaaatgatagcacaagtatgggtggagttattgtcatatgcagcagctaattgcatacccattacccatgtccaacaacttagtaaaggtggagagttcctttcccttgtttggctattgatgactcatttaggccttgccaagcagtttcaaatcaaggaaggccatgcgagggcaaaattgatagtaggtgaagaagaacagattgaacaaaacttagctaaaactaaacaataa

SEQ ID NO: 7833 - DNA, 642 bp, Glycine max
  Peptide Sequence Number=SeqID_124611
atgaaatgcgttttcgttcatggatcctccacccacgactttggagccatgcgtagtgattgcttagtgcaattctccattatcaaccctttttcagagcccatgaattgcgttttcgttcatgcgtcgtccaccttcgagtttggagccatgcgtagtgattgcttagtgcaattctccattctcaaccctttttcggagcccatgaattgcgttttcgttcatgcgtcctccaccttcgagtttggagccatgcgtagtgattgcttagtgcaattctccattctcaaccctttttcggagccaatgaattgtgttttcgttcatgcgtcttccaccttcaagtttggagcaatgcgtagtgattgcatagtgcaattctccattctaaaccctttttcggagcccatgaatttcgttttcgttcatgtgtcctccaccttcgagtttggagccatgcgtagtgattgcttagtgcaattctccattctcaaccctttttcggagcccatgaattgcgttttcgttcatgcgtcctccaccttcgagtttggagccatgctgatgcaatcctactccgcaagggcattggataaaaaaactccaagtagattgggccagagatgcaagagaaggccctag

SEQ ID NO: 7834 - DNA, 129 bp, Glycine max
  Peptide Sequence Number=SeqID_124612
atgagtgagatacgaaggtttggaggtttgggaatggaggaacgtcgcaagagaaaaggggatgcgcagggatttctggaaaatgtgatatttatagagcaggacgcgtggccatctgttctagtgtaa

SEQ ID NO: 7835 - DNA, 318 bp, Glycine max
  Peptide Sequence Number=SeqID_124613
atggctcacggatttcgccgccgtcgtcgcccccggagcgatcatcctcggccactccttcggttcgatcgtcacctcggccgccgtcgcgaacggcctgcagaccccgcggctgattctgctgaacccgatcggcgctcccgccctggaggggccgaaaggtctgatgacccggttggcggtgctgtactacgccctgggagcgcgactcccggagcggctgggcaccgctctactgcggaacaggttcatcgtccgcgtgatgagcatcacgatggcgaagacgagggatccgcagcttcgacgattcatccatga

SEQ ID NO: 7836 - DNA, 594 bp, Glycine max
  Peptide Sequence Number=SeqID_124614
atgggggtgatctgcggtgacatcgtcgtcctcctcgtcaacgcggcccctcgtgaggctccgcgcacggatgccggcgtcatcaccggcatgcgacgcgtgctgctagtgtttggcactatgccaggactcgaccgcaccgatctcgagctgctcgccgccctcgcggatgatccgaggaccaccatcgtcgcgctggcggagaatctggggctgtcgcggaacacgattcaagcgcggatggcgcggctggagcagagcggcgtcttcctctcctacgaacgctcgttctcccctgacgtgctcggcttccccctgcaggcgttcgtgagcatcggcgtgcgccagaccgagctgccacgcatcatcaacgagctcgcgcggatccccgaagtcgtacaggcgcacgggttgagcgggtcaatcgacctgctcgcacgggtggcgtgccgtgatgcgcgtcacttgttcgacaccgacgcgcgcatcctctccatcgagggtgtcgagaggacggagacctcgctcgcgatgggtgaggtgatccccttccgcgtcgcgggcctcatcggcctcgcgcgacgggaatcctga

SEQ ID NO: 7837 - DNA, 252 bp, Glycine max
  Peptide Sequence Number=SeqID_124615
atggacgaatacgcaagcatacgtttcatgcttgtttgggtaatagcaatgagattccccaatatcatgctaagaatagctaggattccagaagaagatgccattcgtttgatgagaaataaaaagggatatcgaaaattcgaaaagaaaagcaacgactggagtgggagagtcagagtcgaaaagaggattcctcacttctttctctcattcaaaaccgtgcatgagactttcatctcgcacggctcctaa

SEQ ID NO: 7838 - DNA, 210 bp, Glycine max
  Peptide Sequence Number=SeqID_124616
atgcaggccattgacaaattgccacttttcccaatgttactggaattaattggaatattttactctgtgcctaagaccacgagtgcacgagctcataggctcgttgtgttaacctttggggagccgtcgacaatttggattgcaccgatgtctagtcgaatgtcgctttcagggaagtggttttcacggcacaacaaaactttcaattag

SEQ ID NO: 7839 - DNA, 1257 bp, Glycine max
  Peptide Sequence Number=SeqID_124617
atgaaactaaacaaggttgctcggagagctggtgaagagtgtcatgtgtttgttcttgataatgttatgatgataaattctttaggaggttggcactgcaatgtggatggagaacagcacatgagagttacctggattactgatgataactctgcaccttcaattgtagaatatggaacatcaccagggcgatatgactctgtagctgaaggagaaaccacctcttacagttatctgttgtatagctcaggaaagatacaccatactgtaattgggcctttagagcataattctgtgtactattaccgatgtggtggacaaggtcctcagttccagctcagaactcctccagctcaacttccaatcacttttgccgtggctggtgatttgggtcaaaccggatggactaaatcaacattggatcacattgaccaatgtaaatataatgttcacctgcttccgggagacctttcatatgctgattatatccagcatcgctgggactcgtttggtaggctagtgcagccacttgctagtgctagaccatggatggtaacacaaggaaaccatgaagtagagagcatacctttgttaaaggatgggtttttgtcctataattccagatggaaaatgccatttgaggaaagcggatcaaattcaaatctctattattcgtttgaagttgcaggtgttcacattatcatgcttgggtcctatgcagattatgatgagtactctgaacaatatggatggctaaaggaagatctgtcaaaggtggatagggaaaggacaccttggttgattgtgttatttcatgtaccatggtataatagtaacacagctcatcaaggtgaaggggctgatatgatggcatctatggagccattgctttatgctgctagcgccgatttagttcttgccggtcatgtgcatgcttatgaacgctcaaaacgtgtatacaataaaagacttgatccttgtggttcagtccatataaccatcggtgatggaggaaacaaagaaggtttagctcctaagtatataaatccacagccaatatggtcagaattccgtgaagccagttttggtcatggtgagctacagattgtaaactctacgcatgctttctggagttggcacaggaatgatgatgatgagccagtaaaatccgatgatatctggataacatctttgaccagctcaggatgtgttgatcagaagagaaatgaactcaggaataaacttatgacaccttaa

SEQ ID NO: 7840 - DNA, 651 bp, Glycine max
  Peptide Sequence Number=SeqID_124618
atggcagatgttgttgttgatgcaatgatagctgaggcagtaagatatgaacgacctatgtcttggtttttccttgcccacgttacgattccgaatctttcaaccgtcatcttctactacgaaaccgaggttttaaagctagaagcatctttccttgggacttcacgggttgttggttggttgggacttatgctgggcaccttcatttataatcgtcacctaaagtatatgaccctacgaaaaatcctcatgtgtgcccatattggtttggccttcttgaatcttctgcagattgctgtagtgtcaaggaaaaatattgcctttggcatctcagacaagattatggtcctttttggttcggctcttgctgatggaatcaatcaattcaagtttatgcctttcctgatcttatctggacaactttgtcctccaggaattgaagggactttatttgcacttttcatgtcaataaacaacttgggatccacagtggggtcttttgtgggtgctggcttggcttctatattgaacattgattcaggatcatttgacaatcttctcttgggcatcattgttcatgccttgtgcaatttcatcccaattgcttttctgtttctgataccaaaggaagctacaggttcttcaacatag

SEQ ID NO: 7841 - DNA, 366 bp, Glycine max
  Peptide Sequence Number=SeqID_124619
atggccacagaaggatctgtgatctctttgatttgcatcaagagcaagtaccttatgaagtggcctggtctttggcaaaaggagattgtcagggaaaagaaggcacacattgaaaaggaaggagattgcactgacacccttattattctacaacacccttctgtttatacattaggtacagctagtatggaggagaacctccagtttgacaagaaaaaatgctcggtgctatcgcatgctattaacattattagcaagagatgtcatagtggcatggttgcaacaataaggtgctatgaatcaggaccacataggaattggctgtactacaattgcaaggaaatggttagcaaattccttggatga

SEQ ID NO: 7842 - DNA, 430 bp, Glycine max
  Peptide Sequence Number=SeqID_124620
tgatgttgatgcaccttctggttttcttcttaaacgtttgaaaactgtttcttctggaaattctgctcaagatggtacgatagctaatgaaagtattgatgcttatgttccaacatgtaagaatttgtccaacccaagttcttcagcctctactgcagaatatgaaaatgttaaaaggatatcaccactgacaaaactgcttgcaaaagatacggttgaaccattgatggggcgtttggaggaagattttgaagatgcgaatgggagcaaagaatcaaggctttctagtgagagggtaagcctatctggtactcaaggagaaagctatacctttgtatctggaataaatgtaatggatcttgagcagagaatcaacagacttgagacagtgattaaaaaattgaagatagcaaagtttggtcactgttaa

SEQ ID NO: 7843 - DNA, 198 bp, Glycine max
  Peptide Sequence Number=SeqID_124621
atggataaagttgacaaatttgaggccgacattgaactcaaagtgaatatacattcagaaagtagtgaagccaacaaagcacaaaaatttgtggaaaaacagtatgctacttctgttcggtttgtaaagagtgctgttcgattagcattcaaagtccttagcctctcgggattgggtgtcactgcacagggtacgtag

SEQ ID NO: 7844 - DNA, 591 bp, Glycine max
  Peptide Sequence Number=SeqID_124622
atgagcacctttgaatcatcaacaacaagatcctttgtttctgtagaatcaacaacaccaattgaaggaacggaagctgacaatgtgaatagggactcattgttccgagggtgtgtattggaagggagatgggacttcattcttacggcatataaaaacgatagtcactatcacaaaattaaaataaacgaaagcagaggcacagcactacacgtggcagtgaatgatggcaaagtggaacttgttaacactctcgttggtgcaatcttaaaccatgaagggatggatgtgctgagggatgatagtgcattgaaaacaaccaatgagagaggggacactcctttgcaccttgcagcatcaagagggttcaatgctatgtgcaagtgcatcataggggagtctgaggaaaggaaggatttgattagggttaggaacaataagggtgaaacacctctcttccgggctgtgctcacatgccatacaaagacctttgtgtacttccatcatgtttccaaagatattccacttaggaactatgatggggataccatccttcaccatgccatttggagagaattcttgggtaagtaa

SEQ ID NO: 7845 - DNA, 567 bp, Glycine max
  Peptide Sequence Number=SeqID_124623
atggatgaatcattgttgagcattatggaggtaagggaagatttaatggtttcacctattggagacagtgaaccagctttgagaagtgcctattttctgaaacccattgcaaaatcccttgatggaccagtttctaaggttctttcatcttctatgactatgtcactgccacccgtgtttgaaccaaaggactggcctttggtgatccatttcgactggcggcgccacacaaagaagaaatgggttgaatgggtggatgcccttcaactcaggtataaatcagtgtggaagaaagttggcatctttgaagccataatgagcatcaagtgttccatagcgaaagatcagaacttgtgttttgggatcgctgagaagtggtgtgctgagacaaataccttattgtttccatggggcgaggcaaccatcacattggaggatgtgatggtgttggggggttaccctgttgttggtgatcctgtcttcgccccacttcaaagccatgaaatgagagaggcggagaagaaattgattcttgcaagagaacaacacttcaaagccatgaaatga

SEQ ID NO: 7846 - DNA, 610 bp, Glycine max
  Peptide Sequence Number=SeqID_124624
atggatgcttttgtcaatagtgggagtgaagttgagcatgaagcattccttgcaacttggttgtcaatgattggtttttcttccaaaggtttggtgagtacgttggttttccctatagctgttcatcttgctagagggaatcccattgctttgggaccagcagttttggccagcatatataaggatttgactttgttgaagaactcaatagtcggtatgacaaaacaactagtacttggtgataaattggaattggaggttactcttcagtcacctttttacttggtccaaatttgggtttgggagaggttcaagaatttgcaaccacagcccaggttgatcaaccatgaagatcctatgatgtttaggtggcacaaggttaaggccttgaaaattgacaatgtgagattggcactagagtcggctatggagcatttttgttggcgcccttatgttcaatatgccgatttggataaagaacctacgggactactagtatcttttgctacatgcttgagagtttctctgcttgttggtattcagtctactataaagaagtacctgccacatagagttgctatgcaatttggaatggatcaagatgttccaa

SEQ ID NO: 7847 - DNA, 1611 bp, Glycine max
  Peptide Sequence Number=SeqID_124625
atgattctcaatcagtcatccatcaccattgcacctcaaacattatcaccaccttcaacccccaattcacaacccctaacaaccaccacctccaaccctcaaatcagattcaaaaaacaaattatggatttgaacaacaacaacatttgtaaccgtcgcgaaagggatgctgcccgccacaaggttcacggcggaggaggcgacaagcctttgttgaacacaacggaagaagttgcagaggagccatgttggacatgcgggttgcaggtgctgtgctggttgaaatcaaagctggggactcccttagaatcctccattggaactctccctcttactccatcatcatcgtatgtagcgacatctttaaagaatttttacacgtgtcagaatctagttggctacttgtccaacacacccatgagacatatagtggtgggtggtgcagctagctcagggcaacaagaaaacaatagagtggaatccgcagcaaaaaatgaggaaaaggagacatttgtggcagtggcaaaagccggcatagttgaacttgtgaatgagcttcacaacaaagtaccaagtaccttccatgacactaactctcctgagaaggaaaacttactgattgtggcaatgaagaacatcaaatacaaaataggagaacaccatgttgacaaaaaggagactgcatttttggcagcggctaaatacggcattgtggagattgtatttgcacttcaatccaaaataccaagtgccgtgcatgaaaccaactccaacaatgaaaacgtgttgcttgtggctgtgaagaatagacaaaccaaagttgttgaggtgttaaggaaacatatggataaggaactctttgatagcttgattttagaagtggataacagggagaacactgtgttgcacttggcagctggaactggaactacaagcaacagtgaaaggacctggcagattgctggtgctgccatgcaaatgatgtgggatatcaagtggtatcagtacattagagccctagtgccggagcacttcgttttcagaaccaacaaagacgataaaaccgcaggcgaaatcttcaaacaaaaacacaaagacctggtgaaagaaagctccgagtggctaaaggaaacctccaactcctgctccgtcgtcgccgccctaatcgcgggcgtctccttcgccacatcgagctccgtccccggtggcaccgagaagggcaagcccgaacttgaaggccagccagccttcgacgtcttcgccatcgcatcgctcatcggcctctgcttctccgtcaccgccctcatcatgttccttgccattctcacttcgcgaaaacaggccccagacttccgcaagagcttgcccttgaagcttctctttggcttaagctctctcttcgtgtccattggctcaatgcttgtttcgttttgcgctgcgcatttctttgtgctcaaggacaagtacaagaacattttgttccccgtttatattgctacttgtttgcctgtgaccttctatgcggtggtgcagtttccgttgtatgctgatcttcttaaagccattttcaagaaggtgccacaacccagtattaccagcagccaattttag

SEQ ID NO: 7848 - DNA, 555 bp, Glycine max
  Peptide Sequence Number=SeqID_124626
atggagatgaaaggctccgcatgcgggacgccgggatgcattttgagggagatgctaccacacgcgcgttatgcaaagtggtggaagaaaacagtaccgagtcatcaggattttgcaaagaacatagtgcaaagtggtggaagtccaaagtcccctcattctgcacctcatgtatcaaaagcaaacacaaatggaaatgatgctgattttccacctggttttcttcccaaacctgttagcactgtgtattttggaaaatctggtaaggatcactcaaatgctaggaaaggtaatagtgatgctgatgcaccttctggttttcttaaaagtttgaaaaccgctacttctggaaattcttatcaagatggtttgaaagataaggaaaaaattgataccaatggcgatgttccaacaatatgtaagaatttatccaaccaaagttcttcagcctctactgcagtttatgaaaatattaaaaggaaatcaccgctgacaaaactggtctcaaaagatacagttgaaccattgatgggggtttggaggaagattttgtag

SEQ ID NO: 7849 - DNA, 318 bp, Glycine max
  Peptide Sequence Number=SeqID_124627
atgtacaaggcaaagttgcaagagctgtgccaccagagaaagtggggtttgcctaggtactctgccatgaaagatggtccagatcacatgccaagctttaaggcttctgtttatgttaatcgtgtcaccttcacttctggtgccttcaggtcccttaaagaagctaaaaaccatgctgccatgcttgctttcttcagcttctcttctggctcttcaacacaaacatctgaacatgatataaacgagcaaattggagaagtgaaacctcgggatgttccaattccagcacaatcttcagtcattatagatggtgaataa

SEQ ID NO: 7850 - DNA, 717 bp, Glycine max
  Peptide Sequence Number=SeqID_124628
atggatcgttattgcaaaaaccagcctcagaacaatgctcaaaagaacaatcttgatccacctgtatttacatgcaaaactgaggacctgcctccaactaatgagcaatctgttgagagccctgactttttcaacactataaaagaggtagatcaagctgctgcaaaacttgatttaatgtcattgtcacctgacaactttgagaaggcaagtatccttggtgactctggttcattcaagacttcactgctgagactatctgagagacaagactttcacaaaccaacatataaaactatgcaggctggttctcctcatatgccaactttcttctctaccgtggaagtagagggcgtggaatttcacggaaagggaggtagatccaagaaacaggcagaagaggatgctgcaaagattgcttacattgcattaaaagagtgtggacttaatatgtatgctgctttttctccctctcaaatagaaaataaagcagtgcaatcaattcataacttagatgaacttttggacctagacttgaatgagatattacttgctaatgtcaaagttagaaatgaggtgcacaatccatctttcctacagtcacctgaggaagacatgataaacaacaggaattcatcatcttgcgaaccagtaatcagttcttcaccaaaatcatctccactttcacatattgatgtttcttgtctgtcaatttga

SEQ ID NO: 7851 - DNA, 357 bp, Glycine max
  Peptide Sequence Number=SeqID_124629
atgcaatgtgtacggttactcgattactcaacaacttacattctaacagtgtgcaacgaatcggtacatttttttgtgtacaatggcggtaatgaagttagaaacttacctcaaatagattcagttcatgcatctataacaaaaggaaaactcaaccaacacttcgaagataatgaaactgttgctaaagtttacagaaacgcagacaatgacactgacactacagtttacaaaaatttagaaaatgaaactgaaattacagttcaacgaattacaaaagcacaaggtagtatgggcaaaaatgcaagacagacgcaagaaccaatgtcagaaaggaggagaatgtaccaacactaa

SEQ ID NO: 7852 - DNA, 279 bp, Glycine max
  misc_feature (21)..(21): n is a, c, g, or t
  Peptide Sequence Number=SeqID_124630
atgggtagtgggagatcgagncgacggttacacagtgaacgctcaaggaagtatttacgaagtacaaggctaagacaagaaaaagggcttcgaaccattgggcgattcgagttggcgtatggtcgagtcgaagtcaaggcagcaagatttctggacttagcacaatttctgacaaaacttcacaaaatcagttcgacttcgagcaatgaggataaccgttctaaggagcagttatgtgcatgtaaggtgtacgtagcaggacacttggcattaggatag

SEQ ID NO: 7853 - DNA, 411 bp, Glycine max
  Peptide Sequence Number=SeqID_124631
cagtggctgacgatggccttcagaggcgcgctgctggcggcgatgctgatgacggtgattggcgcgatgggcggcgggcgcgtcaatccggtgcgtctgacgctggcaggcgtggcgctggcggcggtactggagggtttaacctccggcctgtcgctgctcaatccggacatttacgatcacctgcgcttctggcaaagcggctcgctggatatccgcgatttcagcgtgttgcgcaccctgagcccggcggtgctggccggtgcggcgctggcgctggggctggcgcaatcgctgaacagcctgagcatgggcggcgatatggcggcggcgctgggcacgcgcgtgttgcgcactcaactgctgggcctgctggcgattgccttactgagcggcgcggcgaccgccgcc

SEQ ID NO: 7854 - DNA, 231 bp, Glycine max
  Peptide Sequence Number=SeqID_124632
atgtcgtcgtggcatagggattgtgcccgcaagacacctagtggacccgaagaaggccaacagggtcttggagttgccagctctgattacgggcctccgtcagttctacggagtgcccgtcgccccaacaaggtcgttaggccccgcattaaccgggctttcatcaagaagtactgcgcccccagacgggcgcagggcgaagcaccacagcagcattgggatggccggtag

SEQ ID NO: 7855 - DNA, 1495 bp, Glycine max
  Peptide Sequence Number=SeqID_124633
atggtggactggccacttcctcacatcgcttccgagttatgtggtttcttgggcctcactggcttttatcggcatttcatttgccagtacgccgccattaccaggcctttaactaccttactgtgcaaagatcaattttattggtcagatgaagctacccactcattccttcaccttaaggaagcgatgatacaggctccggtgttggtcctgccggacttctcattgcccttcgtccttgaaacagatgcctctgctacggctatgggcgccattctccaacagcgctcacacccaatcgctttttatagtaaggtgttctgcccacgcctccaacatgcatccacatacattcgcgagcttcatgccattacctcggcagttcggaaatggcgccactaccttctcgggtaccctttcatcatcatcacggaccacaagagcctcaaagacctcatgtctcaggtcttacaaacaccagaacagcaacattacctatccaagcttctcagatttgattattctatccaataccggcctggttcgaagaatgtggccgcagatgctttgtcctgggtccccgtctcgggcaccacacacttctccttatcaatggtgaattttgaaatccttgagcaattgcgtctctccctccaagacaaccatgattttcaggagctgtcaagtcgtattacagttgatcccgatggccatgctgatttcgctgtttgccgtggcttaatcttccataaacagaaaatttggcttcctccagcacatcctttcatccctctactattggaagaattccattctacacccgtgaaatacgagaccactaaactagctggactcctccatccccttcctattccctccaccatctgggaagatttgtccatggatttcatcaccggacttccgccgtcccaaggattctcggttattctcgttgttgttgatcgttttaccaagggggctcactttggcgctttgccttcatcttacagtgcccataaagttgcttcgttgttcattgatatcgtgtgtaaactacacgagtttccaaggagtatcgtgactgatcgtgatcaatggtcctataacacctctgttcattccgccactggtgtatctccctttgaggccacttttggtaaaccgccaccctcacttcccagttacttagcagcttcacagactcagctccatgcagtgctccaatgtcgtcttgctaaagctcaggctgccatgaagaaacaagcagattctcatcgcagggacgtccagttcaatgtcagagattgggtttttgtgcgcctgcgtccatatcggcaaacatctcttcagcctcactacaccaaactcttcaagcacttctatggtccattttgcattcaggaacatatcggcctcgctccagaagatacttcttgggaggattggagttctatttgcaccacctacaaccttggggacaaggttgttcctccag

SEQ ID NO: 7856 - DNA, 259 bp, Glycine max
  Peptide Sequence Number=SeqID_124634
caagtatttgggtgcttttcaattggtatcagaattggttgacggtgttttggaaatggctacttacaacaaagttcacttaaaagttgttggtgcagcggtaaagttgtgccttggtgacttgttggtcatgggttcgaatccggaaacagcctctttgcatatgcaagggaacacggccgggattcctgaagttttaacgaggttggatgcagcaccgtctatcttgggagattcaagtccagagtatgagagctag

SEQ ID NO: 7857 - DNA, 1011 bp, Glycine max
  Peptide Sequence Number=SeqID_124635
atgcaacagaaagtggtgttgagcgagagcttcgagaactgcctacaaatgttcaagatgtgtctccaaggtggggctatagacgagaatattgtcgaagaaggctgcaacaaaccgacggatgaacgacttaaacaactgattcatggttgcttgaattgttgtcggtgcgttggaaagactgaagggaatcactttgtattcgtaatgtccctggtgagtgcagaatgcggtcttatggatgtcggtggatgccatggggatttgatggaagccttgacgaagttcgtcaatggttggcattggaaaacgatccttgatggtgatcgcgttcaatgccctgtaatcaacacaacacctccagctaccatccttcttcttgaccatcaacactggggaagaaaaggggttgtgacttacttggatcaacccggtttgaagcatattggatatttggcgttcgagctccgctttctggttgtgtgggtatcggctgtggtggtggaagggtggatggttcctggaagagatgggcatatcggtggaggatgggtaatatggcaggagccggcggagttggtggacagaggccggagcagggaggaggggaacatctgccgtgagctggactggggcgcccaaccaggtgaaggacatcgtccgagagaccttctggcatacgagtgtgccgccatcacctaccatgacacggaggggggcgatgtcggtggagggcagcgagaggaaatgggccaaccgagcttgtacgaaattatgggtgctaccatcatctaccaagatcgcatgccggaaagggcgttaagactcaactgtggtgtgttcggtagtgagaccaagggttcgtcgccatctgagggaggtggcgaggtttgcagcgatgaccgacaacccatttttcgtcacactgataacagaggctgcggtctctgtgagaggctaactcttcaggtgagaagtaccgcacaaagagtttggtcagaggtggggtag

SEQ ID NO: 7858 - DNA, 186 bp, Glycine max
  Peptide Sequence Number=SeqID_124636
atgaaagaagagtatgttgaaggggttttcgtgacaccaacaattattgaagagagagtaccagaacagcttaaaggggcacttgggcaggcagctaatgctttacaacaacttcctgcccctatacgcgatcctgttgctagtgggctgaaagttcctctaaatgttcactgttacattatctaa

SEQ ID NO: 7859 - DNA, 486 bp, Glycine max
  Peptide Sequence Number=SeqID_124637
atggagaataatgaagcagtgcaagaatatgtggttttaaattataatgctggtggttattgtaatttggaaggtgatgcaagtgatggaagtgatgatgatgcaagtgatgaaggtgaagtgtttaacattgatggatttcttgatatagcaaagtttgatatgaacaatataagaagtggtgatgtgggaaggtatcaatttgctgatctggaattgacttatagatacttcatctatgattcaccatttggaaaggcatatttcagggcccctggctcgcctaggctagcctctggctcacttgggctgccaaatagcttagtggctgaggaagaggttggaccttcagtgttaagagaaattggagagaaatcaaagagaagaagaagaaagaagagaaaaatgaggccgaggctttaccgaattgcaaccgtaaccgacttctacattgttcttcgttcggtgttcttcgtttgtcatcca

SEQ ID NO: 7860 - DNA, 324 bp, Glycine max
  Peptide Sequence Number=SeqID_124638
atggttggtcttttacgccgcttcaagacaggatggggtttcgaggccttggtctctgggaagactactgaatggcaaaagattgatgtgaatgaaaggataactggtcttgagcggctcaatccaacacctcgccccacaacgtcacccttcttggaggggcgatggaactttgagtggtttggttctggaagtccaggcttgtttgctgctagaatctttccttcaactttggctaatttgtcaaaaatggattttgttattaaggatggaaatgcgaagattactgcgaacatgagattattaaactcggtatacctctga

SEQ ID NO: 7861 - DNA, 435 bp, Glycine max
  Peptide Sequence Number=SeqID_124639
atgagcctcgcttttgtcggctgccccacaatctctgtcatactgaccttggagtcgtgcgacaagcagaaataccctagcggttatccgtataaactttttgctatctgtaagactcaaagcatgatagcacgcagagacttacgtcgtcttctgcgccttttgtcatccagaggcggcgagcccgatgacacgcgggaaccttttggtcccgcactttcttttgctatctataagactcaaagcatgatagcacgcagagacttacgccatcttctgcgccttttgtcatccagaggcggtgggcccgatgacatgcgggaaccatttggtcccacaccttttgctatctataagactcaaagcatgatagcacgtagagacttacgtcgtcttctgcgccttcttgtcatccagaggcggcgggcccgatga

SEQ ID NO: 7862 - DNA, 252 bp, Glycine max
  Peptide Sequence Number=SeqID_124640
atggatattgccaccacaggggttcagcatgtgaccaagaaaagttccgatgaacttctgaggaagtttgctgaagtgggtgattctaacaatgccccaaagaagaagaaaacaaagaggacggcggaagacggtagcggcactgccgtggtggaacggcggtcgcttcttctgagggctcacctcagggcaagggatctcactcatttcagaaccaagtctctattgggaacaattgagaaggatgcatga

SEQ ID NO: 7863 - DNA, 514 bp, Glycine max
  Peptide Sequence Number=SeqID_124641
tcctctgatggcgaggacgtgtagtcctctaaaggtgagggcgtgtggtcctctaaaggtgagggcgtgtagccctacgaaggcgagggcgagtagccctctcaaggcgaggacgtgtagtcctctggaggtgagggcgtgcagccctatgatggtgaggacgtgtagtcctctcaaggcgaggacgtgtagtcctctcaacggtgaggggcgtgcagccctctgttggcgaggacgtgtagtcctcccaaggcgaggacgtgtagtcctcacaacggtgagggtaactagtacccaaggacgtagtcctctcaaggcgaggacgtttagtcctctcaaggtgagggcgtgtagccctacgttggcgagggcgtgtagccctctgaaggtgaggacatgcagtcctctgaaagtgaggacacgcagtcctctgaaagtgaggacacacagtcctcttaaggtgagggcgtgcagccctctgttggcgaggacgtgtagtcctctgaagaccagg

SEQ ID NO: 7864 - DNA, 222 bp, Glycine max
  Peptide Sequence Number=SeqID_124642
atgcacgggaaaaaggagcaagaagagtacataaggaaagggccatcggaagcagaagaagatgaggtgcatgaaccacgtgaagaagtatgttcacagagattggagctccattcgatccaaaggtcttcttcaaagagcaagtcgtgtcatcttcgttgcgtcaataagcttcgaccaaatctcaagaattgcaatattgaggaggttgcttcacattaa

SEQ ID NO: 7865 - DNA, 207 bp, Glycine max
  Peptide Sequence Number=SeqID_124643
atgaaggatttcttgaagaaaagctggtacattgataacggatgctctatacacatgacgggagatgcatcaaaatttactcatatatctcgtaagaaaagtggatacgtgacttatggagacaacaacaaagatttagtaatcgggttaccaaaactcaaatttgaaaaagatagattatgtgatgcatgtcaaaaaggaaaataa

SEQ ID NO: 7866 - DNA, 369 bp, Glycine max
  Peptide Sequence Number=SeqID_124644
atgccttttctaacccaagaaagagttgttcctagtacccaatatcatcacccctcccaagttaaggtgtcggactttgacaagtacaaggggactacttgccccaagaaccatctaaagatgtattgtcggaagatgggggcatacacaaaagatgaggaactgctgatacatttcttccaaaaaagtcttactggggtagctgttacctggtacactaacttggaaccttcccgagtccattcttggaaggacctaatggttgccttcgttaggcagtatcaatacaattctgatatggctacggataggattcaactacaaaacatgtgcaaaaaggggcacagatctttcaaggaatacacctaa

SEQ ID NO: 7867 - DNA, 135 bp, Glycine max
  Peptide Sequence Number=SeqID_124645
atgtctcgtgtgtatgttggtaacttggattcaggagtcaccgagagagatctcgaagacgaatttcgtgttttcggagttattcggagatactatgtgcctggatcattagtgaaagtgcaaattcatttttag

SEQ ID NO: 7868 - DNA, 480 bp, Glycine max
  Peptide Sequence Number=SeqID_124646
atggagttggttaaaattttaacaattttcacatccattgatttgtcgtcgtccaaccattttgaaggacctataccagatgatttaatggatctcaaaattctccatatcttcaacttgtcaaacaatgatctgtctggtgaaatcccatcatcgataaataacttgaaacaattggagtccttagacctttcacagaactctttgagtgtgaacctaaagctaaaaagcttcgagaaatggaatgctcctgaggagaactgtagagaaggacggcgaggaagattgaagttcttttcggagaaagaaaaccaagaaacacaacaaccacaccccagagaagaaccctcactgtgtcgtcgtggtgttgccagggaaggacgcagggggccgtcaatttcttttgttgttgtggtgttgtcagagcataagcccgttgaggccgcgcgacacagagtggagaagaccatgaagtggtaa

SEQ ID NO: 7869 - DNA, 369 bp, Glycine max
  Peptide Sequence Number=SeqID_124647
atggctcaacctccacctcgtgagaggactcttagggagatggctgcacctgatttcacttatgaaagcttgtgcattcaatatcctggtgagggtgttccatatgttctcaagactggactaatacatttgctgcccaagtttcatggtcttgcaggagtggcaaaagattggctatactaccttgctcccaggtccattttcagctgggatgaccttaagagggtgttcttggagaaattattccctgcatctaggaccatcaccatcaaaaaagacatttcaggcatcatgaaacttagtggagagagtttgtatgagtactgggaaagattcaagaaattaagtgcaagctgtcctcaccactag

SEQ ID NO: 7870 - DNA, 135 bp, Glycine max
  Peptide Sequence Number=SeqID_124648
atggcgtgggaggcgcagaagctttcaaaattagaggccggcgagcagtggtgggatattgatttcagcaatgacatcatggagacaaccatcaatagagctgtcaaatgggtcacatatataaatggcccatag

SEQ ID NO: 7871 - DNA, 681 bp, Glycine max
  Peptide Sequence Number=SeqID_124649
atggggaagaaggcgaagaaagctatgaagaagaatttgaaaagggcttcctttaataagaatccatctgaggatgctgatttcttgcccttggaaggtggccctgctcgtaagctcgccggccagcagaagccgccgccgccgccggagaacaccgccacggttttgtacgtcggtcggatcccacatgggttctatgagaaggagatggaaggttattttgggcaatttggaaccattaagaggttgagaatcgcaagaaataaaaaggggaaagaatgcacttacaagtgcatttggaagaaatctggaaaatcaagacattttgggttcatagaatttgaatctcctgaggtagcaaaaattgtggctgatactatgcataattatctcctttttgaacaccttctccaagtttatgtgatacctccagagcatgttcatccaagaatatggagaggattcaattaccattacaagccattggattctgtccaaattgaacggaagcgtcatgacaaggatagaacattggaagagcacaagaagttggtggagaaggttctgaaacatgaccaaaaacgacgtaaaaggatagaggctgctgggattgattatgaatgccctgagattgtgggtaacatccaacctgctccaaagaaaataaagtttgaagactga

SEQ ID NO: 7872 - DNA, 273 bp, Glycine max
  Peptide Sequence Number=SeqID_124650
atgagccaagttcaagccttgtgcattcaactcaagccgaactcaagccttgagcattcaactcaagccgagctcaagcctagtaaagcttggcttagcttggctcatttccacccctactggcaggccaacacccttttaacagtgagtcgctacatctctatcgcaccagcatcctcacacattcacaccaccttcctcgacgcgattgagtccgcttgtgttgttgataatcttgttgatgattttgttgttgttgccattgtcaattaa

SEQ ID NO: 7873 - DNA, 237 bp, Glycine max
  Peptide Sequence Number=SeqID_124651
atgtcagctgaatcgcaaagaggtcaggctacagtaccctatgaagagatttccactttttgtagagtagggttaccgcgctctctatctagaatcggccatgttagaagtcttaaggaggtggacgcaggattggcttcggtctgtccacaggtactggagtacagcaatggatccctgggtaaccatccaccaactattggatgcccccgtggtgatccgagactaccagattaa

SEQ ID NO: 7874 - DNA, 321 bp, Glycine max
  Peptide Sequence Number=SeqID_124652
atggtttggaatgaaaatgatgatatgactggccgattgcttgctgctactgttgttgcatcgtttggatatcggaaggatatggatggtcagtgggcgaggaaacaagaccttccacctactgctcctaatgaacgtacgctcttaccaccaccacaaagggatccctccttttcattgctgcatgatgttctaagtgaacttcaggatcttcgagcctttgtaggtgatcattttgatgctatggattcacgtatcatgcgtcttgagaatgatatgaacttcatcggtcgatgctttgatcctccggttgatccatag

SEQ ID NO: 7875 - DNA, 348 bp, Glycine max
  Peptide Sequence Number=SeqID_124653
atggcaaaagatcatttaaccttaacaaagggttcatcatatagaggaatgttaaaatgttggagaaaaagagtgacaagttggggatatagaagagcaaaattctgcaagttgcaaatctacaagtcttttccaggatgtcaagacatctcatgtgacatcagctttctgctccccctgtctccatgctcctactgctgtgaagcagttcactgcggcattctgcaagttgcaagtcgtttccaggatgtcaagacatctcacgtgatatcagctttctgctccccctgtctccatgctcctactgctgtgaagcagttcactgcggcatcttctatcagctactag

SEQ ID NO: 7876 - DNA, 331 bp, Glycine max
  Peptide Sequence Number=SeqID_124654
atggctccgaaaaagcttcccgcgaagaggtctaggagagatgccgcagctgaagggaccagtgccgcccccgagtttgatagccaccatttccggagcgccgagcaccatcaacgcttcgaggccatcaaaggatggtcgttccacagagagaggcgcgtccagctcagggaggatgagtacacatattttcaggaggagatagctcgccgacattggacgtcgctggtgactcccatggctaagtttgaccctgaggtagtcctggagttttatgctaatgcttggcccacaaaggagggagtgcgagacatgcgttcatgggtgaggg

SEQ ID NO: 7877 - DNA, 426 bp, Glycine max
  Peptide Sequence Number=SeqID_124655
ggagattggaagtcaatttggccttaaacaacccccaaaggttaaacgttttctttggaggataagcaaaggtgtgttgcctatgaggttgaaacttcagcaaaaaggaatcatgtgccctagtgtttgccaacagtgtaaggcagtactaaaaatagctggcacattgtcatggattctactaaagctagacaatgatgggagttcgtgggtttacacttgtggggtgcgaaataggttaatatgggaatcaattgaagtggagggagctcaggaccgacgtgagaaactccatagtgagacacattggaagaagcctaggaataggtttgtgaagtgtaacatggatgtgaccttttgcaaagggaagaagagtatggggatcaacatttatgtcagggatgcaaatggtgcatttgatgccaa

SEQ ID NO: 7878 - DNA, 546 bp, Glycine max
  Peptide Sequence Number=SeqID_124656
atgagttgggttttgaaagttccgctccgattaaagggttccactctatgcggttgtccggtggaaagcggtggcaactcgtggaggaagagaaggttgccactaagcaagacatttgtgctaagcacaatttctcctcatgttggaattgcacttagcaagctggtgtcgctaagagaattatttcctatggatggaattaagcttagcgagctagtgtcgccaagcgagccattcaacaaatctccaaggaggtggtcattgtatgatgctaaaggaaatagacatagagtgagtgtaaacctgattggagaacaaccttttatgacacaagattggtttgaactaaggatattttataatctcacttgggaccaatctatcatgtttcgttatgtcattcattcaaggtttcatattactatttatagagacccattgtgtgctgtacgaagaccaactcatgcggcagaaagattccagtgtgcttcattctttgcaagtataaacaagtttttcatggctgaagtaatggtagtcaattag

SEQ ID NO: 7879 - DNA, 252 bp, Glycine max
  Peptide Sequence Number=SeqID_124657
atggatgaacattggccacaagttatggtattcgcccagtgcaatgaaaaggggctaagaagagggaaattgtgcattgccggggtagagggcaagttgttgttttccaaaggagaatggaaagtcacacttgtacacatgtggcatgtgaagtggcccttttttcttaatccactccctaactcatacagttgcattaaaggtttgtggttgctacctaggaggcagggaccatttgataccccaaaataa

SEQ ID NO: 7880 - DNA, 1419 bp, Glycine max
  Peptide Sequence Number=SeqID_124658
atgttttcgtggctggcaaggatagtgtcggcgtgcttgagaccggtgcggcgatatgcgcgtatgagcaaggatggtgatgtcgatgacgtgtccaccatcggcgacgcgcttgtgtgggggaaggacctcgaaaaacactcgtgcggcgaattctcctacgcggtggttcaggccaacgaggtcatcgaggatcacagccaggtcgagaccggctccgatgccgtcttcgtcggcgtctacgacggacacggcggcgccgaagcctcgcgcttcatcaacgatcatctcttccttaatctcatcaaaatacaaggtttttttttaacaataataataccaatattgtgggtaccattgagggcgagccctggtgcagcggtaaagttgtgccttgtgacttgttggtcatgggttcgaatccggaaacagcctctttgcatatgcaagggtaaggctgcgtacaacatccctcccccataccttcgcatagcgaagagcctctgggcaatgggttttacatgcttttgcggctacggaaactgtggaaaattcaatttgctttcaggggttgctcaagaaaatggttctatgtctgaagatattatcagaagtgctgtttctgctactgaggacgggtttctgactcttgttcgaaggagttatggaataaagccattgatagcagcaatgggttcctgttgtctggttggtgttgtctggaaagggacgctatatattgcgaatcttggagactctcgcgctgtaattggttctgtaggtagatctaacaagatcattgctgagcagttgaccaaagagcacaacgctagcaaagaggaggttagacgagaactcaggtctttgcatccagaagattcacaaattgtagttatgaagcaaggaacctggcgcattaaaggcatcatccaggtatccagatctataggagatgcatatttgaagcggccagagttctcatttgatccgtcattcccacggttccacctgcctgaacctatccgccgacctgtgctaaccgcagaaccttctatatgttcaagagtgttaaaacctaatgataagttcattatctttgcatctgatggactctgggaacacttgacaaaccaggaagctgctgagattgttcataacaatccacgaatcggtattgcaagaagacttcttaaagcagctttaaacgaggcagctaggaaaagggaaatgagatataaagaccttcagaagattggaaaggggattaggcgtttcttccatgatgatatcactgtggttgttgtcttcattgaccacgagttgcgcggcaagaatgttacagttcctgatttgtccatcaaagggtttattgacacagttggaccatcaaattttagaaatttgcggggattggaatga

SEQ ID NO: 7881 - DNA, 302 bp, Glycine max
  Peptide Sequence Number=SeqID_124659
atgaagtgtcttcgatttagtcaaattcgggcttgttgggtggcgattgagctaggtggtcttgatctgggtgttcctgatagtggcataaagtgtttgaaggctcgcaaacttgcagataaattaccacctcttgatcttagggcattggtttctatggtgcttagtgtgagatttagttttctgttagtttggtcactatgtttagattgtgtggagttacagggagttcttgcgttcgctaagcgcaacactcattggctaagtgcgaggaagaatttggaagaagaagagctgtacag

SEQ ID NO: 7882 - DNA, 109 bp, Glycine max
  Peptide Sequence Number=SeqID_124660
gtttaatcctagacgatcctaagtcagcccttgtgccatgtgggtccatatcatttggtaatcagagctctggttctaggatcaacacttcctttgctggaaatattgg

SEQ ID NO: 7883 - DNA, 1302 bp, Glycine max
  Peptide Sequence Number=SeqID_124661
atgctaggagctcaaggaggtcccatgccaccacagtcgtctttcccttcactcgtctcaccacgcactcagttcaacaatatgaacattctgggaaatatgtccaatgtgacttccatactgaatcagtctttcccaaatggagttccgaatcccgggctctctggtccaggaagcagccagcgtggagcaattgatactggagctgaaacagatccgctctccagtgttggaaatggaatgagcttcaataattcttcatccacatttgtacagtcaagtatagtgaatgctgcttcctctggtcaaggtcagggacaacaattttctaacccttccagtaaccagctgttgccagatcaacagcattcccaacagcttgaacctcaaaatttccaacacggtcagcagtcaatgcaacagttctctgcccctctgaatacacagcaaccgccgcagccacagccgcattttcaatcaattcggggagggataggtggtatgggaccagtaaagctagagcaggtaagcaacgatcaacttggacaacagcagcagcagcagttgcaatccttgaggaatcttgcttcagtgaagttggaaccacaacaaatgcagacgatgagaactctgggacctgttaaaatggagcctcagcattctgatcaaccattatttttgcagcagcagcaacaacagcaacagcaacagtttctccacatgtcaagtcaatcgtctcaggctgctgctgcccagatcaatcttttgcgccatcaccggcttttacagttacaacaacaacaccagcagcaacagctcttgaaggcaatgcctcaacaaaggtcccaactaccacaacaatttcaacagcagaatatgtctatgagatctcctgcgaagccagcatatgaaccagggatgtgtgctaggcggctgacacattacatgtatcagcaacaacatagacctgaagataataatattgagttctggagaaagtttgttgctgagtattttgctcctaatgccaagaagaaatggtgtgtttcaatgtatggaagtgggagacaaacaactggagttttccctcagtgtatcaggatttgggtgactattttcttaaatgttgccacgcctagtttatggtttatggatgtatggcactgtgaaatatgtaatcgcaagcctggccgtggatttgaagcaactgttgaggttcttccacggcttttcaagataaaatatgttcttgggaattttgtgctcggcgccatgaggaactcatacccaggagattgttga

SEQ ID NO: 7884 - DNA, 1230 bp, Glycine max
  Peptide Sequence Number=SeqID_124662
atggctgacctgttcttgaaaatagcattgagaattaagatgtcccacaaatgcccaggaatactccgtatagggcttgggcaatcctccttccttcagtttgttgcatcagcccgtcagttggttaaagccttagaagtgccattggttaatgatttaggatatacaaagagatatgtgcgctgcctacagatatcagaagtggtaaatagtatgaaagacttgatagattacagccgagaaactgggactggacctatggagagcttagcaaaattccctaggagaacaagtggttcagctggacctcgtggtcaagcacaacagcatgaagaacaattacagcagcagcaacaacaacaaatggtggcccataactcaaatggtgatcaaaactcagtacgagctgctgccatgcaaattgcttctagcaatggtatggttagtgtaaataactctgtcaacccagcatccacatcaacaaccacaagcactattgttggtcttcttcaccagaactctatgaattctagacaacaaaattcaatgaacaatgcaagcagtccatatggaggtagttctgttcagattccttccccaggttcctccagtacagtgccacaaggccagccaaactcgtccccttttcaatcaccaacaccgtcctcttctaacaaccccccacaaacatctcaccctgctttaacatctgccaatcacacaagtacgacaaactcaccagctaatatttccatgcaacaacagcagtcatctatttctggtgaacctgaccctagtgatgctcaaagctcagtccagaaaatcatacatgagatgatgatgtcctcccagattaatggcaatggtggaatggtcggtgttggatctcttggaaatgatgtgaagaatgtaagtggtattcttccagtgagtgccaatacagggctaaatggtggcaatggcttggtgggtaacggcccaatgaacagtaattcaggcgttggggttggtaattatggcacaatgggtcttggtcaatccgctatgcctaatggaatcagaactgctatggtaaataattcaatcatgaatggaaggggaggaatggcgtctcttgcccgggatcaagctatgaatcatcaacaagatctgtcaaaccaactacttagtgggctaggggcagttggtggttttaataatcttcaatttgattggaaaccttctccttga

SEQ ID NO: 7885 - DNA, 366 bp, Glycine max
  Peptide Sequence Number=SeqID_124663
atgacaaatcaagatctgagcaccgcaaatgcagcagagaaactcccaacagcaatgttgtcaagatcagcaagagacgctggagagaggtcgtggctgaaaaagaagagtttagagccacagatgtcatggtctggtctggtgagaacagaacgtaggaaacaaaagaaggcaaaacacagcaaatctcactcacaacaacacaggctacgggagaagatgcaggcgggggagaagaaagtcattgaagaggctccggcagagaagaagatcgcagttcttatgaaagaaccgttcttacacaaggagtccaactcattgaactccaatggtgcaaatctagaaagaaccaattcttatttgtaa

SEQ ID NO: 7886 - DNA, 996 bp, Glycine max
  Peptide Sequence Number=SeqID_124664
atggaggattcttcagctggtgaagacaccaagacttgccctcgtggccactggagacccgctgaggatgaaaagcttagacaacttgttgaacaatatggtgcccaaaactggaattcaatcgctgaaaagctccaaggaagatcagggaaaagttgcagattaaggtggttcaatcagctggacccgagaatcaacagaaggccattcacggaagaggaagaagagaggctactcgcggcacatcgcattcacgggaacaagtgggcactcatagcgaggcttttccccggtcgaaccgataatgctgtgaagaatcactggcacgttataatggcgagaaagcaaagggaacagtccaagttatgtgggaagagaagcttccaagacgtttacaacgattccaacaacacgttcctcgaaaaaagaacaacaccacaatctcatcatcaagacatgttgtttagtacgagatttgggttagagaatggaatattcttcgactttcgaagcctcgataaaaataaggatgatagtaataataataatcataggatagtgtcagatactccctctagtaattctctggcgtcttggaattttggttctgtgccaaccaccaccaccaaaggagcgagagacaatttcaataacacttcttgttcttctagtgtttatctctcggaatgttccagaagctcagatagatcttttctttacagaatttatccaaatcctgcattctctcttcccaactacaagagggttgttccaacaagtcctttaattagtactttccttggttcttctgatcatgatggaaggataaagaaggacttgatgagtttctgtgataataatacaaactcatcatccacattcaccaagttgaaggcatccacggagaaagatcaacaacaaacaaatgaagatgagaccaataatatcaagcccaaggaagttcctttcattgattttcttggtgtgggtgtctaa

SEQ ID NO: 7887 - DNA, 651 bp, Glycine max
  Peptide Sequence Number=SeqID_124665
gggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtgaatcaaaacgagcttttacccttttggttccacacgagatttctgttctcggtgagctcatcttaggacacctgcgttatcttttaacagatgtgcccgcccccagccaaacttcccacctgacaatgtcttccgcccggatcgaccggccgaagccgaccttgg

SEQ ID NO: 7888 - DNA, 159 bp, Glycine max
  Peptide Sequence Number=SeqID_124666
atggtgtcactggcaacaaaaggtcaacaaggaaacaatggttctagaatcttgatagagatggtggttgcacgagggtatgaaagatggtggcaatggtgttttggagatggtcatttttgtgtcggtaaaggtgggaccaagagatttttagggtaa

SEQ ID NO: 7889 - DNA, 249 bp, Glycine max
  Peptide Sequence Number=SeqID_124667
atgggaaaggtgcattgtggtcgcttcgatcgaggtgaaagtattacggatgtacgtcgacaagtggtggttgtagtggtggttggtgtggttgtgaacaaagtggtggagacaacctcaattgtggcaatggaagttgaggacggcggcggcatgacagaaaacatagagcaaaggaagaagaagaagcagggagctactgcagcgttgtacaaccacaaggtaggagggagggtttttaaaatttaa

SEQ ID NO: 7890 - DNA, 597 bp, Glycine max
  Peptide Sequence Number=SeqID_124668
atgggagatgttcaaaacgttaaattctgtcagtggtgtggtggtccaacgaagcatgaaattcctgaaggagaagaaaggttgagagctatttgtacaagttgtgggaagataacctatcagaatccaaaaatggtagtcggttgcctcattgaacatgataacaaggtcctcctttgcaagcggaagattgaaccatcttatggcctatggacacttcctgcgggttatttagaaattggagagtcggctatggaaggtgctatcagggaaacacgggaggaagccaatgctgacgtggaagtgatttctccctttgctcaattggatattcctttaattggccaaacttatataatcttcttagcaaggttgaagaaacctcacttttcacctggtccagaatcatcagaatgcctgcttttctcactcaatgaaatacctttcagttctctatctttttcatcaatggtggttactttaagtttgtatgttgaggatatgaaagcaggaggaaagcccaaattccattatggtaccattaacaaaagatgctgtcttcttcaggaactcctcatagcaagtttttggcattag

SEQ ID NO: 7891 - DNA, 570 bp, Glycine max
  Peptide Sequence Number=SeqID_124669
atgatgatgaggatggtccatctcccagtcaaggcccctcatggaaaccatgagttttgcaaagatgattttgacgttgaaaccgttttctggtctgtctttggtggcaatcgatcttactattggtcctttataaatgaggaaaatcctcagtggaggtcaggaggcttttctaatcatgagaaatcttggaattggagacgtcggagtgaaaatgaatataatggcacatcaaccgagccagagtcggattgttcacattcagatttaatttcagatagattagcccttggactgggtgcttctggccctctgaaacttgaagatgtgaaaaatgtgcaagttcttttgcaattcctcttcaatgtgattttaaactattttctgagttctttttcacttcctcttcaatgtgatattgtacaattttatgaaaccaggtatcggatatgtgccttaaagtggcatccagatcgccatcatggctcttttaaggttatagcagaggaaaagttgaagcattgcagtgctgcttatcgaccgttgtctgataagctggccttggattag

SEQ ID NO: 7892 - DNA, 273 bp, Glycine max
  Peptide Sequence Number=SeqID_124670
atggccatgagccatgggcatctgtatcaacgaaggataaagcacgcgttagacaagaaggtacgcccacgcaagttcaacaagggggaccatgtgctgaagaagatgtcccacgctgttaaggacaatcgaggcaagtggaccccgaattatgaaggacctttcgtggtgaaaagagctttttctgggggtgctctgatactcaccaacatggatggcgaggagctaccctcgcccgtaaactctgatgtcgttaagcgatactacgcttga

SEQ ID NO: 7893 - DNA, 114 bp, Glycine max
  Peptide Sequence Number=SeqID_124671
atggggacacagtttgttaaagatggatgcaactacgaggcacctcatgataactgccatgccaccttcgacattttaactgttcaattgtatgatgaggtggggtctaaataa

SEQ ID NO: 7894 - DNA, 489 bp, Glycine max
  Peptide Sequence Number=SeqID_124672
atgcgggataccttatggttacccgcacctttcatcaaccagggggcaaacgagcctgttgatgcgaggagattaacatcatcttatgcaccttttgtcgtcctgacccgtgaagtcagactaacatcgtcttctgcacctttattcatcctgaccatgaagtcaggtgacatgcggggtaacattatggttacccgcacctttcgtcaaccaggggaaaacgagcccgttgatgcgcgaagactaacatcgtcttctgcaccttttgtcgtcctgacccgtgaagtcaggggaaacgagcccgttgaggcgtggagaccaacatcgtcttcttcaccttttgtcgtcctgacccgtgaaactgacatcgtcttctgcaacttttgtcgtcctgacccgtcaagtcaggtgacatgcggggttacattatggttacccgcacctttcgtcaaccaggggaaaacgagcccgttgatgctcgaagactaa

SEQ ID NO: 7895 - DNA, 579 bp, Glycine max
  Peptide Sequence Number=SeqID_124673
atggagtccaagatggagtccgagatggacccgagatggacccgagatggagtccgagatggaccgagacggagtccgagatggacccgagatggagtccgagatgggccgagacggagtccgagatggaccaagacggagcccgagatggagtccgagatggagtccgaggtcgagaccgagaccgggaccgagaccgagaccaagaccgagaccgggaccgagaccgggaccgagaccgagaccgaggccaaggctgagacagagcccgagcccgagtccgagtccgagtccgagtccaagtccgagtccaagtccgagtccgagtccgagtccgagtccgagtccaagtccgagtccgagtttgagtctgagagggtgaaagcccaaagcgttcgtttcccagaccctggggggtttggtgagctccaaaagtatagtaagggggaggactgcagtggagccagtttggccaggaaaggccagtttggcccaggaaggccagacccagtgttgggtgatgaactgaccactgggaagtccaagactagagtgaatacggaccaacaagtggggtag

SEQ ID NO: 7896 - DNA, 598 bp, Glycine max
  Peptide Sequence Number=SeqID_124674
atggatccgccagtggactctacttgcctgcaagagtcatcagagctggtggaggctactatccatatcaacgccaagcaagctgaccacgctccacttgatgctgcccataccactgagtcaatcttgtccacgtatccaactgacggtgaccaggcgccattggacccgcatgaggccgccccagctgccgagctggtcgtatcctcatttccaacggactcaacgtgtgcccaattgtctgactacgtgccattggaacctccctacaccgcccttgctgcctgttcggtcatgtccactttgccaacggaggcaccagctgaaatggcgtgtgatcacacgccatcggaaccaccccatgccactgttgagccagttgtaccagagtctacagctgaaatggcatgtgcccacatgccatcggatgcgattgaccccacattgcagaggagagtatttccgcccttcatgtttcctcgaccaaaaccctctcaacgaccatcgggagcaccattcgctaatattgtagatgagtcacggcgaaggtactgtatcgtttttgatctgaacggtgtccttttctcctatgagcgtg

SEQ ID NO: 7897 - DNA, 342 bp, Glycine max
  Peptide Sequence Number=SeqID_124675
atgagtaaaagggataaaggattcagaagaagaataaggcgaggtgatgtttgggaaacgttacaggtctgtgtgtcggaggagaaaagctgctatccatcatcttcatttcccaaagggtgcaagtgcaactattacaaacttcagtcttcagactctgagcctgagtgctggaaaattccttacaattctggctctgctttgttccaaattccaaatccaaacaaaccccaaccccaccccagacacactctcgatctttctccacactctgatgaactgaagaacatcaatggcttcttcagcaggttaattatatcaaacagtgaaaaagcagtgtga

SEQ ID NO: 7898 - DNA, 258 bp, Glycine max
  Peptide Sequence Number=SeqID_124676
atgcgggttggactaattaagggagagaaatccataactgggagagaaacgcgagaaactggaatcagagaaacggcgcgcaaaccgaggcaggattttagcgtttcaaagccccacattttcagaagctctctctccctctccctcacgttgcttttcttcctccctcattcaccattgaagctccacacaaagcttcaacctttggccatcatttctgctccaaatcgtgaaaggagagcattttcgaggccgtga

SEQ ID NO: 7899 - DNA, 1528 bp, Glycine max
  Peptide Sequence Number=SeqID_124677
atgtcagcaacatctaaagaaggagagaacttaagcacaaacgacagggccaaccgacacccctcaactccttcatcgcacactaaaaaatgccctttgaatgccaattttgtgaagatggtggtagaagagctaagagtccaacgagggatagcccttccacttgtggccatgaacttggcttggttcgccaagttagccataacaacagcttttctcggccaccttggggagctgaacttagccggtggcgcactcgggttcagttttgctaatgtctccggcttcgctgtcttgaacggtctaagcggcgccatggaacccatttgtggacaagcacatggagccaagaacgtgaggctccttcacaagacccttctcatgacaaccctcttgttgcttttggtaacacttcccttatctttcttgtggcttaacgttgacaagattttgattctttttggccaacaacaagagatctcaatagtggccaaaacctatgtttcctatctcatacctgacttgtttatcaaggcactcctttgtcccttaaaagcctacctcagctctcagtgcatgactcttcccaccatgtttagttctgctgtggcactagcctttcacatacccgttaacatactactctccaaaaccatgggactccgaggagtttcaatcgcggtttgggtaaccgacctcattgttatggttatgcttgcaatttatgttgtggttcttgagagaagaaatgggagcatgttgtggaaggaaggagggtggtgggatcagaacatgatggattggagtaggctaatcaagcttagtggatcatgctgcctcaacacgtgccttgagtggtggtgttatgagattctacttttcctcactggccacttggcaaatgcaaaacaagcagtgggggttctggccatagtgttaaactttgactatttgctttatgcagtgatgctttctctagccactagtgtttccactcgtgtgtccaatgaacttggtgctaaccgtgctggtcaagcttataaatcagcacgtgtgtctttggcagtgagtgttatatcgggttgcattggaggttccatcatggtggctgctagaggggtttgggggaatttgtttagtcatcaaaaaggggttgtaaagggtgtggagaaggcaatgttgctgatggctctggtcgaagtgtttaattttcctgtgacggtttgtggaggcatagtacgaggaactggacgaccctggctaagcatgtatgctagtcttggtgggttctatttcctgacactaccattgggtgtggtttttgccttcaagcttcggtttggacttggtggactccttataggactcctgattggtattgctgcttgcttggttctgttgttaacatttattgtgagaataaattgggtggaagaagctaccaaggcacaaacgtttgtatgtaacgcacaggtacatgaacaagtttcaagaaatgaggtaaatgaacttactgaaaaccctgaag

SEQ ID NO: 7900 - DNA, 366 bp, Glycine max
  Peptide Sequence Number=SeqID_124678
atgtatgccaatattggtggattctatttcctggccttaccattgggtgcggtttttgccttcaagcttcggttaggacttgctggactcattataggattcttgattggtgttgttgcttccttgattttgttgttaacatttattgtgagaataaattgggtcgaagaggctatataccaaggcacaaacgttattatgtaccgcacagatgattctcttcccattttccttctttcttccttcacagtcagactaaccttatatttccctcccatgtacaatatgttgagtcccttttcaaactcactagtgtttgtaattgttgggaaataccaagttccacatcgctgtctaactccttag

SEQ ID NO: 7901 - DNA, 1476 bp, Glycine max
  Peptide Sequence Number=SeqID_124679
atgaaggaggaaagcatggtaaaagtaaaggaggaaattgattacaaaagtttatgtagaaggctagacagagaattggacaaactcactatggaatatgaaaggcagcagaaggtatttgaggatgatattgaaagattgaccacagaagcacaacattgcatattagaggcccaacagaattattcggattcgttggagaaggaaagattgaaataccagaaagactataaagaatcaattaagaggcttgaagagaaggcctttgttcctgctgaggaagtagtcattttgaaaaaaatacttcagagagagacccttttgagaaatgctgccgaaggggagataaatcatcttaaaaatcaaatggcagaactgaaaatgttggaggcatcaagagaatcagatatcttaaaacttcgtaagatgttggaagatgaggcacatcagaaagagaaattcaaaggagaaatagcaagattgcaaagtcaattgttgcaattaggttttgaagttggcaaaacaaagcaacaacagcaagcttcaggaaatggagagaaggcctcagttgccaagctctttgaacaaggcaggggattgcagaagattttgtcattgcttgaagcagaagctactgatgcacgaattaatgctgtgaaaatagtagcaaatttatcttctgaagccataacatctctcaaccctgatgttgcagaaacaaatcagaagaagattgtagaagcaggcggacttacgtccttgcttacactgcttaagaactcacaagatgaaaccacacagagagttgcagcaagcgccatagcaaatttggcaatgaatgaaacaaatcaagatctcattgtggctcagggaggcattaatatactgtcaatgacagcagccaatgccgaagatcctcagacccttcgaatggttgctggagcaattgctaatctttgtggcaatgattgggattctaactgcggctcagataatgcattcaatctcacgatcacactcatttttaaccttatgctgaaatataaactgcaaataaagctaaggggagaagatggtatcaaggcactgttgggaatggtcagatgcagacatcctgatgtacatattcagattgcccgcggaattgccaactttgcgaagtgcgaatcaaaagcatctacacaagggacacaggttggaaggtcattacttattgaggatggtgtgcttccatggatagtgcaaaacgcaaataatgaagtctcgttggttaggcgtcatattgagcttgcactgtgtcatttagcacaacatgaagcaaatgcaagagacatgattagtggaggtgcaatattagagttggttcgtatatcgagagattgttcacgagaagacataaggattcttgcacgtagaacactaatctccagccccgcattccaagctgaaattaagcgtttgaagatagattattga

SEQ ID NO: 7902 - DNA, 492 bp, Glycine max
  Peptide Sequence Number=SeqID_124680
atggaatctgaaacctcctttactaccatttttgtacccgtatttgatggactaaactatcaaatgtgggctgtcaaaatggaagcatatcttgatgctaatgatgtatgggaaacagtagaagaggactacgaagttcctcctttgccaaataatcccactgttgcccaaatgaaaagtcacaaagaaaggaggcttcgaaagtccaaagctaaatcaattttgttcacagctgtatctccaatcattttcaacagaataatgacgatgaaaacggcacacaaaatctggaattttttgaaggaagagtatgaaggcagtgagaaaatcaaaggaatgcaagctttgaatctgattcaagaacttgagatgcagagaatgaaagattcagagacaatcaaagattatgcagacaagcttctcggcattgcaaacaaaatacgtattcttggcactgaaattcctgactctcaaattgttcaaaaaatactt

SEQ ID NO: 7903 - DNA, 762 bp, Glycine max
  Peptide Sequence Number=SeqID_124681
ttccaaagcttaaaccaagccaccgaggacgagaacagcggcagcagcggcgcgcagaaaagggaacgcgaagaaaatagcaacaacaacgaaggtgcaggtgaggctgagataacaagaagacctcgaggaagaccagcagggtccaagaacaagcccaagccacctattatcatcacccgcgacagcgccaacgccatgagaacccacatgatggaggtggcagacggatgcgacatcgtggaaagcgtgtctgagtttgccaggaagcgccagagaggggtttgcatcatgagtggcactggaacggtcaacaatgtgaccctcaggcaaccggcttcgtccggttcggttgtgactcttcacggaaggttcgagatcttgtccctttcgggatcgttccttccaccacctgcgccgccggctgcatcaggtttaaccatttatttggccggtggccagggacaagtggtgggaggaagtgttgttggaacactggttgcttcaggacccgtggtgatcatggccgcttcgtttagcaacgctgcttatgagaggcttcctttggaggacgaggatccttcgctgcaaatgcaaggaggttctattgggtcacccggtgcaagtggtgttggtcagtcacagcttctaggaggggatgcaactgctccacttttccatggtttgcctcctaaccttctcaattctgttcaaatgccatctgagccattctgggcggcatctgctcgcccgcctttctga

SEQ ID NO: 7904 - DNA, 2874 bp, Glycine max
  Peptide Sequence Number=SeqID_124682
atgacttacgatcaagaattattcaaagatcttgatgcaacctacaacacaaatgtcagaattggaaacggagaaaaaatagcagtgaagggcaaaggaaccatcgtgatcgagggttgcacaggtctgaaattaattcctgatgttctatacgttcctgaaattaaccaaaacttgttgagtgtcggccaacttctagagaatggctataaagttctatttgaagataaaagttgcatgattaaagattcagataataaagaattattcagagttcaaatgaaaggcaaaagctttgccttgaatttgattgatgaagagcagcttgttgtgcacaaggttgaagacaacacgctggtttggcataaaaggatgggtcattttcatcatggcgctttgctctatttgaggaagaatgatcttgtacaagggctgcctgaattggaagacaaatcacccgtatgtgttgcttgtcaatatggaaaacaaacgaggttgtcttttccaaaaggcaaatcttggagagcaacaagcaagctacagttagtacatacggatgtcggaggacctcagaaaaccccatctctgaatggcagtaagtactatattgcttttattgatgatttttcaagaatgtgttggatttatttcatgaaaaacaaaactgaggttgccagcatattttacaagtttaaagcatgggttgaaaatcaaagtgaaagaaaaatgcagatattaagatctgataatggtacagaatatacttctgataagttcagcaagttttgtgaagatgcagggatagaacatcaattgaaaacaccgtataccccacagcaaaatggggttgtggagcgcaaaaatagaacgatcttggaaaaggaaagatgtttacttcatgacaaagatctttcaaaaaaattctgggcagaggctgcaagcacttctgtttttttgctgaacagattgccaacaaaagctctttcaaaatcgaccccatttgaagcttggtatggtttcaaaccaaaattgatgaacttgaaagtctttggttgcttgtgtttctcttatattccacaagttaagagagacaaacttgataaaaaggcggaagcgggaatctttgtaggctatagctcaacatcaaaagcctatagaatattcttgccacaaagtaataaagttattgttagcagagatgtgctattctttgaagaagaaaaatggagcaaggaaagtgagaagcttcaagttcaggaggagagcgaagaagatgtggatgaccagtcagttagaggaactagatctctctctgatatttatcaaagatgtaatgttgctgtaatggagcctgtagactacaatggagctgcaactgattcgaagtgggtaagtgcaatgaaggaggagtttgatatgattgaaaaacatcaaacatgggagctcacggagaaacctaaagataaaaatgtcattggagtgaaatgggtttatagaaccaagcttaatgctgatggttctgtaaacaaacataaggcgaggcttgttgtgaagggatatgcgcagatgttcggggtagacttctcagaaactttttctccggctgccaggttggataccataaggctgttgttagctcttgctgcacaaaaaggttggattatacatcacatggatgttaaatcagcctttttgaatgggcacttggaagaagaaatttttgtagagcagcctgaaggatttgtagttcatggacaggaggagaaagtttatcggctgaaaaaggccttgtatggcttaaagcaggccccaaggtcttggtatggcagaattgatgcacatttgataagcttaggctttgaaaaatgtctaagtgagtttaccttgtatgtcaagaagacggatgttggaatagtcattgtttccttgtatgttgatgacttacttatgacaaaaagttcaaaggagctgattgaagagtttaaaggaggaatgaaaaaagcctttgaaatgactgatcttggaaaaatgtcatttttccttggtatgcaggtgcaacaagatagaggtgaagtctttgtaagtcaagaaaaatatgcaaaggaaattcttagaaagttcaagatggaggaatgcaagccaattgcaacgccaatgaatcaaaaggagaaattcagcaatgaagatggagctgaaaaggttgatgaaaaattgtacaaaagcttaataggatgtctgatgtatttgactgcaaccaggccagacattacctatgcagtaagcttgttgtcacgatatatgcactatgctagtgagattcattttaagacagctaaaagaatcctgagatatatcaagggtactattggttatggagtgaagtttcagccagtaaaagatttcagtctttatggatattcagatagtgattgggctgggagtaatgatgacatgaaaagcacttcaggctactgtttcacatttggttctggagttttttcatggtgttcaaagaagcaagatgtcatagcacaatctaccgctgaagccgaatacgtagcagctgttgcagttgcaaatcaagcaatttggcttagaaaacttatggctgatctacacatggagcaaaaggagagtacacaggttcttgttgataatcaagctgcaatttcaatttctaagaaccctgtgtttcatgggaaaacaaaacattttaagataaagttgtatttcctaagggaggtgcaaacgcaaggtgacgtgcaattgctatattgcaaaactgaaaatcaacttgctgattttttaacaaaatcacttcctcaagcaagatttgagtatcttcgacaaaaacttggtgtatgctgccgttga

SEQ ID NO: 7905 - DNA, 372 bp, Glycine max
  Peptide Sequence Number=SeqID_124683
atgggttctcaacagaagccctgcgccaacaactgcggtttcttcggcacttccgagaagcgaaacctctgctccaaatgctacaaggacctctgtctcgaagaggagcttgcggcaatgaagtccgtgctctgctcccccgcgccaccctcgccgggcaccgcgggtcagtcgaaaccggcgaaccggtgtgggacatgcaacaaaaaagtgggtttaaccggttttgcgtgcaagtgtgggagtaccttctgtggggtgcatcgttaccccgagaaacacgagtgcacctacgattttaagggagaggcgcgcgaagcgatttcgaaggcgaaccctgttgttaagggtgacaaggttgataggttttag

SEQ ID NO: 7906 - DNA, 1066 bp, Glycine max
  misc_feature (1055)..(1055): n is a, c, g, or t
  Peptide Sequence Number=SeqID_124684
agggctacacgtcctccaattcagaggactagacctcatctccttcacaggactacacgtcctcgccttcagagggctacacgccctcgcctttagaggactacagatcctcgccattagagggctacacgccctcactttcagaggactacacgaccccacctttagaggactacacgaccctcaccttcagaggactacacgttctcaccttcaaagggcggcacgccctcgccttcagaggactacacgtactcgccttcagagggctgcacgccctcgcttgtcctcaccttcagaggaccacatgtcctcacctttagaggactacgcgtcctcaccttcagagggctgcaggctcccgcgttcagaggactacatgtcctcaccgtcagaggacaagacacccccggcttcagagggaggactacacgccctcgccttcagaggactacacgtcctccccttcaggggtctagacctcctccccttcagaggactacacatcctcgccttcagaggactacacgtccacgccttcagaggactacatgtcctacactttaaaggactacacgtcctcgccatcaaagggctacacctcctcaccttcaggggactacaggtcctcacctttagagggctacacgccctcgcctttagaggactacacgctctcgccattagagggctacacgccctcaccttcagaggactacacgtcctcaccttcggagggctacacaccctcgccttcagaggactacaagtcctcgtctttaaaggactacatgtcctcgctttcagaggactacacgtcctcgccttcaaagggctacacgccctcgccttcctcacctttagaggactacacgtcctcgccttgatagggctgtacgcccttgctcgtcctcaccttcagaggactacatgtcctcaccttcagaggactacacgtccataccttcagagggatgcatgtcctcggcttcagaggactaaacgtcctcgacttcagagggctacacatcctcgccctcagaggactacatgtnctcccctatag

SEQ ID NO: 7907 - DNA, 516 bp, Glycine max
  Peptide Sequence Number=SeqID_124685
atggaggacgagaaaatagttggatacgttacggcgttccttaagaagaaaggcttcacgcaaaccgagaagattttccaggaagaattccaacacaacaagtccaacacttccaattccgttctggaacccgacattgccaaccacctcctcgccttctctcagtatttctccacctctgctgacgtattggagactggtcctgctaggttccacgacggctatagcagactaagaacatggacttattcttcactcgatttgtacaagcacgagttgcttcgcgtgctttatccggtgtttatccactgcttcatggatcttgtcgccaaaggacatgttcaagaagctcggaacttcttcaatactttccgcgaagaccatgaaatgatgcacttgcgtgaccttcagaagttggaaggagttctctctcctaatcatctcaaggaaatggaatttgctcactcgcttagaaagagcaaattcaacataaagatatgtgaggtaatgccttga

SEQ ID NO: 7908 - DNA, 387 bp, Glycine max
  Peptide Sequence Number=SeqID_124686
atggctgcacgtaagggaatagtgaacaagattttcaagcaccggtgcccaaactccaaagtcacatcccatttgaagtgttgtagcagtgtgttaagggaagcagagagtgcaggctgcagagcccacaggaaagggagaggcaacttgagtgcaaggggacaatttgaattgaatgttatgggaatgaaaatggtagatgacaagtgtccaaaggttacagttatagcttgcattatgggcataatgcattattgcgaggttgatagcaattccgtgttctcatcgcagctctctcactgcaacgattcgatggcgactttggaattcactcgaagtggactaacacaacgcaaatgggatatactaatgattttctccacttag

SEQ ID NO: 7909 - DNA, 413 bp, Glycine max
  Peptide Sequence Number=SeqID_124687
atgcgctgcaaatccgactacattctgatgctggagccggttcacgctatttccggtgaagtggtggcatgggaattgttgacgcgtttcgcagatgatgcagataccaataataagcgtaaccctgacagggatgcagggttcttcagtcggctttctgctgacgaaaaatggcagttattcctccaccaggtcgaaaaacttattcagctttaccatgcggggtttgagcaggtcatcagcgttaatgtagacagagatattgtttcaggcatttttaaagatgctgaaatacaaagaaaactggccgcgctgacgcgatcacggctggaaatctctgccttcttcaccgcacgttttaatagtgccgacctgctgatactgaaaggcgtagccaaaatcacgccggcccc

SEQ ID NO: 7910 - DNA, 506 bp, Glycine max
  Peptide Sequence Number=SeqID_124688
cccactgaaagtgaggacgcgtagtcctctaaaggcgagggcgtgtagccctctgaagttcaggacgtgtcgcctttcgaaggcgagggagtgtagtcctatgatggcaaggacgtgcaatcctctgaaggtgagggcatgtagccctacaaaggtgaaggcacatgaccctttgacggtgatgatgtgtagtcctctgaagttgaaggtacatgaccctttgaaggcgaggacgtgtagtcctctgaaggtgaaggcgaggacttatagtcctctggaggtgagggcgtgcagccctctggtggtgaggacgtgtagtcctctcaaggcgaggacgtgtagtcctctcaacggtgagggacgtgtagtcctctcaaggcgaggacgtgtagtcctctcaacggtgagggtaactagtacccaagaggtgagggcatgcagccctctgatggtgaggacgtgtagtcctctcaatgcgaggacgtgtagtcctctcaacggtgagg

SEQ ID NO: 7911 - DNA, 405 bp, Glycine max
  Peptide Sequence Number=SeqID_124689
gcgagccagaggctagcctgggtgagccaggggtctgaaaaagtgcaaaatgtcctcattgccctcccttttgagtattttttgcattcttttccgaaatgtcaaaaaaccttacagattgcgcggcaactggcgttaagcagctcaattcggctagcaagaatcaaaatgttagcgaagatgatgacaaaagcccaagacaatgagttcaagattgaatcaagaacacttcaagaatcaagaggaaatttgatttcaagattcaagaatcaagtttcaagatttaagttttcaagaatcaagaataatcaagatcaagattcaagactcaagattcaagaatcaagaaaaggctcaatcaagataagtacaaaaaagtttttcaaaacattgagtagcacatga

SEQ ID NO: 7912 - DNA, 333 bp, Glycine max
  Peptide Sequence Number=SeqID_124690
atggagtggttttttcgcatatctcacccattcatgataccgacccaggcaggtgaccagcctagagatgcaccagccgcagaccctgaggagtacatacagccgcccaacccccaggttccagtggcatttgacccacctcgacatgcagtggatgattacgacggatatgaggcgattgcacagaggttggagcgtgtgctcaaccttgggatggtcactgcagacactgagttatatgagattatgcaggactgcctgacgatcgccagagggggagccagtgctgatggaagtgtcagggttcgtcagagacaccgcagagagcattga

SEQ ID NO: 7913 - DNA, 1150 bp, Glycine max
  Peptide Sequence Number=SeqID_124691
ggtggacccttgggtactagaacctattgcctttagaggactacacgtcctagcctttagagggctacacgccctcaccatcagaggactacacgtcctcgccttcagagggctacgtgtcctcgccatcggaggactacacatcctcgccatcagagggctgcatgccctcaccttcagaggactacacgtcctcgccttcagagggctgcatgccctcaccttcagaggattacacgtcctcaccttcagaggactacacgtcctccccatcagaggactacaggtactcaccttcagaggactacaagtactcaccttcagaggactacacgtcctcggcttcagaggactgcacgtcctcacctttagaggactacacgtcctcgcattcagagggctacacgccctcgccttcagaggactacacgtcctcgccttcagaggactacatatcctcgccttcagagggctacatgtcctcgccttcagaggactacacgtcctcgccttcagaggactatatgtcctcaccttcagagggctgcacgccctcaccttcagagaactacatgtcctcgccataatagggttgcacgccctcaccttcagaggactacacgtcctcaccttcagaggactacacgtcctcacctttagaggattacacgtcctcgcctttagagggctacacgtccttactttcagtgggctccatagccacaccttaagagaatttaaggagaaggatatcgtacagccactatgcatactggggcaagatttcacccgtgtcgttacaaagagacaagtgcggatcatgcgcaccaacatgaccactcttacacatatatggatgacgttgctacttagcaacattctgcccaacgaccgcaatgccgatctccccctgcggaaggatcgcgcccacaagacacccagtggacccggagaagtccaacagagccctggggtttcctgcacgggttacgggcctctgtcagtcctacagggtgctcgtcccccccagcaagggatcgctcccgcaagacacccagtggacccggagaagtccaacagggtcttggggtttctagctctgatcacgggcctttgtcagttctacgaagcacccgtcgcccccaacaag

SEQ ID NO: 7914 - DNA, 117 bp, Glycine max
  Peptide Sequence Number=SeqID_124692
atggggagagttaacctagggttaaatgtgagaatggtagtgatgacttgtgggaaagcttgggctgagcaaatgagaaaaatgagtgacaaaggtgaaagcaagagccatttatag

SEQ ID NO: 7915 - DNA, 912 bp, Glycine max
  Peptide Sequence Number=SeqID_124693
atgagaagattctttggcgcccttgtctgcttcagcgctatgcttttttgtaaagggattgtctcagcgggatatgcatcactgaaaaggataagccataccgctgaacgttcaagtgatgagtttacgagcaacctgatgattaaatggccgtggaaagcgactcaaccctctcaatcccaggcagacatcgaggcccagtggcaggacgcgctggcgatcccgctgctctcgccgctgaatgagcaggagcggcagcggctggtggccgtcgccgggcagatcttgcagcaaaagcgcatcgtgccgctgcaggggctgcagctcacctcgcaaatgcaggcgcgcatcgccctgctgttcgccctgccggtgctggagctcggcgcggagtgcctcgacggcttcaacgaaatcctgctctaccccaccccgttcgtggtggaagacgaatggcaggacgaaatcggcctggtgcactcggggccggtggtgcagtccggccagagctgggaacaagggccgatcgtgctcaattggcaagacgtgcaggactctttcgatctctccggtttcaatctggtgatccacgaagcggtgcacaagctggatatgcgcaacggcggcgtcgccaccggcgtgccgccgatcccgctgcgcgaggtggccgcctgggaacatgacctgcacgccgcaatggaaagcctgcaggacgagatcgacatggtcggcgaagaggccgccagcatggacgcctacgccgccaccgatgcggccgagtgcttcgcccgcccccgagctgctggcagaacgctttccggcgctgtatcagcacttttgccgcttctaccgccaggatccgctggcgcgcctgctgcgcggccaggcggaaaacgacgcgcaatgggctga

SEQ ID NO: 7916 - DNA, 252 bp, Glycine max
  Peptide Sequence Number=SeqID_124694
atgaagagaaggttgggccccaggccaggctaccctctccagaaactgctcaatggaaggaatggatcctggaggagctacaaatatggaagggagatcagttggcctcgccctcgccctcctagcccctcagatagcaactgtcagatcattaggactacaacagttcttcctgatgtaggccaagttaatgaccgggctcagtcactcaaaagtgaggctgtcagagacaacccttctggctcgacatag

SEQ ID NO: 7917 - DNA, 258 bp, Glycine max
  Peptide Sequence Number=SeqID_124695
atgtcaaaatattgtcttaatgtcaacatagttggaagatattgtcttaactctggaggtaatatagctgcatcttctaagatattgtctccacggtggtgtgttgttctttgcctctatgatggggatttccgtggtggtggtgctgttcttcgttgccgtgatggggctctcctcagtggtttttgtgttagtgtagcagaagtgcagaacagcaaaagccaagatcgaataaaggtaaacgaaaatgacaaatga

SEQ ID NO: 7918 - DNA, 291 bp, Glycine max
  Peptide Sequence Number=SeqID_124696
atgacaaagggcgcagaatgtgtctctgcacatttaccacccaacttgctgttcctgaatgataaagggcgcataatttgtccatgcgcgtttatcaccaaatttgcgaaatctaaatggcaaagggcacagaattcgtctatgcacgtttaccactcaactcgctgctcctggacgataaagggtgcagaatttgtctctgcgtgtttatcactcatcgagcgtgcggataacagcatgtcatcgggcccgccgcctttagatgacaaatggtgcagaagacgacgttag

SEQ ID NO: 7919 - DNA, 180 bp, Glycine max
  Peptide Sequence Number=SeqID_124697
atggccaatgaacaaccgggacgtgtgacccttgaagactattccaagaggaacctttttcatggcctaccaaatgaagatccctatgcacacctagcaagatacattgaaatctgtaacattgtgaagattgctggagtactgttcgcaaccggcaagtgtaccagaccgcacaagtag

SEQ ID NO: 7920 - DNA, 318 bp, Glycine max
  Peptide Sequence Number=SeqID_124698
atgcccctctatgccaaatttttgaaggatatgcttactaagaacaatcggtacatccatagtgacagaattgttgtggaaggtcattatagtgctatgattcaacgcattcttccacccaagcacaaagatcctggagttgtcacgataccctgttctattggtgaggttgttgtaggaaaagctctcatagacttgggagctactgatttcgttgtcatagatatagaagaggatgctgacattcctctcattcttggccgcccattcatgtctactgcaagcttcataatggacatggggaagaagatactatag

SEQ ID NO: 7921 - DNA, 186 bp, Glycine max
  Peptide Sequence Number=SeqID_124699
atgaagatcttaaaatggtatacaaagaatctacactgtccagaagcatccgttgttgaaaggtattcgttctacacgaaattacaagacgacaagaatctgaagaagttcgcttatcagaataagcctttcatcatggcagaactagctaaacaggtgtttttgttggacaagtggcctcaataa

SEQ ID NO: 7922 - DNA, 735 bp, Glycine max
  Peptide Sequence Number=SeqID_124700
atgatgacacttgctcagacatggagtgtcctttcttattacgatcttgcgcccacttctcacacatctgatgttaatcttgacagggcccgcttgatctacggtttggtgagccgcatggacatggatgtgggcagctttatatcacagcagatcagccagattgtccagtccagcacctcgaggctcgggttcccagcgttgattacagcgctgtgtgacattcagggggtggtttctgataccctgatctttgagtcactcagccctgcgatcaacctagcttatgtgaagaagaactgctggaaccccgccgacccatcgatcacattccctgggcctcgccgcacacgtaccagagcttcagcatcagctcccgaggcccctctccctacccagtctccgtctcagccatcccagcgaccgcgacatccacctgcttccacctcagcatccatggacatgcatgggcagatgctgaggtcccttcacgttggacagcagctcatcatggagaatatgcataggttgtccctacacctgcagatggaccccccgctcaccactccagaagcctatcgtcagcgagtcgcctggccaggagaccagccctccactgacaggggggaagagccttctggagccgctgaggatcctgcagtcgataaggacctcattgctgacttagccactgctgactggggcccatgggcggacttgggcggaggcagttga

SEQ ID NO: 7923 - DNA, 1119 bp, Glycine max
  Peptide Sequence Number=SeqID_124701
atgtctgacaaaaccgtggcaaaaaccgtcatcgtgctgggtggcggcatcctcggcgtctcaaccgcctggcaactggcgcaggcgggcgcgcaggtcacgctggtgacggaagcggcactctgctccggcgccaccggccgctccctctcctggctcaactccgcgggcgagcgttcgcagccttaccatgcgctgcgcatggcaggcattgaccgctatcgcacgctgtttgcccgtcatccgcagctcgactggctgcgcttcgatggcgcgatttactgggccgcagacgatgacgcgggcaccaaagcgcgtcatcactatgaaaaagcgcagggctacgactcaaagctgatcaatcgcgccacggtcggtgatgtcgatgcgcaggtgaatccggccagcctgagtcaggtggcgattgccaaccccggtgaaggctgggtcagcctgccgcatctggttgagcatttggttcaggcattgcgcgcgctgggcggagagatcgttgagaacgccggtaaagccagcgtgatcaccaaagacggccgggccagcggcattcgcagcgaaaaacgcggtgagctgctggccgatcgcgtactggtagcgtgtggcccgtggacgccggaagtggttgccccgctcggcgtgcacatccccaacggttctccggtctctatgctggtgaccagccagcccggcgatcaccggctgcaggtggtaatgaatacgccgcgcgcggcggtccggcctaatcccggcaacaccatcgccgtcgatcacgactggtatgaagagcacatcgtcgcgcaggccgacgggcagtacagcattgataccgcagtcattaaccagctgatggcggaagcgggtaacctgatcgctgacggcgcgccgctgcaagccagcagctggaaaatcggtctcaagccgattcccggcgatggcgaaccggtggtcggtgagctgcagcaggttcccggctgttttgttgtcttcacccattccggcgccacgctggcattgatcctcggtgagatactgacgcaggagatgctcaccggcgttaaacacccgatgctggcgaccttccgcccggaaagattcagctaa

SEQ ID NO: 7924 - DNA, 153 bp, Glycine max
  Peptide Sequence Number=SeqID_124702
cggactcttattttatctggccctggcggttgtcatcggaaaagaaaccggcaatacgcggatatcagaccagcagggaagcggaaagggcgcgtggatgaggcgatgggatcgggcaaagtcgcggtgtgtgacagacaacagggcgtgtag

SEQ ID NO: 7925 - DNA, 860 bp, Glycine max
  Peptide Sequence Number=SeqID_124703
cagtcggcaatctctgccgccagcgaggggagaaaacggccggggcgatcgttaatctgtccggccagcagcagacgcggcagctcgtgcggttgcggatcgatctcctgctgcggataaaggctgatgtagccgcgctcgccaaagctcagtgccgcgtggccggtacaaaagtgcccttcaccattaatcacgccgatgtaacggtcaatcacatagcgcttcggctgttgactgacttcagactgcgcctgccagacgtggacacagagaggaaatgccgcggcgaccggcggaaagcgggcctgctgccacggccggagccgcgcgatatgacgatggccgcgacaaaaccacggcagcagcgtaacggactgacccgccggcaggcgctgccactggcgccagacgcgccacaccgtcaggctgaacgacagcagcaacagcaccagccagctgcccagcaacaggcaggtatgcaggttgtcattgaaaaacagcaccacgctgagcaccatctcgccgcagcccagcataaaatgtcgcacccagcgctggcgccgaatcagcgccgcgctcaggcagcgaaacaggccgttaaacaacaggcagatttccatcaccgtcagcagcagtttcttcagttgcctttcgtcaccgtgccacagcgcgccagccagcagcgtgccgacaaaaatcagggaaaacagcagattgagccagcgctgcagcgacacctcgccgctcagcagcacgtccgccacgatcatgccggccagcagcacgccgcacagcgccaggccataaatcagcagacgataacgcaccagcagctcgcgtccggccagcagcagcagtaa

SEQ ID NO: 7926 - DNA, 619 bp, Glycine max
  Peptide Sequence Number=SeqID_124704
atgaaggattccatacaggaagaagttggtgttattatgtctatagaaaccatgtcaagggaagaacataaaaagaagttggctgaagatgcaactttgaaggtcttggcaggaaaagtttttgaagaaattccagaagagattactctaaaatctttaaagactttgtttgttgaggaggtgcaaaggaaagttgctgaagaggctaccatgttcgatgttgatgcttctctcaatgtgtctgaggacaacatcattgagatagaccttgttgtcaaaccgatcagatcaaagcaagtgtcaatcgttgatgaaagacaaattgatgtcgtcttgtctgaagtagtgagtgaagacaacattagatatcaacagcaagctattaagtggctacttccttcaaggtcagtacctccaccaccatcctcaaagaatattcttatcaaaccatatgttaacattgggactcatgcacttgatccacaaatgcaaaagttggagctggaaaagcttaatcttcttaagctctggaaggaaggtttcctagggactgaccatttctcctatcaatcttgggacaccttacctaaagaagagaaacacgttcttggagtctatg

SEQ ID NO: 7927 - DNA, 198 bp, Glycine max
  Peptide Sequence Number=SeqID_124705
atggaaggtactaaaccaatgaaagctcccatgcatgcctccaatcctttaagtaaagatgaatctggtaaaccagtagatcagattatctatagaggcacatatcatcaatgggccgatatcattactaaacctttgtctgaagaatgctttgtctatataagggaacatttaaatatggttagcttatcaaaataa

SEQ ID NO: 7928 - DNA, 461 bp, Glycine max
  Peptide Sequence Number=SeqID_124706
atgatcgatggtattcctcaatcaagtccgttacgaaataatgacagggagatcagaagtattgatccgtcagtacttgaacgtattgaagttgttaaaggagcaacatccatttatggaaatggtgcagagggcggtatcatcaattatatcactcagaaaaatactaagagcaaaccattttcaggaaaaacagttttgggctttaccagtcatgatttattcaatagtaatatgttcaaatcggacggtggcgctggctacagggtttcccagagtttttttggaaacttaagaaagtgggattacctgattaatggtacaattactcagaatggagtgaaaattgacggtgatgatttggttcaaaatccaagatatggattaggagaaaccagtgtaggaaacatattcggaaaagtaggatataatatagatgatgataatagagtggagttaat

SEQ ID NO: 7929 - DNA, 529 bp, Glycine max
  Peptide Sequence Number=SeqID_124707
gaagtcttcataagcctcagccttgaattgggtgtcgttgtcggtgacaatgggttaagggaggccatatctgcacgggagggagagatatcaactagtagatatttgactgctcttggggcctttggtagtggtcctaatatgttctctccccacatggaaaagggacaaggggagctcatattgtggagattgttaggaggggtgcgtggaatcgtgcaccactttggtggcaagggagcatcccctggtgtgaagaccacagatcccttcatgaagttctctcatgacgtagtatgcttgttggttattcagtcatttgagcaaggtgtctatggtgggagtttggagcgtctcctagatgatagtcttgaggtgctcaatatttttggtgctgactatcttagagagcaggtctgctctggtgttgttctccctggtgacattgtcaaggccttcgaggatgattcctgctctgttccccttcacgttggacgtaccaccaacgtagaggctccactagtttggg

SEQ ID NO: 7930 - DNA, 411 bp, Glycine max
  Peptide Sequence Number=SeqID_124708
atgcggcttcgtcctcctggtcatcgaagcagcaaaccagtgttgttcatcggtgcctcatcagcgtcgctgcctcgtcgtcctggtgaagcttttggtgttgtccctaaaacccactgtttgggtgtcgtccaggctccactagtgacatcatggactgaggataatccagggaggcatttttatggttgtggtctatgtaggaaaaggtgtaattattttgagtggcatgatccagttaccaacattcgtcagaagaggatcattgtagcattgatgaagaaggttgatgaattgaagttgagggaaaaggatttgcaaaccaagatcagtgacatgaagatgaagggaaattttttagggattggattggttttttcttggattgtaattgttgaatggctatgttaa

SEQ ID NO: 7931 - DNA, 396 bp, Glycine max
  Peptide Sequence Number=SeqID_124709
atggtgggttacacaccttcaagttttacagatttggtcttcgccggtgaaaggatcaaagtgggtctgaaaagaggcaaatttaatcatcctgcttgcatgaatgagaaaactggggcaaatgaagagggtgaggatgagggagaaacccatgttgtgactgccattcctatacggccaagtttcccaccaaccagacaatgtcattacttagctaataacaacccttctccttacctaccacccagttatccacaaaggtcatccctaaatcaaccacaaaacccaccttccacacaaccaatgctaaacaccacccttagcgaaaaccaaaaaggaatttttcagcaaaaaaagcctataggattcaccccaaattccggtgtcctatgctaa

SEQ ID NO: 7932 - DNA, 498 bp, Glycine max
  Peptide Sequence Number=SeqID_124710
atggtcggacacggatgtcagtgcacagatccagactgtcgagcaagtcgcagccctggaggcgcttgtcgcgccacgccaggcggccatgctcgtggaatggatacgtgtgctgcgcgaggaagaggtcgatccggcgaagtacccgggcatccaggccctggtctggttgatgcgcggagaccagggcgcgattgcccagacgctggagcgctacggccagccattgcaggccagaggctatgtgcgccagtctgccagctccgcccaggaccaggcggagcacctgctggccagctaccgcagcgcgctgcaatcccccctggcccaggaatggcgcgcctacctggcagcgaacccgcaaccagagactggcgagaaggtatccagagcgcagaactccaactgcaaaccacccctgggtcgcagcaggcctttggatctggagccggatccgcgcaaatgcttcggtacctatctggcccagagcaaccgtga

SEQ ID NO: 7933 - DNA, 173 bp, Glycine max
  Peptide Sequence Number=SeqID_124711
gagtagggatgaaacctgatgaggttgttcttcctgagccaattgtgccagttatacataagactcttgaagcacgtgagtcacaattgagacaggaggctgctactcctgagaggacaccacagacctcaaaagatccactctcaccaaggatggacctatcttttgcttag

SEQ ID NO: 7934 - DNA, 552 bp, Glycine max
  Peptide Sequence Number=SeqID_124712
atgggattgatagatgaaggacgaactgaaattggtcgcgtaaggagggaggaaggagaggtgttcatgcagtcaagcgacaccaacttgggtaagcctaaacctttagaaattgattttactagagatgttaccactcaagtaccacaaggtttccaacccgctgtggtgaggacaccatcaccattcccttacaaaagtgacaaggcggtcccatggaggtatggcatacagggatctgacggaaggcaagacgtgtccgtcatgcgtgttggggatagcattccgactgctaaggtcactaatatttttggtatgagtggcatgatgcatagtggacatatttttgctcctcccgaactaccgacaaagtcgaatgacaagggaaaggcgagggaggatatggtcgaaaaggagaaaataggccttgtgacgaataatgaggcccctgtcaaaaagcctatggaggaagagaacatttttggcaagaaagagatatctgctgaggaagcaacggaatttctgagaatcattcagcagagtgaattcaag

SEQ ID NO: 7935 - DNA, 384 bp, Glycine max
  Peptide Sequence Number=SeqID_124713
atgtctcactatagtatatgcaagagtatcggttcaagacccacatctcaatatgatacaaggagatttcactccttagatgcatggaaccggtacacggataatgtattggggagaaacatcttgccagagaggaaggtggagctctaccacactgagtttgatgattttaagactgagttggagaggcataatctccataaatgcctcaccaatttggttgatgggagcattgatgtggctttggtgaaagagttctatgcaaacctatacagctctgagggtccttcaccaaagcaagccagggtcagaggccatctagtttacatttcttgcttactttcacagcatatttcctttaccttccattgtcaaaccgcctag

SEQ ID NO: 7936 - DNA, 667 bp, Glycine max
  Peptide Sequence Number=SeqID_124714
atgggtgaagtagaggaggtgcaagagcagatggaggccgacatggaggccatgaaagagcaaatggccacaatgatggaggccatgatgagcgtgaagaagatagtgaaagccaatgcggttgcagttgccgctaccagggctgttgctaaggcacatgaaattccccaccacaatctagccgacttcgagccttgcctcagatatgttactgaagggcaagcagttggtggtatacccctacaaaaccctttggagggccctcagtatcatccccagctacacctcttgcattccacaacaagtaaaaatcctcatgctatggcagaaataggaaagttggatcatctagaggaaaggctcagggccattgaaggaggtgaagattatgcctttgctaacctagaagagttgttcctagtacccaatatcatcacccctcccaagttcaaggtgctggactttgacaagtataaggggactacttgccccaagaaccatctaaagatgtattatcggaagatgagggcatacaaaaaagatgaggaattgctgatacattccttccaagaaagtcttactggggtagctgttacctggtacactaacttggaaccttcccgagtccattcttggaaggacctagtggttgccttcgttaggcagt

SEQ ID NO: 7937 - DNA, 690 bp, Glycine max
  Peptide Sequence Number=SeqID_124715
atgagaacgggtaagacagcgctgtacgaggatctcaagcggcttatcttaacgatggaactcgacccggatgagctgctggatgaagccagtctgaccgctcagtacggcctgtcacggacaccggtgcgcgaagtgtttcagcgcctggcaggtgaagggtatctcgagatcgttgaaaagcgtggcgtacgcgtgattcccatgagccatgccacgctgcgcaactttttcctggtggcaccgatgatctatgcggccaccgggcgccttgcagctcagcactacaaacccgcgcagttgaaggcgctaaaagaaactcaaaagcgctttcgcaaagcggttcagagccatgatgtcgaagcgttggctctggagaacaaccgctttcacgagatcatgggggaaatggcggctaacccctatttgcaaccgagcctcggacgcttgctgatcgatcactgccgtatcggtcacacctttttccgtccacgtaatgatgacatggaacggcgtttacaactggctgccgatcatcacgatgcgtttatcgtcgcactggaagcgcacgatgagcaggcggtagtggatctggtgttcgaacactgggaactctcccgggaaaacatggagatctttattgcgccgcagggacttaaggccgatgagcgcatccagtcacctgaataa

SEQ ID NO: 7938 - DNA, 351 bp, Glycine max
  Peptide Sequence Number=SeqID_124716
atgacaacttgcaacttctttatggatcaagctggtgaggaaagaaaattgcaactgagtgagttagatgagatatgcctagaagcctacgagagtgccaagttctacaaagaaaagaccaagaagttccatgatagcatgataattaagaaggacttcatggttggccaaaaagtgttattgtataattctaggcttggactcatgagtgttgagatcaaaagcgactccacaaacaagagcttcaaggtcaacggacaccgacttaagtcattcctcacaaacccttctttagtggacatagtggtggaagagacttccttactccaccctactcttcctccaccatga

SEQ ID NO: 7939 - DNA, 393 bp, Glycine max
  Peptide Sequence Number=SeqID_124717
atggtagccacggcttaccaaacctcccatgaatgttcggaagaaaccattatagatatcttagtggcaggattttctggacaactgaaaggatgcgcagttaagacggatctcaatggaaaagtcattactaatgacgatgataaagagattcctgacgctgttaacacattaatttttacaatagcccaacatttcattggagacccatccttgtggaaagataggtctgtagaattattatcaaatcttaagtgtagaaccttagcggattttaggtggtatagagatactttcctaactagggtttacacaagagaagatagtcaacaaccttttttggaaagaaaaatttctagccggtcttcccagatcattaggagacaaggttag

SEQ ID NO: 7940 - DNA, 246 bp, Glycine max
  Peptide Sequence Number=SeqID_124718
atgctccaaccatatgggatcagcataggcttaaaggagcactcaaacccgatgacccccaaggcctacactccgaagagtccgtcagggcctctccctcctgattcaggaaacctacactttctctttaacactgtgcatttacacttttctcaagataacactggtcgggttattgtacaattcatagcttacaacacaagtaatttcacatcaagtgttaactacacacttatccacaactaa

SEQ ID NO: 7941 - DNA, 117 bp, Glycine max
  Peptide Sequence Number=SeqID_124719
atggttcacaatgccatcgatcgccaatgggatatggtatatatatggtgtcagaaaagaataattgatcgtagggaaagaatatcacgaagcataagcggaaaagaatccatgtaa

SEQ ID NO: 7942 - DNA, 439 bp, Glycine max
  Peptide Sequence Number=SeqID_124720
atggagagaagtatgattgatgctgccagtgatggagcccttggagacatgacccctactgaaaccagaaatttaattgagaagatggcttcaaactcccaacaatttagtgccagaaatgatgcaattgtcattagaggagtgcatgaagtggccacaaattcatcttcatcagttgaaactaagaagcttgaaggtaaactagatgccttggttaacctagtaacccaactggccatgaataaaaaatctgcacctgtcgccagactctgtggtttatgctcctctaccgaccaccacacaaacctttgcccttctgtgcaacaatctgtagcaattgaacaacctaaagtttatgctgcaaacatctacaatagacctcctcaacctcagcagcaaaatcagccacaacagaacaattatgacctctcagcaacag

SEQ ID NO: 7943 - DNA, 291 bp, Glycine max
  Peptide Sequence Number=SeqID_124721
atgtcgtatgctaacttactcccatatctgctcgataatgcaatggtagtcataagcccatcaaatattcctcaacctccatttcccagaggatacaactccaatgtgacatgtgcttatcatgggggagtttcggggcattccattgagcattgtataaccctaaaacataaggtgcaaactctgattgatgcatgcaccatgcatgagcttcaagcgaacctaggggcagacaagaagtcctcacccgataggttgaaaacacaaaagggtggcctaggcaaaagttag

SEQ ID NO: 7944 - DNA, 317 bp, Glycine max
  Peptide Sequence Number=SeqID_124722
atggagttggcatttacagaatttggaagagaagcagtgggcagtggctatatgaggctagagttctgggaaggctgggctgatgacagaaatgtattagtcattaacatttatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 7945 - DNA, 507 bp, Glycine max
  Peptide Sequence Number=SeqID_124723
atggacgacatgaccaaccctccccctccgcccggtgcgccaccggaggcgccaggggtcgacgccgagtacaccgaggtgacggggtcggtgtggccgcacgtcgaagaggcgatcgtcgaccgcatcctgcagaacaactggaccatcgtgttcgcgaactcgcggcgcctggccgagcggctgacgggacgcctcaacgagatctactccgagcgcatcggtgtcgcgctgccggaggcgaccgttccggcggcgatgatggcgcaggccggggcgacggccggcgccgacccggtgttggcgaaagcgcaccacggctcggtgtcgaaggagcagcgtgcccaggtcgaggaggagctcaagtcgggagtgctgcgctgtgtcgtcgcgacgagcagcctcgagctgggcatcgacatgggagcggtcgacctcgtgatccaggtcgaggccccgccgtccgccgcctccgggctgcagcgcgtcggccgcgccggtcaccag

SEQ ID NO: 7946 - DNA, 243 bp, Glycine max
  Peptide Sequence Number=SeqID_124724
atggtggaattagcaaccggtcaaggaactgatgtgagccaatcagttagaccaccaaacatcggagacaaccaaatcaatttcccttcatgggtccacaacaacctcaaccacaatcaattcaagggagcatgcaccgaggaccccatgctcatctcacaagatttctacaattatgcgtatcgcataatgggaaaggaggaagagagattagagatgccacttcaaggagaagatgagtag

SEQ ID NO: 7947 - DNA, 174 bp, Glycine max
  Peptide Sequence Number=SeqID_124725
atggaagccccaaattttccttatacttggtggagtgggcctctcaagaatgacctttattctcttaagggattcgatgcctcagaatacctatttttggcaccaacaaagaacaaggagttaatctcttacaaactaaaccctcatccaacaactcctttacttgaggaataa

SEQ ID NO: 7948 - DNA, 168 bp, Glycine max
  Peptide Sequence Number=SeqID_124726
atggaggagtttgatacacaggtggcctggccaggagcccagccttctccttctggaagggaaggaggatgcttctatagaccatatcccagagccatcccaacacccatacgtgatgatgccacaccatctgcaccagcacctgagttagagcagcctatctcttag

SEQ ID NO: 7949 - DNA, 780 bp, Glycine max
  Peptide Sequence Number=SeqID_124727
atgcgtcctcggcaggtccgacgcgcatcggtgcaggcgacgatattggaaggcgaagcagtcaacctcgatctactaccgatccagtggtgttggccgggagagcctgcgccgcttgttacctggccgctggttatcacacgggcaccagacgatccatccgacgtaaatgtcggaatttaccggatgcagaagcttggccgggataagttgatcatgcgctggctcgcccatcgcggcggtgcgcgtcatcaccgcatgtggcaaaagcgaggcgaggatatgcctgttgctgttgctatcggggccgatccggcgacaatccttgcagccgttatgcccttgcctgaagggatgagcgaactggccttctcgggcctgcttgctgaacgcaggccttccgtcgttgatgcgcacactgtgccgctctccgtgcccgctaacgctgaaatcattctggaaggacgagtttctgcatcagtgacagcgccagaggggccttatggtgatcacacgggctattacaatagcgttgaggaatttccggtcatgcaggtcgcagcgatgaccatgcggaaaaacccggtctatctttcgacctatactggtcgcccgccggatgaaccctcaagacttggcgaagtgatgaacgagctgttcgtgccaattgtacgaaagcagttcccggaaatcgccgatctgtggctgcctccagcggcctgttcctatcgggcaatagtcgtttcgattgacaagcgctatcccggtcaggcgcggcgg

SEQ ID NO: 7950 - DNA, 160 bp, Glycine max
  Peptide Sequence Number=SeqID_124728
atgtgcctattggggaaggagagtttgctgatgaaacactgggcccgacagaatagaagaatatcactcgaagtgtatcaatctcacatgagtcatgcggatgagggcacacacggcctacctatgtcaaataacaaagcaaacagagaagaatgcaatg

SEQ ID NO: 7951 - DNA, 537 bp, Glycine max
  Peptide Sequence Number=SeqID_124729
atggttcatcttgaacttagagggccatcctgggaagatctcaggaaggatctgactacactagctcaagtgtggagtgtcctctcatactccaacttggcccccacatcacacacttctgacttgacagtggatagagctaggctgatatttggcctagtctcttgcttggatatgaacataagagccctgatctctggccagatgacctctatagcccagtctaacacttctagacttgggttccctgctctaataaccgcattatgtagagccagaggaattgtctctgatagcctcacttttgagcgctcgagcccggtcattaacttggcctacatcaagaagaactgttggaaccccgaggatctaacaatttctattcgaggggctaggagggcgagggcaaggccagctgagcttccttcaacttcagtagctcctactccagcatccacttcagcagccccttctatcccaagtcagacagattctcagtgctttgaagctatgcttcagagcattcatcagggatag

SEQ ID NO: 7952 - DNA, 279 bp, Glycine max
  Peptide Sequence Number=SeqID_124730
atgggtgccaagtacctcgaagtggtcaaacgagggtcgcatcccaacaatgaatggtccccgaatgaaattagggcgcaaaatgaccataatttgtctctgcgtagcttttggacgcgatcgagcctgggcggcaaggcgcagaatgaccataatttgtctctgcatgccaccaaacatgatcgcctctggatggcgaaaagatatgaaaaggagagattaaaggagaaaaagatccagaaaatatccaaaatatcaagaaatctcaagaagatatga

SEQ ID NO: 7953 - DNA, 267 bp, Glycine max
  Peptide Sequence Number=SeqID_124731
atgtcaggatttacacgcaattctcctcaaatttcagccagcccgcatcaattagaccttgcaccttacgcttcagagccctaccatgctcaatggaacgccccggggcttctccgtgacaagcacacgttgcgttcgagtcgtattctcggagaaatggaggttgatgaaccttggctagggttatggctaccattgaattatcatgtagatatgggatcaagtggtgtttgtcatgggaagtgcggtagacagactttgtggtag

SEQ ID NO: 7954 - DNA, 736 bp, Glycine max
  Peptide Sequence Number=SeqID_124732
atgatctatccgggccagacgctcacgctccgatcccccgcggccccgccctccacgcccgcgaccgctccggcgccgaccgcgacctcccacaccgtcgtcgccggcgacaccgtgttcgccatcgcccgcgcctacgcgaccaccgtcgatgccgtgctcgccgcgaacaagctcacccgctcgtctgtgatctaccccggtcagcgcctggtcgtgtccgggtccgctgcggttccgaacgccgcaccggctgccaccgcagctccggctccgagtgcagcagcgacgcacgccgtcgtcgcgggtgacacgatcttcgggatcgccgcgaagtacggcaccacgacgcagtcgctgttcgcgttgaacgggctctcctcgtcgtcgatcatctacccggggcagaagctcgtggtgcgcgccgcaccggcgcctgctgcggcagcggcgtcgaccggcgggcagcgcacggcgacgctcactgcggagcaggccgggaacgccgccctcatcatccgcatcggccgagagctcggcgtctccgaccgggccatcgccctcgcgctcgcgacggcgatggtcgaatccgagctgcgcaacctcgactggggcgaccgcgattcgctcggcatcttccagcagcgtcccagcacggggtggggcacccccgcccagatcatggacgccgaacggagcacccgtgtcttctacggcggcccgcacgatccgaacg

SEQ ID NO: 7955 - DNA, 621 bp, Glycine max
  Peptide Sequence Number=SeqID_124733
ttggaggaagctgcacagtcaggaagtgttgatggcgtcattgacacttcattcctcgtcagacgccacgtgaagtggaagatggcccgcaccaagaaaacaagggagatgacgactgaggctataaaggaaatcgattcctttgaggagcaggcgtcacagggatccttcatcccccatggacgtcaagatgttctcatcgctgctattggaccaactgatccagcaaatcagggaccagctagaggagtcgatcacagaaaaagtgactcgacagctcctggcatcattaagctagatgcagtcccagtttcggtcccagatgcaatctcagggagttgcactgcctccggagcctctggttggtccctcagaaattatcctgagacgggtgactcagacaagtgcggcttatacatcgaagcacaggtgggtgtggaggaggttaaagatccagatgttcccgttcctgtacccactgatgagacggttgtgtctctggaaaaaccacctcaaaacccagatccagaggtcgataatctgctttatcttatgacattgaccatcccagagcttttcttgaggccttaccaggttacatgggatgtccccgtgttcagg

SEQ ID NO: 7956 - DNA, 547 bp, Glycine max
  Peptide Sequence Number=SeqID_124734
taactgcgacattctaataactgtttgggaggactatgctattcagctacatgatgctattgacaaaaaccttctgcttcaggaaccattggttgttatgttgaccttaggtaaaatcaaggatgctacagacaagtatcccctaagcgtgcagaatatcaaatttggatctaaattgtatgtcaacgctgatattacagagatacacgaatttcgtcaaagtttgtctatgccattttattctggtgggatgatcaatgataaagatggttctcagtcccaatctagccagagtaatgtggattgttactgcttaactgttggaacagttgacgaaatcattattgatgctccatggagttgtgacagttgtcctaactgtacaacgacatttgatccatcaaaaggtggctcagcttgccgttcttgccataccagtgtggtcgatacagttccacggttagccatgatcattttttgtactgattatttatttacacgctttgctgttttagcaaatttccctgaaatttctatggatgtcaag

SEQ ID NO: 7957 - DNA, 330 bp, Glycine max
  Peptide Sequence Number=SeqID_124735
atgtattacgggactcaatcagacatccgagtaaaaagttattgtcgtttgaaattgccgagagcttcaacattcaatttcgagcgtctcgatgcattacgggactcaatcagacatgcgagcaaaacattattgtcgtttgaattagctcagagcttcagaattcaatttcgatcgtctcgatatattacgggtctcaatcagatatccgagtcaaaagttattgtccttagaattagctctgaggttcagaattcaatttcgagcgtctcaatagattacgggactcaatctgacatccgagcaaaaagttattgtcatttgaattag

SEQ ID NO: 7958 - DNA, 321 bp, Glycine max
  Peptide Sequence Number=SeqID_124736
atggcacgaaaatgcttcccaaatgaatgtatgatagcacaggattcccttttaaatgcaagtatgtgcataatgttaaatatcttgccaatatgcataagtgtgagtgaaacaatgaaagtttgtatggaaatggccccgaggaaacttgcctcaaagagatccaggaaggataaggcggccgaaggaactagttccgctcccgagtatgatagtcaccgttttaggagcgctgaacaccagcagcgcttcgaggccatcaaaggatggtcatttctcccgggagcgacgcgtccagctcagggacgacgagtatactga

SEQ ID NO: 7959 - DNA, 357 bp, Glycine max
  Peptide Sequence Number=SeqID_124737
atgaaccttagggtagaggacgccggaaaaaatggcggaagcttggtgacggtgagccttccggaagacccgttaggggttcttccggaagatttccggaagaagggttcttccagaggtaatgaaacgacttccggaagaacaggtcttccggaaagctctcgcaacacctcttccggaatgtttccggaaaatgtacttcttccggaaacattccagaagagggttcttccggatgacatcctccctaggaagggaccaatcactcgaaccatgagcaagaggctccaagaagattgggctagagctgctgaagaaggccctagggttctcatgaaccttagggtagatttctga

SEQ ID NO: 7960 - DNA, 386 bp, Glycine max
  Peptide Sequence Number=SeqID_124738
gagggaaagataaaggtaggttggaactcagcataaaggttgaaaagatcttttttgatctctttgaggccatgaaacacccagatatgggtgatgcctattttgaagaagaagaggtggagcaggaaataacattatcaaccgcaaccatggtactacaatctcccttggaaaaagaacctggctatgggagagattgcttagcttgtgatgaagagcttgatgattcaaaagacagttgtgttgatcaggtggtttttgaagaattggaaaaactaagaccagcagaaaagcccaaagcagaattaaagacccttccggcacatttaaaatatgtatttttggaagaagatgagaccaacctgttatcattagcaactctttga

SEQ ID NO: 7961 - DNA, 288 bp, Glycine max
  Peptide Sequence Number=SeqID_124739
atgaggagaaggagtagagttgagactcttcagggagaagatggtacctgggtttcggatggggaatctttgaaaagtatggtgactcaatattaccagaacctatttgttgatgatcagtgtgttgatgagttccctgtaacaagaatatgggagcatttaaggctcctagccctgatggcttccatgcagttttttttattaaagtcaatggaatacagcgggggatgctcttgtcaagttggttcaaagcgtgtttcaggatctgtaattggtgcatcagattaa

SEQ ID NO: 7962 - DNA, 1380 bp, Glycine max
  Peptide Sequence Number=SeqID_124740
ggtgttgagagttctactagggtttcttctgaatcctctaaggaggaagatgatatccagcgtagtactaggaaagtcaataggaagcctaatgaggaaggtgatggtaattcggagatggagcttgataaagataaggaggccgagcaaggtgtgccagatggtacgtatagagagaagcttttgaagaatggtggtccaatggctttttcaacttttgatgggagatgttttgggtatctagatcagaaaatacctcctacgccaatatctaaggaggactttgaacgtttcccagaagttcctatttccgataaggagtttagtgactggtgtaagccatggaagggggtccttgatggtcatggtgatggggaagagattgggttcccaaaatttcctattgaattgttcaacgaccaattcttatggagattagggtctactcctggagtaatgcttaaaatcgacagagtgatgactatccaagcaaggggttgtttcacaagaatctgtgttgagattgatctattcaaacctttgcagcctaagattattgctagaggttacttattaaatctacaatatgaaggattgcatttgatctattttaattgtgggaggtatgggtacaaggatgcaaactctgtggagatgaaagccgatgttgtggatatccaatcccaacaaaagccgagggacgaaaaaactgttctctttaatggggttggccttgccaatcataccaagattgtagcacagggatgtgaggatcgcaacaacaaatcatttgggtcaaaattcattgctcttaatgaagcacgtgaggaaaggttggtctctagagttaagcgtaatgctaatgggcctagcactagtggcccaaagggtgttcagaaacagaataggggagttgtttttaaggagatgaagacgaactatgtggtagaagagggtaaaactgggccaactaaaaacacaggcccagttttaaggaagccgaaagaaaagcaaataaagggaaatactaaaatgggaattgccaataaagggaaggcctctaagaagggaaaacaggaagttgtgccaactgacccaagcattgttggtgaggcacaaattaaaggtggtcgtagtaatgctagtttcaaaaatgagaatgatgatatggtagtttgccaagagggtagccaaggccatgttaaggccatccatgattgggttgtggaagaagttgtgggccactctagtggtatttgctgcttgtgggattcaagcttatggaaggttcagatgctgggaaattctagataccatgtgcatctgaagggtatgtgggatgtgttgagagagttagcttgtgagattgataagtcatag

SEQ ID NO: 7963 - DNA, 171 bp, Glycine max
  Peptide Sequence Number=SeqID_124741
atgaagaacaacgaagaacaaacgatgaacggtggacccattgctttagccttcccacgcctatttgtagcagaacaaggcatttgggctgaaggtagctcgcccagacgagctgataacttcattctgaagcaacttgcttgcctaggtgagctggttacttcatcatga

SEQ ID NO: 7964 - DNA, 363 bp, Glycine max
  Peptide Sequence Number=SeqID_124742
atgacggttcctcaagaaggaaccatcttacttaaacatttgctctccctcactcgctctttcactctccataagcgagagccacagagacctctcactctcactctttccctctttccctttcaaatccctctttcactgattgtggtttttggtgctgcacaaccaaaacctgatatccagatccctctttccctttcagatctgaatgcgtatcgtccctcccatggcttcaaagcgcatcctcaaggagctcaaggacttgtagaaagacccaccaacttcttacaacatcgataccccttttttagtggatatggtgcttctctatcaagttttattctttccacttccaatccctaa

SEQ ID NO: 7965 - DNA, 480 bp, Glycine max
  Peptide Sequence Number=SeqID_124743
atggcgcttcatcgctccattataagcaaaacgacgtggtacaatgtcctattatggatgatggtggtgctcgtgagagtgcacggtgcagccgcgaggctgaaccgtaaggagtgggactcagtcataaagttaccgactgaaccggtggatgctgactcggatgaagtgggaacacgatgggcggttctcatggctagttcaaacggctatggaaactacaggcatcaattgctgataaaaggtggactaaaagaagagaacatagtggtgtttatgtacaatgacatagctaccaacgagttgaatcctagacatggagtcatcatcaaccacccagagggagaagatctctggattttattaccaggtggagatgaagcaggtcctacgaaacctatatgcctaagtcaagatgagattaaaccctgcacaacgggtacgcctttagttgctcatacttacaatgtagttgcataa

SEQ ID NO: 7966 - DNA, 434 bp, Glycine max
  Peptide Sequence Number=SeqID_124744
atggacttgaaagaaaattgtacttatgtcatgcacaattttaaagtgctaaaaaacaatggtcagtacagagtgtgtgatcatcaatttaaattggtgtttattggggttactattgtggctgaccagtttaaacctggactattggttgatgttattggtgttgtggaggaggttgtctttcgacaagtttcaggaaaaggtagaagggtagtcttcaaactaaaggacttgagccagcaattgctatcttgcattttgtgggatgattattgctcacagtttttgaagttcttagatgattatgaaggtgatggcccaatttacagttctattgagccattgatcttatcctacatcgatcaacaattctttcaaggcttcaagttaattattaaccagcccgtgatggagattcaagaattcaatgaacg

SEQ ID NO: 7967 - DNA, 471 bp, Glycine max
  Peptide Sequence Number=SeqID_124745
atgttgttgctggtggcagggggaaaggtctttggagtaggtggcacgatacacactgttgcttatggagatgatgtagtaagggtgtgtgttgaaactgtatacgatgctgaagccattgtcccgttacccacttcagagattcagtatgtcagggacgccatgaactcattcattggatggcccatacatctagtgaaacctttatcttatgattctgaccttaatgtgcggaagccaattgaacatagtagtgatgcaaagcttgcaggtgaatccgatccattgggagagttgatgaagatattgttttatgtgtaccagaatccaatggaagtgccgtgggaggctcaccaatttggacttcctgagattggggcaaaattttacatcacacatgcagatctagcggaaataatatcaggtgacaagtgtttaaacatagcgatactacaattgtgggccatgtaa

SEQ ID NO: 7968 - DNA, 165 bp, Glycine max
  Peptide Sequence Number=SeqID_124746
atgaaaaagaaagccttaagtactctatatgcagaacttgaagaagacagaagtgcatatgctatagcagccaatcaaacaatggcaatgataaataggcttcctgaagagaaagcaacaatgcagatggaagccttgcagtatcaaagaatgatggaagaataa

SEQ ID NO: 7969 - DNA, 1296 bp, Glycine max
  Peptide Sequence Number=SeqID_124747
atgactaacttaaaacgattttctaagatttgtatcttttcccatcctcaccattgggccaattggaactttcacgtaggatttgacattagggctggcccaataatttctcttgcttcaatatatgatcttcaaaagcaaagacatcgtcgggtactgtataaaggattcataccagagctatttgtaccataccaagacccaactgaggaatggtattacacaacatactttgattctggtgaatatggttttggacagtctatgtcttcactgcagcctctcaacgattgccctcccaatgctgcattcatagatgcatactatgctggatcagatggtaccccggtaaaaatagctaatgccttttgtatatttgaaaagtatgctggtgatatcatgtggcgtcacacagagatttcaattccaaatgaagtgataactgaggccagatctgatgtaagcctagtagtgagaatagtttcaactgtgggaaactacgactatgtcatagattgggaatttaagccaaatggctgcatcaaaatcggggttgggcttactgggatattagggctaaaggcagggacatacaccaacacagaccaaataaaagaggatatttacggcacactaatagcagataataccattggtatataccatgaccacttcttcacctattatcttgaccttgacattgatggtgaagccaactcctttgtgaagtccaatttggagacagtgagagtgaaagatgacaccacacccaggaaaagttattggacggttgtaagtgaaacggctaaaactgaagctgatgcaaaaatcaacctagggtccaagccttcagagctactagtggtaaatcctaataaaaagactaaacaaggaaataaaattgggtaccgtttgcttccaggtccagtggcacacccacttttgcttaatgatgactatccacaaatcagagctgccttcaccaattacaatgtatgggtcacaccatacaacaaatctgagaaatgggtaggagggtcatacgtcgatcgtagcagaggcgatgataccattgctatttggagtctcagggatagggaaattgagaacaaagacatagtattgtggtacacaatgggatttcatcatgttccttcccaagaagactatccaattatgccaacgttgagtggtgggtttgagctgaggccaaccaatttcttcgagagaaacccggttcttaaaacaaaatcacccaagcctgtgcatttccctaactgcacttctcaacattag

SEQ ID NO: 7970 - DNA, 2034 bp, Glycine max
  Peptide Sequence Number=SeqID_124748
atggatacaaccatgaaggtgatgctgtcatttatcctcatgctcttatggagctgtgtagaatgcaagaaccatcctcacccacaagaccctctaaccccgtctgagttcaacgatgtacgaaccattgtccaaaacgcatacccaacctcccataatctcaccttccactacgtagccttggacgaacccaacaagtccgaactcctctcatggctatcctcaaaccctaaaaccaaacctacaccatcttctccgccaccacctcgccgggccttcgccatagtccggtcccaaaaacagtcccacgagatcacagtggacctttccactcgttccatcgtatcaaccaaagtctacgaaggaaatggataccctatgctgaccttgggcgaaatagcagtggcgacacggttgccattcagctacgaaccgtttaaggagtccgtgacgaagaggggtctcaatatctctctggtgcggtgtaatgcctacagttttggttggtttggagaagccaagaccgtacggagcgtcaagattaagtgccattacagaaatgggactactaatttctatgccaggcctttggaaggggtggcagtgttggttgactttgataatatgaaaattgttggttacaatgatagatatgtggttcctgtgccaaaggcagagggcactgagtatagagcatctaagctagaaccaccctttggtccaaagcttaagggaatagctttcaagcaagacggtggacctggattcaccatcgatggtcattccgtaagttgggccaattgggtatttcatgtaggatttgacattcgggctggcctagtaatttctcaggcatcaatttatgatctccaaaagcagaaatatcgtccggtactatacaaaggattcgtatcagagttgtttgtgccataccaagacccaagtgaggaatggtattacgcaacattctttgactctggtgaatatggtttgggacagtatatgtcttcattgcaacctttgaccgattgtcctcccaatgctgaattcatagatgcatactatgctagttcagatggtacccctgtaaagatatctaatgccttctgtatatttgaaaagtatgctggtgatatcatgtggcgtcatacagaagttggaatcccagatgaagtgattactgaggttagatctgatgtaagcctagtggtgagaatggtttcaactgtggccaactacgactatgtcatagattgggaatttaagccaagtggcagcatcaaatctgtggttggacttactgggatattagggcttaaggcagggacttacaccaacacagaccaaataaaagaggatatttacggcacactaatagcagataataccattggtatctaccatgaccacttcttcacctattatcttgaccttgacattgatggtgaagccaactcctttgtgaagtccaatttggagacagtgagagtgaaagatgacaccacacccaggaaaagttattggacggttgtaagtgaaacggctaaaactgaagctgatgcaaaaatcaacctagggtccaagccttcacagctactagtggtaaatcctaataaaaagtcaaaacaaggaaataaaattggctatcgtttgcttccaggcccagcagcgcgcccacttttgcttaatgatgattatccacaaatcagagctgctttcaccaattacgatgtatgggtcacaccttataacaaatccgagaaatgggtggggggcttatatgttgatcgtagcagaggcgatgatactttggcggtttggagtcgcaggaataggaagattgagaacaaggacatagtattgtggtacacaatgggatttcatcatgtcccttgccaggaagattttccagttatgccaacattgagtggcgggtttgagctgaggccaaccaatttcttcgagagcaaccctgtccttaaaacactatcacccaagcttgttggctggcctaactgcacttctcaacattag

SEQ ID NO: 7971 - DNA, 1989 bp, Glycine max
  Peptide Sequence Number=SeqID_124749
atgatcagaaggtttgataaagcagttcccatgattgttcaatgtctcattctagtcctttttctgaaattcaactccgttaatagtttagctcatcctttagaccctctatcccctgctgaaatcaacaaaacaagggacatagttcaagggtcttaccttggtgctattcctaacattacctatcattttgtggatgtcgaagaaccagacaaaaaaaatgtcctagagtggctatcttcaaatacaaaagacaagcctattattcctcgccaagccactgtagttgttcgagtcaaaggtgagacacacgagcttgtagtggacttaaccaaaaggtccattgtatctgataaaatctacactggtcatggataccctcctttcacattcaatgagctttttcaagccagcaaattgcctcttacctaccccaaattcaaatcatcaatagccaaaagggggttgaatttgtctgaagtttcttgtgtaccatttaccataggttggtatggagaaaaaatcacaaggagagccctcaaagtgtcatgcttttataggggaggatcggttaatgtgtgggcaagacctattgagggaatcacagtgctagttgatgttgattcaatgcagattactatgtacaatgacaggtacattgcccctttgcctaaagccgaaggcacagattttcaatcttcaagcagcaacagcaacagcaggcccaaagcatcatctgcttcatgtaatgggtcagatattactgggttcaccatcaagggccatgaggtcaaatgggctaattgggttttccatgttgggttcaatgctcgggcaggaatgatcatatcaactgcttctatatttgatgccagaacacaaaaatatagaagagtgctatataggggtcatgtgtctgagacatttgttccttacatggatcctacagaggaatggtatttcaggactttcatggatgctggtgaatttggctttggacgtgcagctgataccttgcaaccgaaggttgattgcccgagcaatgcagtgtatatggacggttacatggcagggcctaatggagaggtgcaacaggttcccagggctatttgcatttttgagaggaattctggcagtttggcttggaggcacatggaaatcaacaacccccaaaacttgataaggaatggagaacctgaaattactttggtggtcagaatggttgctactgtaggtaactatgattatgttcttgattgggaattcctaagaagtggtagtataaaagttggggtggatctgacaggtatcatggagatgaaagcagtaccctatagacagaaaagtgagataaaagaaagggtgtttggaacattagtggctgaaaacactatagccaactatcatgatcaccacataacctactatcttgaccttgacattgatgatagtagcaactccttcatcaatgctaagttgcaaagggcaagagcaactgggtttcgaacaccaaggaagagttactggacagtagtcagagaaattgcaaagagggaagccgaggggagaatacggctcggcttggagccagctgagctgttaatagtcaaccccaacaaaaggacaaagctagggaatgaagtgggttaccggctgatcagtgcacacccaattacttctctgctatctgatgatgattaccctcaaagaagagcatcttacacaaagtatcagttgtgggtcactgcctataaccgatcggagagatgggctggagggttctatgctgataggagccgtggtgatgatggcttagccgtttggagccagaggaatagagagattgaaaatacagacatagtgctatggcacacaattgggatccatcacgttccttatcaagaagattttgcagcaatgccagcaattcatggtggttttgagctaaggccagctaactttttcgaaagtagtccattgcttgaataa

SEQ ID NO: 7972 - DNA, 911 bp, Glycine max
  Peptide Sequence Number=SeqID_124750
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatggcatgccaaaagtacttgtgatgcaatgtaaagtctctcacagtcatgtgagactttacactttaggggttgatgtggatagaagaagattgatggataaaggaagagaaggggtagaaagaggatttttcctatttgagatactcaggctttggatgtattcattagagagatttgagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 7973 - DNA, 1455 bp, Glycine max
  Peptide Sequence Number=SeqID_124751
atggggaagaaaacagagctgaaagatcacaaggagatagccaaagttgaaactgttcttgagcttctcaggaaacaaacccctctcactgtgaaacaggagaagttttgcaactatgcttgtgtgaaacggtttctgaaagcaaaaggggatagtgtgaaaaaagcttcgaagcaactcaaggcttgtcttgcttggagagagagtgttatcgctgatcacttgatagcagatgatttctcagctgaactggctgatgggttggcctatttggctggtcatgatgacgaatccagacctgttatgatttttcgtttgaagcaagattatcaaaagttgcattcccagaagatgttcactcgtttgctggcctttacaatagaggtggccatttcgaccatgccaaaaaacgtagaacaattcgtgatgctttttgacgcaagcttttacagatcagcatctgctttcatgaacctattactaccagcactgaaaattgtggcggagtactacccaggaaggctatgcaaagcgtttgtcatagaccctccctcgcttttcgcttacttgtggaagggtgtgaggccgttcgtggaattatcatcatggacgacggtggtatcatcgttggatttcgaagaatcgttggacttcaacgacttcgcggcgtacccgcgagcctcgtccctccgattcgacagcgcgagcgtgaaatcaacggcgaagataggctcgtgctcctcgtcacggttctccttcaccgtatctcaccaccttgactcgttgaagccctggtacctgagcctggccgacacgtcagcatccaaagtgggacccacgagtccttcggccgcactcatctcgccgctgaacgcgcgctcgctctcgttcgcgtcgcccgtcgcgagaaccccccgaggccccccggccaccaggaagggcctcttcccctcaacgccgctgccgcagcgcgtgacggcgccgccgcggacctcgttcctccagtcgccggcgacgttcttcaggcgagatagccacgttgccgccaagggagagaggtgccgggaatcgttcttgccgtatgtgaagttctaccgaagaccatacgacgaaatggcaatattggaagtaattgcatgggaagaaggtagcgtggtcgaaacgacgagcactagaagtgcacattggtgggaaatagaatatgtgtcgggtttggttgtacgagtgagaagtcaaaacttgcttggagtgagtgaggtactactagcttacaagttctctccaccatatgatgtagcagctggttcacaacaacaacaaggagtgatgagtgatgcattaagaaacagaatcctcattcaccatttaatgtatatccagatgtttggggccgggaagggctacaacctagctagggagtgtagtgtagtaggatctgagcaaagaaacaagtga

SEQ ID NO: 7974 - DNA, 570 bp, Glycine max
  Peptide Sequence Number=SeqID_124752
atgacatccttttacgtgcctcagatgcccctccagtcaaaggcctccttgaaactcatccggctaacttctggtctaggtgcatacacaacatcacgcactcacaacaatgcttcatggttgttattttgggagagacacatgaaaagactttcacaatctatacaaattctatcgaatttggcgccagagcttctatttaaatctaataattctgcaattctgttaccatcatcagcaaccttgccaatatggcaacccaccgttcagatgcttgttaatgattcggtgtgcaaagtcttgccgattgcattgaaagagaggaatgattgtgaggaattggccattacaactcttgttagtggtaatttggaggaattaaatgcatgtgacaccttcagtgaggaaagaatgagtaaaattcttgatgtgcatgtgcatgttgagacttatgttcctcctacatttggtatttggggaaatggtgtacatttggctgtagtgggctatgggaggaatgttgcagctgctaaatattcagattgggtaaggtcagtttatgcaatttga

SEQ ID NO: 7975 - DNA, 570 bp, Glycine max
  Peptide Sequence Number=SeqID_124753
atgtcaaaggttgaaggttccaagtacgaggaacttagaatgcagagaatttcagagaatcaagcaaaaatagaagctttaggattgtccaaattggtcaccattttcaaggataaaattcaaaaagctaagaaaaaggataaaaagaaggccaacgatgatgttgaagactacgtgatgaaatcatcgatattgagttctaaaagagtttataatgattcatccatacaccactctcttgataaagaagtgaaggagtctttacctaataatgcatctcatgcctcagaatttaccaatgtagaacaagttgaatcaaacgcaggcgagcatgtcataaagaagggacgtgggcatacaataaatgcaaaattccaaaagaaaaaagaaaatcttatggcaaagggaaaaaatatcgacatccaatttcctccaccattttataagatttgcaaaaaacatgcaaaatatttcaagtctgaggcacaagtgtgtattcgtcagaaagctcctttacaagttaatggttggagtgaaattagtaaggatgatgtagatgaaatgtggtga

SEQ ID NO: 7976 - DNA, 351 bp, Glycine max
  Peptide Sequence Number=SeqID_124754
atggtgcttgaagaaggacgagttttggaagcggattctatggcccatagcattgtattagaggccagagagcccggttctataaccctgcatgccctctttctcagttactattcttctaaacgaggaaaatctcttgaccccgaagtgtaccctccccacacagggagagtaataggagaggttccaggggtgaaggggtgttatgttgcaacagggcataattgggataatattcttaatggtcctgccactggagttgttgctgagcttgttattgatggacattccaacattgttaatcttaagcgctttagtcccaccagattcctggggcgtagaaaggcttag

SEQ ID NO: 7977 - DNA, 579 bp, Glycine max
  Peptide Sequence Number=SeqID_124755
atgagtgaaatagaagaagtgcaagaacagatgaaggccgacatggaggccatgaaagaccaaatggccgccatgatggaggccatgttgagcatgaagaaaataatggaaagcaatgcggttgcagttgccactacgagtgtcaccactgagagcaagcattcattccctggcttgcctcccaactacgcaccacccaatgttgcacacactcacgatgagaatgtcgacaacttcatgcccccatacccattgagagccaaaaaccccaatctgatcatgcacatagtccctcctgctatggtggaaagggaaaaattcaatcagagagaggaaagactgagggctattgaaggaggcggagatcatgcttttgctaacatggcagagttgtacctagtgcctaacgtcgtcatccctccgaagttcaaggtgtcagatttcgataagtacaaggggactacttgccccaagaatcacttgaagatatattgcaggaaaatgggggcatacgcgaaagatgaaaaattattgatgcatttctttcaggaaagtcttactgagatagtcgtcacctag

SEQ ID NO: 7978 - DNA, 294 bp, Glycine max
  Peptide Sequence Number=SeqID_124756
atgtattgtcggaggatgggggcatacgcaaaagatgaggaattgttgatacattccttccaagaaagtcttactggggtagctgttacctgtgaagaggatgagaaggagggagaaacctatgctgtgactgccattcttatacgaccaagtttcccaccaacccaacaatatcattactcagccaataacaacccttctcattacccaccacccagtcatccacaaaggtcatccctaaaatcaaccacaaagcctacctaccgcacttccaatgacaaacaccacctttag

SEQ ID NO: 7979 - DNA, 207 bp, Glycine max
  Peptide Sequence Number=SeqID_124757
atgagtgactatgaatatactataaattggatcagttcaattattttgcaaaggcctacacctactgctgggatgcctaataaaggtcctcttcatcatcatcacaacataacatacgttgaggtccttgatggataccactatgagttgaggaagtcaccatacaatatcaaggagtgtagaagggggcacgccacatctctttga

SEQ ID NO: 7980 - DNA, 201 bp, Glycine max
  Peptide Sequence Number=SeqID_124758
atggctcttttctcaaccattgagccaaagaacattgatgaggcactgaatgaagattcttgggtgactactatggaggaggaattaaacctattcacaaagaacaagactgcccaagttagttttagaagaagcaagattctgcaacttacgatagttgattacctagttccacgaaacaaagaaaagctctctatctga

SEQ ID NO: 7981 - DNA, 900 bp, Glycine max
  Peptide Sequence Number=SeqID_124759
atggggataggtttttttgtgctgcttaacctactggtatatgggttgctgagccatgccttacgtccggtcaggcacatcttgcacgccattagtcgaatagaacagggggatttaaccactcggctagaacgtttttcagtgccggaatttgacaagataggcctgagcctcaaccagatggcggtgtcgctggatgcggagcggcagcttgagcaaaaccgccaattaacacagctcattcagcagcatattgaagatgagcgtcgtagtttggcgcgtgagctgcatgatgagctggggcagtatgtcacagcgatcaaaacttttgccgtggctattgtcaataaaaccaaggaaaatgcgccagacattgctgcgagtgcacaaacgatcgttgccgctgccaaccacatttacgatggaatgcataatattattcgccagttgcgtccggcagccatggacaatatggggctggtggaaacgcttagtgatatggtatcaggctaccaggggcaacatcccgagttaagtatccaattgcatttgtccgggcaatttcagcctctgggtgaaaatgtgaatatcaatatctaccgcattgtgcaagaagcggtcaataatgccattaagcatgcccatgcccaatcaattaatgtgcacttgctcaccgctgctgaaggtttgcgtttgatggtttgtgatgatggtgtggggatgcgggtagagagtgtcgaccagacccagcattttggattacttggcatgcgtgaacgagtacaggccttgcatggccagtttaaagtgatttctcagccagatgctggccgtggaaccaccttggaaattagattgcctatacaatcagcagaagagaaaagggagagaaacgcgtga

SEQ ID NO: 7982 - DNA, 294 bp, Glycine max
  Peptide Sequence Number=SeqID_124760
atggagctttatctacagcatttggttcgccagcaggtggccaaccaccgtgggcaggtgcagatacatgagtgtctctactggttcggcctcagtcagcaggggcagggttccaccccttttgcattccctactccagagcagtttggggctgaggtcgcatggcccggagactggcccgaggcccaggcaggggaggagcctgcaggattccctggtgaggcagatgaatcccatatggatgaagatatgactgacctactcggtttcttgggagggagtggagccgcgtga

SEQ ID NO: 7983 - DNA, 171 bp, Glycine max
  Peptide Sequence Number=SeqID_124761
gtggaggatgttgatgaagagaaggagaaggaagaaaaaaagaaaaagaagattaaggaagtgtcacatgaatgctccttggtgaacaagcacaagcctatttggatgagaaagcctgaggagatgacaaaggaggagtattctgccataatgaaagagtctcaccaatga

SEQ ID NO: 7984 - DNA, 366 bp, Glycine max
  Peptide Sequence Number=SeqID_124762
atgagccttaactctcagaatctacacttgtggtggagactcttatccttccttcttctacttcttcaatttgttacatctcaatttgttacacctcttaactctgatgggattcacctgcttaaattcaaatactccatcctcagcgacccattatcagtcttaaagaactggaactacgacgatgtaacaccatgttcatggcatggtgttgcatgcagtgaaattggagcccctggtacccctgactttttcagatctggatgctgtaaacctgcagaagaatgccagtttagctatgtgaatccaacgacatggatgaagcccacaaatgtgactaatcagagcaatccaactgactcttga

SEQ ID NO: 7985 - DNA, 192 bp, Glycine max
  Peptide Sequence Number=SeqID_124763
atgttgtacgggattgaagcggtcattcttgtagaaataggagaactaacatttagaattgcaaatatgaatctaagcatgaatgaaggaaatcatagaattgagcttaatctcattgaggaaagaagagaagtagttgttataaaagatgcgacattgaaaagaaaaatagtagccagcctaaattactaa

SEQ ID NO: 7986 - DNA, 261 bp, Glycine max
  Peptide Sequence Number=SeqID_124764
atggctcaaggattgtgctgttatttgtccttacaagagatgaaacaagcgaccaagaattttgatgagtcaaatgtgataggggtaggagggtttggaaaggtttacaagggtgttattgataatgggttcaaagtgtctatcaaaagatcgaatccgcaatcaaggaggcatcaattgaccgagaaatcagatgtgtactcatttggggttgttttatttgaggcactttattttaggaaggtagctttggatacttga

SEQ ID NO: 7987 - DNA, 987 bp, Glycine max
  Peptide Sequence Number=SeqID_124765
atggagctttctgcaccttcttcaccctctcttctaagatgtccttcatccctgcttctgaattctagggttagggttttccatacaatacccaaccccacacgcccacctttccaagcttcaatcttttcactcaaccaacgcaatctcactccaatggatcttcccagaaacgtctcctccgctgccttggtgggagacaacgcttcggccacgaccactttgccaattgactcagatgctagaatcggagaggttaaaagggtcaccaaggagaccaatgtatcagtcaaaataaacttggatggttctggggtggctgatagtagtactggaattcccttcctcgatcatatgcttgatcaacttgcttcacatgggctgttagatgtacatgtaaaggctacaggtgacatacatattgatgatcatcacacaaatgaagacgttgcccttgctattggaacagctttgctgcatgcccttggtgataggaagggtattaaccggtttggtaacttctctgctcctcttgatgaagcattgatacatgtttcactggatttgtctggccgaccacatctaagttataatttggacatacccactcagagggttgggacatatgatactcagttggtggagcatttcttccaatccctggtgaacacgtctggtatgacacttcacattcagcagcttgctgggaaaaattctcatcatattattgaggcaaccttcaaagcttttgctcgggctcttcgacaagcaacagagtatgatccacgtcgccgtggaactataccaaggtatgttcgaaaggggttctgtcccgtagctaatatttttctggcggtggaccttcatggctccacaatcacagtccttagatgctgtgtgatggataaatgcttgtgcgggggcacattgagtatgactaatgttatactgttttgcggaggtatagaagaagagcacatggaataa

SEQ ID NO: 7988 - DNA, 2112 bp, Glycine max
  Peptide Sequence Number=SeqID_124766
atggtgctgcatgtgttgaggcagagtgctgtgagtttgtggaagttgatcccacgggaagatatggaagactatagagcatttgatgagtatgaagggatagaaaatcctgaagatcttgagaggttatacagtgaaattcatcttctcaagacattgaaacacaagaacatcatgaagttgtatacttcctgggttgatactgccaacagacacattaactttgtcactgagatgtttacctctgggactctgagacagtacagacttaaacacagacgggtgaatatcagagctgttaagcattggtgcaggcagattttggaagggcttctctatctgcacagccatgatcctcctgtgatccatagagatctcaagtgtgataacattttcatcaatggcaaccaaggggaagtcaaaattggtgatctgggccttgctgcaattctccgcaaatctaatgctgctcgctgtgttggcacacctgagtttatggctccagaagtgtatgaagaggattacaatgagttggttgacatatactcttttggaatgtgcatcttagagatggtcacttttgaatatccttatagtgaatgcaaccatcctgctcaaatttacaagaaagttgtatctgggaagaagccagaagctctttacaaagtagacaatcccgaggttaggcagtttgtagagaaatgcttagcaactgtgtccctcagactttcagctagggaactcttggaggacccttttctccaaattgatgattatggatttgactcaaaagttttgcagtatcaaagagattgttatgaagtaacgccattaattagacaacctgtgaatggaatttgtatcattaacaacaacttaatgagtggggacactgataatattggtggttatgggcctgtatctgaattggattatcatcaagacgattttgaagcgactgaaattggtctctttgattgtgaagaggacgacaatttggctgaagttgacaccacaatcaaaggtagaagagaagacgatggcatctttttgagactcagaatagcagataaggaaggtcgaattagaaatatctacttcccatttgacattgagactgataccgcattgagtgttgcaaatgaaatggtagctgagctcgacataaatgaccaagatgtaacaaatttagcaagtatgatagacaatgaaattgcaagattggtcccagagtggaaaacaggacccagaatagaggaaaaatcagaatgttcaagtgcaagtgtctgcctcaattgtgctgcaaacggttccttgtttgattatgtatcatcaaataatccatgtggcaagaaccttcaatttcttcattgttctaaaactggatgtgctgcagttcatggccgatttgaagagataacataccaagttgaagggtctgaaaatagtgctagagaaggtgcactggatgaatcaagccaatccaatggcattcaatatacagatatctgggctcagagagatgaaccggatttatgccatgaagagttaaaagagatgcactgtgaccaagctcatgaggcatcaaactcatcaaacatcaaggaggatagaaaaactgttaatgtggatgaacaaagtgatctcaataccaaaaagtcttcttcaaaccctgcaccaaattgtgttttcttggactatgaaaatgaaataaggcaagaactaagatggctcaaagcaaagtaccaaatgcagttaagggagcttagagaccaacaactagggcgtaaaccaaaatttactagcatatctcctgaccccgaaaaattggagcatttgaaagatggaattctgaggctatcagatacacccaatttgaagatacaaaacaataaaccactattgagaactatagtttctgggaagcattttcatgttgaatctgagaaatgcaacactttggctgatcaaatggttcaaaatgttgatgagatttgtcagtctaacagtcctgagcaaatgatcacagccagggatttctttacaggagtattgcttccacactcacttcagagggcaacctcacttcctgttgatgcagtagatgtctag

SEQ ID NO: 7989 - DNA, 526 bp, Glycine max
  Peptide Sequence Number=SeqID_124767
gattaggaaatctctggaaaagctcaggcctccctcagtgacagaactgttgctgtctaatgatggggatcagatcctcgaaggttgtgtgacaaatttttttgttgtttgctgcaaggaaaggaattcaaatgatgagaaggccctgtgtgattatggaaataaatactcttttgaagtacaaacagctccgatcagcgatggtgttcttccaggaacaatacgccaactagtgcttgagatatgcaggagtgaaggaattccatttcgagaagttgctccatcatggtcagaatgtgaaatctgggaggaggcattcatcacaaatagcttgaggcttttacaacatgtggatagtattcaggttccaacagaatggcaatcagcccattctaaaacgtggaaggatatatcatggacaaaaaagcaatttcaggtgggtggacctgggatgatcacaactattatccaggttgaagatcccactgagttgctaatatgctgggatgaaacggacaatagttga

SEQ ID NO: 7990 - DNA, 612 bp, Glycine max
  Peptide Sequence Number=SeqID_124768
atggtctctggtaatcgattaccaaaggagtgtaatcgattaccaggcttgaaaacgaggcagcatgttgtggaggcctctggtaatcgattaccaggctgtgtaatcaattacacagaggaacatgccactggtaatcgattaccagttatgtgtaatcgattacacagtgcatttttgcagatcgtgatggcggcgcagctaatccatgatcgagtggagatggagtgcctagagggagcttgggagaccctcgaaggctacatgaggtgccgatttcggggcacgattcgatttacagctacttcattggtgcatccagatgaacccgcgcgcacgcttcaacatactgtggagtggatactacccacgcctacaccataccgtctagtggagccagtccaagtgattgaggtaacgtcatccgaggaagaccttgaggagctacctcctgagcctgctgtagatgctcttgactttctagagggtgatgaggacccactccctgaggtggattctcccgaggacgtcgtgtcggcatctgaggcacactctacggaggatagtggccctggagagatggcgatcagtggaggctcttcatcaaagtag

SEQ ID NO: 7991 - DNA, 628 bp, Glycine max
  Peptide Sequence Number=SeqID_124769
gtctgcaaaagattttccagatatgcatgctctcattatgcacacatacaacccagataatgccgattcacgtattgatcatttgggattacacaaagctctgtgtgttttaatgcgttggaactactcaaagcctcctgataactcaaaggcatatcagtttttacctgctgatgaagcagcagcaaatcaggatgatctgatcatgtggccacctttggtgatcattcataacacaaataccggaaaaaatagagatggtcgtatggaggagcttggatttgtgggtggcaaatcaaagtcattatacggaagagatggtcatttgggcataacactggttaaatttgctggggaccaatcaggctttaaggaggccattcgacttgctgaacactttgagaaggaaaaccatggacgcaaggattgggaccgtgtgcagtcacaaacattaggaaaggatgatgagaataatgcaaaccttgtgaaggtggatgagaaaaaagtagataaaaggagggttttgtatggctatcttgggactgcttttgatcttgacaaagttgattttgacacaaggaagaaggctttcatagagagcaggagagaatacaaaccacccatgtag

SEQ ID NO: 7992 - DNA, 279 bp, Glycine max
  Peptide Sequence Number=SeqID_124770
atgtttagtggtatgcctcagtccaatgccgcgagagctcctcaacaccgcccgctgcaacctctgtacttctcggtggggagactgccttcgtccatggaggaaagagagaagttggatctcatagaggagaggctgagggtcatcgaagggatcgatgattatttgtttgctgacatggtggagttgtgcctagtgcctgacgtcgtcatccctccgaagttcaaggtgccgaatttcgataagtacaaggggactacttgccccatgaaccactga

SEQ ID NO: 7993 - DNA, 2469 bp, Glycine max
  Peptide Sequence Number=SeqID_124771
atgggactggtaactgttcttcagcttcaactgcagccatcattatcgttctcccttgattttggtggaaggttttcatgctcctcaacctcaaactccacacttctaagggtttctgtcaagtgctctgctctttcaacaccgttatcgttaggtgactttcttgttgctataaatatgcagaaacttcaaataagaattttctcaagtttcaatattcttaccggggaaaacacatgttcgtctaaatggggttctgagtttcgtgtgtcttttattggccaaattgcaatgaattgtactgaggctgtgaaaggtgagaagggaaatgaagtggagtcaactaatatactggaattcattgaccaatgtacaaacacaatgcagctaaagcaaatacatgctcacatgctccgcacatcccgcttttgtgatccatatactgccagcaaattgctgactgcttatgctatctcatcatgctcttgcctcatatatgctaaaaatgtgtttaatcaaatcccgcaaccaaatctctattgttggaacacccttattcgtggatatgcctccagctcagaccctactcagagtttcttgatttttttacatatgctacattcctgttcagaattcccaaacaaattcactttcccctttctcttcaaggcagcctcgcggctcaaagttctgcatcttggaagcgttttacatggaatggttattaaggcatccttgtcttcagacttgttcatactgaattcgctgataaatttctatggttcaagtggggcaccggatttggctcatagagttttcaccaacatgccaggaaaagatgtcgtttcttggaatgctatgataaatgcctttgcacttgggggcttgcctgataaggcattgcttttgtttcaggaaatggagatgaaagatgtgaaaccaaatgttatcacaatggttagtgttctttcagcttgtgcaaagaagatagacttggaatttggaaggtggatctgttcatatattgaaaacaatgggtttactgagcacttgattttgaataacgcaatgcttgacatgtatgttaaatgcggttgtattaatgatgcaaaagatttgtttaataagatgtcagagaaagatattgtttcttggacgacaatgcttgacggtcatgccaaattaggaaattatgatgaggctcactgtatatttgatgcaatgcctcataaatggactgctgcatggaatgccctgatctctgcatatgaacagaatggaaagcctagggtggctttgtcactcttccatgaaatgcagctcagtaaggatgcaaaaccagatgaagttactcttatttgtgcattgtgtgctagtgcccagttgggggcaattgattttggtcactggattcatgtatacataaagaagcatgacattaatctaaactgtcatttagcaacctctctccttgatatgtatgctaaatgtggaaatctaaataaggcgatggaggtgtttcatgcagtagaaaggaaagatgtgtatgtttggagtgccatgattggtgctctggcgatgtacgggcaagggaaagcagccttagatttgttctcaagcatgttagaagcttatatcaagccaaatgctgtgacatttacaaacatattgtgtgcttgtaaccatgcaggactggtcaatgagggagagcaactttttgaacaaatggaaccattatacggtattgtgcctcaaatacaacactacgtttgcgtggttgacatatttggacgtgcaggtcttctggaaaaagctgcatcattcatagagaagatgccaataccaccaactgctgctgtgtggggagctttgctcggggcctgtagtcgccatggaaatgtcgagcttgctgaacttgcttatcagaatctacttgaattagaaccttgtaaccatggagcctttgtccttttatcaaatatatatgctaaagcaggggactgggagaaagtttccaatctaagaaagcttatgagagattctgatgtgaagaaagaaccttggtgtagctcaatcgatgttaatggtattgtgcatgagtttctggtgggtgataactcccatcctttttctcaaaaaatctactcaaagttggatgaaatttcagaaaagtttaagccaattggttacaaaccagacatgtctaaccttttgcaacttagtgaagaagataacttaatggagcagtccctgaatgttcatagcgaaaaattggcaatagcttttggacttattagcactgcatcgtctcaaccgattcgaatagtgaagaatattcgcatttgtggagactgccatgcctttgctaaacttgtttctcaactttatgatagagatatattgttgagagaccgctatcgtttccatcatttcagaggagggaaatgctcatgcctggattattggtga

SEQ ID NO: 7994 - DNA, 222 bp, Glycine max
  Peptide Sequence Number=SeqID_124772
atggaatctacagctgctgttcttctttggaaacaacacctttatagatttggagaagtaacaaacgatataatccagtcatatgctaaagttatgccttctccagatcccaaaatggaatctttgttggttgaagctaagttttcatatgttgcaaagctcggacaagttaagatcgacgatactttagtgactgctttggttgaaaaggtggagacctga

SEQ ID NO: 7995 - DNA, 177 bp, Glycine max
  Peptide Sequence Number=SeqID_124773
atgtggggtggtggtgacaaggactacaaggaggtacccccacctcctttgtttaaacctgcagggagacacatcaaccaagctatgaccttcaacagatcttattacaaggttcaaattataggacaattgtgcacgtactataacctgaacagccatccacaaggcttgggttaa

SEQ ID NO: 7996 - DNA, 603 bp, Glycine max
  Peptide Sequence Number=SeqID_124774
atgaacagggtacttgaacaagctctggccaccgaggtgaaggtgatgcgcaaacgagctagcgcaccattcaaagtcaaccccttgaaacactataggtaccatagaaaccaaggacattccattgaagaatacacaacactaaaagacaaaattgaagatcttataaaaaaaggttgcttaaaagactttatccacaagtcacagtcgactgaacaccaaagctctgataggtacggagagcatgatagaggatataggttagatagaaataggtcgagaagagacaaaagagtagagatgtacaacataacattcacaagtgtagactttaagggactagatctagaacaagatgatcccatggtgattaccatcgaggtggccaattgctttttgaacgtaccagagttaatgcttcagccctgtgatgacctgttctttggatttcctggagaaagggtgcctacaagagggtctatagagttaatgacaaggttcaacaccaagaagagtgggtacaaggatattgtagtcaaatacgtggtcattcacgccagtacatcttacaacatactgcttggccgaccattaataacataa

SEQ ID NO: 7997 - DNA, 357 bp, Glycine max
  Peptide Sequence Number=SeqID_124775
atggctatttatagagaaaaagccattttgaggcggttaaagttcgcccaggctaaggtggacaagctgaaagagccaatgtctagggccgaggaggagatagagaaaggaaggaatgaataccaaattctggcgcgaggtgctcatgaaaaggtgtttaaaaagcaaaaggccaggtttgacaaggctatttggcaagatgtgcacgaaggtgtcttgatgtcaatcaaagacattccgaaaaagactctttgtgcaagcttgacacccactcccctgactaatactttgctaaccaattttgacttaggtgaagaggaggaaagacagattgatgaagttgaattcaataactag

SEQ ID NO: 7998 - DNA, 2316 bp, Glycine max
  Peptide Sequence Number=SeqID_124776
atgggttgctacagctcaaacccggacctctctaatccctattacctccacccaaatgacaacccatcactggttttagtatcacctcctctggacgggaaaaactaccattcatgggccagaagcatgaaattatctctcatttcaaagaacaagctgaaatttgttgactgttctctaagccaaccaagtcttttggacctattctatggagcatgggagaggatttacgtgataggttctcaccaaggtgacctcacggtaacagattactttaccaaacttaagactatatgggatgaactagaaaattttagacctcttcctttttgcaaatgtgtcattgcttgtagttgtggagcagttagcatgattaaaaaatacagggatgaagactatgtaattcgttttcttaaaagccttaatgaacaatactcgcatgtgaaatctcaagttttgatgcttgaaccattgccaccattaacaaaggttttctccatggttgtgcaacaagaacgccaaatgaatacaacagtcattccagattccatttctaatttgaatttggcattaaatgctgttgcaaatcaatttcaaaaggaaaattatggaaaggaacctttgctggcaaaggtaaaggccgaggcatcgctccactccagaaactcaaagaataatgatagtagcataaactctgttgcatcttcagtggacgtgtctaccgatcttggtcacaaaagtgcaattgttcatgcatccaacatggttcaatcttcaactagtaattatgttcttgaaaattcccatatgatgccttcagattgttggataagtgccatgaaagctgagttaggagctttagaaatgaataacacttggactattgttgaccttcctccgggaaaacaccctattggatgtaaatgggtatataaaatcaaatatcatgccaatggtaaggttgaaaggtataaagccagattagtggctaaaggttatactcaaatagaagggaaggactattttcagacttactcaccagttgctaagatgactactgttagaactgttttggcacttgcagctatcaatgattggcacttggagcaattggatgtgaacaatgctttcctccatggagacttgaatgaagaagggtacatgtgtctccctccaggcattgcaacttactcctcaaataagatttgcaaactcaacaagtctttgtacggtttaaagcaggctagaatggtacttcaagctatctcaaagctcttacttctctcggtttttctcaatctacagcagattattctctttgtcaagaaacttaataattcttttactgcaatctcgatctatgttgatgatatagtgttggctagaaatgatttgaatggtattcagttagtgacggcttttctagattcacaatttagaattaaggatcttggaaacttgagatattttttaggccttgaaatcgcaagaagtaagaaaggcattgttgtaaaccaaaggaaatatactccggagctattggcagattgtggccttcttgcagcaaaaggggtttccattcctatggacccttcaattaaactacctggatacgatggaaaaccttaccatgatgaacccggttataggcgcctaattgggaaattgatatatttaacttccactagacctgacatagcctttgtcatgcaacaactttctcaatttatgtcacaaccaatggattctcacatgaatgcggctcaaaaggtcctaaaatatttgaagtctgctcctgcaaaagggttattcttttccgctacttccacacttaaaatatcagccttttctaactctgattgggcatcctgccttgatactaggcgatcagtatctgggtattgtgttctaattgtgtcatctctaatttcttggaaatcgaagaagcaatccactgtttctcgttcttcctcagaggcagagtatagggctttggctgctcttacctgtgaattacagtggctgtattttctatttaagaaccttcaagcagccattacaacacgtgctctagtatattgtgacaatagatttgcaatccacatagctcacaatcctatttttcatgaaagaaccaagcatatagcaaatgattgccatgttctgtgggaaaaattacaatctggattgatacatctgctgccaattccttcttcaaaacaaccagcagacatatttactaaagctcttcattcaagttcttttcacacaaacattcacaagttaggccttctcaacataatggctccaacttga

SEQ ID NO: 7999 - DNA, 216 bp, Glycine max
  Peptide Sequence Number=SeqID_124777
atggttggagcattctcgcaaaacatcgtgaccctgactggtctccctatgatcttacttagtgagagtgacctgacaaacccatggtgtggtgtgtcttgttatgtacccctaagcgcctcagggtggtttttcactgacatgatgaataggtggatgactatgaagaacctcatgctagaggacacgggaacacaacgctctgataggatgtga

SEQ ID NO: 8000 - DNA, 240 bp, Glycine max
  Peptide Sequence Number=SeqID_124778
atgccttcggacgtatttggtaaaattaacaaatatgctcacgatcatataagttgcacaaacaaatgcatagtacaacttttcactgtcaccggattcaacataggcggtgagcatcacctgccaaactaccgtttcgacaccactgttcagggctgcggctccggcgccgatcccgacggcaacaccgaagaggacatgcgtgacatgtctcttcatctggttcgtaatcatgcatag

SEQ ID NO: 8001 - DNA, 849 bp, Glycine max
  Peptide Sequence Number=SeqID_124779
atggatgaaatagaggaagtgaaagagtggatgaaggccgacatggaggccatgaaagagaaaatggccataatgatggaggccatgatgagtatgaagaagataatgaaggtcaatgcggctgcagttgccgttaccagcgccgttgctgaggtggacctgactcccccatctaccctcaaccaaataaatcatccaacctcggatatggtaggtcagggaggcaaagagttgggaaatacgggcggcccccattttgtgcaagttcagagcaagcatgcattcccaccatatgacttgcctcccaactatacaccactcaatgttgcacacactctcgatgaaaatgtcgacaactccgcacccatacccattgagagccaacaaccccaatttgataatgcacatgtctctcaacccatgggggagacacatgaagcaccccgagaccataatctagccgacttcaaacctcatctcgaatatgtcattgaggggaaagcaattggtagtgtacccctgccaaacactttggagggccctcaattttgcccacaaccacaacccttgcattttgcggtgggaagagtccctcttgctatggtggaaaggggaaaatttgatcatatagaggaaaggctgagggccattgaaggaggcgaagattatgcttttgctgacatggcagagttgtgcctaatgcttgccgtcgtcatccctccaaagttcaagatgccggatttcgataagtacaaggggacaacttgccccaagaatcacctgaagatgtattggaggaaaatggaggcatactcgaaagatgaaaaattgctgatacatttcttctag

SEQ ID NO: 8002 - DNA, 513 bp, Glycine max
  Peptide Sequence Number=SeqID_124780
atggcttcggataggatgcagctacagagcatgtgtaaaaaagagcatgaatctttcaaagaatatgcccaatggtggaaggatctagcagctccagtagcaccctcaacgatagagaatgagatgataacaatgatagtagacacgttactggtgttctactatgagaagatggtgggttacacaccttcaagctttgccgatttagttttcgccggtgaaaggatcgaagtgggtttgagaagaggcaaatttgactatcttgctttgataaataagaagcctggggcaaatggagagaataagaaggagggagtaacccatgttgtgactaccattcctacatggaaaaatttcccaccagctcaacaatgtcattactcagccaatatctacctttcgcattacccaccaccctatcagccaagaacacctaatcaaccacaaaggcccacccctaaatcagccacaaagaccgcctatcgcacatccaataccaaacgccacccttaa

SEQ ID NO: 8003 - DNA, 219 bp, Glycine max
  Peptide Sequence Number=SeqID_124781
atgaggtgtagcacgcaaatgctcacctcccccttagccaatgtgattatggaacatatctattgggataaaaatgatgaagcaaatgagttggcaccacatgtttctggttacaaaaagattgaaggagaaatgatgaattatcatataaaggagttagaaataatgcaagtcaatggattggattcattgcaacaagaactggccaaccacttgtag

SEQ ID NO: 8004 - DNA, 591 bp, Glycine max
  Peptide Sequence Number=SeqID_124782
atgcccaatcaaaacatcaaggaaccaactaaggaagagtttgacatcaaaacacaactctcccaaaagaaactcccaacattatcacgtcggcttggtggctccaacaaaagacctatctccaaagacacctactgttgctcatctgttcccaccaaccacatggtacaaaatgcaaggggatattcagacagggtcactacacctccatatacatacacaacatacattcatctcaatgacatcatctcatctcaatgtcatcaacatcacaagagatacaatgataggcttaatctaactaggagaaggcataaaaatcgcagttacctcaaagaaaccgtgaagggagggtcaggggctttgttctctactgaatccacaagttgggttttgaaggttccactctgtgcggtggtccaacggctagtggtggcggctcgtggtggttgccgatggccatgggtagaggaggaggtgggtttagggtttggagagaagaggggtagaaaatcgtgttttctcgttggtggacacatttataacttgcaagactcgcttagtgagctggtttcactaagtgaaatttaa

SEQ ID NO: 8005 - DNA, 138 bp, Glycine max
  Peptide Sequence Number=SeqID_124783
atgacgaagatcgttgataccctaggtcctaaatctcgatcggtcgaggttacttctgcttgtcttaaagctagaatgccagtcaatgacgaagggagacaccatttttattggtcattacttgttcacaggaagtga

SEQ ID NO: 8006 - DNA, 381 bp, Glycine max
  Peptide Sequence Number=SeqID_124784
atggagaaggtagtggttgaagttgaagccatattgatgtcgtcaacatcgatgttcttgtcgggaaaatactcactggtagtcatcgacgtttgtgacaaaggagacaaggacgccttgtttggtaaaaagatcgtggaagttgatgacctcgctgcggccgacacggacgtcgttgccagtgatggagagaggggcaaatgggtcgacgaggagagagattgcgagctagaagtggagcgatttgaagggctccacttcgaggaagaagagggagagagtgagaggaagagtgaggagagagaaacggtgaacatgagagtgaggaagaagagcgggtttattgaaatttgcatttctctaatgacggtgtgtcattga

SEQ ID NO: 8007 - DNA, 954 bp, Glycine max
  Peptide Sequence Number=SeqID_124785
atgtcatcgggctcgccgcctctagatgacaataggtgcagaatgaccataatttgtctctgcgtgccaccggactggatcgtctctggatggcaaaaatgtgtctggatgaccaaaatttgtctgcgcatgtcatcgggctcgatgccgctggatgacaaaaggtgcagaatgaccataatttgtctctgcgtgccaccggactcgatcgtctctggatggcgaaaaggtgtgcggatgaccataatttgtctgcgcatgtcatcgggctcgccgcctctagatgacaaaaggtgtagaatgaccataatttttctctgcgtgccaccggactcgatcgtctctggatggcataaaggtgtgcggattaccataaattttctccgcatgtcatcgggctcggcgcctctggatgacaaaaggtgcagaatgaccatattttttgtctgcgtgcctccggactcgattgtctctggatgggataaaggtgtgcggattaccataatttgtctccgcatgtcatcgggcatgccgcctctacatgacaaaaggtacagaatgaccataatttgtctctgcgtggcattggactcgatcgtctctggatggcgaaaaggtgtgcggattaccataatttttctgcacatgtcatcgggctcgccgcctctggatgacaaaaggtacagaatgaccataatttgtctctgcgtgccttcggactcgatcgtctctgtatgccgaaaaggtgtgcggattacaataatttgtctccgcatgtcatcgggctcgcctcctctggatgacaaaaggtgcataataacaataatttgtctctgcgtgccatcggactcgatcgtctctggatgccaaaaaggctcactgccattgatggacaaaaaggtgccgaatgaccataatttgtctctgcgtgccaccggactcgatcgtccctga

SEQ ID NO: 8008 - DNA, 201 bp, Glycine max
  Peptide Sequence Number=SeqID_124786
atgatgcgaattcctgcagagatgttaatcaactgccatttgttggatagcatgactacacgtgttgtggatagcatgactgacaacttaagaccaactcgtgcagaagccactaatgttgccaatgctattttagatggacatagaaatttaagcaatgctccagtacagtgttgtaagtgcttgtgtgagaagtacaat

SEQ ID NO: 8009 - DNA, 288 bp, Glycine max
  Peptide Sequence Number=SeqID_124787
atgtcaccccacaaaaagcttctacaacacttatccaactcttcacaaatagttagaaacaagaaggtggattgcataacatacgaagtgaatgatgaggacatgaccaagagcaagggcaaggatccacttgaaggacttggaggacatatgacaagggctagagcaaggaaagccaaggaagctcttcaacaagtactatccatactatttgaatacaagcccaagtttcaaggagaaaagtccaaggttgtgagttgtatcatggcccaaatggaggaggactaa

SEQ ID NO: 8010 - DNA, 261 bp, Glycine max
  Peptide Sequence Number=SeqID_124788
atgacgttccgtaacatgccggaaatcaaaaggaagcattattacgcaatctgtgagaaggaaaacaagtatcgttacggaaaaagaatcagcaaaaaaaggcaggggttgtattcagtaaacaggggggtgaaaatagcaaccaggcccacttgggccttccaagatgttcctcaagaaggcggtgccttctggaagaagcaacctagctcgcctgggcgagctgggtggcaagctcctccctcattttcctataaatag

SEQ ID NO: 8011 - DNA, 129 bp, Glycine max
  Peptide Sequence Number=SeqID_124789
atgggagatatgtccaaactttctagagatactctagcttgggaaaacgtggtaaataataaacagccaggaatatgtgacccgggtgatgcctggacaacttcattagctgtgatgattcaactataa

SEQ ID NO: 8012 - DNA, 288 bp, Glycine max
  Peptide Sequence Number=SeqID_124790
atggagcagcaatattacctcgcaaaattactggggtacgactacaagatacaatataagagtgggtcctccaacgtagtcatagatgcactatcccgcctaggcgagatgcttgaggcacactatcttctcctaaacacacctcaatttgcatttatggaccagattagggcctctctaactgatgtagctccatgtggagcttgtaggccttggatcttcttcatcaatggagtcctttgcttcttaaagataaatagcaacggaatggagaaggaacaaagatga

SEQ ID NO: 8013 - DNA, 923 bp, Glycine max
  Peptide Sequence Number=SeqID_124791
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattgtgctgccagtgagccgcttgcgctcacaattactgctgtgtgccagtgctgtcggcgtcgtttttctgctgtttgaaggccatgccatcggctacagcggctggaattggcaatggagcgaatatctgtttggggcgctcagcgacggccaacctgcgtttggcgcagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 8014 - DNA, 525 bp, Glycine max
  Peptide Sequence Number=SeqID_124792
atggaaacccatttaggccaactacaaggaataaagttcataacagaattaacagcatatgcccagaagatcagacaagaatggattactgaaggagatgttaaccagaaccttcatataactaatactatgagaacaatgtgtataagatgcagaagagaaatttggattgtaaagggttgtaagttggtcattcgaatgacgacaccccctccatctcccacacagttcgagattccttctgatgggatgtctaggaaaactagacaagccactcggctaagaaggttgacagcaagaacattggagcaagcaagggcaacagtcagtgtgaatccagcaactggtagaggatccggacctcacaaggatcagtttcacagttaccttggagttgtggcacgagacaagattccaattgttcacgctagctggaatgatgtacctgaaacactgaagaacatgatatgggatgacatattggcaaaattcgacatccccgagggtgatagtgccaaaaagaag

SEQ ID NO: 8015 - DNA, 732 bp, Glycine max
  Peptide Sequence Number=SeqID_124793
atgtgctcatcttcaaaggacaacacgtcctcaccttcagagggctacacgctctcgccttcaaatgactacacgtccttgcctttagagggctacacgccctcgccttcagaggactacacgttctcaccttcagagggcaacacaccctcgccttcagaggactatgcgtccttgcctacagagggctacacgtcctcaccttcagaggactacatagggctacatgcccttgccttcagaggactacaagtcctagcctttagagggctacacactctcgccttcagagggctacacgccctcacattcagaggactacacgtcctcaccttcagaggactacacgtcctcaccttcagagagctacacgctgtcaccttcagaggactacacgtcctcgcattcagagagttgcatgccctcaccttcacaggactccacgtcctcaccttcagagggctacacgtcctcgccatcagaggaatgcatgccatcgccttcagaggactacacgtcctcgccttcaaaggactacacatccttaccttcagagggttgcacgccctcgccttcaaaggaatacacatcctcgccttaagaggactacatgtcctcacctttagaggactacacgtcccccactttagaggcctacacctcctcgccttcagagggctacactccctcgccttcagaggactacacgtccttgccgtcagaggactacac

SEQ ID NO: 8016 - DNA, 2823 bp, Glycine max
  Peptide Sequence Number=SeqID_124794
atggggtttggtttaagccttggaaagaaaagctcaaagcagcaaagcaggtcaaagacagataaggagagttctgatttgcctcaacccaatccatgttcaaaggattcacttaagcttaaatcaaagtctaatgttgatcaagcaaacagtgatccttgtcataaagcaaaacatgatgtaaaaggaaaggctcagctcttggatagtgctaagggaagttcaactcagcctgatgaacttgtcaagtacatgtctaatttgcccggttttctcaagcattctgatggaggagcaagcattcaagggaaggctttaaatgttggggttcttgattggtcacagcttgaaaaatggaagaataagcaaacacatacaaaggcagaagctagctatttcacatcattcgatagcagtgaagaaatatcctcaagggcagccaccacatcatctgcaacttctggtggccataataaaaagcttgatggtagaaaaggttcaagttcttcaagaagcaagggatcttataaagaagaccgtcccagaagttctaaaatgtcttctcagaatgtcaagcaatatcaacattctgaaactgaaataaagaccattggagatgtgctcgggatgtcaccctcggaatttggcaaaactcagtcagataaatcacttcaaagggtgaaagttaatgactatgatgaaataacttcagtagttggaagctctgcatccaagtccaggcatcatatggtcgcactagttcctaatgaaaattcaagtggtaggggtgttgaagataagaagagaatggagggtttgcagcagcatagcctcaagaaaaaggagaggagtctaaagtccagttctgataagggattttcatcattagaatcaaaaaataaaggagtctcatttgatcctcagaagaaaatgagttccggcagcagtgaagccaagaaaaagatggatcagtggcaggagtcagatgttgatgctggttataaacaaagccataggatgcctcgtaatattgtgttgcttcgtcccagagttctgcaattgcattctgaagactattctcagcattctcaatcgagaacttcatctgatgaagactttttggaatcaagccggagtagtttgtcatatatgtgcattcctgaggaggtttacactgaagatgtacattctgaaattccacattcaagtgtactgccttctgtgactgagcttgcttcttcttcagaaaaattgcaacatagtatcaatactgaactagatatagatcgttcttctgttgtatctgagaaaccagcttgctcaaataacatatctaatctccaatccgaatatacttgcattgaaaaggatgtgttacatatcaagctaaaaagtcagtgtgcttttagtaatgtgctggaatcactggaccgtgaaactgttgagctgacacctcagaatccctcatctaatcgtcggcttagcttaagcttaagtcggattggaagaagttttagtttcaaggaagggtctatttcaaaacttagctcctcgtatgttgctgcaaagtctggtccagtgacacctgaatcttctgcttatttggatagtcatagcaaagatagggtaaaaggtcataacagaaccatgtccagccccttcctgaggttattagaccccatattgaagcgtaaggcatcaaacatacagttttcagatgaacaaagtgtgacatcaaaaggtagcatggattcgatcagcttgaggtcaatcaatctgcctgatgaaaagagcaaggaatcatcaatccaagcccttttgcagctaacaataagaaatggagtacctttgtttaaatttgtgctcaacagtgaaagaaaggttcttgctgctaccatgaagagtttagcattgccggagaaggatgatgtagactgctatttcacattctaccatgttaatgaaataaagaaaaagagtggtaaatggatgagtcattggagtaaagaaaaaaactgtggatatgtctacaacattgttggccagatgaaggtttctagctctaaaaccactgaatcaagcaatgaggaaaccaagatagagagtgtggtgaaagaatatgtcctaatgggagttgaagttgaccaactagatcaagaaccaacaaatttcttcatgagcaaggagcttgcagctgttgtttttgagatcccttgcgaaaatataaatcatgaaggactattatgtagtcataatttgattaggaagagatgcttaaagtgcttggcagatgaaaaatgcttttgcagctcacaagaaaatgaaatctatggcaacatgacagttatacttcctggtggtgtacatagttcaccaaacacaggacaaccttcaccattgatccgtagatggaagttgggaggaacatgtgattgtggaggttgggatgttggttgcaaattgcttgttctctccaaccaaaaccttagttcaaatattccaagaagttcaaaatcttaccttgagagatttcatctttttgttcaggaaggagctgatcaaaacacacccctattcacgttggttccattgaaggatggattctactcagttgaattcagttcagaaatcaatcatttacaagcattcttcatttctgtggcagttttaagcagccagaacttgccaagttccttggaaatgaataacatgcaagaagcaatcaataaggaattcaattccaagaacaacaatgaacttcaagggaaagcacctttatattataatccaattcctccatactcccctgctgacagagtttaa

SEQ ID NO: 8017 - DNA, 903 bp, Glycine max
  Peptide Sequence Number=SeqID_124795
atggctggcatatttttgaaagagcaaaatagtttagaggttatgagtgatcagaaagaaatgactccgaatagagttgcgaactggccattcaggactctatatcattatttagggatcccacactcagcaccagtcgatagcttgctgtgttggatatacgagcactttttgtcagtttcagagtgcaatgctgatccggactatgacgaggtgtcaccacgtgtgtgtcggtggattgtgacgaagaagactgtgaagaaggtatctacagtgacgtacaggcagtgcctggattgtctaaggatcctagatgtctgctggatgccatatgcagagcaccgacctatccaggactttcatctgatttcgtgtttctcgggacagctccattgggggcctgttgttgtcagatacagaccggaaaaggttatgcgccagttcggctacgtccagtgcattcctgcacaccctgtccattcatgggtgtcatatgatgacgtgaatgatacttggacgcactactcagactatctggcaacagcaggtgatctatgtattgtgtcaggtcagtgtgcgcctgactacatagactggttctttgtcatattgcatccattcatgactgtgccacagacggatcctcctcaagatgcatatgcgacgcatcccagtcatatccctcatgaggcagcaccgacatcgacacatgcggatcctgatgcggacgagcccaaacatgcagtggaggcttgtcatgcgatcgcggaggcgttggagcaacatctaaatgcgccaagcacatccactcatgaagaggtcatccaaaaatgcctcaggattgccaggggtgtcacagaagatgtgaggtctcaacgtaggcgccgcacggatcatcaatag

SEQ ID NO: 8018 - DNA, 357 bp, Glycine max
  Peptide Sequence Number=SeqID_124796
atgagggttcactgtaatcaagcaagtcggagacctagcatgatcacagattcacctccactccttatattcccacaaacctggattaaatggcctaactctcaaaaaacagtccctagtggagtcgccaactgtcgcaacctacctttcggcaggagggcgatgcgtgactcgcgggtgcgtgatccaagaaaggaatacgcgcggagtcgccaccaacgtttatttgaggaaaacgtcagaaaaactggaaaagccgtgatctacgaacttaagcgaaaggttcgggagttgtatttacgcacagggaaggtattagcaccccacaaatccgtcacaagagacaacaacctttaa

SEQ ID NO: 8019 - DNA, 255 bp, Glycine max
  Peptide Sequence Number=SeqID_124797
atgttcctccaaaaggcggttgcttctggaggaagcaacctagctcgcctaagcgagctgggtggcaagctcctcccctattttcctataaataaggggaggagtgaaggagaaaaatgttcagccctcctggtatttcgagatcacttgaaattagtgaaaaaaattgtttccgtgaagaaaatccaagccgagattttcaaccgttcttcgacgttcttcattcgttcttcgtcgttcttcggtcttcaaccg

SEQ ID NO: 8020 - DNA, 542 bp, Glycine max
  Peptide Sequence Number=SeqID_124798
ggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccggacggtag

SEQ ID NO: 8021 - DNA, 828 bp, Glycine max
  Peptide Sequence Number=SeqID_124799
atgaccctttccgataaagatatcgatttcctcgttgccaccgttgccgctgccggtacggatgagatcatgccccgcttcaggaacctgagcgctggcgccatctccgaaaagacatccgccgtcgatctcgtcaccgaggcggatgttctggccgaaaagctgataaccgcagcgctgctcgagcggtttccaaaggcgcatattgttggcgaagaggcctatgacgcggatcattccgtcattcccgcccttgccgacgcgccgcttgccttcgtgatcgatcccatcgacggcaccttcaattacgcttccggctttcccgccttcggtacgctgctcgcggtcaccgtcaagggtgagaccgtggctggacttatccacgatcccgtcatgggggacaccatcattggtctgaaaggtgagggcgcttatctccaccgcaaaaacggatcgcaggcaaagctgaaggttgccgatcccgcgccactgtccgacatggtcggcctcttttcgtggggccacagccatccggatcgccggccggtgatcgccgccaatatggcgaagataaagatggcattgtcgctcaactgctccgcacatgaatattggctcgcttccgccggcaatcttcatttcatcggccatgaaaagctgatgccatgggatcaccttgcaggcgtgctcatccatcaggaagcgggtggttacacggcgcgtttcgacaacacgccctatcggcccggccagacgaccggtggcatactttctgctcccgacaaggaaagctggaagatgctgcggcgggaaatcgtcgccttataa

SEQ ID NO: 8022 - DNA, 720 bp, Glycine max
  Peptide Sequence Number=SeqID_124800
atgtttgctaacaagagtgcaaccaatgtgcatgttgtctacttggaggcccttcgtgacctcagtatgattgagaggtacgcctggggagtggctgctttgtgctggatttacgagcactttccctcggtcgcggagtccaccactgatcaggactacgacgaggcttccccgcgtgcgtgcaggtggattgcgacgaagaagaccgtgaagagcattcgcacgccggcatacacggagcgcctggaccgactccggattctggatgtctgttggatcccttatggggagcatcgggaggtccaggacttccacgtcagatcatgctattccggtctcttgcgctgggggcctgttgctgtttattaccgatcggagagggtcgtgcgacagtttggctacacgcagaccattcctgcttctcctgtcgattcatgggtctcgtatgatgatatacacgacaggtggatgcactacgaggatcatatcgtaccagcagatgaggtgtgcgttgtgccaggggcgtgttccagtgacttcctggactggttcttccgcatctcccatcctttcatgacaccaggccacacattagatcctctgcctcatggtcacgccctgcagccccgagtcgtccctcaggccccgcagacagatatccctcacgtgccggagccaggagcattgtccacatctacggaggagcctagacatgcagtg

SEQ ID NO: 8023 - DNA, 402 bp, Glycine max
  Peptide Sequence Number=SeqID_124801
atggggatcgcacccacaaagacacccagtgaacctgaagaagtccaacagggccctggggtttccagctctggttacgggcctctatcagtcctacagggtgcccgtacccccccggcaaggtcacgtcatcatagttctacggagtacctgtcacctccagcaagggcatcaggccccctactaatcgagctttcatcaagaagtactgcgccccagacaggcgcagggcgaaacaccacaacagcattgggatggtcggcagcgggaaacagacgcaccgccatcacctctagagttcacctctgctcatccacaaaaaggtttgagtattgcctacacacatggccgaccagtaggcgaccaagtccaaagccaaaggatgcacctagttgctcatga

SEQ ID NO: 8024 - DNA, 255 bp, Glycine max
  Peptide Sequence Number=SeqID_124802
atggcggtgcgtctgtttcccgctgccgaccatcccaatgctgttgtggtgtttcgccctgcgcctgtctggggcgcagtacttcttgatgaaagctcgattagtagggggcctgatgcccttgctggaggactgatagaggcccgtaaccagagctggaaaccccagggccctgttggacttcttcaggttcactgggtgtctttgtggggggagattggcattgcggtcgctgggcagaatgttgctaaatag

SEQ ID NO: 8025 - DNA, 195 bp, Glycine max
  Peptide Sequence Number=SeqID_124803
atgcaatgcatgaatatgtgtcccatgtgtgcagtcaagaaggtgatatggaccttccggcttcctgtgtcaaaagacaagaccaacatacaacgtgtgcatgacgacatgatgcagatgcgcaaaagcgtaacagggggatgtacacagcatggaaatatccacaaaataagcatacaacaaaggcgtacatga

SEQ ID NO: 8026 - DNA, 613 bp, Glycine max
  Peptide Sequence Number=SeqID_124804
ggccaacgagcccgttgacacacggagatttacatcatcttccatgctttctgtcatcctaacccgtgaagtcagtcaggggatgtacggagatacccaagcggttatctgtacaaacggtttccatcatcctgaatcgcagagatacccaagtggttatccgtataaacactctttcgctatccgtcagactcaaagtccgtcaggtgatgtggatataccccaagcagttatccgtgcaaatggtttttgtcatcctgacccggaataccttatggttatccacacctttcgtcaaccaggggcaaacgagcccgttgacgcagacaacaagtctggtgacatgcggggaataccttatggttatccgcacctttcgtcaatcaggggcaaacgagcctattcacacgcagagactaacatcgtcttctgcaccttttgtcatcctgacccacggagtcaggatgatgttggtcgtccgattccgattattctcaaaatttttgcaggtttttactctcgtcgtccagagacattcaagcttgatcacgcacaagattcttctctgctgggcggcgggcgatcaagttcgatggcatggggaagtgtcgtg

SEQ ID NO: 8027 - DNA, 219 bp, Glycine max
  Peptide Sequence Number=SeqID_124805
atggatgtagccagaaaagccaccggggccggccggagatgggtggctctgctggagatgagtcacagaacagagactagagaaggagggtttgctgttgaagaacagggaagggaagaaggaaaaggtgggaaaatggggcgcttagcttttttaagcagtctgaaaggggggaagtccattttactctttaaaaccctcaaaacaacacagttttaa

SEQ ID NO: 8028 - DNA, 195 bp, Glycine max
  Peptide Sequence Number=SeqID_124806
atgggtgccaagcacctcacgaggaccaaagaatggtcgcacgtcatcgagcaaaggagtcaagagcttccccgattgctagccaaggccaaggcgatgacggacacctactccgcccccaaggagatccacggacttctcggctattgtcagcatatgatagatctaatggcccatataattagaaaccgctag

SEQ ID NO: 8029 - DNA, 1107 bp, Glycine max
  Peptide Sequence Number=SeqID_124807
atgcgtggcgtgcggctgaacacgctcggctggtttgacttcaagtccgcctgggatttgagatgctccgccctcagatcctttgcgacgcaaccttaccttctccttaaggaacgcaaagtgttaaataaagttctgcccctgttgctgctgatcgctgcgccggctctggcggccaaacccgtcctcaccgtgtatacctacgactcgttcgccgccgactggggccccggtccggcagtgaaaaaagcctttgaggcccggtgcggctgtgagctgaactatgtggcgctggaggatggcgtatcgctgcttaatcgcctgcgtatggaaggaaagaacagcaaggccgacgtggtgctggggctggacaataacctgattcaggcggcggaaaaaaccggcctgttcagcaaaagcacggtggatacccgtgcactgcagctgccggacggctggcacaatgacacttttatcccgtttgattacggctacttcgcgttcgtttacgacaaaaacaagctaaagaatccgccgcacagcctgaaggagctggtcgaaagcccggaaaaatggcgggtgatttatgaagatccgcgtaccagcacgccggggctcggtctgctgctgtggatgcagaaagtgtacggcgatgaagcgccggcggcctggcagaagctggccagcaaaaccgtgaccgtcaccaaaggctggagcgaagcttatggtctgttcctcaaaggcgaaagcgatctggtgctgagctacaccacctcgccggcttaccacatcattgaagagaaaaaggataactacgccgccgcgccgttcagcgaaggtcactatctgcaggtagaagtgggcgcgcagctcgccagcagcaaacagccgcagctggcgcagcagtttatgcagtttatggtgtcgccagcgtttcagagcaccattcccaccggcaactggatgtatccggtgatcaaaagcgatttacccgccggttatcaggcgttgccggtgcctgctaatgcgctgcaatacaccccgacagaggtggctgaccatcgcgcggcgtggattagcgcgtggcagcgcgccgtcagccgctga

SEQ ID NO: 8030 - DNA, 1221 bp, Glycine max
  Peptide Sequence Number=SeqID_124808
atgctgatcgtcggcgagaaaaacccctggcgcgaccgtacgctgcgcgtcggcatcgtcagtgagaacaccagcccgtacaacatcatcgtggatgacgatctgtatgggctgaatgccgactacctcggctatatccagcaggtgaccggcattcgcttcgccatttacggctttgccgatctgacgcagctggagcaggcgctgcacgacggcaagatcgatctgctgtacggcatcccgcagagtgaggcgctgcacggcctggcgatctctcagccctattacgtcagcaacctgcgcgtattgcgcgatcgcagcaacgatcgcccggtgatgctcaactccgccaacgcccgcgtcgcgatcggcgcgctgaccgacatgcagtccggcggcgctctgcaggcggtcgcgtcgcagatccagcgctacgacaacaatctgcaggcggtctactcgctgctcaacggcagcagcgactactttatcgccgacgaggccagcgccagctttatcatcgatcagctgcagctcggccagctctatcagattgaaagcaacgagaacctgggcaacctgtccttcgtgttcgccgccgacgactcgcggctgatagacacgctggacaccgccatcgccgacgcgccgatggagctgatgaacgccctgcagggccgctggagcaagaagatccccagctacctcgacaccggcaatgccgatctgacgacgatggagaagaattgggtggcgagccaccgcgtggtttactacgccgccatcgaaaacaacttcccgttcgcctaccgcggctccgacggccagccgcgcggctacgccatcgacattctcaacatcatcgcgcaaaacaccgggctgcgtttcgcgccgctgtgggcgcgcaacgccgagcaggccgatctgctggtgcagtccggccaggccagcttccgcgccgccctgccgctggcgcgcggcgtcaaagcgcgctacggcgccagcatgccgatccaccgttcgctgtggggggtttacgtcggccagcacgctaacggcatctccacctggagcgatttggccggcaagcgcatcggcgtgctgcagggcgatttggcgcaggggctggtgccggaacaggagcaaaccatcagcttcgccgacagcaagtcgatgtacgacgcgctggccaacggcccagttggatgcgctggtggataa

SEQ ID NO: 8031 - DNA, 423 bp, Glycine max
  Peptide Sequence Number=SeqID_124809
atggctgacggtggcgaggaatttgctcttcatgcggttttccgcttcggcgcggcggcgcgcgtgctcgagttcttcgcgttcgcgtttttcacggcgctgcagcatgaaacggcgcagcgtcagcgccagcagcagcacggtggcggcggccagcagcgccagcagccaggtggtctgcggcggcatgcggttgtcgttcaccgcgtcgatcaggttgctgcgatcgacgatccactcgtcgcgcagcgattgcagggtgtccgccgggatctgcatcaggttcttatcaaggatcgccaacagaagaggttgatcgcggcgcacgccgaaggccaccggatagggaatgttgttggcggcgaaggccagcttgatggcaccggaatagcgcgacagcgccaaaaagttggcggagaatga

SEQ ID NO: 8032 - DNA, 276 bp, Glycine max
  Peptide Sequence Number=SeqID_124810
atgagggagacacatgaagcaccccagaaccacgatctagccgacttcgaacctcaccttggatatgccactaaggggaagagtcccttctgctatggtggaatgggaaaatttgatcatatagaggaaaggctgagggtcattgaaggaggcggagattatgctttcgctgacatggcagagttgtgcctagtgcctgacgtcatcaatcgtccgaagttcaaggtgccaaatttcgataagtacaaggggactacttgtcccaagaaccactga

SEQ ID NO: 8033 - DNA, 378 bp, Glycine max
  Peptide Sequence Number=SeqID_124811
atgaagatatctcaactttcaccaacaacccatgatgcgtacatggaaactcaatatggaggccaaaatgacactcaattttacaatgtcgtacgtggaatcatattccatggaactatcctcaatgtaatctcacctttccaacagctagagcttgaattgaagactttaaacaatagatttggcagatcaccaaggactaagacaattttgaagaaaaattggtctttgaaagttgtgttcatcaaaatggcatcaagagcttggtgttgtgttgcaaagtgtaatggagggagttctctacaagatactgtcataggattgaatgttgggtcatttatgccaaatttatgctatttcagaaaattgagtgtgtag

SEQ ID NO: 8034 - DNA, 408 bp, Glycine max
  Peptide Sequence Number=SeqID_124812
atgacatatgataagtctgctttcaaggatttgaagcctattaatgtcttaaagatcaagattgggaacgtatattcaagcaaaaggaaaaggaactatatcgattgcaacaacttcagaaaatttcagcaactctctttcctccctccacgttgctttttctcttcttcttctccaccattgttgcctcctttgaagctccaaattcctcttcatttctaccccaaattgcaaggaaaagctattttcggagtcttggagcctacccctacttcgtggggctttaaatttcagggtttaataatgatggtttgtgatatatgtatgcttaaaaatattgatagaaaactggtagagaggatggggagagttaacttagagtcaaatgtgagaatggtagtgttgtag

SEQ ID NO: 8035 - DNA, 3186 bp, Glycine max
  Peptide Sequence Number=SeqID_124813
atgaaaattgagcttgtctcatcagtggtggtggtgtcattctattggatttggctttgcaacaacatccttgtggtttctggcctctgtcttgataatcagaagtctttgctgctcgaatttaagaacaacctcacattcgtagacacggttgacagaaatagcagcaggctgaattcatggaaagcgagtaatgattgttgcaagtggatgggagtaacctgtgacgaggatgggcatgttatcggtcttgatctcagtggagaactaatctctggtggattcgacaattcaactagtcttttcggtctccaacatcttcagaatctaaatttagctgcaaattacttcttctcggagattccctctggattcaacaagttagagaaattaactcacctgaatctgtcagaggcttcctttatgggacagattccaatagagatctctcagttgataaggttggttactcttgatatctcttctctttccttcttaaatgggaaaaggccgaaacttgagaacccgaatctgcaaaagcttgtccaaaatctcactaatattaggcaactgtatctggatggtgtaagtatctcagttgcaggacatgaatggtgcagcgctttatcgtcgatgcttgacctgcaagaaattcgcatgtccaagtgcaatctctcgggacccctggattcttccctggcaagacttgagaatctatcagtcattgttcttgatatgaactatctatcatccccagtgccagaaacatttgcccatttgaaaaatctcaccatcctacgcctttctgagtgcggattgactgggacatttccacagaagatcttcagcattgaaacattgtctgttattgacatatcactcaaccaaaatctcaatggtttctttccaaacttcccattgagcagatcacttcagaccttaaaagtaagaaacacaagcttttctggagcatttccacactcgattggtataatgaggcacttatctgaattggatctttctgattgtcgatttaacggaacacttcccggctcactgtcaaaccttacagaactcagttacatggacttgtcatttaacaacttcactggtcccatgacatcgtttggtatggccaaaaaccttacccatttagacctttctcataatgatttaagtggcataatttcatcatctcattttgaaggactgcaaaatcttgtcaatattgacttgagttataattctttcactgggagcattccttcatccttgtttccacttccactcctacaacagattcaactttccaacaatcaatttagccaactagatgaattcataaatgtgtcttcttctatattagacactcttgatttaagaagcaacaatttgtcaggaccttttccaacatctatcttctatctcagttcactctctatcctccaactttcttcaaacaagttcactgggtcggtgcagctgaataagttttttgagcttaaaaatttaactgcactagacctttcatataacagcttatcattgaatgaaaattttgatccatctttctcttccaagattagaattttaaaattagcatcatgcaacttgaaaacgttccctggtttcttgagaaacttgtccacattagccactctagatctttcaaataaccagattcaaggaatggtgcccaactggatatggaaactagacaatcttaatatttctcgcaatttgttgactggttttgaaggacctttgcagaattttacttccaactttgttttccttgaccttcaccacaataaacttgaagggccaatacctgtttttcctaattatgcggtgtatttggatttctcaagcaacaaatttagctcttttatcccacatgacattggtaattacctgtcttccacattttttctttctctttcaaacaatactttgaatggaagtatccctgattccctctgcaaagcttcattacttcaaatgcttgatctttccattaataacttttctggaacaattccctcatgtctaatgatgatgagtgacactcttgtggtattaaatctgaagaacaacaatctcacaggccaaattccagatacaattccaatttcctgtggtttgtggactttaaatcttcatagaaatcaattagatgggccaattccaaaatctcttgcccattgctcaaagttagaggtattggaccttggatcaaatcaaattattggtggctttccatgctttttgaaggaaatatccatacttcgtatcttgattttgcgaaacaatggatttcaaggttcccttagatgttcggaagccaatgagacttgggaaatgcttcaaattttggatgtcgcttttaacaattttagtggcaaattgccagaaagatatttcacaacctggaaaagaaatataatgcataataagcatgaagttgaagcaaagtttattgagcggcttgatatcagttctggtttatattatcaaggtagtgtgacagttatcagcaaaggtctacaaatggagttggttaaaattttgacaatctttacatccatcgatttctcatctaaccattttgaaggacctataccagaagtgttaatggatttcaaagaactctatatccttaatttgtcaaacaatgctttgtctggtgaaatcccatcatcgataggtaacctaagacagctggagtctttggacctttcacaaaacgctctgagtggaggaattcctatgcagattgcaagtttgtcattcctttcatatttaaacctttccttcaatcatttggtagggaagataccaacaggtacccaacttcagtcattttcagcttcttcctttgaaggcaatgatgggctatacggtcctccattgactgaaaatccacatggtaaaaggccaggggtgttgctgcaacgagaatgtgaaaggctagtttgtacaattgattggaattttatcagtgttgaactaggattaatttttggccacggaattgtttttggtccactcttgatttggaagcggtggaggatatggtattggcaagttgtgcacaaaatcctttgttggatcttccctcagatgtatcttgaatatgtaacccacagaggacaagttttcacaactttaaggtggtggcactag

SEQ ID NO: 8036 - DNA, 111 bp, Glycine max
  Peptide Sequence Number=SeqID_124814
atgccttataggctgcatgaagttttcgcatgtttgagacgtgcaagactccttgaggaaattgagtttggaggggaaggaaacataaagagtgttttctttaaagaataa

SEQ ID NO: 8037 - DNA, 315 bp, Glycine max
  Peptide Sequence Number=SeqID_124815
agtgcaaagattgcttagaagaaggaaaaggccaagaagaaatttctctagaagagacttccaacaaggagaaagttctagacaaatcagatgctttgagtgcaagaaaacttggtcacatcaaaactgactaccttttccttaggaaagacttcaagtggaatgattcaaggaaaaaggcaatgatggctacatgggatgatttagacttgcatatgattggagacaaaggcaagttcctcagccttgagaaaagaaataatggtgggtttgctgcttttggagatactagaaaagccctaatcaaaggagtag

SEQ ID NO: 8038 - DNA, 372 bp, Glycine max
  Peptide Sequence Number=SeqID_124816
atgtgcaagcagaatacttcaatctttatgcctttcccttctctattaatgggaatgcatggaactagctatgttcactgccagagaatagtatcactacgtggaactagtgcccaaatgcaagcagtatcattgaagaagacactcatgagagctcaagctcaagtcctcaatactacaccttcattcctaacttgtgataaatgtgggattgtgcatgggccaagagaatgcactattgatggcaagctagttgtagctaaggatgagatcaactttattaagggagtaaacaattattataatcaataccctgacaatttcaatcaaggacagggcttcaggcagagtcggggaatgtttaggtcttaa

SEQ ID NO: 8039 - DNA, 468 bp, Glycine max
  Peptide Sequence Number=SeqID_124817
atgcatgcagttatcgacagacaaaagaatcatggtatgcactttcgtgtactagctaaagcattacgtttgtctggtggagatcatgttcacgccggtaccgtagtagatcgaagtcgcggtatttatttcactcaggattgggtttctctaccaggtgttttgcctgtagcttcgggaggtattcacgtttggcatatgcctgctctgaccgagatctttggggatgattctgtactccaatttggcggaggaactttaggacacccttggggaaatgcaccaggtgctgtagctaatcgagtagctcttgaagcatgtgtgcaggctcgaaatgaaggacgcgatcttgctcgtgaaggtaatgaaattatccgtgaggctagcaaatggagtcctgaattagctgctgcttgtgaagtatggaaggagatcaaatttgaattcgaagcaatggatactttgtaa

SEQ ID NO: 8040 - DNA, 1414 bp, Glycine max
  Peptide Sequence Number=SeqID_124818
cgtcctcgccattagagggctacatgccctcgccttcagagggctgcacgccctcgcctgcaaaggactgcacgtcctcgccataagaggactacactccctcgccatcagaggactacacattctcaccttcagtgggctacacgtcctcaccttccaagggctacacgtcctggccttcagagggctacccgccctcaccttcagagggctacccgccctcgccttcagaggactacacgtcctcgccttcagaggtctccacgccctcgcctttagaggactacacgtcctcgccttcggaggactacatgtccacaccttcagaggagtacacgtcctcgccttcagatggctacacaccctcgccttcaaaggacaacacgttctcaccttcacactactacacgtcctcgccttcagaggacaatacgccctcctcttcagagggctacatgccctccccatcaaagggctacacgtcctcgacttcagaggactacacgccttcaccttcagaggcctacacgccctcgcctttagaggactacacatcctcgtcttcagagggctgcactccatcaccttcaaaggactacacgtcatcgccttcagatggctacacgccctctccttcagagagctacacgccctctccttcagagagctacacgccctttcctaccgaggactacacgtcctcgcctttagaggactacatgtccatgccttgagagggctgcacgcccttgccttcaaaggactacacatcctcaccatcagaggactacacgttctcgccatcagaggactacacgtccaagcctttcaagggcaacaccccctcgccttcagagggctacaggtccttaccttcagtacgctggacaccctcaccttaagaggactacacgtcctcgccttcagagggctacacgtccccacctttagaggactacacgtcctccccttcagaggtctccacgccctcgcctttagaggagtacacgtcctcgccttcagaggactacatgtccacaccttcagaggagtacacgtcctcgccttgagatggctacacgccctcgccttcagaggacaacacgtcctcaccttcagacttctacatggctacatgccctccccttcaaagggctacacgtcctcgccttcagaggactacacatcctcctcttcagaggactacacgccctcaccttcagaggcctacacgccctcgccttcagaggactacacatcctcgtctttagagggctgcactccatcaccttcagaggactacatgtcgtcgccttcagagggctgcacgccctctcctttagaggcctacacgccctttccttccgaggactacacgtcctcgcctttagaggactacatgtccatgccttga

SEQ ID NO: 8041 - DNA, 902 bp, Glycine max
  misc_feature (144)..(144): n is a, c, g, or t
  Peptide Sequence Number=SeqID_124819
gctatatccagaacgacaaccagcgcattattctgaatacacaaggccaaacgaccacgccacaacaactcgcaaacatcacgctggtgcgtaagctaggccggaccatacgcattagggacgtcgccgaggtcagtgaagggncggccccttctatcagtgccgcggccatcaacggccagccagcggtttacctgtcggtacaaggacaattaggtgcgaatgtctacgccctgactaagcaacttgaactcaagctcgcagaaattaaacccagcctggaaaagcaaaaagtcactttgcatgaaggcctgttccgcccggccaactttattgaaatcgcgatccagagtttgcgcagtgacattctgatcggctctgtactggttatcctggtgctgttcatctttttgtttaatgtgcgaacagccattatctcagccaccgctattccgctatctttgcttacagccatcgtcgtactttaccagtctggcgtcggcctcaacatcatggtgctaggagggctggccatcgcattgggcgaagtcgtggacgatgccatcattgatactgaaaacattttccgccgtttacgcgaaaaccgcttgctatcagtgccattacccgtgaccaaagtcgtatttcaagcctctatggaggtgcgcagctcagtcgtctatgccacgattattgtcgctcttgtgtttttaccactactgaccctgtccggagtcgccgggaaactgtttgcaccactgggatacgcttacatctcggccattctggcctcactagttgtcgcactcaccctgacccctgccctctgctatgtcttgctggcgagggcaccacttaaagatgaagactcccccttactgaaatggcttaaaaaacgctat

SEQ ID NO: 8042 - DNA, 1140 bp, Glycine max
  Peptide Sequence Number=SeqID_124820
atggctacccttatgcatccttccgtagttattgatgaggatgagaaagaatggaaaagcactaatggtacttgtcaatttcttggaaagccaatggtttcttggtcatataagaaagaaagcacaattgctttatcaaccttagaagttgagtatgtctcagtagcttcttgtagctctcaaatcatttggatcaatgagacttctcagtcaccatatcctaaaaaccaaaacaagggcaaggccaagactatccatatttcctctaggttagattctgaagcaaccattaccatcacacctcctcgtgcaaaatggatcatgacagggtctcccaaaaggagaagctatgtgaaggctgagagcccctggtttattcaagacaagaagcttcaagagaaatttgaagctagttggatcaacaagaaggtagtcaatggaagagtttctttcgatagtgaactagttcgtgatgatgttttatcttggggtgccaaaaatgttattgccttgaagctatctcctcaacctagtatagagaaagaaaaccattttgagcctgctcaaaataaggagacaaaggaagagtcctctcagaaagaggttgaagggcatggagaagatctttctaaggaacttctagattatggtacttaccatgatggctcaaaacacttttttgaggtggacaagaaggaagcaaaagtccatttcgggcatcagaatgaggtggaggctaaagatgttcataacccaattttccctgaacctatccaagatgatctcaatatggagatcatagctgatgttcttgccaaaattaggactgttgactcaagtttggaacaagaaaactcagagaaagaagaaaagaaagaggaaccatctgagaaaggaagagaagctgaagccattcctgatattgagaacatgcaaaatctcatcaactctccaatctttgacacttttgtcaaggttgcttatggacttggcccaattcttggtgaatcctcaagcttttctattccaattcctccactcagcactaagtatgtcaacatagaacctctcaaggtttctgaggatattcttagcattcacattcctctcctacaaaacatgattagactatcattctag

SEQ ID NO: 8043 - DNA, 354 bp, Glycine max
  Peptide Sequence Number=SeqID_124821
atgtaccctctactagaactgatccacaagagatgtaccctctcttgttctcagtcaacaactcaagtagatgtaccctctacttgtaccacaaaggatgtaccctccaatgtgttaagacaaagatctcagcgagaattcgctaagcgcaaccttcaatggctaaacgcgaggaagaatccagaagaagatgagctatcaagttcgctaagtgcaccgctccaggtcatcaagtgcaccactccagctcatccgctaagcgaaacaagcgcgctaagccaaaatccacttatgcgcgctaagcgatccagatctgcgctaagcgcacgagcacgaacaaggccacctatttaa

SEQ ID NO: 8044 - DNA, 369 bp, Glycine max
  Peptide Sequence Number=SeqID_124822
atgtcatgcttctatccctttggatgtcaatgcttcattcttaacgctaaagacaacttgggtatgtttgattttaagtgtgacaatggaatattactcggatactctaaaacatctaaggcctatagagagtacatctctagaaccttagtattggaagaatctatccatgtgaagtttaatgacgccaagcctgatagaaaaatatcagagctggatgagtttattggagatttaagactggacgatggcattggacccttaacaacaacaaatcagccaatagaagcatatgtgtccaaccaaacactgaacaacctcaacaagtcagggaagcaactggatgaatacttagaaagaatcatctag

SEQ ID NO: 8045 - DNA, 255 bp, Glycine max
  Peptide Sequence Number=SeqID_124823
atggcttgtgtctcgttgggatgtgctctacaaggccaatgtgatgatggtatttatgatattaaagttggaagggaaacctcaaatgggagcttagagcttaaggggcttagagcatccctaaatgcaatcctagtgaggagtgatggtaaaagagtgtctaaacctataagtgaattggtgaccacggtgaggagtggtggaaacaatagattcaaaatcattcttactgaggagaatgcgttgcataactag

SEQ ID NO: 8046 - DNA, 2025 bp, Glycine max
  Peptide Sequence Number=SeqID_124824
atgtcttctcctttggaaattagtgaaccaataacatccactcatacaaatgataatgaggtgaatgtacaagttcctgcagattcaactcaagtagaagctaacaatgaagaaaatgaacatcaagaaccagttgtcaggagaaagaggaaaaaaactttagttgtttggaatgattttgatgaaatggaaatctcccctggggtgaagaaagttgttttttgcattcaaaagaaggctaaaacaactgctgaaagtagacaacccaccattccattccagccttcaaattcaaataacccttttatgattcctagtgttagatactctaatgaaaagatgagggaaataattgcaattgctatcatggttcatgaatatccttttagtgttgttgaggattctatttggatgtgggccttccaatatgcaaaccctaattttcataagattactcataaaactgcaagaaatgattgtttggcactatttgagatggagaagaaaacattgaagaaattgttagaaagtgtgagcaagatcagtttaactacagatatgtggaaatctagccatcaagtagttgaatatatgattattactggacatttcattgacgcgggatggaatcttcaaaaaagagttttatgttttgtgaaagtgcctgctccaaggcgtggtattgatgttgctgatgctatttttaagtgtttgaaaacttgggggattgaaaataaagttttttcaatatctgtggataatgcctcttacaatgactcatgcataagatgtctcaaagagaatatatctctaagtatgcaagatgaccttagtacaattaaggatatcattttcaatattcgtgaaagtgtcaaatatattaaccacaacgatgcaagactaaaggcattttgtgatgttgttgagcaaaaacgcttgaaagaaaggaaacttgttattgattgtccaacaagatggaattcaacctttaatatgttgtcaactgctttgaaatttaagactgcatttgcttcttacaaagaaagagagcctcactataattatgcacctttacttgaggagtggaatcaagttgagaaagtttgtaagctgctagaagtttttaatcttgctactcatgtcatttcagaagtttggaaggttaaaaaaatacttgataaggagattgaagatgaagatctcttcatgagggaaatggtaggtccaatgaagaaaaagtttgacaaatattggggggaatgtaatatgttgatggctatcgcaagtgttttggatcctaggtgcgaatttcatatggtgagtatatgttttcccttgatatattctaaagaagttgttgatgagaatataaagaaggtgaaaagttcatttgaagaattgtatgatgagtatgtaggtctatgtttacaagagtctacgtctagtgttgttaatttggatgataatatttcatcatcctcccaattcaatacttcagttgtcactagttttgacgaaattatgagcatgctacgtgaaaaggaagttgtttctcctataaaatcagaattgcaagattatcttgatgaaggtatttatgttcctaacactaattcctttagtgctttggactggtggaggaacaataacatgaaatataagatattgtctaagatggctgctgatatactagttattccaatttcaactgtggcatcggagtccacatttagtgctggaggtagagtaattgatgaattccactctaaattaaacgaagaatctgttgaagctctaatttgtggtggagattggtttcgtcagaaatataatgtgaagaaaaaatcaaagacttggatgatgctacctcaactgcccactgtgcttctctcccttcttgatgtagctccatgtggagcttgtaggccttggatcttcttcatcaatggattcctttacttcttgaggtctgattgtagcggaatggagaaggagaaagatgaatggagacgccacttcaagtag

SEQ ID NO: 8047 - DNA, 1197 bp, Glycine max
  Peptide Sequence Number=SeqID_124825
atggccactgaaaagcttagaagtggtgccaacttccttgagaactctaaaccctactttgccatgattgctttacaatttggctatgcgggcatgaacattatcactaaggtttccctcaaccgtggcatgagccactatgtacttgttgtttatcgccatgcctttgccactgctgtcgtcgctccatttgccttcatccttgaaaggaaagctcaaccgaggataaaattcccaattttcatgcaaatatttttcctagctctacttgggcctgtgattgatcaaaacttctactatgctgggttgaaattaacctccccaaccttctcatgtgcaatgagcaacgtgcttcctgccatgacttttgttatggcagtattatgccggatggagaagattaacatgaagaaggtgagatgccaagccaaggtggtgggaacattggtgacggtggctgggaccatgttgatgaccttgtacaaaggccctagagtggaaatggtttggaccaaacatgcacctcatcatgggcaaatcaataatgcaacatataccacaacatattcagacaaggattggttcattggctccatcctcctaatcattgccactcttgcctgggcatccctctttgttttacaagccaaagccattgaaacctacaaaaatcaccagctaagcctcacatcacttatctgcttcataggcactcttcaagctattgctgttactttcataatggaacacaagccatctgtgtggacaattggctgggatatgaacttgcttgccgctgcctatgctgggattgttacatcaagcatatcatactatgtccaaggattggtaattaagaagaaaggtcctgttttcgcaactgcatttagccctctgatgatgatcattgtagccatcatgggctcctttatccttgcagagcagatttttcttggaggtgtgcttggtgccatcttaatcgttttaggcttatactcagttctttggggaaagcacaaagaacaagtggagaagaacgtggcagacgatatacccttgcctctaaagggtgctcaacttgatggaaacccagaatcacttattgattccactgatctgaaatccgattccaacaaggtctcttcacatatgattaatgagactatccctgagcctcccatgaaatctaacaattaa

SEQ ID NO: 8048 - DNA, 372 bp, Glycine max
  Peptide Sequence Number=SeqID_124826
atggaccccagtgatcacgaacctcgacgacggtcacgaaccccgacagcggtcatgaaccccagcgacgacaatggtgtggaggagaccatggtgacaggtcttcgtgattcctctcgctcaagcattgaggtagacttgcttgaaagaggcatgtcaatgtctcctccatatgattatgtcttgggcttgaagctcaaaatcaaaaagcaagcagtccaagcaagcactatcctctcttcttctccaaaactcagccaagacccaaaaaagaaaatgatagtaactagggacaaatggtgtgggaatgaagtgttaaggaagtgtaggacaactctaggttcaaggtttcaagtgctcattggtccttga

SEQ ID NO: 8049 - DNA, 213 bp, Glycine max
  Peptide Sequence Number=SeqID_124827
atggtcgtcattttgcctaaggaaaacctagttgtctggttttgttctttacataacaggtcatacaactaccttaaaggaataattaacagtgctttgaaaggacttcatgatacttcacaacctaaatccaaggctgctgctagttggattgttgttaagtgtaatagacaaaaaggaagcattgagtgcggctattacgtcatgcattag

SEQ ID NO: 8050 - DNA, 525 bp, Glycine max
  Peptide Sequence Number=SeqID_124828
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttccattggctgtggtttcgctggatagtagacagggacagtgggatctc

SEQ ID NO: 8051 - DNA, 102 bp, Glycine max
  Peptide Sequence Number=SeqID_124829
gacataggacactgttcatttgatcgccaagtgaggcaaaagcgtcaagctaatgacgttaaagaagcacttcctgggaggcaacccagttttaagctttga

SEQ ID NO: 8052 - DNA, 276 bp, Glycine max
  Peptide Sequence Number=SeqID_124830
atgagtataaaaggtggtgctggtggagctagtagaatctcaacctctggggaagccggtgggtctactactagtggtcgcgactcagctggtgcaggctctgtccttgttgatgctgcattagatgagagagagaaagagatgatatggtttatgcaaaattctctagctatccctacactcagcacttgtcattgtgctgaagttacacttaaccaatgcttttttcgatgctcccgcttagtgaagcgttcgctaagcgggagagtcgtttga

SEQ ID NO: 8053 - DNA, 618 bp, Glycine max
  Peptide Sequence Number=SeqID_124831
atgaatgttttgagtggtgcaaccctcttttgtaaaatcactcttacacctaacatcttcatggtgtgtgtacatagggacccattaggtagagagctacacgccctcgccatcagtggacacatcctcaccttcagaggactacacgtcctcgcctttggaggactacacgtcctcaccttcagaggattacgcgtcctccccttcagacgactacacaaccgcacctttagagggctgcacgtcctcgcctttagagggataaatgtcctaaatttcagaggtctgcacgcccttgcctttggagggctacacaccctctccttcagtggactacacgtcctccccttcagagggcttcacgtcctcaccttcagaggattacatgtcctcccctttagaggactacacgtccttgccttcagaggactacacgttgtcgccttcagagaacaacacgtcctctccttcagaggactacacgtcttcaccttcagagggctacacgcccttgcattcagaggactacacgtcgtacctttagaggactacacctcctcgctttcagagtacttcacggcctcacctttagaggtgtcacaacctacccttcggtag

SEQ ID NO: 8054 - DNA, 391 bp, Glycine max
  misc_feature (61)..(61): n is a, c, g, or t
  Peptide Sequence Number=SeqID_124832
atgggagaaagaaaaaagagaaaagaaggaaagaaagctcctggtcaaggatcgaaagaanacagaagaaatgtgcagagaggtctttggaccggacaatatctgaacaatacagaattgtcaccaaatgaacaaaaaagaaggaaagggaaccacgacctaaaatatggagaaaacaccgagactttttcaagtctcacaagttatccagaactatgtaggtctgagttcctcattggaggatacgtaggagcaagagcctcgcttttgtcgaccacaccgccttttgtcgccatgactcaagagctggtagcccgcggagacaccttacggttatccgcacctcgtcattcagtgaccccgagtgtgattcacgagcagagaccaatat

SEQ ID NO: 8055 - DNA, 348 bp, Glycine max
  Peptide Sequence Number=SeqID_124833
atggtattcgtagtgctcatgatttgttcggaagcccgttttggaaatgtcttcttcaaccatcagaatttgatggaaaccttgacgaaggtccaacttggtgaaccaggaagccttgccaaggtggaggaaggtctgtggggtgagaaagatgggggcaaatttggtaatgagctgttggatttcgggtatggggtggggtggttcctagcacgggtttggagtggtggtgggttggagggccagatggaaaaaggaggaggtggatccattgtggatcatctttctgatttgttttgtcgaagcattgagaggcccaaacacaacgtcagcgcacaactccattag

SEQ ID NO: 8056 - DNA, 273 bp, Glycine max
  Peptide Sequence Number=SeqID_124834
atggcccgcaccaagaaaataggggagataatgattgaggccgcaaaggagatcgctgagaagatcgattcctttgaggagcaggcacgacacagggatccttcgtcccccatggacgtcaggatgttctcactgctactattagacgtccagagcaccctggacatgtccgtgctgctggagccggtgtcaccatcaagcagtacttcagatcagctccacggacgtcctgcagctcttcctcgctgcctcctgaagaattgtagcagctga

SEQ ID NO: 8057 - DNA, 624 bp, Glycine max
  Peptide Sequence Number=SeqID_124835
atgggggagacacatgaagtaccccgagaccacactctagccgactccaagccttgccttggatatgctactgaggggcaagaatttggtggcgtacccctgccaaacactttggaggggcctcaatgtcacccacaaccccaacccttacattttgctatggaggaaagagtgcctcctgctatggtggaaagggagatatttgatcatatagaggaaaggctaagggctattgaaggaggcagagattatgcctttgctgacctggcaaaactgtgcctagtgcccaatgtcgttatccctccaaagttcaaggtgtcgaattttgataaatacaaggggactacttgccccaagaatcacctgaagatgtacaacaggaaaatgggggcatactcgaaaaatgaaaaattgttgatgcatttcttccaggaaagtcttacaggggcagtcgtcacctggtatactaatctggaaccttcccgagtccattcttggaaggacctaatggttttcttcattatgcagtatcagtacaattttgatatggctctggatagaatgcaactacagaacatgtgtaagaaggagcatgaatctttcaaagaatacgcccaaaggtga

SEQ ID NO: 8058 - DNA, 207 bp, Glycine max
  Peptide Sequence Number=SeqID_124836
atgaagaatggaagtttagaccacattcttagttacattattgacaatcaaaatttttattccttggattatggggttgaaccaagcacatgcttttacggaaaggttcatcaagtcaaggtcaagcacggaagtaaccagcttgcaaaagttggggcagaagatggatcgagttacatcgcttctttgcctactactaacacatga

SEQ ID NO: 8059 - DNA, 426 bp, Glycine max
  Peptide Sequence Number=SeqID_124837
atgaatctaagagggagacaagtagagataagtgacccaatgtgcctgttatgcaacaattcggaggaggttgcagcacaccttttcttcaattgcagtaaggtcctccccttgtggtgggagtcactctcatgggttaattcagtgggtgctttcccgaaagaacaaaaagatcatttcatgcagcacaacagaagggatgctacacgaacaaaagatataagatggagctattggtggatagccctcacaaggaccatatggcaacatagaaataaggtggtctttgataaccaaacttttaatgcaagcaagctgatggatgaagtgcttcttctagtctggtcctggcttaaagctatggagaaagatttcgatacacattttaatcagtggtcttccaatttgacagatgcctttgtgtaa

SEQ ID NO: 8060 - DNA, 313 bp, Glycine max
  Peptide Sequence Number=SeqID_124838
gcacatccttggtgaagctcttagctctctgagtctgaaggaattaaagaacctggagagtagactggagaaaggtttaagcagagttagatccagaaaggaaatagagctgcaaaaccataataattttctgagagctaagatagctgaacacgagaaagcacaacaacggcaacaggatatgataccgggaaatgtgtgcgagtcaaccatacctccacaatcatatgaccgcaatttcttccctgttaatctcatagattccaataatcaatattcaaatcaagaccagactgctcttcaacttgtgtaa

SEQ ID NO: 8061 - DNA, 303 bp, Glycine max
  Peptide Sequence Number=SeqID_124839
atggaatttcccaacgaagcaataccagaagggtgttcacagaagaaaacgggaagggggaaaatagaaatcaagcggatcgagaacacaacgaataggcaagttaccttctgcaaacgccgtaacgggttgctcaagaaggcttatgaattgtctgttctgtgtgatgctgaggttgctcttgttgtcttctcaagccgtggacgcctctatgagtatgccaacaacaggttcaaatattcttttactactaattcaacaccgtactttttctatccttcgatctcatttcatatcttatga

SEQ ID NO: 8062 - DNA, 4659 bp, Glycine max
  Peptide Sequence Number=SeqID_124840
atggcagacaacacccgtatgaaggaggtttatgcagaattgaagaaaaacgctgatgcgattactcgtgttagtgacgatcttcagaaccatattgaacggttggaagctacaaatcacgctcagatggagaagattgaagtgatgcagtcgacgaatgattctcaattctcacaactgaatgcagtaatgtcacaggtgctgcagcgtctacaaaacattccgatgtcttcccatggtgcatcgaactcacagaaagagcagcagagaagttcgtttcaggtgagatctgtcaaacttgattttcctcgctttgatggaaaaaatgtgatggattggatattcaaggctgaacaatttttcgattactatgcaacaccagatgctgatagattgattattgcttcagtacatttagatcaggatgttgtcccttggtatcaaatgcttcaaaaaactgaaccattcagttcatggcaagcatttactagagccttagaacttgattttggaccatctgcttatgactgtcctcgtgctactttgtttaaactgaatcaatctgcaactgtgaatgaatattatatgcaattcactgctctagtaaatagagtagatggattaagtgcagaggcaattttggattgctttgttagtgggttgcaggaagaaatcagcagggatgtgaaagcaatggaaccccgtaccttaaccaaggcagttgcattggccaaattatttgaagaaaaatacacttcaccacctaaaacaaaaacattctcaaacctagccagaaattttacctcaaacacttcagccacacagaaatatccaccaactaaccaaaaaaatgacaatccaaaaccaaatttaccaccacttctacctacaccatcaaccaaaccattcaaccttcgaaaccaaaacatcaaaaaaatttcccctgctgagattcaattgagaagagaaaagaatctgtgttacttttgtgatgaaaaattttcccctgcacacaagtgtcctaatagacaagttatgctgttacaactggaggaaacagatgaggatcaaactgatgaacaggtaatggtgactgaagaagctaacatggatgatgatactcatcatttgtccttaaatgctatgagaggatcaaatggtgtgggcactattcgatttactggccaagtgggaggcatagcagttaagatattggtggatggaggtagctctgacaacttcattcagcctagagtggctcaggtgcttaagttaccagtggaaccagctcctaatcttcgagttttagtgggaaatggacagattctgagtgcagaaggaattgttcagcaattaccattacatattcaaggccaagaagtgaaagtgccagtgtacttgttacaaatttctggtgcagatgtgatattggggtccacatggttagcaacattaggtcctcatgtagctgactatgcagcattgaccttgaaattcttccaaaatgataaattcattactttacaaggtgaaggtaattcagaagcaacacaggctcagctccatcatttcagaagattgcaaaacacaaagtcaattgaagagtgctttgcaatacaattgattcagaaggaagtaccagaagacactttgaaggatttaccaacaaatattgatcctgaattggccatcttactccacacttatgctcaagtgtttgcagtaccagcatcactgccacctcagagggaacaggatcatgctataccactgaaacaagggtcaggccccgttaaagtaagaccatacagatatcctcacacacaaaaggatcagattgaaaagatgatacaagaaatgttggttcaaggcatcattcaaccaagtaacagtccattttcctcacccatactgcttgttaagaagaaagatggaagttggagattctgcacagattatagagctttgaatgcaatcactgtgaaggatagctttccaatgccaacagtggatgaactgctagatgaactacatggagctcaatatttttcaaaactggatttgaggtcaggataccatcaaattctggtacagcctgaggatagagagaaaactgcttttagaacacatcatggccattatgaatggttagtgatgccatttggtcttactaatgcaccagccacattccaatgcttaatgaacaaaatatttcagtttgctctcagaaaatttgttcttgtgttttttgatgacatcttgatatatagtgcttcttggaaggatcatctcaagcacttggaatctgtgctacagaccttgaagcaacatcagttatttgctagattgtccaaatgttcatttggagatacagaagttgattacttgggccacaaggtatctgggttaggagtttccatggagaatacaaaggtacaagcagtattagattggcctactccaaataatgtcaagcagttaaggggatttctaggcttaacaggctattatagaagatttattaaatcttatgccaatattgctggaccattaactgatcttttacaaaaagacagtttcttatggaataatgaagcagaagcagcatttgtcaagctcaaaaaagccatgacggaggctccagtattatcactaccagatttttctcaaccatttattctggaaactgatgcatcaggtattggtgtgggagcagtgttgggacagaatggccacccaattgcttatttttcaaaaaaattggcacctagaatgcagaaacaatcagcttataccagggagttgctagctattactgaggctctatccaaattcagacactacttattaggcaacaaattcattatcaggactgatcaaagaagtttgaaaagtttgatggatcagtctttacaaacccctgaacaacaagcttggttacacaaattcttagggtatgatttcaagattgaatataagcctgggaaagataatcaagcagctgatgctttatcaagaatgtttatgctagcatggtcagaacctcattctatcttcttggaagaattgagagctagactaattagtgatcctcatttgaaacagttgatggagacatacaagcaaggtgctgatgcaagtcattatacagttagggaaggcttactgtattggaaagatagagtagtaatacctgctgaggaagagattgtgaacaaaatactccaagaatatcatagctcacctattggagggcatgcaggtataactagaactctggcaaggctgaaagctcaattctactggcctaagatgcaggaagatgtcaaagcttatatacagaaatgcttgatttgtcaacaagctaaatcaaacaatacactgccagcaggactactccaacctttacctattcctcaacaagtttgggaagatgtagccatggatttcatcacaggtttaccaaattcctttggattatctgtcataatggtagtcattgatagactcaccaaatatgctcatttcattccattaaaagctgattataacagtaaggtggtagcagaggcatttatgagtcacatagtcaaattacatgggataccaagatctatagtgtctgatcgagatagggtttttaccagtactttttggcaacatttattcaagttacaaggtactacattggccatgtcatcagcttatcatccacagtcagatggacaatctgaggtgctgaataaatgtttggagatgtatcttagatgcttcacgtatgaacatcctaaaggttgggtaaaggcattaccatgggcagagttttggtataacactgcatatcatatgagcttaggcatgactccattcagagccttgtatgggagagagcctcctacactgaccaggcaagcctgttctatagatgatcctgctgaagtgagggaacaattaactgacagagatgcattgttagctaagcttaaaattaatttgacaagagcacaacaggtcatgaagagacaagcagacaagaagaggttggatgtgtcattccaaataggagatgaggtactggtgaaactgcagccttatagacagcattctgctgtcctgagaaagaatcaaaagctgtccatgagatactttggaccatttaaggtgctggccaagattggtgacgttgcttataagttggagttgccttctgctgcacgaattcatcctgtttttcatgtgtcccagctgaagccattcaatgggactgctcaagatccttacctgccattgcctttgacagtcacagaaatgggaccagttatgcagcctgtgaaaatactagcaagtcgaattatcatcagagggcacaatcagattgagcagatactagtgcagtgggagaatggcttgcaagatgaagctacttgggaggatattgaagatatcaaggcaagctatcctaccttcaaccttgaggacaaggttgtttttaaaggggaaggcaatgtaacgaatggaatgtcacgtggggagaaggttaacaagactgctgagtcatcaagtgagagaggattgcataacaaacttgctgattttgaggaattgggacgtgggaagagagagaagaaaccaagttggaaaataacggaatcccactag

SEQ ID NO: 8063 - DNA, 372 bp, Glycine max
  Peptide Sequence Number=SeqID_124841
atggatgcaaccggtttgagtgaaatagacagctctggggaattttttacctggactaataaacaggcagacaatcctatctattctaggatagatagaatattggctaacatagactggttccaaactcatagtgatgctaatctgactgttctcccccccccccccccccatgtatctgatcatagcatcctttatttgtctaagcctcttcatgttagaaaaagaaatcagttcagattcaacaactactgggtggatgcagtgggtttctatagtattgtggaaagaagctggaatcaacctgctagaggcactctaaggcagaggctgtgcaagagaaaagttggaccaggctcaacaggaccttag

SEQ ID NO: 8064 - DNA, 575 bp, Glycine max
  Peptide Sequence Number=SeqID_124842
aaccacatggctttcgcctaagcagaagcaaatcggagtatatggaatgtaagttcaacaaaagaaggagggtttctaactcagaggatgatggggaaattgacggggatgtgaatcatcgcattcaagcaggatggatgaaatggagaaaagcatcgggggtgttatgtgatgcaaaggtaccgatcaagctaaagggaaagttttatcggactgcggtaagaccggcgattttgtacggaacagaatgttgggcggtcaagagccaacatgagaataaagtaggtgtagcggagatgaggatgttgcggtggatgtgtggtaagactcgacatgataaaattagaaacgaagctattagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagaggttatcaaaaaggatctcgaaattaatggtttggatagaagtatg

SEQ ID NO: 8065 - DNA, 198 bp, Glycine max
  Peptide Sequence Number=SeqID_124843
atgaagatcatgaggagcagagatgtggttaagttcaaggttagatgctcgaagtacctctacacactttatgtgtttgacccagagaaagctgataaattgaagcaatctcttcctccagggtatccagttttgactccatgtattccaaatgccaatggtgatatttccataacaattgccaaaaatttggattag

SEQ ID NO: 8066 - DNA, 195 bp, Glycine max
  Peptide Sequence Number=SeqID_124844
gaggaacatgcacgaatcggtgctgattcttctagtgcaacctctaataaatgtgagaattataaggaggaagcacggaatgcagcacagaagcataaagtaaagagggtggagagtgtcaatgctgatgtagaagcctttggtgatcactggaaagttcagattgctctatgcattctgaagctgaagcactag

SEQ ID NO: 8067 - DNA, 111 bp, Glycine max
  Peptide Sequence Number=SeqID_124845
atggagaaggcagaggaaattgcagctctgataccaaatccattaccgcccattgatgccattcaattgttttggcctttcaactccaaaattgatggaacacttcaataa

SEQ ID NO: 8068 - DNA, 345 bp, Glycine max
  Peptide Sequence Number=SeqID_124846
atgggagctggccatgcccgaagtcgttaccttaaccgcaaggagggggatgccgaaggcagggctagtgactggagtgaagtcgtaacaaggaggatagatggggcgattcaggtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctggggtga

SEQ ID NO: 8069 - DNA, 801 bp, Glycine max
  Peptide Sequence Number=SeqID_124847
atgtttacttccattgtcggtaatgtatttgggttcaaggccctgcgtgctctacgtctggaggatttgcgaatccctactgcttatattaaaactttccaaggtccgcctcatggcatccaagttgagagagataaattgaacaagtatggtcgtcccctattaggatgtactattaaacctaaattggggttatccgctaagaattatggtagagctgtttatgaatgtcttcgtgggggacttgattttaccaaagatgatgaaaatgtgaattcccaaccatttatgcgttggagagaccgtttcttattttgtgccgaagccatttttaaatcacaggctgaaacaggtgaaatcaaagggcattacttgaatgcaactgcggctaaagcattacgtttgtctggtggagatcatgttcacgccggtaccgtagtagatcgaagtcgcggtatttatttcactcaggattgggtttctctaccaggtgttttgcctgtagattcgggaggtattcacgtttggcatatgcctgctctgaccgagatctttggggatgattctgtactccaatttggcggaggaactttaggacacccttggggacatgcaccaggtgctgtagctaatcgagtagctcttgaagcatgtgtgcaggctcgaaatgaaggacgcgatcttgctcgtgaaggtaatgaaattatccgtgaggctagcaaatggagtcctgaattagctgctgcttgtgaagtatggaaggagatcaaatttgaattcgaagcaatggatactttgtaa

SEQ ID NO: 8070 - DNA, 126 bp, Glycine max
  Peptide Sequence Number=SeqID_124848
atggcccctctacaggatactgggctgccttgcagcgacgttttctgcttgtccagcgtcgggaagggacggcgatctgttggtcgtgaccctatcctccatttgcatttgtccctaagtacttga

SEQ ID NO: 8071 - DNA, 195 bp, Glycine max
  Peptide Sequence Number=SeqID_124849
atggaagcaaaagcgcaaaaatggtggcctaggggcgaaaatctgcaaaacccgtgggtgctgcattttttgaatgagggaggggagttttgggtggagagaaactccccctcccctcgcttttgtgtttccagctgcgcctcccgcttgtctggagctaggcatgggatgatgatccatcgatcatgggcctag

SEQ ID NO: 8072 - DNA, 111 bp, Glycine max
  Peptide Sequence Number=SeqID_124850
gttccttgctacaaggtcatgacgaaagataacgattgtacctcaaagccttacactagggcaacgaaaggcaccatgcaaaaacctcaagcgaacctaggggcagattag

SEQ ID NO: 8073 - DNA, 219 bp, Glycine max
  Peptide Sequence Number=SeqID_124851
atggagaagttgaatgtgcacataataacaagaggaacccctaaggctcacccaggtgagctgaaacttagtgttgaagcaatgagcttgcccaggcgagctggtttcttcaccatgaagctatttggtggcccaggcgagccaaagttgtttcgtattgtaactggtgttcaacaccgtaagtcgactagcaaggatcaaaagatcaatgaacgatag

SEQ ID NO: 8074 - DNA, 348 bp, Glycine max
  Peptide Sequence Number=SeqID_124852
atgtcaaaggatgaaggttccaaatacgaagaacttagaatgatagaattcaaaaagctaagaaaaaaggataaaaagaatgccaatgataatgatgaagactatgtacctgaatatgaagggggacttggatcaaattcttcaagtgaaaattacgagaatgacaaacgtgatgagtttggtgctacaaatgatcttgagtcacaaaaaagaaaaatgatgaaatcatggatattgaattctaaaagagtctataatgatccattcatacaccaatctcttgataaagaagtgaatgagtctttacctaataatgcatctcatgtctcagaattgaccaatgtataa

SEQ ID NO: 8075 - DNA, 1065 bp, Glycine max
  Peptide Sequence Number=SeqID_124853
atggatccaagtcaactaacgatgattccctgcacccaaaaaggaagtcagatttgtagttcttcactgtattttgttggatatcactttctgcataatgcacatgtcaaatgttttgatgaaattagccaagttaaaaaggaaaaagttttttatccaagagatatacaagaagctcttggtcgagtattgggaaaaagattggccttcaggttgaaggtagtccctggcaatacatgccattctgtttctcaattatctcaagatgaggcattatttagctctactcttgctaagcttccaagctttgaccttcaggatgaagttgagctatctatatcgtcggtgcacgagaataatgatgctattgacagtcaatgcttctcagacattgttgagtttaatccacatttaccgggatccattatagcagccaagcacaatttgtccctatctcatactcaattggatggcatatcatttgaagatttatcatcaatacaactatcctctgctaggccaactgttacggagtccatgtttacttcctggctattaactaatagcatttcccatgaaggaaaacatctaacgtatgtgcaattcataacaaagtttacatgtgtagccaaggataaacgtcggaagccaggtaaaggaggctatacaattggaaggcttaattggatgcctctaagtactggagaattgtattatcttaggatgatgttggttgtggaatacaccaaggctttaagagaagcataccgttggggttcttgccaattcctaagaagattgtttgtaacaattctcgtatctaatagcattgagagaccagatcatgtgtggtatgagacacgggagtatctaattgatggtattctacatcatcaaagaaggattacaaacataacagatttagagctggcaattgaagaattgcagaatttggcactgcttcaaattgaagagatattacaatctaacaaaaaatcattgaaggattatccaaacatgcctttttcaagacatgtagtgcgatcacatactttgcttctctaa

SEQ ID NO: 8076 - DNA, 288 bp, Glycine max
  Peptide Sequence Number=SeqID_124854
atggcgaaaaggtgcggaatgaccataatttgtctctgcatgtcatcgggctcgccgcctctggatgacaaaaggcgtagaatgacaataatttgtctctacgtgccatcggacacgatcgtctccgaatggcgaaaagactcgccgcccctggatgacaaaaggcgtagaatgaccattatttgtctctgcgagccatcggactcgatcgtctccggatggcaaaaaggtgtgcggaatgaccataatttgtctccgcatgtcatcgggctcgccgcccttggatga

SEQ ID NO: 8077 - DNA, 180 bp, Glycine max
  Peptide Sequence Number=SeqID_124855
atggcagaagagcatgaccagaggattgcccttgaggattattcaagagaagccaaaaggtggctccactcattcaagggcaacagtctgaaaacctgggaagaagttgttgaaaagttcttaaagaaatacttcccagagtccaagactgcagaagggaaagttgcaatctctgagtga

SEQ ID NO: 8078 - DNA, 213 bp, Glycine max
  Peptide Sequence Number=SeqID_124856
atgaagaagatcctaggcctacaagctccaatggagcttacatcaattggtgcaggaggctctgaagtggccacaagagatcactcaggagtggtagcagttgtctcacctgcctcctcccctataacaaatggctcatggatggtggccttagatgactcatcttccacatgttgtagtacctggactgtgggaccttcatcttccctgtga

SEQ ID NO: 8079 - DNA, 336 bp, Glycine max
  Peptide Sequence Number=SeqID_124857
gtagcaggatcaacatggaccactagtctctcagcactaggtggtctagtacacaaggatcgtagacgtgaggctttgcgtgtccgcttcacgacagatgacgaagttgatgcatcggaaagaggagaaggaggaggaggaggaggcgaggcaggtggagaagccatgatccattatacgtcatcaaaatttgggtatgtgtattcttttgtgaatatgttagaggcttgggaagaccaaaaggagttgttttgtgaccaaatgcctgaggcacgtaggagtttgggggctgcaacatatataggagtgcctaacaaacttgacaggacttactag

SEQ ID NO: 8080 - DNA, 313 bp, Glycine max
  Peptide Sequence Number=SeqID_124858
caacaccggtgtacgcaccgatgatataggatttacattggtagacctaaagaaacttggttaccacaatgaccctttcatcatggcagaacaagctagacaagtattttatgtgcaagacccttatgatgaaaggtggtgcgtggttctaccgggcaaaacaattggtgttaatgtagaagatgatgattcatacatggacacctatgaagtagttgcagaggtggttcaaaagttgcaaccacgtgaagcatcaactttgtttgttgaggtgaaatctgaacatcttcgaagtatttatcccattttatag

SEQ ID NO: 8081 - DNA, 321 bp, Glycine max
  Peptide Sequence Number=SeqID_124859
atgttaaaacgaaaggatgtacctcaattgataagtggcagagacgaactcagcaaagatgaactccacaatgtgcttacagtgatggcagggcagggcagtttgcggcaaaaacaaactcaggcggaaggagaaagaagaagaacgataggcttcaagcgcgtgggatatagatccaacggtcatcatcacatcgacaattttagcggtcaagattgtgtttacagtaacatgaatagcaggatttttggcaagcacagtgatgcacatagtgatgtgaacaatgtctctgtaggattcctgacgcgcatagtggggtga

SEQ ID NO: 8082 - DNA, 144 bp, Glycine max
  Peptide Sequence Number=SeqID_124860
atggttggtgtgcttccaaagagaaaaatactgatgcagcatgggaagtcgcgggagaaccaagacacgacgacgtgcagttctacgtgtccccctacatccacacctgatcgatacttcacgaacttagacggtgtttcttga

SEQ ID NO: 8083 - DNA, 177 bp, Glycine max
  Peptide Sequence Number=SeqID_124861
atggagtatgagggtggtgaaaacaaccatatagggtttaacttaacatcaaattccaacagaccgcagtggtcacgaaccccgacggtgatcacgaaccccagcgacgacgatggtgtggaggagaccacagtgacaggtcttcgcggtgaaggagaaagatacttttgtttctga

SEQ ID NO: 8084 - DNA, 192 bp, Glycine max
  Peptide Sequence Number=SeqID_124862
atggcgaagctcgaggacctccccatccctaatcacgacacgctggaggcagtgtatggtgagctggaagaaacacggcgtcgtttcgatgttttgtggtcaaagttcgtggacctgttcggtgacagtcccgaggtgattggtcggtcaccggggagagtgaacttgatcgctaacgaaaatgatacctga

SEQ ID NO: 8085 - DNA, 2790 bp, Glycine max
  Peptide Sequence Number=SeqID_124863
atggccaccatggagcgccggaaaacgatgaccatgaattgggatggcctcggcgacgacgatgacgacgaccacttcttcgagacctacaaccgcctctccaccgccgtgccacaggacctcgctgacgacgatgacggcaatttcgaagacagccgcctctccttcgcctccaccatctcctccaccctcaccatcaagccccgaacctcacacttctccgcaaacttcaccggaaaaccaaactacgaaatctggatggccgcgccgggatccatctccgaacgccgaagaaggttgctgtgtagtatgggcctcgacgagaacaaggagctgctccaagccacaagcaaagccatcgcccgcgccatgacgaaaaaatttgaaaacaacaatgacatcaacaacaacaacgataataacaacaacaaatacgctgccaattccatcgccgttcgtgttgaaaagcagaaaccgtcgagctcaccggttttcgtccttgtccgatcgcggtccgagggcgacattgactctttttcgatggagaaatccaggaaggaggagataataggaaaggtgtcaaagcagcggttgacgagaaccgttacagaggtcgctcaacgccggcatgcccgcgttgagaacaaccgagtggtggtgaaagatgcggctgctggcgattcccttgtgcacgttgatgcacgggtgaatcgccaggtaatcacgccggtcatgggagtggccggcgttagcgcgttttttttaataaagaacctggacacgggaaaagagtttatagtaaacgaatacggagaagacggcacgtggaacaggctgagtgatttgcagacggggaagcagttaacgatggaggagtttgagaaaacggtggggcattctgcggtggtgaaagaggttatgagacgagccaacgtggcacgtggcgagaagaagctttcttcgaactcctacatttcaaggagtttgaggttaagcaagaggcgaggtgcgtctttgctaaggaacataaaaggtgtggcgagtggattcgtcggggagcgtgagcgcgaagcggtggttccgccgcaagcggcggaaccggcggaaccgaaggggaagaacaaatgggtgcgcgtgaggcagagtgggaagtcgcaaaaggagctatcggcgctgcacctatgccaggagtttgaggcgcacgaggggtgcgtgtggacgataaagttcagtttggatgggaggtatttggcgagtgcgggggaggacaaggtaatacacgtgtgggaggtgcaggagtgggaggttatgtcgttgaggcccgaggaggggaacttgacgcctattcacccgtcgttgctttcgtcgatgacgaaagggaagaatgggagcaggagaggaggtgctggagctattccggagtatgttcatgttccggaaactgtgtttacgctatccgagaagccgtattgttctttcactgggcatttggacgaggtcttggatttgtcgtggtccagatctcagttacttctctcatcttccatggataaaacagtgaggttgtgggatttggaaactaagtcgtgcttgaaattctttgcacataatgactatgtgacctgcgtgcagttcaaccccatggatgaagactatttcattactggctcccttgatgccaaggtcagaatgtggaacatccctgcacgcctcgttgtggattggattgatatccatgaaatggttactgctgtttcttacacccctgatggccagggtgttctagttggtacacaaaaagggaattgtcgaacttacagcatagaagattacaagttaactcaatctgacacaatcgagcttcgaaacaaaaagaaatctcagctgaaaaaggttactggtttccagtttgccccaaataatccatcagaagtgcttgttacttcagctgattcaaggataagaattgtcgatggatcccaagttgttcaaaagtttaaaggatttcgaaatgcaagcagccaaatggcagcttcatttactacaagtggaaggtacatcattagtgcaagtgaagactcacaagtgtatgtctggaagcacgaagagactcgcaatccgagctctggaaaagcaaggaatctgattgttaaccaatctcacgagcacttcccatgtaaagatgtttcagtagcaataccttggccatgtaccataaggggtgatccaccaccagtgccaatgcaaaaccccaaaaagaactcaaaacgttcgcaagaggactctgcagcaaacagcaagagaatgttgccacctcttccaaagaaaagcaacaaccacaccacagaaagtgcaccaggctccccagaacatgaccctgcagcgatttcgcacacagaatctggaattggagactcatttgggaacagcaagagaaggttgccaccccttcctaataaaagtagtaaccatgcaacagaaagcggtgactacaaacctatagaagaagaacttgaagcaatttctaggacacacacaggattaggtgattcatttgcttcaagctatggtgatccagctagtatatctgctgcagctactccatcaaatgcatcttcgtcttccaattactcatcatatgatggttgcaatggtgcctcatcaatacacccttcagcatggggcttggtaattgtgacagcagggtttggaggtgaaattaggtgttatcagaattttggcctgcctagaaggatgagacagaccaatatatttttgggccctacataa

SEQ ID NO: 8086 - DNA, 1369 bp, Glycine max
  Peptide Sequence Number=SeqID_124864
aggaaactcggtgaccagttgcccgatcttgcgctgcgagacggccagatagcgcgactgcgggatcaccggaatggcggaagggttcttgttgccctcggtggacagcgtctcgttgagcagctccagtttttccagatcgtagtcttcgatctcttcacaggagacaccgaagaaatcggagatccgattcacggtggattgctgaacgttgttcactcttccgtcaagaattttgtagagagtcgtgcgcgtcaggccgctgcgattggaaaagggaagccttggtttcaccgcgggcggtttttgcgcccggctgaaggccagtttgagcacccaatacagcaggctggcggccaccagagagttgatggtcggcacgccccattcggtcgccaggccaacggcgccgccgacgatgctggcgacgatcgccgcccagccgatggtcggcgtttcgctcggcagctggccggtacggcggctctcgtccaggatcttgcggtggctgcgcagcaggtaatagtccaccagcatgatgccgataatcggcgggaagaccacgccaagcaccgtcaggaagtcgacaaagcggtcaagaatgcccagcaccgacagcgtggtgccaagaatgccgatcaccaacgtggtgtaggtgtacttcagctttttgccggtgatgccttccaccgcgttgacgatgcccagcgaagaagagtacaggatcgccaggccgttcaccacgaactcgccggcgatgatggtgaagagcgtgacgccgagcacgtgcttgccgtttttggagtaacgagtcaggtcgggggtcatcaggctggccacgatggcgccgccgacgacgatggtgatgccggcgctgatggtcagcggttcacccggcggcgccagctggatgatctcctgcaggttatggccggaaagcgcggtcaccgaaatataggccaccagcatgatgaacatcggcaccgcgatacgggcggcgatgcgcagcgccttgaagccgaatgccaccaggatggtcagcagcgtgcccgagagcccggcggccaggccgaagcccagcttattgccgagcgcgaagtcgagcgacttggcgaaaatggcgttctgaatgccgaaccaacccagcaggctgacggccaccaccacgccgatcagcaccgagcccagacggccgaagccgcaccagcgcgccagcaggctgccggaaatgccttcgcgcatgcccgccagccccaggccgtaggtcaccacgccgaagatcaggctgccgacgaaaatggcggtgaaggcgtcaatcagcgtcatggagttgccgagcacggcgccgagcatgaactggtccagcgcg

SEQ ID NO: 8087 - DNA, 624 bp, Glycine max
  Peptide Sequence Number=SeqID_124865
atgagaacgtcgtcgtttcggagatgcagcaccggcgagtttgatttgcaggaaaattttgatgcctcgtcgccggtgaccggaggacacgcatatggtgctatgttgccggtgttcctcaacgagctgaggagtaatcatcacaaggaacttgtggagatcacgctggagcttgaaaacgacgccgttgtgctatgcaacgtggcgccggcgccatcttcggctccgaacgcttcgccgtcgtcgagcaccaccggaggcgacggaaacggcgggggaggtggcggaggcgtagcgcggagcctttcgattacgtcgaggattcggaggaagtttccgtggctacgttcgatgtcgtcggcgtcggcggagagtgtcactgccgcctctgccgcagtggaggatcctctggtgacggcgcgaaacgcgcggaaaatgagagtgaagcttgagcggacgaggtcgagcgcgcagagagctttgaaagggttgagattcatcagcaagtccggcgaggccacggaggagctgtggcggaaggtggaagaaaggttcaacgtgttggccaaggatggcttactcgctcgtgaagactttggtgaatgcataggtgaggaaatataa

SEQ ID NO: 8088 - DNA, 2079 bp, Glycine max
  Peptide Sequence Number=SeqID_124866
atggtggagggaatgtccctaatatcaaatgattgcaaaagggaaggccacaccaaaaagtattatcctggaagacagaaaaccaatggtgggagtgacaggcaaaagtacctgggagatgctgccattgttcatgataactatgagacatcaaaagttttggtgtctaatagcgacagtctagaaacagaatggatcatggactctagatatttttgtgaacaagctgaaggatttgtgctctttggtgacaacaagtcttgtaagattgctgaagtaaggtatgtacctgatcttaagaggaacttaatttcagttggtgaattagataaaaaagggtatctgttcaaaggagagaattcagaattgctagttgttaaggggtcagtggttgtgataagaggaattaagaagaaaggcctatattccttagatggtgatgttgtaattggaacaactacttctgcatttgagaaattgagtcaaaaaactgaaatatggcacaagaggttgggccatactggaaggaaagtgaagagattcaggactaataatgggcttgagttttgttcagaagctttcattgatttctgtaaagctaatgccattgctagacacaagattgtagttggcacacctcaacaaaatggtcttgctgaaagattcaacagaaccagtttggaaagggtgagatgcatgttgttgagtgcatatctgcctaagacattttgggcagaaactgctacgactacaacctatctaattaatagatgtctttccacaactcttgacatggaaacaccagaagagatttggtcaaaccaccctccaaagttggatcagcttaaagtgtttggttgtgttgcctatgctcatattaggcaggataagttggatcctagtgtagtaaagtgtatgttcttgggttatccagaaggtgtgaaaggctacaaactgtggtgtttagaacttggacataagaaatgccttataagtcgtgatgttgtgctcaatgagaatatcatagcttatcaagacaaatttgatctcacaaaaccaagcacaagtgatacatacaagactaaatctgagagagtcaactttgaggtagagcagataagcaagggtggtcaagctacaaagaattacttgttatctgataaagatgatgatgaatctgagcaacagacatcagagctagacaattatcaattagctcgtgatagagtcagaagagaaactaaagctcctgagaggtatggatatgctgatttgatagctttggcactcacttttgcaagtgaggttctagaagaagaaccaaaatcatatgaagaggtacttgctagcaaagaaaagggaaagtggttgagaaccatgaatgaagagattaagtctcttcatgacaacaacacttgggagctgattagaaagcctcctgactcaaagttgcctgaagggtttatagtgaaaggcaaagaggattatgtctgcaaactgaagaagtcactctatgacctaaaacaatctcctaggcagtggaacaaaagattaccagttgtgggaacatttgtgattttattgttgtatgttgatgacattctgattgctaacaattccaagtctgaaattaacaaggccaaaggtgaattgaatagagaatttgagatgaaggacttaggggcaataagtaaaatcttaggcatggaaattaagagaaacagaagaaaaggaactctcaagctgtctcaggaatcatatctgaagaaggtgctggagaagtttggaatgacaaagttgaaactagtcatcacttcactgtctcaacagttcaagttgagtgcaaatcaagtccctaagacaacaaaagaagtgaattatatggataatgttcaatatgcaaatttagtaggtctcttatgtatgttatggttcatgtccaatcctgggagagcacactggcaagccctgaagtggatactcagatatataaaaggatgtcttgacttaaggaagtctctcacaggatacattttcgctgcttttggcactatcatcaattggaaggcatgcttgtag

SEQ ID NO: 8089 - DNA, 834 bp, Glycine max
  Peptide Sequence Number=SeqID_124867
atgttgttgctagaaaaggataggtacatgaactacagcagacaactcagcaccgcaagtgtgaattggagtcaaaatatgactgatttgaggcccaaaaatgagatacaaagattctgcagaacccttcaatgtcttgcattagagtattggagaaggggctggattttgttactgtggttggttaccactgctttcctatttgcctggaaattttaccagtatagaaacagatcaactttccaagtgatgagctactgcataccaatagctaaaggtgctgcagagacactgaagctcaacatggctcttattctcttaccagtttgtaggaacacattgacatggcttcgttccacaggagccaggaaatttgtcccttttgatgacaacattaatttccacaagatcattgcattcgccatagcagttggaatcgccgttcatgcaggcaatcatctggcatgtgatttccccctcctcgtaaactcatctccagaaaaattttcacttatatcttcagatttccacaacaaaagacccacatacaaatcccttctgaccggcgtcgaaggcgtaaccggaatctcaatggttgttttgatggctatctctttcactttggccactcaccacttccggagaaacgcactcaggcttccttcacccttcaacagattgacaggtttcaatgcgttctggtactctcaccacctctttggtctggtctatgttctgcttctcgtccatggaacgttcttgtatttgacccatcggtggtaccagaaaacggtaagaatttcaattgctatctacaatgaagggcatgtttga

SEQ ID NO: 8090 - DNA, 345 bp, Glycine max
  Peptide Sequence Number=SeqID_124868
atggaggattcgaaggaatttgcagtgtgtatattcgacgcattggttcgaaggaaggaaaggagagtgagcagcataaacagagaagagttgcatgagttctggttgcaaatttcagatcagagctttgatgctcggcttcagattttctttgacatggcagatagtaatgaagacggaagaattactagggaggaagtacaagagctcataatgctcagtgcttccgcaaacaagctatcgaagctaaaagaacaagccgacggatacgccgcgttaataatggaagaattagacccagaaaacctgggttatatcgaggtaaaaatgggacgacgagaataa

SEQ ID NO: 8091 - DNA, 927 bp, Glycine max
  Peptide Sequence Number=SeqID_124869
atgcgcggagtcgccaccaacgtttatttgaggaaaacgtcggaaaaaccggaaaggtatgatctacgaactttaagtgtgaaaggttcggaagttgtatttacgcacggggaaggtattagcaccccacgcatctgtcacaaaggacgacaacctttaatcgacccactaaaagtgaggacacgtagccctctaaagtcgaggacgtgtcaacctttgcaggtgagggcgtccagccctctgaaagcgagggcgtgcagcccactaaagaagagggtgtgcagccctctgaaggcgaggacgtgcaaccctctaaaggtgaggacgtgtagtcctctaaagatgagggcgtgtagccatctaaaggcgatgacgtgtagtcttctgatggcgaggacgtgtagtcctctgaaagcgagggcgtgcagccctctaaaggagagggtgttcagccctctgaaggcgaggacgtggaaccctctaaaggtgaggacgtgtagtcctctgaaggcgagggcgtgtagccctctgaaggcgaggacatgtagccctctgaaagtgaggatgtgtagccctctaaaggcgaaggcatgcagccctctgatggcgaggacgtgtagtcctctgaaggtgagcacgtgtagtcctcggaaggtgaggacgcgtagccctctgaaggcgagggcgtgcagccctctgatggcgaggacgtgtagtcctctgatggcgaggatgtgtagtcctcggaaggtgagtgcgtgcagccctctgaaggcatgtagtcctcttatggtgaggacgtgtagtcctctgaagttgagggcgtgcagccctctaaagtcctctgaaggcgagggcgtgcagcctctgaaggtgagggcatgcagcgctctgaaggtgagggtgtgtagtcctcggaaggtgaag

SEQ ID NO: 8092 - DNA, 960 bp, Glycine max
  Peptide Sequence Number=SeqID_124870
atgaagcaggatgtcaagctatttatctcttcttgcatagtatgtcagcagactaagaacaatcatcgcaaaagctcggggttactctgtccacttcccatgccagcacgaaaagctcggggtgtacataggtttacttccggcgcactacactgctgccactgtggccaggatatttatggagattgctggcaaaatccatggcatgccacgcagcctcatcctcgaccgagatcccctgttcgtgagtcgcctttggcaagaactattcaagctaagcggtaccaaactcaagatgagcacggcgtatcacccccatatggatggccagatagaggtgatgaatcgcgtaatcgagcaacacctccgagcttttgtccaccaaaaaccgacaacatggggacgtttcctcctatggccggagtggtcgtacaacacatccatccactccgctaccggcaaaaaaagaaggagagtgcggacaaacaacgaagggatgttcaatttgaggaaggcgcgcaggtcttggtcaaattacgacctcggcgccagtcaacggctacaggaagtcaatattcaaaattggccaaaagagtcatcacgcatacatccagtatttcactgctcactactcaagccatatactccatccaccaccccgccggaggtccccctcttagtctaccagcttcgtcggaagaacaccagccactcatttcccccctagctatcttggacactaagtggactcagtcagagaaggatagtgaattacttgtcctcgtgcaatgggctggcctactacctgaagacacatcatgggaaccttgggcacaattgaaagcggattataaccttgaggacaagtggagtagggagtgtcctggcagcattgctcctgatggtagtggtgctcctaaagatcctttgttggctgagagtaatccgttaggattgtga

SEQ ID NO: 8093 - DNA, 393 bp, Glycine max
  Peptide Sequence Number=SeqID_124871
atggagacccttgggaagccatatgcgaccattttgaaggatgaagtcgtcgcggatggagctgtcagggtatttggaaggatcggcttgaatttgttgacgaaattcgaggaaggcggagttgtggaggagctcctgtttaactctttgaggttgcggtggtccgtgagaatggtgaagggactgcccaacaagtattgccttccattttttaacggcggtggtgatggcggcgagttccctgacatacgtggatgcatgaagaagcttagggcaaaaaggtttactaaagaaggctattggatggttcttctgggacaggactgctcccatgccgacgtcggaggcgttagtctcgacgcagagtgggatggagaagtctggcaagcttag

SEQ ID NO: 8094 - DNA, 570 bp, Glycine max
  Peptide Sequence Number=SeqID_124872
atgctattatacttatcaaccctaactctgaaccaacaaacttgtctgcagccatggatacgtcgcaatcgttgtgggctctgttctcggcttggcgttgttgctgctgttgctgtgtctgaggtggcggtggagacaactagtgaagtcgccgaagtcggtggtggctgcgcgagttgccacgccggcggaggcggggacgttgtcgtcgaaggaggatataaccgggggtttggtggaggcggagaggaacaagctcatgatttgttgagggcttcgatggaggtgttggggaagggtagcgtggggacttcgtataaggcggtgctggaggaaggaaccaccgtggtggtgaagaggccgaaggatgttgtggtgacgaagaaagagtttgagatgcaaatgaaggttctggggaagattaagcacgagaatgtggttcttctcaaagccttttacttttccaaggacgagaaattgctcgtttatgattacatgtccgctgggagcttgtctgcgctactacacggtacgatgttgttgaaatccctaattcatttatctgtttga

SEQ ID NO: 8095 - DNA, 336 bp, Glycine max
  Peptide Sequence Number=SeqID_124873
atgattcaaagggttagttcatcccttctcaagccagcgaagcgagaaggtgcattgggaatacgtgagtgcctggaatcacagggtcatcacagtacattgtcaccgatgacaaagaaggacctgattctgggatacatgggtgatgggtgcttgttcacccttagcaagggatgtgatagtctatccatatggaatttattcatttctcaagggatacaacctatccacgagagtttgtcctttgggcatgtcctaatgcacaatgatttcattaggtctttaaaggttttgctccctttcaaccgtcacaatcataagaattggtatatttaa

SEQ ID NO: 8096 - DNA, 306 bp, Glycine max
  Peptide Sequence Number=SeqID_124874
atggaaggaaggcaagacatccgaactaccctaggaacaccaaaggtgaacaagggtctcaaattactcttcatgttgatggtagttgtcaaggcaatccagatcctactggttatgaaggatatagggattgcggatattgttaaagctgagttgatggccctgtttcaagggttgaatgttgcttgggagttcggttatgctgacattctgtgtctcggaatcattgcttttgtaaattctcccttgtacttgcatggtttgcttgtagcggatgctatgaagattcctatccttagggagtag

SEQ ID NO: 8097 - DNA, 726 bp, Glycine max
  Peptide Sequence Number=SeqID_124875
atggctggcagggacaagaaccctacatatccacatgacaaacaagtaaacatggatgaaaaactaaatagggttacctatagtaaaacaaaagaagccaatgacgctaatctgggcgcgccaccgtctcccaacgagctccgaggccagcacaagcgcggaggtcccaatggtagcacgagcaaagccacagagaaacttgagggcagaatagatggagacgttgggcgaaaaagtgacgagaaaggaagtgatggccatgacgaggcaggagaagaacagcatgttcttgcggccgagcgacgaatcagccagcgaggccagcaggaagccgccaagcaaacagccagcgaagaacatcgaagcgggaaggcccgtgatggaggagttggcgcactccaggccccagtccgacaccatggaggcctgtgtgggcccgtcccaggcccacgagccttctgggaggttgcagactgtgttggtgttggcagtcttgcatgcattgccggcctgctcggtgcagcgccacgccggcggggcgtcggtgaagacgctgatgaaggtctgctgggcgtcaaagatccacgcgagggagacgaggatcgactggaggaactgggaccagttgaactcgcctatgcagagttcgactgtggaccccagagagggatgctgttggtttcgtggcggtggtggtggttgtggtttttgtgtgtccggagatga

SEQ ID NO: 8098 - DNA, 852 bp, Glycine max
  Peptide Sequence Number=SeqID_124876
atgctctactgcatccttgtgaagttgttcgttacggagtccccaagatggcttctagtgcgaggaaaaacagaagaagccgtggaaacactaaagtgcatcacatcaatcacccaaagcaacctcaatttggccattaataacatgtcccacgaggaagaaacatgtgacgtggacatcttctcagccctcaaaatcttgctacaaaataaatggtcttcgagaaggttatcatcaattatggcaatgggaataggcattggattggtgtattatggcatgccactagggctccaaaacctctccttcaacctctacttgagtgtcatattcaacgccttatccgagttaccatcagcattgattgtgttattcttcatagacaagttcaacaggagaatcacactcctcctcttcactattttaagtggtcttttcagcgtgatgtcaaccgtgcaagtgagtaaatcatcatcatcatggaacaacaacgtgcaaatagtgtttgagttagtttcgttctttagcgcttgtacttcgttcaacgtgtacctaatttataccacagagttgttcccgacgtgtgtgaggaactcggcgctgtcgatggcgaggctcgcggtggtgctcggtggcatgttcagcccgctgctgggtttagtggggtctttggaatattcttgcccgagacaaaagggagggcattctgtgattcaatggatgaagaagaaaacaaagagaaaaacatggcttgtggcatgttgttggcttgaattctgcgggtttcgaaaatggaaaaagaaaacatcgggtgagtgtggttggtggatttaccccaattggcaagtgtga

SEQ ID NO: 8099 - DNA, 279 bp, Glycine max
  Peptide Sequence Number=SeqID_124877
atggcaagctcgggaacacaaggcaaagaagcactagctgaacttctgggtattttgcttgaagaagctacagcaagaaaccagactgagggaaataaggatcttaaccacaatgagaaggactatttgcttcctaaagtagttgaattctctgaagagaatagacatgggggaaaagacacatctaaggtagagctttcagccaatgaaggactcaactcaaacaaagcttacaggaataaatcattgatgacagagaagtggaaccttggaaccaga

SEQ ID NO: 8100 - DNA, 444 bp, Glycine max
  Peptide Sequence Number=SeqID_124878
atgtcagtttacgatctgccacccaagatcctctgtcgggttatcaacttcatgctcaagagaccagcgcttaattttctttgcttttcaataactaagtttgaaaatgaatttgtttttgatgttatggtggagccagacacaaatgaggtatttgctcaagtgactttacttcctgagccaaatgttgagctttgtgacgaagatgaatttgtggtgttagcttgtgatggcatatggtattcttcttataggttcagctttgtaacaacaccaatggtttttcattctaggcacatggtggtgtcatttgaagaaaataaagtttatgtgtacaattccagatcaccagctagcgtcgtgccgtcgaaacttgttggccatgttaggtttggtggggcagttttggctaaaaatcagaaactgcctacccctttgttttag

SEQ ID NO: 8101 - DNA, 453 bp, Glycine max
  Peptide Sequence Number=SeqID_124879
atgtcaccagaggacctgcacacacatgccacaactccctgcacaccggaggaaaccgcattacctttcaaccactctttctctctcttttttgcctttgtttctttgtctctctttatcgtcattgaggacctcgatgaaggtgtggttgacacagttctcgaggccgaggttgcggaggccgacatcaacgtcgatggcaaccacagagaagcccatgatgacgaagaagaggtcgatgttagtgatgttgatgatcttgtccacactgcctttgtcgaaggtactgactgtaacgcacaggatggagccgaagagctcgatcgggcttgcggttccaattatggagggcaatggggggtttgggtttggcttttttcggggttagggttttggatgggaggagaagggaatgggggcagaggagaggaacgggcgcaaggggggatgtaa

SEQ ID NO: 8102 - DNA, 276 bp, Glycine max
  Peptide Sequence Number=SeqID_124880
atgtctggccagagaaacttcagaacttcaaaattcacggaaagtgagattaatgatctgatgttgaggctacaagcactgctaccacaactaaaccaaacaagaaactcaagggcatcagaaagcttgatgaagatcatgaaggaaacttgctctcacatcaataggctacagaatgaggtgaaagaccttggtgaaaggctagcagagctgattgattctgtagaccttagtgacattgacgaggagtgtcttacaagacttttacaacaataa

SEQ ID NO: 8103 - DNA, 1008 bp, Glycine max
  Peptide Sequence Number=SeqID_124881
atgtacggaagaacttcttccgtagaaagttacggaagaacttcttccgtgtgctctatatggaagaacttcttccgtatgaaaagcttcttccctaaaaagctaaacgaagaacacttcatcaacgacaaaaaaataaacgaacaccccataccttggtcgagtcaaaatgaaaacagcacgttccaactacacaacaacactaaccctctaacagcttcaaaaaaccatactttaacacaacaacaagaccaaaccggaaaaaagacacttaaaaggtgttcgcccaggcttgggcctgggcccgtcactgaagctcaactacacacatggcaagcactaagaattaggcaaagcagaaagatcccgtcgtcgcaggcgcagagtagagcagcacagaagagggaaaacggcaccgccgccgtagaagaaaacaaccatgatgggaagacattcaagaagccgcgtcgtccgtacgagaaggagcgtctcgacgcggagttgaagctggttggtgagtacgggcttcggtgcaagagagagctgtggagggtgcagtacgcgctcagccgcatccgcaacaacgcgcggaacctcctcaccctcgacgagaagaacccgcgccggatcttcgagggagaggcgctgctccgaaggatgttccgttacggtctcctcgatgagacacagaacaagcttgattacgtcctcgccctcaccgtcgagaactttctcgagcgccgcctccagacccttgttttcaagtccggcatggccaagtccatccaccatgctagggttcttatcaagcagagacatatcagggttggtaggcaagtggtgaacatcccatctttcttggtaagggttgactcacagaagcacattgacttttcacttacaagtccccttggtggtggtcgccctggaagagtgaagagaagaaaccaaagggctgctgctaagaaggccgcaggtggagatggagatgaggaagacgaggattaa

SEQ ID NO: 8104 - DNA, 363 bp, Glycine max
  Peptide Sequence Number=SeqID_124882
atggacagttcatccaactttgatgacaactctgatgtggggtaccaaccttcaccttcttctgtggatcaaaatgatcattcaatcaccgaaaccgttggatactcccctttattaagtggcgaatctttcgcgtattgccggtctaattcggaggtctctaacttctctgagcccattgatgacaatagctttgcaagtgatcaaccttcaccttctctatggacaacaatgaaacatggagctagccaagcttctctttcaagattaggaatgaagcagcacagaaactcactggatgagaaatctgatgaccttgacctcttagagacagataatttattagggtgtgttgctagataa

SEQ ID NO: 8105 - DNA, 132 bp, Glycine max
  Peptide Sequence Number=SeqID_124883
atggctcttttatgctgctggacatatttgcagcctacaacactcgcccagggtgttacatttcgcccgcactcccgtcgtagggtaggttgcgatagatggcgactccactggagactgtttgagagttaa

SEQ ID NO: 8106 - DNA, 156 bp, Glycine max
  Peptide Sequence Number=SeqID_124884
atggtaaagactctcttggaaaatttgatacaaaggtcgatgaggctatttttcttggaaaaggattctgctcttgaagatgacatcaaacctgaagagcttgaacaaagaaaagagatctccataagaatgcctaaagaatttcctagagaatga

SEQ ID NO: 8107 - DNA, 684 bp, Glycine max
  Peptide Sequence Number=SeqID_124885
atgtctatgatggaagagttgaacttctttcttggactccaagtcaagcagatgaaacatggaaccttccttagtcaaaccaagtattgtacaaaactaattaggaaattcggtatggaaaaatgcaaagaagcatctactccaatggcaacttcaacctaccatgacttagatgagaaaggaaaatcagtggatgagtcaagatatagaggtatgattggatcacttttctacttaaatcagtggagtgtttacttatgtgcaaggtaccagaccaatcctaaggaatctcacttaacatctatcaaaaagatcattaagtaccttaaggacacaaccaatgtaggtttgagatggttagcaaccccttcagagctcaaaagaaggccaagccctccaagaagaagcaatgagagtactctcaggctgttctcatcaggcttgatacatgtgaagaatgtgagaatacccaagtttttggacttggagtggttttctcatcaagggtttaacttcccaaatctgctagaagcacagggtttgtccaagtttgtgcagatgaaaggaactttctacccagagctggtgaaagtcttctatacttatgtcgcaccgatatggaagaaatggttatcgatgctggtttggaaggcagtagctaggctggacattggtggagtctga

SEQ ID NO: 8108 - DNA, 572 bp, Glycine max
  Peptide Sequence Number=SeqID_124886
atggatggcctcaaggttttgtctgcatgtctcaatttggtcccaaaatttagttctcaacttgcagccccattgattcatcttgtgagagcaataattgagcttagagatgatgttagtaaagaaaggtttggaccaaccagaatggataacttcttcaaggtcaagttcaagaagccaagcattttcaaagttgatttttttgggaaaagatcttcttttggttgcatcaagataaagaaggattggagagtggtgagggcagtgtttggggtcgtgcaacttctgtttgagaaggttgttggtgatgatccacatgttgctgtcactcatagagagaaaggcaccgtgagcaatggtacttacgtaaggtcctctccttctttaatagcaccaagaattagcatatttttgtcgaagcttcatggccaccctttaagcacccacagtgctagctcaaaattgagctctaactccttgtcctcgtcttacaagttaaggtcctccatggttggttcttccatagttgcagggaaagatgtaaaagcttgggaaaaagcaagaacatatag

SEQ ID NO: 8109 - DNA, 861 bp, Glycine max
  Peptide Sequence Number=SeqID_124887
atgaatcaatggggctgcaagttgagaactaaattttgggaccaaattgagacatgcagacaaaaccttgaggccatccatcatcttaaaggccctgcgaatgttgctcactatacaaaaattcaagagaagttgaaccttcttattgctaaagaagaatcatattggaggcaaagatcaaaagtcttttggcttagagaaggtgacattaattccaaattcttccactcttctacaaaagctaggaaaactgtaaataagatttcttctctttctcgtgatgatggtgttatggttcatagtcataaagatatgtctgatgtagttgtttcttattttagcaatttctttcaagccaatgataattgtattgatattcttcccattatcaataattttcctcattctgtgtccttttataacaatgacatcctcttatctccttttactctggaagaatttcgtgtggctttattccatatgaattctcaaaaatccctagaccctagtggacttaaaacaactttctataaaatattttggcatctttgtggccctgaagtcttctactctagtatcacatggcttgaaacaggatcttttccaccagagagagggctaaggcaggatgacccactttcaccttacctttttattatttgtacagagggactttcttcacttataaagtaccatgagaggagaggtgacatccatggagtgaaggcttctggtcaactcatcaattttcaaaagtcagaaaccgaaaaatacttgggtctcccatcaattattggaagaaggaagaaagcaatatttggattccggaaggataggctatggaatgatataaatctttag

SEQ ID NO: 8110 - DNA, 180 bp, Glycine max
  Peptide Sequence Number=SeqID_124888
atggacattctcaccctgggtcaagggtttgggtttggccagcggttcggggataaaggggatgtctcacattatttccatgatacacatgcaacaatgatgattaggaaattttacgcaaaactggtcatgcatgaacctatgtgggcactcaagcatcaagtttttatggtcatgtga

SEQ ID NO: 8111 - DNA, 492 bp, Glycine max
  Peptide Sequence Number=SeqID_124889
atggagcgtacatcctttgtgctacagctagagcttcaagtggagcatacatccacttggtggttcaaagagaacaagggagggtacatcccttgtggatcttttcttgtaaagggatctaagacaaatgctagtgataaaaatgatgataaaatcaaacttccaccaaaacttcccaaaaataaagatcatatagaggatgtaaatgtggtggatctttcttcttcacaaggcccttccaatccagcatacgataagaatgaagaaactcatgacactcttgttagcttaaatgctaaaagtgtcaataaagacaagaatgaaattaaagaacccattgttgtcaatcaagcaaacttgtctatgggggtagtggttgccacttcaattgccttgcaacaatatgcaaaacccccaagtttacctcttgatgttgtccaatataatgcaaatcatattgatgttgatcctttctccttcattgatgtttga

SEQ ID NO: 8112 - DNA, 294 bp, Glycine max
  Peptide Sequence Number=SeqID_124890
atggcgaggagaatgaaagggaagatgaatagtaattacaaagctagggatcacagaagagaaaaagagtggagagttaaaaagaatgaaggttgtcgcaaccttccctttggcgggagggcgacgtgtgactcgcgggtgcgtcttccaagaaaggaatacgcgcggagtcgccaccaacgtttatttgaggaaaatgtcgaaaaaaccggaaaagacgtggtctatgaacttcaagtgaaaggttcgagagttgtatttacgcacggggaaggtaataaagctacgtgttga

SEQ ID NO: 8113 - DNA, 537 bp, Glycine max
  Peptide Sequence Number=SeqID_124891
atgaagagagatgtgatattagaaatgcaacataaaaatgcagcaagattgccattctttgacagaattagtgaaggtctacctcctgggttcgaaaagaaaatgtcaaccaaggaccgagaggagaaagaaatgataacagagtctttcaagtttgggtttgggaggactattgaggatttgattcctcacaatatagtagtgtcatacttttatggaaaaccttcaaatttagagggagtggtttgtttggatatttcggtaggcagtaggaggaggcctatggtgtttttgaatgaggatggcaaactcataatggtcggaggggatcaatcatcgtatggaatctgtgttgcctttgcaagtgaagctgatcaagcaatggcaaggaccactccgttcgaaattgaagattcattctatgtgaataacatattaggtgacgaaaaggaccaattcttttattgggatacgaataaaggtttcttgttgattaacaaggttgttgagaaaacaaccaaagttgaagaaccatga

SEQ ID NO: 8114 - DNA, 225 bp, Glycine max
  Peptide Sequence Number=SeqID_124892
atggaaatttctccagatatcagggtaaatttactcaagaactttggatcattcatgagaaaccaaatgacttggggtggtgctggtgctgaatcatttttagaagttgatgttaagttgaatctcacacttgagatctacacacaaccatttaccatgatgcctacttcagccgttgagggtcctggaaatatgttatgcactccgcatggtcaagttctctga

SEQ ID NO: 8115 - DNA, 228 bp, Glycine max
  Peptide Sequence Number=SeqID_124893
atgtataagataacggggggaaaggagaatgagctggactgttgggcaaaggttcatgagaggagaaatacaaatgcagttaggtgtaaggagggaaaatggtgggagagtgtaacgcaatgtacacatgaaggcaatgtattggagaggggaaggggagaggggggcgggggggaggagagagaaggaaatgtgaacaaggagagggcaaataatggtgtggcataa

SEQ ID NO: 8116 - DNA, 219 bp, Glycine max
  Peptide Sequence Number=SeqID_124894
atgttgaccgtcatcgatagtttcaaggtctacaacgacgtcatcttcaaagatggacccccaccgtctttgaaagtgattttcgaccgatgtaaaaaggctttttttagtagtgtcatcgtcattagtgagggtacatatgagggttgtggcagcatcattgaagttgaggagaggacaaagggtgtaatgttttgtttctttgcggtgagaggctaa

SEQ ID NO: 8117 - DNA, 854 bp, Glycine max
  Peptide Sequence Number=SeqID_124895
atggctccgaagaaactctccacgaagaggtgtagaagagacgccacaagagatgggtccagtaccaccccagagtttgatagtcatcgtttccggagtgccgagcaccagcagcgcttcgaggccatcaggggatggtcgttccacagggagaggcgtgtccagctcagggaggatgagtatacggactttcaggaggagatagctcgcagacgttggacaccgctggtgactcccatggccaaatttgaccctgagatagtcctagagttctatgctaatgcttggcccatggaggagggagttcgagacatgcgttcgtgggccagcagtgtgagttcagctaaaggaggaatagggttgacgggttcgacgaggaagccattgcccagctgttatgcacaccggggtaggatttcgcctggaccgctgcagggaggtatgccacccaccaggcaccctctggacccggataagtctaacagggccctggggtttccggcactgatcacgggcctctgccagtcattcggggttcctgtcacccccagccgcagacacgccgccaccacctcggcaggccgatcccgctggatcactaggcatggagcgttatctatagcacttggttcgccagcaggcggccaaccacccctcagtcagcaggggcagggttccgctccttttgcatgccctactccggagcagtttggggctgaggtcgcatggcctagagactggcccgaggcccaagcaggggaggagcctgcaggatcccccggtgaggcagaggaggctcgtatggatgaagatatgactgacttgctcgatttcttaggaggaagtggagccac

SEQ ID NO: 8118 - DNA, 270 bp, Glycine max
  Peptide Sequence Number=SeqID_124896
atgaaagagattgtgactgtccaagttggtgatttcgccaacttcgttggttctcacttctggaactttcaggttatcccttcatatactcctcgcctactttcaataaacttaagagctgtccaggttgcagtcaaaaggaggcagctctttccgaacaacattttaagaagcatggaagaggagtatgaggaggacatggagagggtgatgtttaattggttggttaatgctgagcagcatgtcttaagtctaggttgcttcttgtag

SEQ ID NO: 8119 - DNA, 1335 bp, Glycine max
  Peptide Sequence Number=SeqID_124897
atgaagacattaactactagtttggaaggtaaggatgatcaacctgtacctcggtggattgaacccaagatcattgaagctgctagagatgtccaggaaaacacggagatatatgcccccttcatcattcttccattggactctatcggggcttctcaatctattatgcagattgaagagaatactcgtggcctgagttggccaacttcatttgagcaacataggcaaagaactggacatttggatctggttgattctcttagatacatattgaagtctggacctggtggaatcaagtctgagggctcttcagagcttactaatacaggtgttcacgcgatgcttacaagtgagcaaggcatgtctcttcacggggaacacatagctgagcatagagttcttgcaaaaggaagcaataggggaaacactcaggaggagccaacaagcagccctaacactttaataaaaagcaaggtatctcgggcaccaagaacaggttcagctagtgcactagaatcatctaacattcaaccttcatctacaacatttccaagttggccacctaaaaattcacgctcacgaagagtgaaagtagtttctcctgcctcacgcaatattgaagttcaagtctcatctgaagttgatgatatttcatctgcctttggattatctgaaagtgaagaatctggagcgggggaaaacaaaataaaaaagaaagttatgaatggaagtgactttgctatggccgtagataagggtggcgcttctgtgtttcaaatgaagaacaataagatatcaacagatgaatctggagatacttcagagaatgttccaacaatgaagccagtacaggacatgaagcctaatgataagagtagaacaccttggttgttcgggtccatttttgcttctataagcttggatgatgcatcttacttgaagcaacaggtcaatattgctgaggaatttgataaaaaaagtttatctcctatgtttggcattgatcatgatctgctgggtgttgttataaataacaagtccactcaaggttcagaggaaagaaagagaagtcactgtgacgaagaatcaactaagtttgatgctttaggtggaaaaaaggacatggaaagactggacaagcttaccccactattccaaagacttctttgtgctctaatcgaacaagatgaaagtcaagaatcatatgaccaagtgatgcaaagaatatatctcgacaatgtgctagtgatcattctcactatggttcttgtaatcaaattgattttgaacccaaagatcgagatagaatggattctgaagttgaatcagaggtga

SEQ ID NO: 8120 - DNA, 1491 bp, Glycine max
  Peptide Sequence Number=SeqID_124898
atggataaaagcaaggaggttgcaactcctatgactacaaattgctaccttagtgcagatgaaaaggggaaactcattgaccaaacatgtatagagtctcatttatcaacaagtaagagagttataaagtatcttagaggaaccttagatgttggcttgtggtaccctaaaggacatggcctagtatcttggaatagcaagaagcaagcatgtgttgccttatctacggctgaggctaagtacattgctgcaaggagctgttgtgcacagattttgtcacttaaacaaatcctttctaattttggattgcatttagaacacattcctttaagatgcgataacagtagtgccattagtctcaccaaatatcttatcatgcattctaggataaagcatatagagattaggcatcatttcattagggatcatattcacaaagacctctttttgaagaaagtatctttgttatcctttcaaccttctaaacacttaaacctctctttctaccctcatcctcaacctccatcaatgccaaagaagaagaacaaaaggataaagaacattggacacaaacccacagtccctagaacgaagaaggagaaggaaccgacaaagggtggtccttcaggcagaagaaaacgggttacatgttctcccttacctcctactactccaaagggaactccttggttttctgaagaacactatgaggcttcttacaagttcagttatgcgaagaaggagatgattcaaccaaaatatgtcaatttagtgtggcttagaagtgaaggatttccttttcttgagttgattgagcatcacgggttaaagaagctggtggagatgaagggcacctactacactgacctagtaaaagttttctataccacaactcatattgatggtgatactgagttcttgtgtgttgaagtgaaagggcaacaaattgtgatgacaccaaaggtttggtttggcattgttgggttatcgtcaaaaggagttatggcgaatcaactgggtctcaaggaagctagattttctttcaacaaggttgagaagtacaagtctatgatgaataatccttctacctatgatgttgttgttacaaaatcaaagggaaaggaatgctttggtaccagacccctgatgcttcagcataggcttttggcgtatgttgttgcttggattattactccaagggggagaaatcatgctcaattgattgaggaggatcttctccttatcagtcttatgcaaggaaagttgaagattaactgggtcaacattatttttgatatcatgttgaagacaaaaaggattggctttttcaaatatccttatgcaattctggtctctaggattcttgattattttggtgttgatacccaagaagaatctaaagaaactgggattggatggactgagaagagtagagaagatcaagcagaacaagaagaagcagaagagaagcccataagtccctttgagtaa

SEQ ID NO: 8121 - DNA, 408 bp, Glycine max
  Peptide Sequence Number=SeqID_124899
atgatgagcatgaggaaaatgatggaggtcaacacgactgcagtcgccactacaagtgccaccattgaggtggacccaactcacccacctggcctcaaccaagtaaattgcccagcctcagacatggtccagagcaagcattccttcccactatatggcttgcctatcaactatacaccacccaatgttgtacacgctcctgatgagaacatcgataactctgctcctattctcattgaaagccaacaaccccaatctggtcaagcacaggtccctcaacccatgggggagacacatgaagtaccccgagaccgccctctagccgactccaagcctcgcctcagatatgccactgaggggcaagcatttggtggcatacctctaccaaacactttggggggcccttaa

SEQ ID NO: 8122 - DNA, 650 bp, Glycine max
  Peptide Sequence Number=SeqID_124900
atggtcgacgtggaccgcagacccaccggtccaaacccggcccacgcagccggtctaaggcggctcctggctcgagccgcttcggtgtccgcggcgtccaccgttcgcaaccgcaacagccttcactcattctccgcactctcggaaaaagtcataacccacctccgcaactcgggaatacaactccacgcgagtcacgccgccgagttcgctcgctctgattcggatcccattctcaggaagcagagatccgtatccgagaaccactcctctgccgccaacaagtgccccgcccccggcttctcccgacacagcctcgacgccgccgtcgaacgccgccggagatcgaagtgggtggagggatatgtggggatgatgggttcggttctgagagaaggagggtggagcgaatcggatatatccgaaatggtttctggttcgggttcggtttcggttttgttggataatgaagaggtcttcgatgcggagaggttttcggattcgttgaagaaatccgggtggagttccgaggaggtcaaggatgttctgggtttgtatttgcgaccggaaaagaagggacggaaaccgcctaagaaggtggccactcaaatggtgaaaagaatagggaaactggtggagtcggcttcccg

SEQ ID NO: 8123 - DNA, 396 bp, Glycine max
  Peptide Sequence Number=SeqID_124901
atgacttcgaaatcaacaaaaatagataaaaccgagcaaagaataagacacaaatgtatgcacggctcagaagcacttggaagaagatatgcaaggtctgtttccgacgtgggtgccgccattgacactggcgggaagcttgaaccgccagtgccaatggcggtaaggtgggtaccgctagtcccggttgcgggacatgtgctgagtaggagagagggggtggtgccgccagtactgcttgcgggacaccttcagctagcaatcccgccattagagctggcgggacaggcttctcatgcacatggcactgaagctagggctagggaggagaatagggcactgtattggatagggaaatcagaaatcacatgcatgtatggcagcttaaagagctag

SEQ ID NO: 8124 - DNA, 234 bp, Glycine max
  Peptide Sequence Number=SeqID_124902
atggggtgggaaagcaagaaacaaaatgagaataacaaacccttagcttatgggctaaaggagacatctgattccgctacccatttgagacatgttgttacgggaaagatgaaggaaggggtgtcaatagcaagggaggtgcaggaagcaaggagtgctagaccacaaagggaaaggtccaccccaacgtatctagaaggctacgacagaagccatgcagaatggaatgcgtga

SEQ ID NO: 8125 - DNA, 4217 bp, Glycine max
  Peptide Sequence Number=SeqID_124903
atggcagatggaacacgttctaaggcatcatcagagcgtctggaagatgcaattgcaaagctcactacttcgcaacttgctatgaactcgaagattgatgatcttctccatcgaatgtctcagctcgaggcgaatcaacagcaaccgcaatctccgtcgtcgtcgttcgcaggacacatgtcgccgtctcaaagccccttccaccgtatgaagcttgatgttccgagatttgatagttctgatccaacggggaccagtgcttgcgtggttctagtggatgcatcgaaacgcacaactatcatcgtgcgttcttcggtatcggcgtatctttcagaatttgaatcattggccaacaagatagtagggttatcggctccgttcgtcttgagttgcttcatctcaggattgaacccaacgattcgcagagaagtgcaggaagaaaaacttctcgatgctcgccggccaccgccgtatcgttcactagtatccacaggatcttctaacacacgttcatcatcaagcaactctacgcaatccttgctaccaactccggtaaggactccttcatcaattccttttaaacgtttaacaccagaagaattggccacgcgcagggaaaaaggattatgttttcactgtgacgagaaattttctcgaggtcacaagtgcgcatcttcattgtttcttttagttatggaggatgaggataccacgatcgaaggggattcattacgcgactatacaccaactcaggagttgctaccagaatcatcactggcgcagctaagcttacatgcattatccggccacttggcaccagagacgttacgactgaaaggctttattaatgaccactctatcaacatcttgatagatggaggcagtactcataatttcctccataatcgtgtggtattgaacttaggattaaagtctactaaaacagcgccgcttagggtcacggtggggaatggcgaggaaattcactgtaatcagttgtgtacggcggtacaggttcacattcaacagcattctttcaccattgacttccatgtattaccattatgtggagttgatgtggtcttgggggtgcaatggttgaagacactcggaccagtcttaacggactacggcgcgttaacaatgaagttcatcactgggggtaaactcattgaactccatggggatcgcgagaagggaatcgaacaggtgtcgccatctcaactacgcaggttcgtacacacaaaccctactactgccttcttccatattcgtgttgaaacaacaaccacgcataactcttcctcaaaccatcccttacctgcaatcaatacattgatcaccaaatacgcttccctcttccaacctcccacgaccctgccaccatcacgatccacagatcataccatcaatctattgcctaactcaaccccggtgaacgttagaccatatagatatccttactttcagaagaaggagatcgaagaacaggtagctactatgctcgcgaaaggttttatacaacctagctcgagtccattttcatccccagtcttgctggtaagaaagaaagatggatcatggagattttgtgtagactatagggctctcaatgccatcacggtgcgcgatcgcttccccatacccacggtggatgagttactcgatgagctgggtggagcacggtggttctctaagcttgacctaatgcagggataccatcaaatattgatgagcacgtctgatatctgcaaaacagcatttcgaacacatcaagggcattacgagtttcgtgtaatgccctttggattgtgcaatgcaccttcttcttttcaggccacaatgaatcagctatttcaaccatacctcaggaagtatatcattgtcttctttgacgacattctgatatatagaatgaccatacatgatcatcttcttcacttggagacagctttccaggttctggtggcggggcaattttctctcaaactttccaagtgcacgtttgcacaagaacaattggagtatttggggcacatggtgtcgtcaagcagggtcactccggtgccggagaagatacaagctgtctcacagtggccaatacctcgcacaccacgggcgttgagaggctttctaggcctcaccggattttacaaacgatttataagaggctacgcagccttagcttctcctctcacaaagcttttgtgccattgccaatttgaatggagtcaagaggccgagacagcatttcagaacctcaagaatgctctcacggcagcgcctgtcctcgcgttaccggatttcaccacgccgtttgtggtggaaacagatgcctcggggtctggtatgggggcggtgttaacacagaagggccaccctctggcttactacagcaagcagttttgccctaagttgcttaattcttctacctacgttcgggaattagcagcaatcacggtggccgttaagaagtggcaccagtatttacttggccaccacttcgttatcttaacggaccaccagagcctacgcgaactcatggaccagaccattcaaacgccggagcagcaccgatatttggctagactactggggtttgactactccattcagtatcatgcagggaaagccaatgtggtagcggatgcgttatccagatcccaagaagaccacactgcttcactcttcctcctttcgatgccacgctttgtcttcctcgatgatcttcgcaaggagctagcccctctcgcgacatttcaagacttgcgcaatcgaatccaagaaaacctagcatcatacctagagtatacattgactgagggactcatcatgtacaagaaacgaatatggcttccctctaactcttctttcatcaaacatttgcttgaggagtttcatcaatcccctacgggtggccatatggggtccagaagactctacaacgtctgcaagacaattttacctgggcttcaatcaaggaagacactcgcaattccgacactgccatgggaggatctatccatggattttatcacgggactaccatcttatcatggccacacgtgtatcttcgtcatagttgatcacttctcgaagggtctgcacttaggcatgttacccatacaacatacagcacacacagtggcccttctattcatagacatggtgggacgtcttcatggcatgcctaaaagcatcgtatcagacagagatccattgtttatcagcaaattctggcgcgaactcttcacgatgaacggtacgaagctacgcttaagttcatcataccatccgcagtccgatggacaaacggaggtagcaaatcgcattgtagagcaatatctacgagctttcgtgcatgaaaaaccatcaacgtggggaagatatctaccttgggccgaatggtcctataatatgtcttgccattccactactggtatgacccctatcgaaattacctttggccggaaaccacccacttaccctcattacatcgccggtacttccaacaccgaagtcgtagactccatgctcagtcagagggaagcagtttttgcgatgttgcggcgcaagctacttaaggcccagtctcgaatgatggccaacgcaaattgccaccgtcgtgatcaagaattccaggtgggtgactgggtcctcgtcaagctcaggccacaacgacaagtttcggtcacgggcaccacctgttcgaaattaagtaagaggtattatggcccctttcagataactgaacgcatgggtaaggtagcctatcggttacaacttccagaccactcacgcattcatccggttttccatgtctcacttctcaagccctacaccacgactcccaccacggcgacagtcatggaccttccccctttggcatctgacaatcacccgattatcacacccttagccattgtagcatctaaagtcattccgtcggagaccggacccaagcatatggtcctagtccagtggcaagggctaccaccagaagaaacctcatgggaggactggtcaagcttgaagaacatccaccaccttgaggataaggtgctgcttgaagggcaggggagtgttacgggaaagatgaaggaaggggtgtcaatagcaagggaggtgcaggaagcaaggagtgctagaccacgaagggaaaggtccaccccaacgtatctagaaggctacgtcagaagccatgcagaatggaacat

SEQ ID NO: 8126 - DNA, 204 bp, Glycine max
  Peptide Sequence Number=SeqID_124904
atgtctccccgaccagtgtttcctgagtctcgggtatcacccagggtagacttggtggatctcgtgtcaaaggatgagggagaggagttggaggaggacacgccctttaaggaggatccttggatggatgaggagaaccccgtcacagggtcggagtttatggaggaggattctttggaggattcctctcatgagtcttgctag

SEQ ID NO: 8127 - DNA, 1413 bp, Glycine max
  Peptide Sequence Number=SeqID_124905
atgagggaaataattacaactgttatcatggttcatgaatatccttttagtgttgttaaggattctatttggatgtgggccttccaatatgcaaaccctgattttcataaggttactcataaaactgcaagaaatgattgtttggcactgtttgagatggagaataaaacattgaagaaattgttagaaagtgtgagcaagatcagtttaactatagatatgtggaaatctagccatcaagtagttgaatatatggttattactggacatttcattgacgtgggatggaatcttcaaaaaagagttttaagttttgtgaaagtgcctactccaaggcgtgtgcaagatggccttagtacaattaaggatatcattttcaatattcatgaaagtgtcaaatatattaaccacaacgatgcaagactaaaggcattttgtgatgttgttgagcaaaaacgcttgaaagaaaggaaacttgttattgattgtccaacaagatggaattcaacctttaatatgttgtcaactgctttgaaatttaagactgcatttgcttcttacaaagaaagagagtctcactataattatgcaccttcacttgaggagtggaatcaagttgagaaagtttgtaagttgctagaagtttttaatcttgctactcatgtcatctcaaaagtttggaaggttaaacaaatacttgataaggagattgaagatgaagatctcttcatgagggaaatggtaggtccaatgaagaaaaagtttgacaaatattggggggaatgtaatatgttgatggctatcgcaagtgttttggatcctaggtgcaaatttaatatggtgagtatatgttttcccttgatatattctaaagaagttgttgatgagaatataaagaaggtgaaaagttcatttgaagaattgtatgatgagtatgtaggtctatgtttacaagagtctacgtctagtgttgttaatttggatgataatatttcatcatcctcccaattgaatacttcagttgtcactggttttgacgaaattatgagcatgctacgtgaaaaggaagttgtttctcctataaaatcagaattgcaagattatcttgatgaaggtatttatgttcttaacactaattcctatagtgctttggattggtggaggaacaatagcatgaaatataagatattgtctaagatggttgttgatattctagctattccaatttcaactgtggcatcggagtccacatttagtgctggaggtagagtaattgatgaatttcgctctaaattaaacgaagaatttgttgaagcactaatttatggtggagattggtttcatgagaaatataatgtgaagaaaaaatcaaaggctgaaaaagaagagatacaaatcacattgaagttttga

SEQ ID NO: 8128 - DNA, 777 bp, Glycine max
  Peptide Sequence Number=SeqID_124906
atggctatctgcaggttgttctttagaagcaaaaagattatggcccaaattgttcctgctccaaaaagagcaaaggttgccaagccaacacctacaccaaaagaagccatcattttgtccaccattcccagacgtatgaagacaagagccacaaaagccaatcccaagattagtgacaaagagtgtttcatttcctttactagcaataaggagagtgttgcctcatcatcctcaagcagtgagtccactaaagatgcttatgtctcccttctccgtaatcccctattctcatcctccctctctgaagatgtccgaggagaaccaatcatcagagagtccatcactgttcaagctcctgagtggacaaagcatggctatgtgaacacactatcagaagctttcaaagttttcattagaagccatagttcatctagagccccctcagtggacacatccaatgttgtctcaagtaatcaagatgaggtggaaccaccaaagagtgagttccagaaaaaggtcaacctcaagacacctatcgccaagctcttacctattcatccaatagaccttgacctcacctcaacaaattactctatgcttggtggactacatgctcagatgtactttcacaatcaagcaacttcttatccattagggttgcacatctcaaaggccaccgagatcaaagttgcaaataagatgtgccctcatctaaccatttggggtgttgctaagaataagggctttaaactacattataatgaagaaatgccctga

SEQ ID NO: 8129 - DNA, 216 bp, Glycine max
  Peptide Sequence Number=SeqID_124907
tctttcttttctggaggcattgagtgggccttccgggctttgaacggcgccgcggaaaccgcagcgtttaacggcggaagaaggtggcggtggtgggcttttctagaagaacacggaagttgtggaagggtttgggtggtgatggagtggcagtgttgtttgagtggaactgtggagaggttggagatatttgtaaagggtgtgactagtgattag

SEQ ID NO: 8130 - DNA, 249 bp, Glycine max
  Peptide Sequence Number=SeqID_124908
atgccttactttggagtcattgaagaaatcttagaggttaattatgtaaaatttcgagtctgtgttttcaactataagtgggtacatagcaatatcggtgtgcaaaccgatgatttcggatttactttggtagatctgaagaagctcgcttatcagaatcagcctttcatcatgacagaacaagctaaacatgtgtataaactatctgtgcaaaaagaaagaaaatcacgcaagagaaatgatgtgtaa

SEQ ID NO: 8131 - DNA, 307 bp, Glycine max
  Peptide Sequence Number=SeqID_124909
gaatgaggataagggctacgtgggagtgcgtgagctcaatttgaaaatgggcaactggggatgggacgtcaggtggggtgctattgcccaaaaccaagcttggctaatctcgacccaacccgggcatagtcaatcagtgagaacctgtgacgtacctaaacaggcgagctcctggcagtcaaccaataaaagaacaaagaccacaaagcaaggaggcttgtgtggcgggcttaaaaatggagataggaagttaagatggcctctggtaatcgattaccaagggtgtgtaatcgattacaaggcttaa

SEQ ID NO: 8132 - DNA, 681 bp, Glycine max
  Peptide Sequence Number=SeqID_124910
atggctacctcatgctatcttgacccggttgagaaatgtaaatatgtagatgaatcaagatatagagatatgattgaccctcttctatatctaactgctagtcatctcgatattaggcatagcggtgcatctataagcttagttgggtattctgatttagattatgcaagacgtaaggtagataggaagagtactagtggtacatttcatttgtttgggagtgctttggtctcttggcattctaagaaacaagtttgtgtggctttatccatagttgaggtggtgcaagatatgcttccagaggaaaacacgttgccaaaaagatactatcaggcaaagaagatactgtgtccgatgggtatggagtacaagaagattcatgcatgcgctaatgattgcatattgtacataaatgagtttgaagaaatgcacaactaccccaggtttaagcatttatttgctaatgcaaatgacgcaaaagactttacatggcatgcagatgggagaaaatgcgatggactgctctatcagccgactgattcctctcagtggatgaagattaatagtctgtatctggattttggcaaagagacaagaaatcttaggcttggactcgccagcgatggaatgaatgcctatggcagtttaagcactcagcatagttcgtggcctattttgcta

SEQ ID NO: 8133 - DNA, 276 bp, Glycine max
  Peptide Sequence Number=SeqID_124911
atgtgtgaccatgagaataaaactcaagagtcaaagaatgatctagatgatgattgtgtagaaaatcttgaaggatctagcaatcttgaggagactagaccattgaatatgatgaagcaaaatgttgatacaagtcaaggatctacaaaagagctagccaaagaatggagaacatctagggacttatcactagacaacataataagtgatataaacaaaggatttttggatcttgtatcccaagaagagccaaaatctactaagaaaagtttctaa

SEQ ID NO: 8134 - DNA, 1101 bp, Glycine max
  Peptide Sequence Number=SeqID_124912
atggaagttatacctaattattggctaacatcgctagctgtggaatctcatgaatctctggtttctggtgctgagtgggaaagtgaaagccccaaggctggtttttcttctacagctttaggatggccttcctttgatgacatcaaatcatcttctctcacttattctctatcagcagaagagaaagcaactatggcagtgctgcaattgcagcacagagcattagaagcttgccagaagttcttagttggggatgctggttctgacagtgacgaagatgatgaggaggcagaggatgatgagctgctagataatgattctaaagaatctgaggagtataagttctttgaaaaagtgtttgcagaagatggtgaccttaggagatattatgaaaacaatcacaaggaaggagatttttattgtttggtttgtgggggtattgggaaaaaggtatggaagaggtttaaggattgtattggactaattcagcactccactgccatactaaggacaagaaggaagcgagctcacagggcctatgcacaagtcatctgcaaagttgtaggttgggatatcgatcaaatgccagctattgtgttaaaggatttggattcctcattggctggttcaaggaagcttttcgttgagcccaaaaatcctgctgtgggttgtattgatgatacaaattcaaatgatgttcttccaaagtttgctagaagggggctcaatttttttgagacgcaggaggagagtaatgagcaaaacagtggaagcaacaacactttgtctgagtctgaacgcgtgacaaaagctgagacagaaattttggccttgaagaaagccattgccaaattagaagatgaaacagaagctggcttgcttcagtatcagcagagtttggagaaaatgtctaatctcgagttagaagtgtctactgcacaagagaattctcaaaaactcgatgagcgagcaagtaaagctgaagctgaagttcaagccttgaaggaagcccaaatcaaattacaggctgaaagtgaagctagtcttcttcagtaccaggaaaaagtgaaaaaacagaggaccctcattttcaaagagtga

SEQ ID NO: 8135 - DNA, 363 bp, Glycine max
  Peptide Sequence Number=SeqID_124913
atggggttatacgtgcaacaacaacatactacagtgttggtggccttggcgaaaatatgtgagggtggatcttccattcacaatgtcacttatgctgatgatgttgtaagggcaggctcttcaaaaattcattgcatggccaacaaatcttctgaaaaagtgtcacatgaggagtccgatactagtccaaagaaacttcctgaaacagatgaaagggggacgaatgattttgaccatgatccgttgcgtcaactgattaagagcctatatttcatgtacgacacacctgttgagttgaagtgggatggcagcaaatttgggctttcaaatgttgatgcttcattcttcttgacattctctgat

SEQ ID NO: 8136 - DNA, 858 bp, Glycine max
  Peptide Sequence Number=SeqID_124914
atgatatcaactaagcctgttgatcgatatacaagaccagaatttacagagaatgggccgttggcaattgattttggtagacacccaatcctggagagcatacacaatgactttgttaaaacatggcaaaggttgaagacttcaaatatacttcatgatgccatccctcatacacatgaaagaataggtcatccaatgcatatcaagaatctatcattattgactgctgctaaaagcaaactttcagaggctaaaaagcaatatgatcaaatggtagagaataaacagttagaactatcaaggcatttgaaagaaatatctcagagaaatgatcaggctattaatcatattaagaggaagtatgagttggagaatatggaaattgtgaacaaggaaaaagaaaaggttcgatatgatttcctggctgacaaagccattgcagaaattgaggcaaagtgtggccaaaaaattgaagaatgcaaagaagaacaaaggcagcagttgatgcgcattcaagatgaacacacattgctcgttactcaaatgaagcaggagcatgacaagaggcaagcaagcctcatagctgaacacaacgaacagctaaagcgtacccaactgcaagctgaaaatgaattgagagagaaaacaatgtttatgaggaatgatcatgaagctcagatcaaagcattgaggtgtgaacttgaagatgagtgtcagaagctggaagaggagttgcatcttcaaaaatccaaagaagacaggcaaagggctttgttgcagttgcagtggaaagtgatgagtgacaagcccaaagaggaccaagaagtgaattcaaaacaggcacagttggggaaatga

SEQ ID NO: 8137 - DNA, 1098 bp, Glycine max
  Peptide Sequence Number=SeqID_124915
atggcattgtctgacaaaaataaacagcttcaattgcctgggaaccacattgaaaatcacctgcatcaaggccagcctaatctggggaattcttttctaagtggtataaaacagcgattgctttcattcatattccagggactatggaatgaagaaagagatgataccttggctgtacatgtgtgggaaatggaaatgcactggaggatccaaaggctcaggaagaaattttacttccactttcaagattatgttgatttgattatctggaaggtgcaattcttggaccgacaccatttgctaatcaagtttggtagtgtagatggaggggtgtcccgaaatgctgatcaccacccaacttttgttgttgtatataacatggatacaactgaaattgtatcattttatcagaattcaccagacgagctttatctgttgtttgagcagttctgtgaccacttccatgcaacatcaaggaattcaatgtatatgaatttcatatcatctcattcaaataatatccacgcactggaacaactctggagcattaaagataaggcaagcagctctgcacagtttgtgaagaatatttttgaatcaagattcattgggaggttattgatgaagatgtacttcatgcacgtgttccttttgttgcctgcactcaacaatgctttgctgttaaggctggaattgatggcctcttggatatttcacgaagagcattttgtgaaaccagtgaagtgtaatctttcttggaatgcagcatatcatatctgtgttctcaaagcatttggtgttactttcacagccatcaacaatattgcaaacaattatcgagaggattttaagttgcccaatttaaagcttacctataaaaacaggcagggattccactttgttataccacagaagaatattcaaggaaagcttccaagcaagttcattcaggttgtaaaacatgggaacaacattcgttgctcaagtttagaactagcatcttttgatgagatcatggtcaagctaactccattatcccatgaagaaaatgattactctgatcaagaatggattatcccatgtgatattttctcatga

SEQ ID NO: 8138 - DNA, 234 bp, Glycine max
  Peptide Sequence Number=SeqID_124916
atgtcataccctaatttcttctggggactatcattcgttgatcttttgatccttgctagtcgacttacggtgttgaacgctaattacaattccaagaaaggagagcaaaagggtcttttccttggtttcctggaccctagctcacccaggctagcctcttgcttgcctgagccaccgaatgatttcaaggtgaagaaaccagctctctgggcgagcttattgcttcatgactag

SEQ ID NO: 8139 - DNA, 306 bp, Glycine max
  Peptide Sequence Number=SeqID_124917
atggcggggttcaaacccactgttgaactcactagcagggcaaaggaatatggtaacctaaacacaacatacaataacaacaaagaacacataccagaaaaggataaggttcctactgatgggaactcaatgccaaaaaaggaaggggataaaaataaggagatactaacatctccccagggtcatacaatgctcaatggaatgccccggaactcctccatgataatgttgcattcgagatgtatccttgcgaaaatggaggttgaggaatctttgctgggattatggctaccattgcattactga

SEQ ID NO: 8140 - DNA, 213 bp, Glycine max
  Peptide Sequence Number=SeqID_124918
atgggagaaatatgcgagggtgtggatggcattgcggggagagaaggtgctggtagggaggattgtagatctaagggggcaagtttagggtaccctgtgacaatgaagagggtttggtgtggatggcattgcggggagagaaggtgctgggttgaggaaggtgtaggagacaatgcagagagagagcacaagatcaccattgcaagcatttaa

SEQ ID NO: 8141 - DNA, 541 bp, Glycine max
  Peptide Sequence Number=SeqID_124919
caaaacgactagtctaactcttgatcctgaaattgaaaacacttttcaaaagctaaaaggagaagcttcgcgtggcaagaagcaaatttttgaagaaggatccttttcaagctcatcaaccgaagcaaccaaaatagacaacgaaggaatggcggaagtagagcaaaccatggcagaattagcaaccggtcaaggaaccaacatgagccaacctattagaccaccaaacactagggacaatcaaatcaatttcccttcatgggtccacaacaaccttaagcacaaccaattcatgggagcaaccaccaaggactcccatgctcatctcacaagatttctacagttatgcatatcgataaggctatctggggggggtgcaaccgattggttcaactcgcacccacatcattcaccaaccacatgggaggaagttaaagacaaattcctcaatcgcttcttccccgagtctaaagttaaagctatcaaggagcgcatcgtcaacttcaaacaagcttcaaccgaatcgttatttgatgcgtag

SEQ ID NO: 8142 - DNA, 429 bp, Glycine max
  Peptide Sequence Number=SeqID_124920
atggatgaacaagagaaaagagctcaagaagaagaatttggtgttgctgctactacgaaggaacaagttgttacaatccaagctaaagcttttgttaaagctgtggacgacaacattgtgtgtaagcagtcaacaacctcaaatgaagctacatcaagggagaatgatgcacctgatgttatcattgtctattcaaaaaactcaggtcctaccccactaacctatgctacccccattgttttgattagagatcaagtgcaagagatgatagaaaactatgttaagagttatgctgcccttgcacctattgctcctacacccccaactcttgtccatcaactgccactccttgaaccaacacaaccatcaccaccaccctcttcacctccacctacacaacctccaccaccacctcaagttcaagactga

SEQ ID NO: 8143 - DNA, 189 bp, Glycine max
  Peptide Sequence Number=SeqID_124921
atgggtgtgcaaatagcaaccaggcccacttgggccctccagaaggcggttgcttctggaggaggtcaccttgctcgcctaggcgagctgggtggcaagaatctcccccattttcctataaatagggggagaagtgaagaagaagttcgttcagctctcctgaaaatccgagccgaggcgcttccataa

SEQ ID NO: 8144 - DNA, 492 bp, Glycine max
  Peptide Sequence Number=SeqID_124922
atggcatatgcatcaatgaccacattaggcccattggagaagggaaccatgaagtcatctaagcgactaagcagctggggtcttgctggagctgcttctcactgccgccgccatcgacgtcgtgcttcttcgacttcaagcggtgccccagcatcttgcgccaccctcaaatcaaacgacgtgggatggggagcaagtgatatttttcccgtgtgttgtggcggtgacggtgagatccaaaaagtggaccatataaagcacagaatcggaatcgaaattgcatggcaccatataaagcacggcctctcctcgatcatcaacttcttcgagccaccaggtgtaagggaagaggtagagaggctcgagggtgacgaaatcgtgatggtggttgtggtcatggttgtagcggaagcgagcgagggacttgcaaagatgatggagagtggagagagaaacaagagtctcttcagatttctcctaatctttatataa

SEQ ID NO: 8145 - DNA, 207 bp, Glycine max
  Peptide Sequence Number=SeqID_124923
atggcagatccgtgccttctcctcagccttctcacggccccatgccttccttctattcctccaagtcttgtaggaagggtgtgcatcaaagttggaggaattactgacatcacttttgtgcctaatgatgatactgggaagattgagtgcttcacggagatgttgaaacagatgaagctgagggggcatcgtgtatgttactactaa

SEQ ID NO: 8146 - DNA, 270 bp, Glycine max
  Peptide Sequence Number=SeqID_124924
atggaagtagcaatggaacttgccctgttgttggagaagctgacaaatgaaaagttgcttaacttgcacagtgttgcctcaaagagcaatgatgcgcaattgtcagattttattgaaagcgagtttttgggtgaacaggtggaagccataaaaaaaatctctgaatacgttgctcaacttagaagagttggaaaaggacatggtgtgtggcactttgatcagatgctactccatgaggaaggagtagcatttcacttcaggtgtatttaa

SEQ ID NO: 8147 - DNA, 909 bp, Glycine max
  Peptide Sequence Number=SeqID_124925
atgaagaagagttcttcatcatcattccagaacttgggatctttcccaagtccaggggcaccctattacagagagagaagcattgggagccaaaaggggtggtgctcagagagagtttcaaagccttcaagtagttctggcagcatcagcagaaggcacacaatggcagggttaacacccttttgtggtggaagaacaatgccatctaaatgggacgaagctgagaggtggatttgtagcccagtttctgcctatgctgagagcagaagttcgcattcacagcttcagcgaaggccaaagtcaataagtggcccaattgtgcctcctggtgtggctgctttctactcaaattactcacctgtgctgccacttcgccagggtttggttgtgaggaacttggtggtgggttcgcccttctcaactggggtgctggcacctgttgctgtttctgttcaccactttgatgcacatgatggcactgtttttggctatgacttggacagtggaatgcagttttctagccctgttatcaatgagaatggcatggtgttttctccattgtccactgctgcacccacgtgctctgaactgccctgtaaccaatcatctcctatctctgaagatgagaagcatgacggaacgatggagggggaaaacgtagcatctcattcctcaaggtgtgacaaaggtacccaaatgagtccaggagagatagagaatgattcacattcctctccaaaatcttgtgccacttcaattgtggatcaacaacaatgccattcttctaaattagaggtcagagatgtggaagttgacagccaagctacaattgtcaggtggtccaagaggcatgcaaccaaattggccaaaaaagaccactctacacagcaaagatttaagagagattag

SEQ ID NO: 8148 - DNA, 402 bp, Glycine max
  Peptide Sequence Number=SeqID_124926
atggcatgtttgttattaggtttcatttgcgagatgatgtggttatggttagattctatctatgagataatgaggccttactttgttattcctgataggctatcaatggtgcatgtggtgtcagtagataaaccaaatgtcatgcccatcactatcaatcatcgtcggtactcctatattccttggggatttacatcttgtcgacaactagagtggtttgaagatatcagtttttatctgggtatggaagtgcctcacgatgctcaagaatttgaagtgaccccagtgaggtttgatgtcactgaggaccgaggagatcacaccaacatgacacccgagggggaggaagtgtatcgtgagcttctacgagatttagagctttcatctgaggaggaggattga

SEQ ID NO: 8149 - DNA, 276 bp, Glycine max
  Peptide Sequence Number=SeqID_124927
atgatgccgagtaaacttaatgctctgaggtttactactcagatagaagaacttggcagaatgatggtcaaggttttgagggaaaagcggcctttccttgcacttcatcttagatatgagatggacatgttggccttctctgcctgtgctcatgattgttacagcaaagaggaggaggaactcacaagaatgagggcttatgatcgagctgtgatcaagtttcgtggcgttgatgcggatatcaaaaggaaatcgacctttctaaaatgtcaatga

SEQ ID NO: 8150 - DNA, 405 bp, Glycine max
  Peptide Sequence Number=SeqID_124928
atgaccaccagtggcccccacgagccgtcgttgcttatcgctgaaccaccacacggagaggaatgttttaattggatcggaatcctcagaatccacctcaaggattcggtggagaacaagccctcaatcctttcttttgtagcttctctaagggagaagggagacacaaaagaattcagacggttagtccttcgttcttttggaaaagggagaagagagacacaaaaagaattcaggcggttagtccttggcgaattctttttggcaaagggagaagagatgaaaagaatgaatagcacaagttttcaaggtttagaaaaccagaaaactttggaaagcttttggcacaaagaagaagaagaagttcaaagaaattcaaggcttgtaaaggattgtatgaaataa

SEQ ID NO: 8151 - DNA, 228 bp, Glycine max
  Peptide Sequence Number=SeqID_124929
atggtgcaagatgacacatcgaatgaggcatatgatgatgatgatgatcccataagctatgaagaggctatagtatggattttagttaaggctccaaaggatataaaaccaattgcatgtaaatggatttacaagaaaaagattgtagtagatgggaaggttgaaacctacaaagctctccttgttgccaagggatatcgtcaaaagaaagatatagattatgaataa

SEQ ID NO: 8152 - DNA, 183 bp, Glycine max
  Peptide Sequence Number=SeqID_124930
atggtgacaatcaccaaggcacttggcataaaggagttttacaagaacaagtgggaagtagaaatgaagtacatgggtattggctctactgcaagtgggagatcgtcaaggataaatataattaatgattattcaagaagggatccatcagctcttggtaatgagtttgaactttatgagtaa

SEQ ID NO: 8153 - DNA, 732 bp, Glycine max
  Peptide Sequence Number=SeqID_124931
atggcctcaactcaacctaacaactactttccaactttccctcctccatcaccttcccaccccttcaatcctccaccaccaccttcacaatccttttaccctccacctccaccttcgcactttaaccctcctccaccaccccctcattctttttctccacctcctccaccatttcgaacatcaccaccgtcaccacctcgtccattttctcctccacccccaaaggtgcgaccaccaccaccaccacctcgtcccattcatccatctccaccgccaccacctcgtcctgttcgtcctcctccccttcccccggccccactcccaccttcaccctctccaaacaaccccacagtcataatagtcgtggttgtctcattgggtggcctcttgtttctctcaatgctcgcttttgctctattctgctgcattcagaggaggaagaagaagacgcaagaaaccgaggtccttcactttgatgagcaccaaacggtaaaggaaaccatcgtgcctggtccttttggacgaaacacagtagtggtaactgttgaagatgatgtgcatattgatgaagaaatcaagactgagaaagttggtcacggtttgcatgcaaaatcatcttcacctcatgaagcagatcgagttacttctggcagcattgttgaggtggcaactcctctacgtgcacttgaacatcatgatgctcatcatcaccatcctgaaaacaagccctga

SEQ ID NO: 8154 - DNA, 702 bp, Glycine max
  Peptide Sequence Number=SeqID_124932
atgaataggatggccacactccctcctccgatgctccctgatgatttgatcgtgaatattctgtcgaggctgcgtgtgagatctctgatgcgttccaaatgtgtctgtaagtcatggctttctttaatatccgatcctcagtttgtgaaatctcattctggcctagcagaagccacacccactcaccttcttctgaaatcctccaacaatcctcaatttaattgcatagacatagaggcatcacttcacgatgatggtgattctacgaaagtaatctttaatattccacctccgtcatccgcttccggacctgtaagcagggtagatatcgtgggttcttgcagaggatttatactcttagcctatgtgtacgcagatttcttctattttgtcatatggaatccaccaaccggtttccataaacgaattgacaatgtgtcgtcaaccggtgactgcgttgaacgtgtatttcgcattgggtatgacaactttgcacttttgtttggcattgggtatgactcgtcaactgatgactacgtggtggtaatcgtaacggtgtcattgccattgccattgcgcatcacaagtagacgttggtccgcgaaggtcttttgtttctctctgagaaccaatctatggagtttcaccgagggtactgctcagccttatattgggatgcagtccagtcccgggtgctcttga

SEQ ID NO: 8155 - DNA, 268 bp, Glycine max
  Peptide Sequence Number=SeqID_124933
atggagctaacagaaggggttgaaactaatcaagttgttaggcttgttgccttggagaggatttgtgctcggaaatgctttaggtactttaggaaattcagggaccttaggtatctcgggcacattaagcaactgaggcttagacaattctgggactttaggatgctcaaagtttttggcaattcggagaccttaggcagctcaggaacttttggtggaggtggcagctcaggtttgggaagttgcggcacttctggctttgacaacg

SEQ ID NO: 8156 - DNA, 267 bp, Glycine max
  Peptide Sequence Number=SeqID_124934
tgcagttatcgaagggaaattataatttcttgtggtggaaggattggagtggatacccacaaggacttagatttgatattgtcacgatcacgaaaatattctcaactttctgctttccaaatcccgccggtggtgtccataaacaaggccattgaccttatctgcatgcttaacaactccgcaatagtccaagatcctctctggactattcgccaagttcctatttgcatttacaaactaggtcatggagattctcgtagcgggtaa

SEQ ID NO: 8157 - DNA, 1137 bp, Glycine max
  Peptide Sequence Number=SeqID_124935
atgcctgtgggaatggattttcctcctccgtttactatgttagaggacaaagacagtgcatttgtggtggatgatcagaaatcaggggatataaaaccaatgacaaagggtaagcctccacgccatgcttcgggtttgaggcacagcgttagcaccaccagattgctggctgtagcagatttgagtttggatgtgggggttactgggagcaagtcatcttctgaagaaaagacggagtttctaccaatatttcggtcaggaagctgcgccgaaagaggacctaaacaatatatggaagacgaacacatatgtatagataatcttattcagcatataggtcctgcttcaactattcctttacctggagctttttatggggtgtttgatggtcatgggggtacagatgcggctttgttcatacgaaataacatcctcagattcatagttgaggactcccattttccaacttgtgtgggggaggcaattacaagtgcgtttctaaaagccgattttgcatttgcagattctagttcgcttgatatctcttctggcaccactgctttaactgcccttgtatttggaaggaccatgatagttgccaatgctggggattgtcgagctgtactggggaggcgaggtagagcaattgagatgtcaaaagaccagaagccagattgcatttcggagaggctaaggattgagaaacttggtggagtggtatacgatggatacttgaatggccagttatctgtttcccgtgccttaggagactggcacatgaagggttccaagggttctgcctgccccttgagtgctgagccagagctgcaggaaatcaacctgaccgaggatgatgagttcttgattatgggctgcgacggcctatgggatgtaatgagtaaccaatgtgctgtaaccatggcaaggaaagaattgatgatacataatgatcctcaaaggtgttctagagagctggtcagagaggctcttaagcgtaactcgtgcgataatttgacagttatcgtgatatgtttctccccagatcctcctcctaggatagagacacctccttctcgagtcaggaggagtatatcagcagaaggcctcaatttacttaaggatgtattggactgttag

SEQ ID NO: 8158 - DNA, 219 bp, Glycine max
  Peptide Sequence Number=SeqID_124936
atgattcaaatcttgcagtttgctgaattgatcaaaaaaggatctgttaaagtgggaggtgtgagcaaagttctttgtcaagatttgagcaagcattgcagtcaaatgaggttgtatgttctaaagataatattgttgtttattgattgtgaacattctaacatgcttttagcatttactgaagtgaccttccttctggcctatcctcctagtatatag

SEQ ID NO: 8159 - DNA, 362 bp, Glycine max
  Peptide Sequence Number=SeqID_124937
atggtgcccaccaggcaccctctggacccagataagtccaacagggccctggggtttccggcgctgatcacgggcctctgtaagtcctgcggagttcccgtcacccccagtaaagtaatccgaccaccgatcacccgaggcttcatcgagaagtgctgcacacctaggcaggtgcagggtgatgcacatcaggccacagacgcgccgccaccacctcggcaggatgacccagctgggtcactaggcgtgagcgttatctatagcatttggtttgctagcaagcggccaaccacatggcagtgcagatacatgactgtctctacggttcagcctcagtcagcagggcagggttccaccccttt

SEQ ID NO: 8160 - DNA, 2750 bp, Glycine max
  Peptide Sequence Number=SeqID_124938
tatcatcggtaactccttttgtggcggctgcaaatgtgtcatcctcaaggcccgccgttgtgcacattggagcaatcttcaacatcgattctgttcttgggaaagtcgctaaaattacattggaggaggccgtcaaagatgtcaacgccgacaaaaccattctacatggaactcaacttgttctcacgatgcaaaattccaatcacagtggtttcataggcatggttcaagctttgcggttcatggagactgatgtgattgctataatagggccacaatcttctgtgactgcccacataatatcccatgttgcaaatgaactccgggttcctttagtgtcatttgccgctacagaccccaccctctcatcgctgcagttccctttctttgtgaggacaacacagagtgatttgtaccaaatgaaggcagttgctgagattattgattattatggttggaaggaggtgattgccatatatgtggatgatgattatgggcgaaatggtgtggccgcattggatgacgaactagctgcaaggcgttgtagaatctctttcaaagaaggaattaaatcaggaactgaagttgaccggggtgaaattactagtttacttgtgaaagtggcactgatgcaatctcgcgtcattgttctccatgcacaaactgattctggatttatggttttcaatttggcacgttatcttgggatgacaggcaatggctatgtgtggatagtcacagactggctctcttcttttctggattcctcttatctcccttcagagacaatggatgttctccaaggagtgcttgttttgcgccatcatacacctgattcggatagaaaaagggcatttctctctaggtggaagaagttaactggtggctctttggggttacattcttatggcctctatgcttacgattctgttttgctggttgcacgggctattgatgcttttttcagtcagggtgggattgtttcgtttaccaattacacaagtttaggtggtgataagggaggtggtcttaaccttgatgtaatgagcatttttgacaatggaacgcttctgttgaagaacatattgcagagtgattttgttggactatcaggtcgaatgaaatttgaaccagaccggtctcttgttcatcctgcctatgaagtccttaatgtggttggaaatggccttaggagggttggttactggtccaactattctggtctgtcaattgtgactcctgagatattgtatgcaaaaccacctaatagatcaagtgcaaatcagaaactatacagtgtgatatggcctggagaaacattatctaaacctcgtgggtgggtcttcccaaacaatggtagacaattgagaattggtgtgcctatccgagtcagttaccgtgaatttgtggcaccggtgcagggaacagagatgtttaaaggtttctgtgttgatgtattcacagcagctgtaaacttgttgccttatgctgttccttaccgttttgtcccatttggagatggccacaaaaatccaagctacacacagcttgtcaacttaatcacaactggtcagtactttgatggtgccattggtgacattgctattgtcacaaatcggacaaggattgtagattttacacagccatatgctgcatctggacttgttgtggtggcccctttcaagaagatcaattctggtggttggtctttcttgcagccatttactcctcttatgtggattgtgactgcttgtttcttccttttcattgggatagttatatggattctggaacacaggataaatgatgagttcaggggagagaataccatgagttctcttggtcggttggtgatgctcatatggttatttgtggttttgatcctcacttccagctacactgcaagtttaacatccatactcacagtgcagcagttatattctcctatcagtggaatagagagcttaaaagctagtgatgagcctatagggttccaagtgggttcatttgcagaacattacatgactcaagatttaggaatagccaaatcgaggcttattccccttggatccccagaagaatatgctaatgcactccagcttggtcctaaaagaggaggtgttgctgctattgttgatgaacgaccctatgtcgaaatcttcttatcaagccagtgcacattcaggattgtaggtcaggagttcaccagaagtggctggggttttgtgagtatctctagttctctaccttttagatcgattatcagtggaatcaaggactctcctttggctgtagatatgtcaactgccattttacaactttctgaaactggtgatctacagcggattcatgataagtggatgacacgaagctcttgtagtttagagaatgctgaaattgattcagatcgtcttcagcttaaaagcttctggggtctctttctcatttgcgggatagcttgctttattgctcttgttttgcattttttgcagcttatgttccagttacggcaatctcctccttctgaacctgcttctagtgctagctcaatttctggtcgttttcatagatttcttacactcattgatgagaaggaagatccatccaaaagaaaaggaagaaagaggaatggagatgaaagatcgcttgaagatcaattgggaaggcagccaaagagggccaccttgagaccttgggagacatacccgatcccagctaagccaattgaacttattgggttgttaggttag

SEQ ID NO: 8161 - DNA, 273 bp, Glycine max
  Peptide Sequence Number=SeqID_124939
atggataatttacttaggagaaatatagttgtggaggagaaccaaatgcagtgttctttttgtggggagatgacagaacgtgtcaaccatatattgtttacatgtagatgtgtggatgagatttggaaattcttcattaacaagttggcaatattgttggtgctacctctcacgacagaacaacacttttggcaacatgtgttggttgcatgcatcgggggaggtccttcgtggagtacagggcacaggatcacaaaagcacaaggatattaa

SEQ ID NO: 8162 - DNA, 1089 bp, Glycine max
  Peptide Sequence Number=SeqID_124940
atgaagaaatggaaggcttgggaagcggaaacatcttccctggagtatcaatttacaaatgatccttcaaggttcaggtttgcgcatcaaacatcattcgttaggcgtcactctggttggtctaggatgccaggaattcgatggatagtggcattcttcaggcaattcttcggttctgtcagtaaggtggattacatgaccatgcggcacggatttattaacgcacattttgctccggatagcaaatttgactttcaaaaatacattaagagatccatgaaggatgactttaaagtggtcgtgggtataagcattccgttatgggtttttgcaatcgtctttatgcttgtgaacgtttacaaatggtacacgctcacttggctatcattagcaccactagtgatacttctattagtgggcaccaagcttgaacttataatcatggaaatggcccaacaaatccaagatcgagccacaattgttagaggagtccctattgtagagccaaacaacaagtatttttggtttaaccggccacagtggattatcttcttaatccactttaccttattcgagaatgcattccaaatagcctttttcttgtggacatggtatgagtttaagatcacatcttgcttccatgaaagcttgccgctaatactgacaagggttgtccttggaatagccttacaagtcgtgtgcagctacatcacatttcctctctattccctagtaatacagatgggatctcacatgaagaaagcaatctttgaggagcaaactgcaaaggcacttaagaagtggcaaaaggctgcaaaggacaagaggaagttaaggaaagcagggatagatatgagtggggaaacaacaccaagccaaggcacatcacccttgcatttgcttcaaaagtacaagccaagccacacagacaccgatagtgttctctactctccacgatcataccaatctgacactgacttgtctgagacagagggatcttcacaccaattgaatgaaataacacaaacgcatcaagctccaaggaatggagaaactcataatatcgatttttcctttgtgaagccttaa

SEQ ID NO: 8163 - DNA, 108 bp, Glycine max
  Peptide Sequence Number=SeqID_124941
atgctacggcgaagaagagagacagaacctggagagaagagagttaaggttgcggcggttggcgacggtagtaagggcgacgaagcgaagagagtgagagcaaattaa

SEQ ID NO: 8164 - DNA, 915 bp, Glycine max
  Peptide Sequence Number=SeqID_124942
atgaagctgggaggggaagtattaacagttcttcaggctatgcctgatgcatcacccttggaaaatgctggtgaatcactgtcttatggggttccagagcatgcaaaaccactgctcagaaagccaacacaagtactagagattaataatgtgtttgcagcagacactattttgtctttatccgacatggccattgaagaaattttggatgatgtacggttggaatgtgcaagatttgggactattaaatcaattaatgtagtcaagcatagcagtggcgagaatttagcaaccaaattagaagaatgcaaagtcataaacaaagtggatgctaaagaagtttctcaagacacaaactgtattactaataatacagaatctagtttttctgacaaggctacttaccccgactttgaaggaacaaatgggatggaaatccatgataacaatgaaatggaagaagttaaagttgacgagggtagctgtgtttatgttgataaaaatgctgaagtttttgactataaatcatgtagagaacacgtggatgattcagcagtagaagatgtgggggataagggcataccttgtagtatcattcaagaatgtcctgatcaacaagatacacccaatgatgggccagaattttatgataagatggttgctaacgatattgatgtgaatattgaaaataatatggaatctaaagacacagtttgtgcatttcaggaaggcttttctgaatgggatatcagtgcagaattggttagtccccaaaagagcattgacacggaagaggatatttatggtcatgtatttaaaccaggttctgttcttgttgagtatggaagagctgaagcatgttgttcggcagcacatagtttgcacggacgattctttgatggcagaattgtgacg

SEQ ID NO: 8165 - DNA, 1752 bp, Glycine max
  Peptide Sequence Number=SeqID_124943
atgagcaaatctaatcgttcaaaggagaagcatggaaaaagcaattggctttctgagcataattgtgatgaagagagtgcagcccgtacaaggccatttagttttgaagagattatgcttagaagaagaaacaaggaactgcttggaaactcaccaaaagaaaaagaactgcttgaaaatgtaaaagaccctgcacatggatgttcttcagagaaaattactgatcattttaagtctgccagaatctataaacatgacaaaagtttatcctttggcatggagaaacatgtttcggaggaattagtgaaagtaacatctagaaagaaagttgaaagcgccattgtaaaggaagatgatttaactgaagggaaaagaagggcaaaccatattttggaaaccaaatcaagtgctggattaaataataaagccaggataaccaaagaaaagactgaaaaagagatgtctggttataaaaaaaatgagcgagttcatgatagttccgagtatagagctggaaataagcattcaagagattcagtttataaggatagttatgtggaaacaaatagaccaaaatctgaaagggaaataaagaaaaagaaccacattggaggggatgagaatcataatatgtatgttactgaaaagaggcatgacaaagatagagataataggtggaaattgaaaaagcggttaagcaatgactctgaagaagtacctgaaaagaagcattatagagaatcagataaggataagcatgcagggggtagggcaaaatatgaaagggaaaccaagagaaaatacaaaaatggtgatgatgaaactcaagacaggaatacatcaagaaaacaagatgctgtgaaacatcataacatgcacatttatgagaggaaagagagacgggtaaaggtgaagtctcataatgaagaattaacagcaaagaggagatgttcaagaagtcgagagcgtgaggatagaaggtccccttctttttcaccaagggagcaaaaacgtacttatcaagatggagagcgcaaagagttgtcaatgcattccttgaaagatagttctagaactaagaaccctgatattgatagaaatagagtatcaactaatggttcaagtggtcaccatcatcgacatggtgtctccacaagtggacttggtgggtattctccaaggaagaggaaaagtgaagccgctgccaagactccttctccatctaagcattctcttgagaagaaacgtgctggatgggatcttccccctgcagggacaaataatccttctgctgttgtttcttcaagttttccagtatcaaattgtgctgtgttgtctaatatgcatgatgtggtttcaactagttctcttgatctagcccttgtgaagcctctgcctgtgtcttttccaagtgatgtatcaacagggaagaataccaacattgattctgtccaattgacacaagctacccggcctattagaaggctttatcttgagaatttacctgcttctgcttctgagaaagctgtgatggattgtttcaataacctcttgctctctgcccgtgtaaatcatatccagcaagctcaaccatgcatctgctgcattttacataaagataaggggcaagcacttgtagagttccttacagctgatgatgcatcagctgctctttcttttgatggcagtatgctatttggctccattgtgaaaattagacgtcccaaagactacattgaagttgcaagttag

SEQ ID NO: 8166 - DNA, 1539 bp, Glycine max
  Peptide Sequence Number=SeqID_124944
atggcgggaggaggagaaggcggtgacagcaggcagctagatctcacacctacatgggccgtcgctgcggtttgtgcaattatcgttatcatttctatactcttggaaaaaattatacacaaattcgcaaaggtgtttgaagagagaaagaagcatgcattgctagaagctcttgaaaagattaaagccgagcttatggttttgggatttatttccttgctcttaacatttggtcaaaactacatttctaaaatgtgtattcccgcgaagtatgcacgcacaatgctcccctgtcttccccttgaagaacgtcatggaggggctcctgcaaccgaacatggagctcagacagaggagggtggtggtggtggtggtgaggccgaaggtggtggccatcaccgcaggcttttatcatatgagcgtaggtttctagcagctgagggtggaggccaaagttgtaatccgggatacacgcctcttatatcagtgtccggattgcatcagctacacatttttatatttttcttggctgtcttccatgtgatatacagtgccataacaatgacgcttggaagagcaaagattcgtggatggaaggaatgggaggaagaccatatcgtggatcaagatgccttgaatgatcctagaagattcagactcactcatgagacatcatttgtgagggatcacaacagtatctggactaaaacaccagtttccttctattttgttcatttagcaccgggaagtaagtttgattttcaaaaatatatcaagaggtcattagaagatgactttaaggtagttgtaggaatcagtaatttagcttcatggagtcatgttgttaaaagtccactactttggggatcagtggtgttattcttgcttgtgaatgtccatgtcaaattcttagtaattgctaacttgttttcaggatggcatgctgctttttgggtgtcttttcttccactagtggtgattctggccgttggaacaaagcttcaagcaattataactcgaatggcacttgacatatcagaaaggcatgctgtagtgcagggaatccctcttgtgcaagtctctgacaagtatttttggtttgcatggcctcagttagttctttatctcatccattatgtcctctttcagtatgaatttggttgggcatcttgcttctacgaggatgatagtctcatgatttttagagtagctcttgggttaggagctcaagtggtttgcagttatgtgacacttccactatatgcgcttgttactcagatggggtcgacgatgaagaagtcaatatttgatgagcaaacatccaaggcactgaaacagtggcataagaatgctctgaagaagaaagtatccaagggacgcaccgaaactcgaacgttaggtgaggctgtgggcccaggagatcattcaccggagcaatcgccgaggtcaacgggagccggagaaacagaaatggctgagcagagtgccaccatagtcaccaccccctatgataatcgcgaccttctaagtgaaccgtga

SEQ ID NO: 8167 - DNA, 1787 bp, Glycine max
  Peptide Sequence Number=SeqID_124945
gtgtttgcttcttcttcttaccatcttttccttgtgctttgcagattgatctgacttcacagattgtgcgcatcactacttcactaaaggtgcagaatacgggatctgatgttgtgtctgagattttgctgtcctttcctgagaaccaggcaagtaacttggcatacttgaaggcaacacttggtgatgggaagggaaaatcaaaaccatcttctggtgttggtttacctgtcgaagttgtccggcctaaagatgtgccaccttccttgacaatttattccgtgtctttacctaaggggcttgggaagggagatagtctgacgttggatgtcttggctgtttttacccactcattgcaaccatttccagagaaaatcaaccaggctgacatccagcttctactgtttcaagaaagtgcacactatctctccccatatgcagtcaaggtccaatcactcactgttaaattgcctgatgcaaggatagagtcctatacaaaactagaaaatgcaaaacttcagggatctgaattaaaatatggtccatatgaaaatcttcctccattttcatacctgccaatagttattcactttgagaataaccaaccctttgctgttgctaaagagttggttcgagagatcgaaatttcccattggggcaatgtacagatcacagagcattacgatattatccatgctggttctcagagcaaaggagaattttctaggcttgactatcagaccaggccatttttaagaggtgcatcagcctttaggcgtcttgttgccaagctacctccaagagctcattctgtgtactacagggatgaaattggcaacatttccacttctagtttatggggtgactcaaaaaagacagaactggagattgaacctaggtaccctatgtttggtggctggaaaactgcctttaccattggatatggcttgccacttggggacttcttatttggatcggatggaaagcgcttccttaacatctcttttggtgcccctattaatgagttggtcattgacacactatttgtgaaggttgttttgccagagggttctaaagatatttcagtgtctgttccatttcctgtgaaacaatcggaggagacaaagctttcccacttggatattgttggtagacctgttgttgtgctggagaagaacaatgttgttcctgagcataatgagcattttcaggtctactataagttcaacagtctttctatgctcagggagcctttgatgttgatttctggctttttctttctgtttcttgcttgcattgtctacacgcatgcagatatatcaatctccaaatcttctgcatcttatttggcaaagctccagttggacgaggtgcaagcaactattcagcaggtccatggtatcattagccgttgcttaaccgcacatgacaagctagaaatgtcattacacgatctttcaaggacaggagacattcaagcctgtaaagcaactcgaaaatcagtcgatagcttactgaaagagctctctaaagagttgaagcaaccattggcaattttgcaatcttctccgcaagctgctcaaatattaccgaaggtggaggaacttgttaccaaggagagagagttgcaggataaacttctagtaaaacactctacagttgtagacggctatgagaagaagtcagcaggaagggaaattgagaatcggattgcttcacaacagctgaaaattactgctttgagacgggagattgatgatcttatggacttgattgatgagatatga

SEQ ID NO: 8168 - DNA, 363 bp, Glycine max
  Peptide Sequence Number=SeqID_124946
atgttggttttcagtgaagaggaagctaagaaaaagatttacaatgtttcctgtgagaggtacttcgcatttggatgtgacattgatgaggagacatcgaataagctggaaggtttgcctggagttttgtttgttctcccagattcatatgtagatcctgaacacaaagactatggaggtgaattatttgtgaatggagagattgtgcagagaccacctgaaagacagagaagagtggagccgcagccacaaaggcaacaggacagaccaagatacaatgatagaacaaggaaatcagttgccacgaatgttgtttatgcttcctatccaatttatcaacagaggaaaagaaaagaaaattag

SEQ ID NO: 8169 - DNA, 558 bp, Glycine max
  Peptide Sequence Number=SeqID_124947
atggagacctctctgcgatacggagaagattccaaagctttacgaatccatgcgaagcaaaaactccgaatcgactccaacacctactttcagttgcgcggagagcttgatacaagacttggacaaccaagttcgtccagtgccctcatcagacatttctatccaagtttatcagcaacccttggcgtaggagtgcgttatgataagcgtgacaagttgcgttacactgtgagtgcaaagaaaacatttcctgtcactgttgacggcttgctcaattttaaaatcaagggtggatgtgatgttgacaaagactttaaagaggttaaaattcgccatttcggttttcacattcttttattttccagaggaagtccagaggagccgccgagttttcatggaacgtgttcaattttcagaaggaccaagatgttagacttaggattggctacgaagtatttgatcagatcacctattgataacaatgattttgagttgaatggagtctcctcattgttgatttatattgctgttgaaggaagaatagcttctgaagtttga

SEQ ID NO: 8170 - DNA, 195 bp, Glycine max
  Peptide Sequence Number=SeqID_124948
atgggaaatcgtaagttttggttctcatatgtgcctctgctgatgatcaagctgttgtggagtaaacatacatttgttgtcttgtctttggtgcaatggccaaatgggttgaatgaagctgttatgcattttggggagagcatcaaagaaataatcaatgaggagtttggtgatgggatctttaaagctaattga

SEQ ID NO: 8171 - DNA, 297 bp, Glycine max
  Peptide Sequence Number=SeqID_124949
atgaacaagttgatggtgaaatttggtaatggaattgatggaatcgtgtttgagttgttgggcgcaagagcgccaattggagattcgatttctgatgctaatgcgatttctagtggcagcgctactgcaattgctactaatagtgaattgaatgaaagacttacgcgaagagaaagagagcggaagtgcagtgtccaaacagacgccatgggaaacggtggtggcaatggcaactcaaatgaaggtttccgcttccatttccctttctctatctcctccaatccaacctcaagctaa

SEQ ID NO: 8172 - DNA, 519 bp, Glycine max
  Peptide Sequence Number=SeqID_124950
gtttgctcgaggctagcgcatggcatctatcattgccccagtatagcgtttagaagtatctattattgtcacctgtcacgctttgtaccaagaagaaacaaaagaatagaacgaaaaaaagaaaactatgtggtttctcgaaagagaatttccaaggacgataaaagtgtagaaacaaagattcatagtgaatcaaaggtgattcaaaggtgttttgatgataacaatgatgatgacaaaggtgatgacaaaaagctcaaagatcaatctatgaacaattcaagagttcaagaatctattattttattcaagactcaagaagaaagcctagaatcaagaatcaagattcaaggttcaagatctcaagaatcaagatcaagattcaagaatcaagaatcaagactcaagatctcaagaatcaagatcaagattcaagaatcaagaatcaagactcaagatctcaagaatcaagaatcaagactcaagatctcaagaatcaagatcaagattcaagaatga

SEQ ID NO: 8173 - DNA, 570 bp, Glycine max
  Peptide Sequence Number=SeqID_124951
atgcaagaatgctttaaagagtccgaaaagcatggaatgcggtgcaaaggaaggataaagagcttagaggaagcagcaatggtgttattggaggtccctgaggaaagtgaagaggtgcaagccttgaaagcggaacttgaaagaacacaagtggtcaaggaaaagttcaagccgacaaccattagggtcagaaaagagtgtgacgagctgagggacgtcaacatggccatagctgaagcattagaacaagaaacgaagagggcacgaaaagaagaatggggccgaaacaaggtcgaaagagacaagtcaagggtggaaggaatgatattagaggacaagttgaaggcttgtcaaaggtcgaagaggaacttgaccaaacagttgagtaggacagaagagaacatgtgggcaatcattgaccaatataaagagaagcaaaatctagctataacccgtgagcaaaggctagaggacgagcatgcaaaagtatcggtcctgcaagtggaaaagggaagcaagggagagagtgatagattcattacacagagaagctatgatgtggatggatag

SEQ ID NO: 8174 - DNA, 1638 bp, Glycine max
  Peptide Sequence Number=SeqID_124952
atggcttattatggaatatcatcaaatttgatactgtatctgactaggaagcttcaccaaggcactgtgacctcttccaacaacgtcaccaattgggttggcaccatttggataactcctatcttaggagcctacgttgccgatgctcatcttggtcgcttttggacttttctcattgcctcagtcatctatttattgggtatgtctctacttacgctatcggtgtcccttccaagcctaaagccaccagagtgccatgaattggatgtgacaaaatgtgaaaaagcctccacactacatctagctgtgttctatggtgcactctacactcttgcactaggaaccggtggaaccaagccaaacatttccacaattggtgctgaccaatttgatgactttgactccaaagagaagaagctcaagctctccttcttcaattggtggatgtttagcatcttcattgggaccctctttgcaaattctgttctggtctatatacaagacaatgtggggtggactcttgggtatgctcttcccactcttggacttgcaatatcaatcatcatattcttggcaggcacacccttttatagacacaaattgcccacggggagtccattcactaagatggccaaggtcatagtggctgctataaggaaatggaaagtgcatattcctagtgacactaaagaactttatgagcttgatttggaagagtatgccaagagagggagagtcagaattgattccactccaaccttgaggttcctcaacaaggcatgtgtcaacaccgattcaagtactagtggatggaagctaagccctgttacccatgtggaggagaccaaacaaatgctaagaatgatcccaatcttggctgctacattgatccctagtgcaatggttgcacaaataggtaccctttttgtgaagcaagggattacacttgacagaggcattggcagcttcaatatacccccggcaagtttagccacatttgtgactctatccatgcttgtatgtgtggtgctctatgaccgtttctttgtcaagatcatgcaaaggtttaccaagaaccctagagggataacccttctccaaaggattggaattggcctcataatccacatagtgattatggtgattgcatctctaactgaaaggtatagacttagagtggccaaagaacatgggctattagaaaatggaggacaagttcctttgagcattttcatcttgcttcctcaatatgttcttatgggagcagctgatgcgtttgtcgaggttgccaaaatcgagtttttctatgaccaagccccagaaagcatgaagagccttggcacttcctattcaatgactaccttaggcattgggaatttcctaagcacttttcttctcacaacaatttcacatgtcaccaagaaacatggccaccgaggatgggttttgaacaacttgaatgcttctcatcttgactactactatgcacttttggccatactaaacttggtgaacttcgtattcttcatggttgtgacaaagttctatgtgtatagagctgaaatttcagattccataaaagtgcttgaggaagagctcaaggaaaagacatcaaaccaggtgattccaagagattaa

SEQ ID NO: 8175 - DNA, 426 bp, Glycine max
  Peptide Sequence Number=SeqID_124953
atgggttcatctttgttcacttactcattacataaacgtttctcatctagggcccatcaaatttacatgtaccgagaattgtgcaccgatttgatgcgtcattccgtgtggagcagacaatggtacccaaattatccaaattatgtgttattcgactatgaaggagacaaacactttataaagcttcataaatatggtaaccgattctatgttggcaatggactcaaggaacttaggagaacacatggcattcacgaaagtgttctcatgcggtttgttggaaggaacaaaaatactactttcagtgtggacgttgtgggacctctacaccaaagggcagccccaaccataaggcaccatgtttttaccattgatgtctctgaagatatgatacaacaaaattatcaattggtaggtgtttcttaa

SEQ ID NO: 8176 - DNA, 1284 bp, Glycine max
  Peptide Sequence Number=SeqID_124954
atggaagaactactgtatgaacttagtgatcatgaaaggagaaacgagcaaggtctgccaccgggtttcaggtttcaccccactgatgaagaacttgtaaccttttacttggcttcaaaggtctttaatggcaccttctctaacgtcaagtttgctgaggttgacctcaatagatgtgagccttgggaacttccagtgttgtgtgactgtgaggaagcagatgtggcaaagatgggggagagagagtggtatctgttcagcttgagggacagaaaatacccaactgggctaagaacaaacagagcaaccggagctgggtactggaaagccactgggaaggacaaggaagtgtacagtgcatccagtggaaccctacttggaatgaagaagacccttgttttctacaaaggcagggcccctcgtggtgaaaagaccaaatgggtcatgcacgagtaccgtttggttttggatgctcacttttcccttccccacactcacccctctaaggaggagtgggttatatgcaggatatttcataaatctggggaaaagagaagtccagtgctccaagtccatggacattcagatgcttcttcgtccccaagagaaagtgctttacctccattacttgcaagcccaagttgctttacatttgatccagaatctcaatcccaaagttcatctcattctcagcgagacttccaaagcccggttctgattcaccaccaagaccaaaatggccactctcataaccctcgtcttttcccattagaaatcaccaacgccagaaaccacccatcatcattttcggacctattcttcaagccccttcagcagaattgcaccctgaagaccaacgaacaaactattcttccaaaagtaaccaaaacggaggacgctacattctatgatcaatatcatcaattactagatgaccataataacatgcgctgggtgaacaagttgaatcaaaatccaagcaatttactcaacactttcccttttgaggtggatgctggcttgatggcattctcaggagctgcaaatgctcaagttaaggacatatccacttcaacaccctttaataggaactatcaattaatcagacatggaaaaggaacgttaaaacttgaaagagagtcgaaaaaccacagcgcaagaaattgtgacattccagcatcactcccgaagggcatacaatacaagcactaccagggaacagcaatcatgccagcacagccagtacgtagcccagttgggaggctgcttattcaccagtcataa

SEQ ID NO: 8177 - DNA, 276 bp, Glycine max
  Peptide Sequence Number=SeqID_124955
atgaagagtctagaccttctcttccagtccagtctaaagaaggcttgtccacagaccactctaatgaggagaagtcaacaacaaatctctgagcaagcctctaaggctcaaaagctgagggatttgaaggaaacaaaggatgtgggacctctaataatcctaaggaagcacaaagtgaagcaagaaaggaagaaaaaatttggacgcaagttcatgcctccaaaggaatccatcaagataccatcatctaacggctctagctcgtccgaaagtgag

SEQ ID NO: 8178 - DNA, 279 bp, Glycine max
  Peptide Sequence Number=SeqID_124956
atgacaggaggcattctgaagcagatgtacatacctgaccaggccactgcttatccctctaaactccacattagtagatgcattgacatcaagatggtgcgtgacagaacctacccaaggctacctatctatgatgaggggaagaagggcttcaagctctacttcaacaaagaaattcctaacaaaggtcagaagaagcctatcttccaaggtcaaaagctcatcaaagagcttgatgttgatgatgttgactttatggaatcaaaccatgtggaataa

SEQ ID NO: 8179 - DNA, 479 bp, Glycine max
  Peptide Sequence Number=SeqID_124957
atgtgtctgaggatgttcgtgtctacactgacgatgagaacaagttcaagattgagattcccgaagagtggcaagtgggaacaggagacggagaatctagtgggtttaaatccataactgctttctacccaacacaggcatccaattccaatgtgagcgttgtgatcacagggctgggaccggatttcaccaggatggaatcctttggcaaagttgacgagtttgctcagactctagttagtgggcttgacagaagctggcgaaaacccccgggtgtggctgctaaactcatagattgtaaatcatctaatgctattgggatggcatcaaatggttggtataacagactgtataccgtgacaggacagtatgtggaagaggacacagacaagtatgcttcaaaagttcagaagaacaaaggttatgatgatccaagatatctagcttatgcgataatgacgcgtaggtcgatgaagtga

SEQ ID NO: 8180 - DNA, 219 bp, Glycine max
  Peptide Sequence Number=SeqID_124958
atgatgaggtctagaggcaacgcaacggtgcggaggtctcacagcacaacagcggtgaggaagtctggcgtcgcgtcgcgagtgaggaatgttataatagatgatgagaaagagagtggatgcgcaataggaagcaacaacatggggacgaagaggcggagaggcaccgcaagaggttgcagtgctatcggtgaggaagtttcagtgccgcaaatgtga

SEQ ID NO: 8181 - DNA, 1116 bp, Glycine max
  misc_feature (914)..(914): n is a, c, g, or t
  Peptide Sequence Number=SeqID_124959
atggcataccaagcgatccaggttccgagttcgggatcgagttcgagttcggggtttcagttattgaattctccgttcggagacaccacctacaccaaagtcttcgtcggaggattggcctgggagactcagagcgaaaccatgcgccgctacttcgaccagttcggcgagattctcgaggccgtcgtcatcaccgataagaacaccggaagatccaagggctacggtttcgtgactttccgggatcccgaggctgcaaggagagcgtgtgccgatccaactcctgttattgatggcagaagggccaattgtaatttggcttcacttggtcgaccacggccccctctgccttatggacggataagacctgcctccccttatgttggaagtttgcaaccagctcgtggtgcttatgttgggggttttggctaccagcaacaaccagtttcctacagctatcaacaaggattggtttaccctccttatgggtatacgacatatggacctgagtacatctacccacagagtctgtacaacccatatatggggcaacagtatcttcagatatatggagtgcctggggcagtgaatacaactgtttatccttatggacaagtgggtcaggctattcctagtggtcatggttattcagctatacagggttatacagtaccaggtcatcagattgtgccctatggtggatctaatgttaatgccataacaacttcacctatgcctgccattcaagcttcatatcctagtggtatgaataatgaggcattgaagaacccatgctgcatctcttggttattattggcatctgagagaaaaacttctttaggaattgctgcaccagttcctggccaaccacaatttattgttcctgctcattctcctcagtttatgcaaggtancggtcctgatcaaacagctggcatgaacttatgttttgaaagtatcatgttacaggtcatatgtagtcatgctcaccaagttgtgtctgagtcgctccagatggcgaaggaaactggaatgtgcaggctgcttttccatttggacatttacactagtgtatttatacctaatgctacctgtactcaagaagagttgcagtag

SEQ ID NO: 8182 - DNA, 276 bp, Glycine max
  Peptide Sequence Number=SeqID_124960
atgaatacacaaattcagattggatggttcctaagacatcaaaagaggagaaaggaagaattgtgcgtgtggagtgaaaaaagtatctggggatacttggtgctggtggtagtagacagcagcagcagcagcagcagcagcagcagtagtagtagtagtcaactatgggagggaatcgagaaagaagggaagggggataaaatagaaaagggtttctggtttggggtggatgatggaggaggaggagagtgggagtcattcattctctctgaatga

SEQ ID NO: 8183 - DNA, 792 bp, Glycine max
  Peptide Sequence Number=SeqID_124961
atggctgctaattacaacaacaatatcattagtgctgctgctgctgctgctgctttcatgacacctgcagccctacacctccagccccagtccgacgacgacgacggagaaggacccttctccacccagcggcgccctcgcgggcggcccatgggctccaagaacaagcccaagccacccgtcatagtcacgcgcgacagccccaacgtcctccgctcgcacgttcttgaggtctcctccggcgccgacgtggtggagagcctctccaactatgcgcgccgccgagggaggggagtgtccgtgctcagtggctccggcacggtggccaacgtcgtgctccgtcaaccggccgggagcgtcctcacgctccacggccggtttgagatagtttccatgacggggacggtgctcccgcctccggcgccacccggttcggacgggttgtcggtttatctgtcaggggcgcagggacaggtggttgggggcgtggtggtggcccctctggtggcttcgagtcacgtggttttggtggctgcttccttcgctaacgccatgttcgaaaggttacccttgcccttgaatcagcatgatgatgatgatcaagttctgcaagaggcaccacgtggcgtcatgggaactgaacaggtggcagatggaaggaactatcccttctccgcgtcgctgcaggcaccttcgagaacaaacaccgacaacgcctgtttgtcccagcacagaaaacgtagccctagttcctgctatttgcagtatctcaacattgggaagcgatgttga

SEQ ID NO: 8184 - DNA, 2280 bp, Glycine max
  Peptide Sequence Number=SeqID_124962
atgaagggtgaggatgaggaggcatctttgggttggtttgcttttgagcctgaatggtatgacacaaactatacaaactttgctcattgtgaggctcagtctgtttctctatttgttcaatacctttcaaatatgaaaggagataccgtccaagttggttcaaaaggaaatggacaagaaaatggaaacactttggctgatgcgagtgaccactatcatcctgtttggggtcaaatggagaactattctgtaggaagagaaaaacggaggcagctacttttaatgctatgccagcatgaggctgataggcttgacgtctgggcgcagcctactaacacaaaggaaagtagttcccgacccaagattagtgcagataaatggatagaatataccaggactgccttctctgtggatcctaggcttgctttatccttggcctcaagcggtaaagttgtgacttgttggtcatgggttcgaatccggaaacagcctctttgcatatgcaagggtaaggctgcgtacaacatccctcccccataccttcgcatagcaaagagcctctgggcaatggggggaaaatattcaattttatgtctgatctatctagctgctgcaacaaattttggcttattcacaagcattgttagttacacatttgggttggatgaagatggaaaattgaaacttaaagcaaatatagtggatgttcgcaacataccagaagcattaccttactttatcaccccaaaggcagttgatgacagttcggtgctcttgcaacaattgcctcattgggctccttgttctatcacacaagctttagagttcctttctcctgcgtacaagggtcatccacgggtcatggcatacgttctaagggttctggaatcctatcctcctgaacgagtaacttttttcatgccacagctggtgcagtcgttgcgacatgatgaagggaaattagttgaaggttatttgcttagagctgctcaaagaagtgacatatttgcccatattcttatctggcatttgcagggtgagactgtacccgagacaggaaaagacccaaacagtgggaagaataattcatttctagaactgctgccagctgtaaggcagcgtataattgacggttttaatccaaaggcacttgacatatttaaaagagagtttgatttctttgacaaagttacatccatctctggtgtactatttccacttcctaaagaagaacgccgagccggtatccgaagggagttggagaaaattgaaatggacggtgaggacctttatttaccgacagctcctaacaagcttgttaggggtattcgagtagatagtggtattcccttacaatcagccgcaaaagttccaatcatgataacttttaatgtaattgatcgagatggggacgaaaatgatgtaaagccacaagcttgcattttcaaggttggagatgactgtagacaagatgttcttgcccttcaagtgatagcactacttagagatttatttgaagccattggattaaatctttatctatttccttatggtgtactgcctactggtcccgagagaggtataatagaggttgtgccaaatacgcgcagtagaagtcagatgggggaaacaactgatggaggtttgtttgagatatttcagcaagactatggacctgttgggtctgccagttttgaggctgcacgccagaactttatcattagcagtgctggttatgctgttgctagtcttttgcttcaaccaaaggataggcacaatgggaaccttctttttgataatgttgggaggcttgttcatattgacttcggtttcatcctagaaacttctcccggtgggaatatgcgttttgaaagtgctcattttaagctgagccatgagatgacacaattactagatccatctggtgttatgaagagtgatacatggaatcaatttttaagtttgtgcgtgaaggggtaccttgctgcccgtcgacgaatggatgggatcatcactactgtggcattaatgctagacagcgggttaccttgcttcagcaggggtgacccgattggcaatcttcggaagagatttcatccggagatgagtgagcgtgaagcagccaatttcatgacacatgtttgtaaagatgcttataataagtggaccactgctggctatgacttgatacagtatctgcagcaaggcatcgagaaggatggatccaagaggagtaccgggagcggatctcctcagtttgtaaaaaatccgttgaactaa

SEQ ID NO: 8185 - DNA, 148 bp, Glycine max
  Peptide Sequence Number=SeqID_124963
gcaattcgacaccaaagtgtcgagcaactcctgctttttggactcaagtactgctcttgccagtttcagggcaatctgcaaaaatttcaaatggggcttcagctgctggaagatcggatttataggtgaacacgagtgtctcttgtag

SEQ ID NO: 8186 - DNA, 930 bp, Glycine max
  Peptide Sequence Number=SeqID_124964
atggaggatggtgagaaacccagccatggcattgctgatatggatgttgttgatgccactttgcaaagccatcgtgtggcttctgatcaagtaatggtcctacagggtcatgatatcaaaaacggcgattctgatcctgctcacgtgccagcaaccagtgcaattagcaataatcagtttgaacttgaagatgctaagactgtttcgcatcaggaactgatcactccaaagcctaaagaaaagaatgtcagagaaatgaagaatgtgctaaatgataccgagatgactgattatgatgagtatggcacgcctctggatcgagaaacatttatgaaagagcttgagactttctacagagagcggtccttggaatttaagcctcctaagttttatggagagccactcaattgtcttaagttgtggagagctgttatcagactaggcggctatgatgtgcctgctgtttaccagactccaggctcaggtagagcaagaagggatgcagcagcacgtgcaatgcaaggttggcatgctcagcgccttcttggatacggtgaggttgctgagccagttattaaggacaagaacttcagttccacgccaaagcgtgaaaagaacctaaaaagtattgcagtagtggatgttggacccccagctgactgggtgaagatcaatgtgcgtgaaagtaaggattgttttgaggtatatgccctagttcctgggctccttcgtgaggaggtgcgagtccaatcagatccagttggacgtcttgttataactggtgtgccagaacatatagacaatccatggggaattacccccttcaaaaaggttgtgaacttacctgcaagaattgattcgcttcagacatctgctgttgttagtttgcatggtcgactatttgtacgcgttccttttgagcaaggagct

SEQ ID NO: 8187 - DNA, 468 bp, Glycine max
  Peptide Sequence Number=SeqID_124965
atgggtgccaaatacctcgaagtggtcaaaagagggtcgcatcccaacaacagatggtccccggacgaaattagggcgccgaatgaccataatttgtctctacgtgccaccggacacggtcgcctctggatggagaaaagggcgcaaaatgaccataacttgtctctgcgcgtttatcactcatcgagtcttaaaggtagcaaaagcgtgcggatgaccgtaattggtctcggcatgtcatcgggcccaccgcctccagatgacaaaagaaaaaaagtgcgggaccaaatggttcccgcatgtcattgggtccgtcgcctctggatgacaaaagtaaaaagtgtgggaccaaatggttccaagcatgtcatcgagcccgccgcctctggattaaaaaaggtaaaaagtgcgggaccaaatggttcccgcatgtcatcgggcccgccgcctctggatgacaaaaggtaa

SEQ ID NO: 8188 - DNA, 248 bp, Glycine max
  Peptide Sequence Number=SeqID_124966
cacttagaaggttaggagtgaaaggtgtggagattcgaaagccggagcagcttaacacaattagttccctcataatccctggtggagaaagcaccactatggctaagctcgccgagtatcacaacttggtcgctttctttacctcttttgtttttatttttatgtctttgtttggtaacaccgtaattagggctgggactccgagatatctccacaagcttcggccctttcggccggctatcaactaa

SEQ ID NO: 8189 - DNA, 363 bp, Glycine max
  Peptide Sequence Number=SeqID_124967
atgatgaacgaagaagaggaagaggatgtcctttcaccagagttggagaggttgatcgctcaggaaaaatggaccggagaggaaaggaaagaggtaaaagtgggaaccagtatgaccacacctatccgccaaggcttgataacccttcttgaagaatatcaagacatctttgcatggtcataccaagacatgcctggtctggactccgacattgtgcagcataagttgccgttgaatcctgggtcttccccagttaaacaaaagctacgaaggatgagacccgatatgtctttgaagatcaaagaacaagtaagaaagcagttcgatgcgggtttcttagctgtggtgcgatacccggagtag

SEQ ID NO: 8190 - DNA, 243 bp, Glycine max
  Peptide Sequence Number=SeqID_124968
atgggcgttgggtctgtgaagcgtggtggaaatagggtacggttgcaaggtatgggacctgagtcccacattggaagtatgggatttgagtgtagggtttacaagtccttgggttccgcaactacaatggctggctttagtgcaatgtgtcttgacatggaaaggagtgttatacaagtaaaggatctgatgagcctgacaaaagatgtgggacgtttcaaaaaatctgaatatgggacctga

SEQ ID NO: 8191 - DNA, 1341 bp, Glycine max
  Peptide Sequence Number=SeqID_124969
atgatctatgtgaaaggaactttcaatccagcggaagatcgagtttctgaaataggccatgaagctgagacccgagattcaatacttacaatgcatacctgttttctaataaaaagtctgtcccagagggaggatcatatacgagatattgcagagaacttgttgaatcaactcagagataagtttccacaggttttatgggattcttcctgcatagattctttgctattttcatttaatggcgactcttctactgcggtcatcaatgatcctgcttggacagcaacagtccgtaccttgtatcagagaattgttcgagaatggataattaaatcagtttcaagtgctccatgcactagccagggccttcttcaggataaactttgtaaagcgaatacttggcaaagagcacagcccacaattgatgttgttttacttttatctgagataagaattggcactggaaaaaatgacaactggccaatacaaacagcaaacattcctgcagtcatggctgcagcagctgcagcttcaggagcaaacttaaaagcatcagagtcttttaatttagatgttatcagttctggtaagtgtaaccaagctgcagcgacagttaagtgcaaccatgctggagaaattgctggaatgagaaggttgtataacagcattggtggatttcagtccagtacagcacctcctggtcttggacttggagctgggcttcaaagaattatatctggagcttttcctcagcagccacaagctgaggatgactcgttcaatggaatgttgcttaataagtttgtgcgtttacttcaacagtttgtcaacatagcagagaaaggtggggaagtggtcaggtctgaatttcgtgatacttgctctcaggccactgtgctgcttttgtcacatttgagttctggatccaaatcgaacgtggagggcttctcacaacttctccgtcttctttgttggtgtcctgcttacatttccactcatgatgcaatggaaactggtgttttcatatggacatggttggtttctgctgcacctgaacttggagctcttgtccttgctgagcttgtcgatgcatggttatggacaattgataccaagcggggtctttttgcatctgaagcaaggtattctggacctgctgcaaaactcaggcctcacctgtcccctggggagcctgaattgcagcccgagattgatcctgtggagcagataattgctcatcgactatggcttggatttctcattgatcgctttgaggttaggcattggtcaccatatgatttacattttctcatttggccactttatctaaacattatatga

SEQ ID NO: 8192 - DNA, 1590 bp, Glycine max
  Peptide Sequence Number=SeqID_124970
gaagagtccgtggagttcttggagaggcaggaaatagcttttaagttgattgctcacgtgttggagaaggtccacgttgaacctgtgcttttggagcaggttaggttaattgggaagaaacagatacagtccatgtctgtgtttctgaagataaggaagagggattggcatgagcaggggtctcttttaaaagctaggattaataccaaactgtcagtgtataaagcagcggtgaacctgaaaatcaagagcctctcagcactggattctgattcgaggtctgttaagaggttggtttatgaggcagttgcgatactgatagatgctgctgaggcatgcttactctctggatggcgtaagttgagatcgtgtgaagagctcttcagttcattgcttcttggggtagcacatattgctattgcccgaggaggacagccgctgcgtattttgctcattcgcttaaagccaattgttctcaacgtttgtgctcagcctgatacatggagtaacacccatgggggcatgtttgagagtgtcatgaaggccagctgtcagataattgaatcctgctggaataaggagcgagcccctgttgacacatacataatgggattagctacaagcatacgtgaacgaaatgattatgaagaacagttatttggttgcttacggaatcctgtcttgccacaggacaaccaagagaagcctgaagttccttttgtacagcttaatgttatacgcctgtttgctgagctgagtgctgcagtcaacaagtctgagctgcttcttgacgctgtgtctcgaatggccagtttaggttttgagaaatcttaccgtgaaacagtggttttgatgactagaagttacttgaacaaactttccagtgtaggatcagctgaaagcaaaacagaggcaactgaagccacaactgagcgagttgaaactctacctgcaggatttcttgttattgctagtggtcttactagtgatagattgcgttcagattttcgtcatcgactgctctccctatgctcagatgttggtttagctgctgaggctaaaagtggaaggagtggagcagatttcctgggtcctctgctcccggcagttgctgcaatttgttccgattttgatcctactttaaatgtggagccatcacttttaaaactatttcgcaacctatggttctatgttgctctttttggcctagcgccaccgatacagaagactccagtaaatacaaagtcagtttccagtacactgaacagtgtgggaagcatgggtgcaatttccctccaagctgtaaatggaccatatatgtggaatgtggagtggtcttctgctattcaaagaatttctcaggggactcctccactagttgttagctcagtgaaatggctcgaggatgagttagaactaaatgctttgcacaacccaggcagtcgtcaaggcagtggcaatgagaaagctgcacttgcacaaagggctgctctttctgcagctttaggagggagagttgatgtcacagcaatgaccacaatctcaggtggattgcacttgctttattttagtaattctctaagtatatga

SEQ ID NO: 8193 - DNA, 361 bp, Glycine max
  Peptide Sequence Number=SeqID_124971
cgtgcgacagggacagggagatatcctcatagctaggttccctgaccctaactatggtgttaaaacgggttcctctcggtgtgggttttcaatggagaacaatgatggtttgtggtggctaatggtggctgtgggtgatggagaaagtgcttggaactttagaaatggctttggaagaaagaaagaagaagaaatgacgtttttcctaagctacacgaaaacaaagactgaaaccaaatttcgaaaacatccaacggttaacgaaggctggacagcgtttttaccgaggcagcttcatgtagctttctctagaagcttcattaagaggcttcctccagaagcttcctcatggcttctttga

SEQ ID NO: 8194 - DNA, 390 bp, Glycine max
  Peptide Sequence Number=SeqID_124972
atggagaaggagcataaagctgctcagttgaccatcttctacaatgggcaagttgttgtgtttgatgattttccagctgataaagtgcaggagatgatgtctttggcattggccaccaagggaatatcccaaagccagaactcctctgcatatgctcacactcataaccagcaaggaaataatcatccttcgactattcctaatatcatccctcaagcaccatccacaccaattgctaatgacatgccaattggtaggaaagcttcccttcatcggttccttgagaagaggaaagatagaattgctgccaaagcaccatatcaaacaaacagacctatctctgctcctaataagccggctgaatcattagatgctaaatcacacacctga

SEQ ID NO: 8195 - DNA, 455 bp, Glycine max
  Peptide Sequence Number=SeqID_124973
gacgaaattggaagaaagttctgcgagagagcggccaagaaagccctagcaatgctggagcgctgttcgcggatcgcggaaatcactacctcgccggagaaggcggcgagctcctcggcgaaatccggcgaggattgcgcggccttggagacgtagccggtgaaatcgaggaagaaagaggcgacggaatcgaggctgaaagggtggggccagaaggattgagtgaaggaatggggaacggagcggaggaactcgaggacgacggactttgggcgcagatcggcggaatcggggcagttggagaggaagcgcgagacggcgaggacggcattgagctgagagcgcgaaaccctaggagagcccgccgagaggtactccggcagagggcatttgtcgcatatccacgagagcttatcggagaattgcgagggattctgcgcaatgaggtcgcataa

SEQ ID NO: 8196 - DNA, 516 bp, Glycine max
  Peptide Sequence Number=SeqID_124974
atgccaacttggcgatgcattcaactcttcatttatttcttagcgtgggcctcacttatatgctcccctacaagctcttcacttgctgattcaatttcaagtccggtgcatgctaaacctttttctcccgtcaacaaatttctgatgcagtcctattatgacagatacatcaatttacacgatttggattttgaaaaatttatgtctcaagaagtcccttatggttcgtgtgataaccttaattttgtgttgagattgtcagatctaaagcgcactcttattggtgaagagttcagtgatatagctgtctttggtgacacaaatctggagctgccttcattcttgtccaatcgttctgctgttgaaattcacttgcttgttgatccaaatatattgcaagagccaactgatattaacatggagcttccattgcatgctcgatatcaacttgtaaccacgataattgcctcaactagatatcaagatgatgattatatgcaacatcaccgtggctaa

SEQ ID NO: 8197 - DNA, 3468 bp, Glycine max
  Peptide Sequence Number=SeqID_124975
atggattttgataaattggtaggtagtgcatccctctatgcattccttcaaattgttttggacaagctagcttcaactgaggtcgtcaatttgatccgtggagagaagaagttgcttcaaaagttgaagaccactctgataaaggtcagtgctgtgcttgatgatgctgagaagaaacagatcactgatgacagcagggtcaaggactggctcaatgatctcaaagatgctgtctataaagccgatgatttgcttgatgaactttctaccaaagctgtcactcaaaagcaggagaatcttggtctgaaagaggttgaaatggagaagaactcgtattggccagatgagaaaactataccaacaacatctctagaagcacgtcatatatacggtagggataaagacaaggaggccataataaatttgttgttggaggatactagtgatggtaaagaagtggctgtgatccttattgtgggcgtgggtggggttggaaaaactactttggcccaatcagtgtacaatgatgacaacttgtgcgactggtttgattttagagcatgggtttgtgtttctgacaaatttgatatttttaacatcacaaaatctgtgatggagaatgttactggaaagcgttgtgaaataaatgatctaaatttacttcaacttggtttgatggaaaagctggcaggtaaaagattcctaattgttttcgacgatgtctggacagaggattgttttagttggagtcttcttacatatcaacatggggctaggggaagtaaaattcttgtaacagcacgcaatgagaatatagcaactataatcgacacagttaaagtttatcgtctagaccaattgtcaaatgaagattgttggtttgtgtttgcggaacatgcatgtctttccgtagaatccaatgaggatacaacagcactagaaaaaattggctgggagattgtaaaaaagtgtaatggattgcctttggctgcgatatcacttggaggtttattgagaacaaaacatcacgtatgggaatggaatgatgtattaaataatgtcctctggggactttctgaaagtgtgtttccagcattggaaattagttatcattatctatctccacatttaaagcagtgctttgtttattgttcattgtatcctatagattatgaattttggaaagaggaattaatcttgttgtggatggctgagggccttttaaatccccaaagaaatggaaagactttagaagaaactggtgacgactattttgatgatttggtttcaagatcattttttcaaccttctacaagttggcctcaacacaaatgttttgtgatgcaccaactcatgcgtgatctggcaatatcctttggtggagaattctatttcagatcagaagaacctcgggaagaaatcaagattggtgtctacactcgtcatttgtcatttaccaaatttggtgatatagtcttggacaactttaaaacttttgacaaagtaaaatttttgagaactttcttgccgatcaattttaaagatgctccattcaacaatgaaaatgcgccatgtatcataatgtcaaagctcaagtacctgagagttttatcattttgtggcttccaaagtttaaatgctttgcctggtgcaataggtaaattgatccatttgcgttatctaaatctctcttacacatgtatagaaacactgccagagtcagtgtgtagtttgtacaatctacaaactttgaagttgtctaattgcagaaagttgactatgttgcctactggcatgcaaaatcttgtaaacttgcgtcatcttagtattcattgtacttctataaaagagatgcctagaggaatgggaaaattaaacaatttacagcatttagattcctttattgtaggccagcatcaagagaatgggataagagaattgggaggacttttaaatcttcgcggtccactttctattatccagttggaaaatgttaccaaaagtgatgaagcattaaaggctaggataatggataaaaagcacattaacagtttatccttggaatggtctgaacgtcacaacaatagtcttgacttccaaattgaagtagatgtactctccaagttacaacctcaccaagacctggttttcctatcaataagtggttacaaaggaaccagatttccagattgggtgggaaatttttcctactacaatatgacacatctaagcttatgtaactgtaatgactgttgcatgcttccttcacttgggcaactgccgtctctcaaggacctctatatttcatgtttgaattcggtgaagattattggtgcaagtttatacaaaacagaagattgttcttttgtgaaacctttttcctcccttgaatctctaaccattcataacatgccttgttgggaggcgtggatttcctttgatttggatgcttttcctctacttaaggatcttgaaataggtcgttgccccaatctaaggggaggtttgccaaatcaccttcctgctctggaatcactgacgattaaagattgcaagctgcttgtctcttctcttccaacggctcccgctctccgaagactaaagatacgtggaagcaagaaagtaaggctgcatgaaattcctattttggtggaatctttagaggtagaaggaagcccaatggtaacgtccatgatcgaggccatctctaatattaaaccaagttgtctacaatctttaacattgtcagattgttcatcagccatatcattttcaggtggtggtttacctgcatcgctgaagagtctaaatatatggggtcttaagaagttggaattcccgacgcagcacaaacatgaattgctagaatcacttgaaatatatgacagttgtgattcactgatatctcttccattgattatctttccaaatctcaaacgtttggtacttgtgaagtgtgaaaatatggaatctctcttggtttctctgtcagagtcatctaacaatctgagttattttgagattcgtgactgtcccaactttgtttcattcccaagagaaggattgcctgctcccaatttgattcgtttcacagttgaaaattgcgacaagttgaattcgttgcctgagcagatgagtactcttctcccaaagttacaatatcttcacatagacaactgctcggaaattgagtcgtttcctgaagggggtatgccacctaacttgagattagtagggattgccaattgtgagaaactactgagaggcatagcatggccatccatggacatgcttacctctctctacgtccagggtccatgttatggaatcaagtccttcccaaaggaggcatacatgaatgccctatgctgcaagagcgatgccacaagaagcacaaagaaatttggcctaaaatttcccatattcatggcattgttgttggcagtaggagttagtgaccgagcatga

SEQ ID NO: 8198 - DNA, 462 bp, Glycine max
  Peptide Sequence Number=SeqID_124976
atggagtcagttctggcaaatcattgtgagtctacacaagagcccgggagattacaaggattcattagactgatgattgctttatcagatctaaatggcagtcaagtacattcttgggatgaaactcccatcacaacaaaattgagagtttcagtttccccaagcatatgcaagggtaaggctgcgtacaacatccctcccccatacctttacatagtgaagagcctccggacaatggggtacgaagttttttatttgggtggcacgatcttcctcttgggtctctctgttgtctctctgctggttttgcattccctatcatggaagcttgaggaatatacggcagatgtgacattttcctctgcttctcattcagacactcaagtatctaaacctagcattttcataatacaccttttggtcggatgcataagagaccagctaagaacccctgactactaa

SEQ ID NO: 8199 - DNA, 813 bp, Glycine max
  Peptide Sequence Number=SeqID_124977
atggaaataaaaggaagctcaatggtggagtccatgatagaggtcatcgctaacttccaaccaacttgtctccaatctttaacattatcgacttgtgaatcagccatttcatttccgggtggtcgtttacctgcatcactgaagactctgaatatcttgggtcttagaagactagaattccagacgcaaaacaaacatgaattactaggatcagtgtcgatatggggttgtgattcgctcacatcatttccattggttacctttccgaatctcaaatgtctcacaattgaaaactgtgaaaatatggaatttcttttggtttcggtgtcagagtcgcctaaaaatctgagttcttcggagattcacaactgccccaactttgttttatttgctagtgaaggattgtctgcgcccagtttaacttgttttatagttgagaattgtagcaagttgaagtcgttgcctgatcagatgagtagtcttctcccaaagttagaacatcttggcatatacgagtgcccggatattgagtcatttccagaagaccatgtaatggcatcaaggagggaatgctgccttttcccctttcatctgagtctatttgggttttcaagtatggtgacattggactgcaagtgtcttctccatttcacatccctccaaaaattagaaattcctagttgtcaaaagctgcctgattctctaataaaactaagcatattgtcatgtcctttgctgcaaaaacgcttaatgcgccgtcatatttggcctataatttcccatatcagtggcatttatgttgacggaaaatga

SEQ ID NO: 8200 - DNA, 534 bp, Glycine max
  Peptide Sequence Number=SeqID_124978
atggtcacttgggatgaatcagacaatgagaagagtagtagttcaaacgatgaacaagccaacatttatctcatggcaaataaaaatgataaggtcgagatccaaactctagaagagagtctaagccaggctagtaagactgatgaaacttccactattgaaaaactaagggaagaagtagcatgtcttactaatgactttgggcagttcttggaaagttcaaagactctcactgacttttttgaaattctagcttgggctttcaaaagggaacaacatcctccaagtcacagtctgttccaaacaagtgtgacttttgtgattgaggaatccttaaatcataaatcacagactaaggattggaagtttgtcaaccatcatccacaagatcagatcattggagatcaaattgaaggagtcaagaccatatcatcattcaaagatcttgcttcatgtgctcttttgtctgaaatagaaccccagaccatagaagcaactctaacagatgatgactggattattgtcatggaataa

SEQ ID NO: 8201 - DNA, 906 bp, Glycine max
  Peptide Sequence Number=SeqID_124979
atggataattttttccgtgccccaggaatgaagaacgcaatggacttagaagatcatgagcatgatctaactctctcactcaggtgtggtagtccagagagaataacgatacagtcttctccaataactacccttcctcaaacaaacatctccttggtggaactacaaatgtcttaccctaattatttggtttcatcttcaaactacaacattaaccctttcttggtgtcatgttctaaccacagcattactcctaattggttggggtcatcttccaaccacaaccctaacccttaccctaactttccaagtggtggtggtgctgctaataataattatgttgtggatgtaaatgctgctcctacgtccgttttgacacgtcgctctcgtcgtggctcgtctcaacggtggagccaaggaaagagcgaaacagtgcctgcacctttcccttgggcgacggatcgtcgggccaccgtgcacaaccgcaaatatctattgcaaaacaatgttgtggccatcagcggaaggtttgaatgcaagaggtgcgagaaggagttcgaggtgacgcttgatctggaggaaaaagtgaacgagttgcggaaattcattgagaaagaaagtgggtccatgcatgatagggccccagcggcttgggtgaatccggtgttgtccaagtgtgtgcattgcggaaaagaaaatagcgccaaacccatccttggggataagaaaagggcaattaattggttgttcttgttgctgggacaaattctgggtttctgcaaccttggtcaactcaaatatttctgcaagcacaccaacaaccatcgaactggtgccaaagatcgccttctttatcttgcctacatgaccatcagcaaacagcttgttcccgagtggttcgattag

SEQ ID NO: 8202 - DNA, 108 bp, Glycine max
  Peptide Sequence Number=SeqID_124980
atggaagatgctaagcttatgaaaactctaatgcatgcttccaatcctccgagcaaagacaaatcagatttcattctgatcctcgagaatcacatcttaaggatgtaa

SEQ ID NO: 8203 - DNA, 396 bp, Glycine max
  Peptide Sequence Number=SeqID_124981
atggctagagagcctactactggaaatgttgaagagatggaagaagatgatgaagctaaagctcaacacgagcctgcacctcaatggactcctttttattttcttggccatagtgttcacttttttcaagtttatttcaagaaaagtttctactctaaagcctttccatatgcactcaatggttttgggaaaaacactttaattgataaaaataggaatctaatcgattacttctttgagataatcgattacattgtgtcgcaacgtgcccttcgcgggcgagcgagggcgaggctcacgggtgcgctttccaaaggaggaaagatgcgcggagtcgccaccaacgtttatttgtgggaaacgtcggaaaaaccgaaggaaaccggtcaaaaatga

SEQ ID NO: 8204 - DNA, 1182 bp, Glycine max
  Peptide Sequence Number=SeqID_124982
atgaacacgagagatcatcagatgccgaaaaaatttaaggctctcctcaaccaaaactttgagatccaatctgaaaagattctcaaaaccaaggaacaaattcttgaaggttctaaacatgattgcgaaaaatctctcgttaagaatactcacaccaccatattagaagattttgaaccaatatcaagtgttccaatttacagaaatgatgacatttatgctaaggaagaaaataaagttgtaaaaaactttgaaccaagacctaatgtttcagcttatggtgacaatgatgttgatgctaagccaaagaaaaatgtcatcaaagactttgaaccaagacccaatgtttcagcttatggtgacaatgatgttgatgctaagccaaagaaaaatgtcatgaaagactttgaaccaagacccaatgtttcagcttatggtgacaatgatgttgatgttaagccaaagaaaaatgtcatgaaagattttgaaccaagacccaatgtttcagcttatggtggcaatgatgttgatgctaagccaaagaaaaatgtcatgaaagattttgaaccaagacccaatgtttcagcttatggtggcaatgatgttgatgctaagccaaagaaaagtgtcacgaaagattttgatccaagacccaatgtttcatcttacaatgacaatgacattgaagcagtggaagaaaagaaaatcatgaaagattttgagccaatacctaaagtttcaacttatggtgatgatgatgttaatacaaaggaaaagaaaaaagtcatgaaagattttaaaccaagacctaacgtttcagcttatggtgacaataatgttagtgcaaaagaaaagaaaaaagtcatgaaagattttgaaccaagacctaacgtttcagcttatggtgacaataatgttggtgcagagaaaaagaaaaaaatcatgaaagattttgaaccaagacctaatgtttcagcttatggtggcaacaatgttgatgaagaggcaaaaaagaaagtcacaaaagattttgaatcaagacctaacatttcagcttatggtaacaatggtgttgatgcaaagaaaaaaaagaaagttgtggacaatgacaacattgatgctcagggaaagcctccagaggattttgagcctaggccaaatatctctacttatgatgaatag

SEQ ID NO: 8205 - DNA, 273 bp, Glycine max
  Peptide Sequence Number=SeqID_124983
atgaagactagagtgtgtgagttgaaaaagctcggtctaactcattcattcaaatgcatgaaagtgagaacacaagcacccccaaggaagaaagagtctattggtatccctaccatcaacaacgttggagatgtaactcaagctttccctgagggctggtttatccctgcaaaatggataaacttccaaagcctgaaggaagaaggctttgacgtgaagggactctttgacagatttggttggacatcttttctagagaagttcagtacctga

SEQ ID NO: 8206 - DNA, 189 bp, Glycine max
  Peptide Sequence Number=SeqID_124984
atgaagaagattgaacttcaaaagttaaatctggtcaagctatggaaaatagaccaacaacaacttcttggtctgatggctaccttcaacatagttcttccttggaattgtgctaagtttggggaatccttctacatagaagacatctaccttgaagatcctaagatgagtccaaccttctcagattga

SEQ ID NO: 8207 - DNA, 213 bp, Glycine max
  Peptide Sequence Number=SeqID_124985
atggcgccatatgtaactcaattaggtctagttattatgaatgtcagcatattggatcttctggtggtcttgaatttaggatctcttcaaaacactcacgaggacaggatcagctgtttaggtttgtcagctgatggaagtgccttgtgtacaggaagttgggatacaaacataaagatatgggcatttggagggtataggagggtggtttga

SEQ ID NO: 8208 - DNA, 819 bp, Glycine max
  Peptide Sequence Number=SeqID_124986
acaactttggcacaacctgaggctactcgagtcactgcccaagccgcccaagcaacaattcctcttgagtttcaaggtctagcaaaatttaggaagaatgatccctcacaattcagtggagactctaatctggatatagttgatcactggattcgagagttagagaagatctttagggccatcgcacgtcctgagaatataaaaccactattgaagcttggaagtgcagaaaatttgaagtttgaggtgaaaaagatggtggtccttatggttgttaaggaatttccagcattggtagaaaaggctaaaattgtggagtgcttggaaggcaatagtagggtgatcataacccatggggctcaaggcattaaatgctttaggtgtggtggtccacacttaatgacttattgtcctcagaaggagatgtgcaccgagcctgagaagcctaaggtggctggaagggtctttgttatgagtggagtagaagcctccaagtttgatgatcttgtccaaggtttgtctgcatgtcctctatcttttgatttgcttgtctctactcctatagccacttctgtggtagcttccctagtgtgtgttagatgtcctattatggttaatggacatagttacaagggtgatattgacttcaagttgatagacattattagagaatttatggaggtttttcctgaagaagtacctggcttgcccccacaaagagagatcaagttcacaattaacatggtcctaggtgttggaccagtgtccataactcccaataagattgcaccacttgaattagttgagttgaataaatag

SEQ ID NO: 8209 - DNA, 2598 bp, Glycine max
  Peptide Sequence Number=SeqID_124987
atggctcagccgcttgtgaagaaagacgatgaccgcgacgacgaagctgagtattccccctttctgggacttgaaaaggggtctgttcttcaggaggccagggtttttaatgaccctcaactagatgctaggagatgttcacaggttattacaaaactcctatacctacttaatcagggagagacgtttacaaaggttgaagccacagaagttttctttgctgtgactaagcttttccagtctaaagatatgggattaaggagaatggtctacctgatgataaaggagatctctccctctgctgacgaggttatcatcgtcacaagctctctcatgaaggacatgaacagcaagattgatatgtaccgagcaaatgccattcgagtgctgtgtcgtatcactgacggaaccctcctttcacaaattgagaggtatttaaaacaagccattgtagataaaaatccagttgttgcaagtgctgctctagttagtggcattcatctactccagacgaatcctgaaattgtaaaaagatggagcaatgaagttcaggaagctgttcaatcaagagcagcccttgtacaatttcatgcactgggtttgctacatcagatacgacagaacgatcggctagcagttagcaagctggttaccagcttgacaaggggaactgttcgctcacctttagcacagtgccttttgatccgttacacaagtcaggttattcatgaatcaggcaatacacagtcaggggaacgccccttctatgattatcttgagagttgccttcgccacaagtcagacatggtgatttttgaagctgccagggcaataacagagctcaatggcgtaacaagccgagaattaactccagcaattactgttcttcagcttttcttaagttcgactaagccagtcttgagatttgctgctgtccgcaccttgaacaaggtggcaatgacgcatccaatggcagtcaccaactgcaacattgatatggaaagtttaatctctgaccagaacagaagcattgctacccttgctattactacacttttgaaaacaggaaatgaatctagtgtggatcgtcttatgaagcagatcacaaatttcatgtctgatattgctgatgagttcaaaattgttgttgttgaagcaataagatcattgtgcctgaagtttcctttaaaatatcgatctctgatgaacttcctgagtaatattcttagggaagaagggggttttgattacaagaaggcaattgtagattcaattgtgattctcattagagatatccctgatgcaaaggaagtggggttgcttcatctttgtgagttcattgaagattgtgagttcacttatttgtccacgcagatacttcacttcctgggaatcgaaggaccaaaaacatcagacccgagcaaatatattcgttacatttataatagagtacatcttgagaatgcaattgttagggccagtgctgtgagcacactggcaaaatttggtgctgctgttgatgtgttaaaggtccgtgatagggctacactttacctggacacacttggaggtgatggttcagttgttgagactgataaagatgtaaaggacttcctgtttgggccatttgatatcccacttgtcaatctggagactagtttgaaaaactatgaaccttcagaagaaggttttgacattaactctgtgcccaaggaggtcaagtcccagccacttgcagaaaagaaagcccctggtaaaaagccaactggtttgggtgctcccccatcaactgcagatgcatatgagaggatgctttcgaccatttcagagtgtgcaaactttgggaagcttttcaagtcctcagcacccgtggagctcactgaagctgagacagaatatgctgttaatgtcattaaacacatttttgataggcatgttgtgttccagtacaactgcacaaacacgataccagagcaattgttggaacatgttattgtgactgtggatgcttcagatgctgatgaattctcagaggtgttctccaagcctctcaggtctcttccttatgattcacctggacagacttttgtggcatttgagaagccagagggagtgccaacagttggaaaattttctaacattctgaaatttattgtcaaagaggttgacccaaccactggtgaggctgaagatgatggtgtcgaagatgaataccagctggaggatctggagattgttgcagcagattacgtgttgaaagtgggggtgtctaattttaggaatgcatgggaaagcttaggccctgattttgagcgagtggatgagtatggtcttggtcctagagagagcttggctgaagctgtaaacactgttatcaacctacttggcttggagccttgtgagggcacagaggaggttccacccaattcaagatcacacacatgcttattgtcaggtgtattcatagggaatgtgaaggtgcttgtacggctgtcttttggacttgatggtccaaaggatgttgcaatgaaactgtctgtcagatcagaggatgaaacagtcagcgatgccattcatgagattgtggcaagcggctag

SEQ ID NO: 8210 - DNA, 231 bp, Glycine max
  Peptide Sequence Number=SeqID_124988
atgaatctctctcaggtgcttgcacaacagatccaacaaactgcaacaatcttgcttggaactattgcaaatcagctcttccaaccagcacctatccaacttgctcctgcacaatttgctcatgcgcaacttgctcatgttcaacatgttcctactcagcatgcactgattgaacaagttgatgatgttgaaccagcaccactacaacaacctccactaccacaagagtga

SEQ ID NO: 8211 - DNA, 1320 bp, Glycine max
  Peptide Sequence Number=SeqID_124989
atggcgccacccgccacctccaccggcggtacgctgccggagctaactaaccgaaccccctttctcggcctcaaactctacgtcctactcctaattgcagttctaatcgtgatcgcaacggtgatcctgatcctcgtgtgcgttcgccggagccggagctcgaagaagcggaaaatgcgagtgaagcacagctccggcgcgatccctctggtgtcgaaggagatcgtggaggtgaatactctggagctgaaaatcgatgaggaggtggagattgagattgaagagagtgcgtcggcggagtcgccgaacatagggtggggacgatggtatagtctcaaggagcttgagaatgcgactgaagggtttgcggaagtgaatgtgatcggagaaggaggctatgggattgtctacaaaggaattctcatggatggatctgtcgtcgctgtcaaaaatcttctcaacaacaagggccaggcagagaaagagtttaaagtggaggttgaagccattggaaaagtgaaacataagaatttggtggggttagttggatattgcgcagaaggtgctcaaaggatgcttgtttatgaatatgttgacaatggaacattggaacagtggcttcatggtgatgtaggacctgttagccccttgccatgggatataagaatgaagattgctgttgggactgcaaaagggctagcctacttgcacgaaggattagaacccaaagtggtccaccgagatgtaaaatccagtaacattcttttggacaaaaagtggaatgctaaagtatcagactttggactagccaagctcttagggtctgagaaaagctacgtgacaacccgtgtaatggggacatttggatatgtttcacctgagtatgcaagcactggtatgcttaatgagggaagcgatgtgtatagttttgggattctactgatggagctaattacaggaaggagtcccattgattattctagaccacctggagagatgaacttggttgattggtttaaggtaatggttgcaagtcgtcgaggcgatgagctagttgatcctttaattgatattcagccctatccaagatctttgaagcgagctttactggtttgtcttcgctgtatagacttggatgtcaataagcgaccgaagatgggtcaaattgttcatatgcttgaggctgatgattttcccttccgttctgagcatagaacaaatcgagagaaagatcctgttcattctaaagcagctgtttccagtaagattctatacccaacaaggcatgtggagcccgcagataaatcaagctggagatga

SEQ ID NO: 8212 - DNA, 2697 bp, Glycine max
  Peptide Sequence Number=SeqID_124990
atgggcatagtgtggcttgggttgttgttgctggtgctgagtcaggtgacattggagcagaatgagccactgagttccgtcgaggagcgagaatcgttgctcgaactaaggggttctctggggttgaggagcaaggagtggccaagaaagccagacccatgtttaatctgggttggcatcacgtgccagaatggtcgtgtcgttgggatcaatatctctggcttcagaagaaccagacttgggaggaggaacccgcaatttgcagtggatgctttggccaatttcaccctcttgcggtccttcaatgcctccaatttcccccttcctggctctattcctgattggtttggtctctctctcccttcactcactgtgcttgatcttcgttcttgctccattgttgatgctattccctccactcttggcaatttaaccaacctcactagtctctatctctctgacaacaacctcattgggaatgttcctgggactttgggtcaactcttggccctttcggttcttgatctttccaggaattctcttactggctccataccagcctctttcgcctttcttgggaatctttcctcccttgacatgtctgctaattttttgtcgggggcgattcccaccggcatagggactctttccaggctgcagtacttgaatctttccaacaatggcctttcttctttgcctgccgaattggggggccttgctagcttagttgaccttgatcttagtgagaattctttcgttggtggtggattgcctcctgatttcacccgattgaggaacttgaggaggatgatacttgccaacagcatgctcactggagctctgccggggagattgtttagtgattcgttgcagttcctagtgctgaggcaaaacaactttagtggttctctgcctgttgagttgtggtctctgccaagattgagcttcctcgatgtctctgccaataacttcagtggtctgcttcctaattcgacttctgctgctaataatgctactgctgcggtgctcaatatttcgcataataagttttatggaggcctcactcctgcactcagaaggtttggtttcgttgatctttcccgcaattattttgaaggcaagattctggattacatgcttaatgtatctctagatatcaactgcctccagaaagcgacaaatcagaggtcaacgatggaatgtgcatcattttatgcggagagggggctcagttttgataattttggacagccaaatacgacaaaacctcccacagccgaaagctctgggaagagcaataaaactaagattatattggcagcagtctttggtggagtgggtttaattgcacttttggtgctgctactggttctgttgcttctgtgtgctcgtaagaggggtaattcaaatcagagagggaatggtgtgggtcctgctcctgttggcagcagtcctccaaatcccggtgtactggtcgactttccaaatgtcggagactcatttacctatcatcagttgctccaggcaacaggagatttcaatgatgcaaatcttatcaaacatggccacactggggatttcttcaatggtgttttggaaagtgggattcctgtcgtcatcaaaaggattgacatgcgttcaactaaaaaggaggcttacctgtcggaattggacttctttaataaggtttctcatcaaagatttgttcctttgttaggtcattgcttagaaaatgagaatgagaagttcctggtttataaacgcatgacaaatggggacttgtctaattgcttgtactacaaaaacacatctgaagatggtactttgcaatcattagactggataactaggttaaaaattgctactggagcagcagaggcactatcatatctacatcatgaatgtgttccgccgattgttcacagagatattcaagcaagcagtatacttctagacgataaatatgaagttcggttagggagcctaagtgaatcctgtgctcaagaaggtgatattcatcaaagtaaaatcacccggtttctgcggttgcctcagtcttctgaacaaggcacatctggttcatcaacatcaatttgtgtctatgacgtttattgttttggaaaagttttacttgagctggtgacgggtaagctgggaatgagtgcagccagtgacaccgaagtaaaggagtggtttgatcagattctaccttgcattagtatgtacgataaggagcttgtgacaaaaattgttgatccgtcaatggttgttgatgaggatttcttagaggaagtatgggctatatccattgttgccaggtcttgcctaaatcccaaaccttcaagaagacccccaatgagatatgttctcaaggctttggaaaaccctttaaaagttgtaagggaagaaaattccagttctgcacggcttagagcaacctcttctagaggctcttggaatgctactttgtttggtagttggcgtcagagttcttcggatgtaacacttactccagcagcctctggtacaaaactagaaagagctagtagtttaaagctgtcaggaactactggctcgcagtcacagggtagtttccacaatggaggtgagattttgtcatcgcggagacgacattcaaaggagatattgccagagccatctggcgtgcatgatgtagagaggttggagcttgaatag

SEQ ID NO: 8213 - DNA, 2153 bp, Glycine max
  Peptide Sequence Number=SeqID_124991
atggctattactacaccttccaattcttcaattctcctctccctttctctattgctcatctccctctccctcgctgagtcgcaatctttcatcggagtaaactacggccaggtcgccgacaaccttccggcgccggaggacacggccaacctcctcaaatccacaaccatcggaaaagtccgtctctacggtgccgatcccgccatcatcaaggccctcgccaattccggcatcggaatcgtcatcggcgccgccaacggcgacattccgagtctcgccgccgatcccaacgcggccactcagtgggtgaacgcgaacgtcttgccctactacccggcgagcaacatcactctcatcaccgtcggaaacgagattttgaccttagccgaccagggtctactgtctcagctcgtcccggcgatgcgaaatgtccaaaatgccctcggcgcggcctcgctcggtggcaagatcagggtctcgacggtgcactcgatggccgtgttgactcagtcggacccgccgtcgtccgggttgttcaacccggcgctgcaagacacgctgaaacagctgctggcgcttctgaaggacaacaaatcgccgttcacgatcaacccgtacccgttcttcgcttaccagagcgacccaagatccgagacgctggcgttttgcctcttccagcccaactcgggccgggtcgactcaggcaacgggaagctttacacgaacatgttcgatgctcaggttgatgctgtacattctgctttgagtgccatggggttccaggacgtggagattgtggttgctgagactggatggccctcacgtggcgacagtaacgaagtgggaccaagtgttgaaaatgcaaaggcctataacgggaacctgattgctcatcttagatcattggttgggacacctttgatgcctgggaagtctgtggacacttacatttttgcactctatgatgaggatctaaaaccaggcccaggatctgaacgtgcatttggtatgttcaaaactgatcgcaccgtgttgtacgatgttggattaaccaagtctagccagcagactccaacaactccggtaactccagcaccaaacactgctggatggtgtgtagcgaaagctggagtttctgatgctcagttgcaggccaacattgactacgcctgtagccaaggtatagattgcgggccaattcagccaggaggctcttgttttgagcctaacacaatagcatcccatgctgcatttgccatgaatctctactatcaaacttctggcaaaaatcaatggaactgtgatttctctcaatcagcaacactcacatcccaaaatccaaagattttagaagctaaaactcaaagggagcttgatgatattgattgctttgcagtattttcaattatatcggccaccaactattcaatgatccgttgtcgtccagcggttaggatatctggctttcacccaggagacccggatgcatacggaaagctcatgatccagattctgcaggctaggacagactacgttgtggttatgaaggagcgtcacttggcggcgacggaaaccatcaacagtttgagggagcgcttgaaggagaggcgtctatcattgctcgatacagatattgctggttacgcgaggtctcaaggtagagcccctgtcacctttggtcccaccgatctcgtttgttgtagagcgctccagggtcatacgggaaaggtgtactcattggattggacttcagaaaagaatcgaattgttagtgcatcccaagatgggcgattaatagtgtggaatgctctaacaagccagaaaactcatgccataaagcttccctgtgcgtgggtcatgacctgtgctttctccccaactggtcaatccgttgcatgtgggggccttgacagtgtttgctccatttttaatcttaattcccccgccgacagggatgggaatctagccgtttcacagatgcttagtggacataaaggttatgtttcctcttgtcagtatgttccagacgaagatactcacttggttactggttctggtgatcagacatgtgttttatgggatattactactggctttagaacatctgtttttggtggtgaatttcagtctggacatactgcagatgttcttag

SEQ ID NO: 8214 - DNA, 502 bp, Glycine max
  Peptide Sequence Number=SeqID_124992
atgacagatcttgtgagcgcggaagatgacggcgcagaagacgacattagtcaatgcgtgctatcaggcttttcatcttacagacagcaaaaagtttatatggataaccactcgggtatttacgcccctcagcgtgactcaaaagtcagtatgacagatcttgtgagcgcggaagatgaccaacaaaaagtttatacggataaccactcaggtatttccgcccgtcagcgtgactcaaaagtcagtatgacagatcttgtgagcgcggaagattacaagacgacgttagtctcctgtgctatgaggctattcggcttacagcaaccaaaagtttatacggataaccactcgggtatttccgcccgtcagcgtgactcaaaagtcactatgacaaatcttgtgagcgcgaaagatgacggcggagaagacgacattagtcaatgcgtgctatcaggcttttcatcttacagactgaaaaaagtttatacggataaccactcgg

SEQ ID NO: 8215 - DNA, 1899 bp, Glycine max
  Peptide Sequence Number=SeqID_124993
atgccaacagagattgcaatgaacaacagaaggtatgaagtgtttatgagcttcagaggagaagatactcgtgctactttcacttcacatctctatgccgctcttcaaaatgccggaatcattgttttcaaggatgacgagtcacttccaaggggagatcagatctcagactcactcctgctagcaatcgaacaatctcaaatttctgttgttgttttctcaacaaattacgcagattcgcggtggtgtctgcaagagttagagaaaataatgaattgtaaaagaactatagggcaggtggttctgccagtgttctatgatgtcgatccctctcaagtacgctatcaaactggccactttggagaatcatttcaaaacctttccaacaggattttaaaagatgatgacgagaaagcggtcggagagggcgaatctgataaggaatatatgatgagcagggttttgatcagtcgttggaggaaggtacttcgtgaggctgctagcatcgcaggggttgtagttctaaattccaggaatgaaagtgagactataaaaaacattgttgaaaatgttacacgtttgttggacaagatagagttgcctcttgtcgataatcccgtgggagtagaatctcgagtgcaagacatgattgagcgactagacctaaaccacaaacaatcaaattcaaatgatgttttgctattaggaatatggggaatgggaggcattggtaaaacaaccattgcaaaagccatttacaataagattggtcgcaattttgagggaaggagctttcttgaacaaattggggaactttggaggcaagacgcaattcgtttccaagaacaacttctatttgatatctacaaaacgaaaagaaagatacataatgttgaattaggaaaacaagctttgaaggaaagactttgcagtaaaagggtatttcttgtacttgatgatgtgaatgatgtggagcaattgagtgctttatgtggaagtcgcgaatggtttggttcagggagtagaataatcatcacaactagagataagcatattcttagaggggatagagttgacaaaatgtacacaatgaaagaaatggatgaaagtgagtctattgagctttttagttggcatgcattcaagcaagcaagtccaagagaaggttttactgaactttcaaatgatgtaattgaatattctgggggtttgccattagctcttacagtccttggttgccatttgtttgatatgaagataatagaatggaagactgtattagacaaacttaagagaattcctcatgatcaagtacaaaagaagttaaaaataagctatgatggtttaagtgatgatacagagagagacatattccttgatatagcttgtttctttattggaatggatcggaatgatgctatgtgtatcttaaatggttgtggacttttcgcagaaaatggaatacgtgttcttgtagagcgaagtcttgtaactgttgatgataagaacaagcttggaatgcatgatttgctacgagacatgggaagagaaatcattcgtgcaaaatcaccaaaggatcttgaggagcgtagcaggttatggtttaatgaggatgtgcttgatggaacgaaaaccattgagggtctggctttgaagttaccattaaccaattcaaattgttttagcactgaagcatttaaggagatgaagaaactcagattgcttcaacttgccggcgtacaacttgatggagattttgaatatctttccaaagatcttagatggctttgttggaatggatttcctttaaaatgcatacccaaaaactttcatcaaggaagtctagtttccattgagttagaaaatagtaatgttaaacttgtgtggaaagaggcccag

SEQ ID NO: 8216 - DNA, 444 bp, Glycine max
  Peptide Sequence Number=SeqID_124994
atggctctagttgttaaagtgcttcactttgtggatgatgaaaagaaatggccatggcttttcaccatccacaaacttattgggtggcaaatgtatgcatcccaagctccatatttgcaaaggctagctatcaaaattttgagccagacctgcagtgcttcaggatgtgaaacaaattggagtgtatttgagcaaaaaagaaaggaaccagcaagtgatggtgttactcttagtgctgcccaaacatctaaaaacacaggcagtggccacatcttcaaaaagaaacaagtagcagtccaaaaaaatgacaaggatgtggaatccaaagaagaagaggtcatgattacttttgaggagtccgatgaagaagagggagagggatatgcgtcattacttgatgataacaacgaagagcattatgtcagagttgaggaagaggattag

SEQ ID NO: 8217 - DNA, 141 bp, Glycine max
  Peptide Sequence Number=SeqID_124995
atgatcaaacctgcagctgtggttatggggacccgaggcagaagcttgattcaaagggaagtattgctttcaccactgttgttattgttccaggaaaagatgatggagatgcgtcaatcgtctagtggaattgtgttgtaa

SEQ ID NO: 8218 - DNA, 147 bp, Glycine max
  Peptide Sequence Number=SeqID_124996
atggaagagtacagtggaaatgattctcttggtcggcgaattgaagttgtcatcggtaggaggcggaggaggaactatacttgtataaagaaaggctgggacagtgacttgaagcatgataaaggtggagagaggcccattaagtga

SEQ ID NO: 8219 - DNA, 960 bp, Glycine max
  Peptide Sequence Number=SeqID_124997
atggcaggggacagcaagagcaagattctgttcatcggaggaactggttacatcggaaaattcatcgtggaagccagcgccaaagctggccacccaactttcgttttggtgagggagtcctctctctccaaccccgcaaaatcatccctcatcctcggtgtcaattttgttttcggagatctatacgatcaccaaagtttggtgagtgccataaagcaggtcgatgtagtcatttctactttaggacacttgcagctagctgatcaagacaagatcatttctgcaattaaggaaatgttaggaactgatgtaaattcacaaacagcgtcaaaagatacctccttttcatgtaagttctatccatctgagtttggaaatgatgtggaccggactcatgcagtggaaccagccaaatctgcatttgcaacaaaggccaatgttcgcagagctattgaggctcaagaaattcccttcacttatgtgtcaagcaacttctttgctggttacttcctacccaacttgtcgcagcctggagctacagctgcccccagagacagagttattatcctaggagatggaaatcccaaagctgtttttaacaaggaagaggatattggaacttatacaatcaattctgtggatgatccaagaaccttgaacaaaattctctacattagaccaccagctaataccttgtcatttaacgagcttgttactctctgggagggaaagattggtaaaacacttgaaagaatttatgttccagaggaacaactcctgaagcaaattgaagagtccgcaccacccgtgaatgtgatcctgtcaattaatcactcttcttatgtaaagggggatcagactaactttgaaattgagtcttcatttggagtggaggcttcagctctatatcctgatgtgaaatacaccactgtggatgagtaccttaatcagttcgtctaa

SEQ ID NO: 8220 - DNA, 431 bp, Glycine max
  Peptide Sequence Number=SeqID_124998
atggacgagatttcttcgagacaaccgggtgaatatgtaataggagagaaggacggcaacatcttgcgggttgctaaagttgacataatcataaccgagcgatctcctactggtcaagtccctgcaaaccctaacggatacgacttgtcccaattggttgaccaaatcatacagctgggcgtccatgacgtttgggtcgagatctctgacataaagcgacgtcatgacgaactgatttccagcaacatcaccaccgttgggagaaaagcaaggagagggaagcgagatggatgcgcggcggatagggagtggccaccggtggaaaccacgatggcgcgtgaaagagaagggaaattgagagagagtagtggaaataagagaggactcttctctcctattacatattcatctggttgccctgaagaaatctt

SEQ ID NO: 8221 - DNA, 279 bp, Glycine max
  Peptide Sequence Number=SeqID_124999
atggtgctgccatatgaagcctgcaatgccactgccatacaatggtattctttcactaaggctctctgcatagcgtttgtgatgacctttttttccatgtttgatgttcctgtcttttggcctatattactctgttactgggttgttctctttgtccttacaatgaggcgtcaagttgcacacatgatgaaatacaaatatatccccttcaacttggggaagcagaagtatagtggtaagaaatcttctgcaagtagcagtggctctcgtgcagactga

SEQ ID NO: 8222 - DNA, 144 bp, Glycine max
  Peptide Sequence Number=SeqID_125000
atgcatgtcaaaaagttcaattgcccagaatgggagcaggttccagttcctacaagtgtaagagcaatagttgctctaaaccttcatagttatggaagtggaagaaatccatggggtaatttaacacctgagtatttagagaag

SEQ ID NO: 8223 - DNA, 300 bp, Glycine max
  Peptide Sequence Number=SeqID_125001
atgtttagaagcagcataaatagaagcaatagccttgcaatcaacgagttcccccgaagatggttccattggagagtgttccagcaggagaagggaagaagaaaccggtgcggtggagataacgaatggcttgaaggatatctgaatgtcgagcagatctcaaacttcgtcgatcgtccagccttctccgccaactacggttgttgggctccacgaaccttggcagcagccagcagcttcatcggatatggatttggagcttctgcgcttcaaaacgacgtcgtcatcgaagtgtcgtag

SEQ ID NO: 8224 - DNA, 1296 bp, Glycine max
  Peptide Sequence Number=SeqID_125002
atgcaatctcggaaaattgcggacgtgttgaacgtctcggatggtggtcgtgggttagaaaacaaggaaaagaacctcagttcaaacctccacaatgatcatgataaccaaaaccaacacgtgcagattgattctggctctgccctccaacaatttcttgatcacatacccattagtgcaatagctggcataaaaaattcacctgctggagacagtataagggatgcaattcatgcgttgtacaaaaaggatatattttctgcagcaattgtggatacgtcagactcccatgcgggcagcataaggttttcagatcgttatattggtctcattgattttacaagcatggttctttggtgccttgaggaatttgataagataaaaaatgataccatggaaaatcatctcatggatttagagaacgatggccttttctccatcctggatcaggttcctcagattgggctaaccaaggttagcgagttggccaagtcattcctctgggaaccatttttcccagtaaacatggatgacacggttttgcatgctttgctacttctctctaagcatcgggtgcacgttttgccggtcatacaggaacctcaagctggactcatcggttatgttacacagaatgcagtagtccagcaccttcttcaatcaagtgaactagagtggtttgatagcattgcagataagaacatatcagatttccgatttgaaagccaagaaaatcctagttgtgtatatggggaccaaactgttgcaaatgctttagatttgctctggcaaaaccaaacttgtgcagttgctgttgtagatcgacaaactaagaagctcgtgggtaatgtaaggaacggcgacgtttataatcttgtaaagaataatgacctcctaagaaatagatcgattttaactgtgaaagaattcattcacatagagactgacaaagtagtaactgaacaagccattgaacatgaccatggggctttactcacagcaggaagtctccgtctgaaaaacagcttcatacccagaatggacttgcccgttgccaacaaggaaactgaaacgctcaagcaaataatggagcatacgactgagactaatagcagtttcagctttctgatcaatgataatgagcaagttacagggttgctcacactaagagatataattctgcagtttgcaccaccaaatatgaattctagcattaatggaggtgggtttttcgaatttgccttggagcaaagtggatgtcaggtgaaaaatggaactatggttcgtaatcattga

SEQ ID NO: 8225 - DNA, 189 bp, Glycine max
  Peptide Sequence Number=SeqID_125003
atggaagctgacctggtggcagagcggatggatctgcaatacaacaaaaggtgggttctctgtccgtcaaccctttctctgtctcatgtaattgttaagagctggaatggaactatggaagtggaagccatctactgctctgaggacgccaataaaattgagaacaaatgctttagacaagcccaatag

SEQ ID NO: 8226 - DNA, 510 bp, Glycine max
  Peptide Sequence Number=SeqID_125004
atggaatttataattagagctgcttttctacccgcagacacaagatccactttcaacgttcaatccaatcacctgcaagtcatagataaggtatctcatctacgcaagatatcatattcattaacagcttgcccaatgcaccccaccccattttatcacaaatcgaggagcattgcacaggttgaaggtactgaagccaccacttcttcatcatcttcaataagtcacagactcaatgacttgcaggatttgcaagaaaacactgataagttgcttcagttgagaatcttccaacaagcattggcacaagaatgcagcaacaaacagattgatgaactattaggcactgttaaagattgtctgctgcaatcaaaggataacatgcgcgaacttgtgtcagttattcgcaggaagagagatgctgaaactggattcacaaatgagggtggaaaatacttggcatgtaggaagaacattaaaaggcaattgcgaaagcctttagagacttaa

SEQ ID NO: 8227 - DNA, 324 bp, Glycine max
  Peptide Sequence Number=SeqID_125005
atgtttaagagtgctttgcatgagggtgatgacaatggtgatgttggtagtgttagtagcgacaacggtagagatactagtgatggttgtgatgacagtggcgtggtgatgatagcgatgtcaatggtgtcaatggtgatggtggtggtggtgataacgacgttgatggtagttgtggcaaaaatgttgttattagtggtggcgatgacaggtggtattggtggtggtagcgatgatggtaatgatggtggtggtggtgatagtagtaatgttagtggtgatggtagtggctgtgatgacggcgacgacgacaatgacaactag

SEQ ID NO: 8228 - DNA, 342 bp, Glycine max
  Peptide Sequence Number=SeqID_125006
atggatcttcatggacaatcaattcacttactgaagcatatgtctcaaagcatcactgttacagttgctaaagagatccatgctttgaaaagcatagctgcatattacggtggtttagaaatcaatttaaatgtgactaaaacggatgctgaggagaatctgaaagaggtgttaacaaatggtgcgaagaattctcgcgaagttgttttctctgttctgcatgatgcatgcactgatggtgagctctcaattcctgaggctgtggaagctgcaaaagacatccttgcacgaaatgcaatccgcttctataagattagttcaaccaacatcactgccccttag

SEQ ID NO: 8229 - DNA, 603 bp, Glycine max
  Peptide Sequence Number=SeqID_125007
atggcaccagtagaaagaaacataaaaagctctcggcacagtcgcagtaacagcttgcacagtgcaccacaccccattttatcacaagttgaggagcatttgcacagattaaaggattctgaagccaccacttcattgtcatcagcatcatcatcttcaataagtcacagactcaatgacttgaaggatttgcaagaaagtgctgataagttgctccaattgacaatctcccaacaagcattggcgcaagaatgcagcagcaaacagattgatgaactattagatgggtctctgaggctcttggatatttctagtacagttaaagattgtctgctgcaatcaaaggaaagcatgcgtaaactcgtgtcagatattcgcaggaggagagatgctgaaactggattcacaattgagggtggaaaatacctgacatgcaggaagaagatgaaaagggcaattgcgaaggccttgagagacttgaaagaaatacaaaatgagttcaaagtttcttcctcaaacaaagacaaggagactttttccatgctcaacatcttaaaagaagcagaaagggtcactatgagctcattagaatctgtgtgttag
